United States Patent 8,952,217 (PROCESS FOR DECREASING VERBASCOSE IN A PLANT BY EXPRESSION OF A CHLOROPLAST-TARGETED FIMD PROTEIN) - sequence listing, part 2

SEQ ID NO: 341 - DNA, 1692 bp, Candida glabrata
  CDS (1)..(1692)
atgaattctcaaccggatttgataagtccacaaaaatcctcttcttcaaatgaggtggattctcatgaatccaaatatctaaaccaagtcggcaagaatgatatggctgacgaatttgttcagaacgaaatgattgccaacccaaacactggtaaaggtgcttttgtcggtgtcattatcagttgtttcatggtcgcttttggtggttttgtctttggatgggataccggtactatttctggttttgtcgcacaaaaggatttcattcacagatttggtatgaagcatcctgacggaactgaatacttatccaaggtcagaactggtttaattgtctctatcttcaatattggttgtgccatcggtggtattattctatctaagcttggtgacactaaaggtcgtaagatgggtttggttgttgtcgttgttatttacatcgttggtatcatcatccaaatcgcttccattaacaagtggtaccaatacttcatcggtagaattatctctggtttgggtgttggtggtatctctgttctatctccaatgttgatttctgaagtcgctccaagtgatctaagaggttctctagtttcttgctaccaattgatgatcacattgggtattttcttgggttactgtactaacttcggtaccaagaactacactaactctgtccaatggagagttccattgggtctatgtttcgcctgggctcttttcatgatcggtggtatgaccttcgttccagaatccccacgttatttggttgaagctggtcaaattgaagaagccagatcatccttggccagaatcaacaaatgttccccagatcacccatacatccaacaagaactagacttaattcaagctagtgttgatgaagctagatctgcaggttctgcttcttggggcgaattatttaccggtaagccagctatgttcagacgtactcttatgggtatcatgattcaatctttgcaacaattgacaggtgacaactacttcttctactatggtactattgttttcaaggctgttggtttagaagattccttcgagacctccattgttttcggtgttgtcaacttcttctccacctgttgctctttgctaactgtcgatcgtttcggtcgtcgtaactgtttactgtatggtgctatcggtatggtctgctgttacgttgtctatgcttctgttggtgtcacaagattatggccccatggtcaaggtaatggctcttccaagggtgccggtaactgtatgatcgtcttctcctgtttctacatcttctgtttcgctaccacctgggctccaatcgcttatgttattatctctgaaactttcccattgagaatcaaggccaaggccatgtccattgcaactgctgctaactggatgtggggtttcttgattgccttcttcactccattcatcaccaatgccattaacttctactacggatatgttttcatgggctgtatggtttttgcatacttctatgttttcttctttgtctcagagacaaagggtttaactctagaagaggttaacgaaatgtatgccgaaggtgttttgccttggaagtcttccaaatgggttcctgcttccagaagaggtgctgattatgatgccgatgctttgatgcacgacgacaccccatggtacaagagagttgttggtagaggttaa

SEQ ID NO: 342 - protein, 563 aa, Candida glabrata
MNSQPDLISPQKSSSSNEVDSHESKYLNQVGKNDMADEFVQNEMIANPNTGKGAFVGVIISCFMVAFGGFVFGWDTGTISGFVAQKDFIHRFGMKHPDGTEYLSKVRTGLIVSIFNIGCAIGGIILSKLGDTKGRKMGLVVVVVIYIVGIIIQIASINKWYQYFIGRIISGLGVGGISVLSPMLISEVAPSDLRGSLVSCYQLMITLGIFLGYCTNFGTKNYTNSVQWRVPLGLCFAWALFMIGGMTFVPESPRYLVEAGQIEEARSSLARINKCSPDHPYIQQELDLIQASVDEARSAGSASWGELFTGKPAMFRRTLMGIMIQSLQQLTGDNYFFYYGTIVFKAVGLEDSFETSIVFGVVNFFSTCCSLLTVDRFGRRNCLLYGAIGMVCCYVVYASVGVTRLWPHGQGNGSSKGAGNCMIVFSCFYIFCFATTWAPIAYVIISETFPLRIKAKAMSIATAANWMWGFLIAFFTPFITNAINFYYGYVFMGCMVFAYFYVFFFVSETKGLTLEEVNEMYAEGVLPWKSSKWVPASRRGADYDADALMHDDTPWYKRVVGRG

SEQ ID NO: 343 - DNA, 1707 bp, Candida glabrata
  CDS (1)..(1707)
atgcttttctcaaaaaagaaggaagatcctcaggccgttcctgaggcatctccagaaaatgacttttctccatctctatcccaacaagattcatctgcttccccatatgaaaatgatgtcaagaagcttgaagaagaagccgaacaaactccaatagtagacattccaaagaagcctgcttctgcttatgttactgtttctatcttctgtctattcatcgcttttggtggttttgttttcggttgggatactggtaccatttctggtttcgtcgctcaaaccgatttcattagaagattgggtcaaaagcgtgcaaatggtacacactacttgtctaaggttagaactggtttggttgtctctattttcaacattggttgtgccattggtggtgttatcttgtccaaattgggtgatgtgtacggccgtaagcctggtttgattatcgttgtcgttatttatgtcgttggtattattatccagatcgctactattgacaagtggtaccaatacttcatcggtagaattatctccggtttgggtgttggtggtattgctgtcttgtctcctatgttgatttccgaagtctctccaaagcacttgagagcaactctggtggcgtgctaccaactaatgattacattgggtattttcttgggttactgtactaacttcggtaccaagaactactccaactctgtccaatggagagttccattaggtctatgttttgcttgggctatctttatgatcagtggtatgaccttcgttccagaatctccaagatttttggtcgagaaaggtagaattgaggatgccaagagatctattgcgtcttctaacaaggtttcggttgatgatccagctgtcgttgctgaagttgacagtgttcaagctgctgttgaagctgaaagattggctggttctgcttcctggggtgaattgttctcaaccaagaccaagattttccaacgtttggttatgggtatcatgattcaatctttgcaacaattgacaggtgacaactacttcttctactatggtactattgttttcaaggctgttggtttggaagattccttcgagacctccattgttatcggtgttgtcaacttcttctctactttcgttggtattttcttggtcggtagatttggccgtcgtacctgtctattgtggggtgccgctaccatgactgcttgtatggttgttttcgcttctgtcggtgtcaccagactatggcctcacggtaagggtaatggttcttccaagggtgctggtaactgtatgattgtcttcacctgtttctacattttctgtttcgctaccacctgggctccactagctttcgttatctgttctgaaaccttcccattgagagtcaaggccaagtgtatggctcttgctcaagcctctaactggatctggggtttcttgattagtttcttcactcctttcattactgatgctattaacttcaactatggttacgtcttcatgggctgtctatgtttctcctacttctacgttttcttctttgttccagaaaccaagggtctaactttggaagaagtcaacaccatgtgggaagaaggtgtcttgccatggaaggcttctcaatgggttcctccatccagaagaggtgctgattatgatgccgatgctttgatgcacgatgacaccccatggtacaagagattcctataa

SEQ ID NO: 344 - protein, 568 aa, Candida glabrata
MLFSKKKEDPQAVPEASPENDFSPSLSQQDSSASPYENDVKKLEEEAEQTPIVDIPKKPASAYVTVSIFCLFIAFGGFVFGWDTGTISGFVAQTDFIRRLGQKRANGTHYLSKVRTGLVVSIFNIGCAIGGVILSKLGDVYGRKPGLIIVVVIYVVGIIIQIATIDKWYQYFIGRIISGLGVGGIAVLSPMLISEVSPKHLRATLVACYQLMITLGIFLGYCTNFGTKNYSNSVQWRVPLGLCFAWAIFMISGMTFVPESPRFLVEKGRIEDAKRSIASSNKVSVDDPAVVAEVDSVQAAVEAERLAGSASWGELFSTKTKIFQRLVMGIMIQSLQQLTGDNYFFYYGTIVFKAVGLEDSFETSIVIGVVNFFSTFVGIFLVGRFGRRTCLLWGAATMTACMVVFASVGVTRLWPHGKGNGSSKGAGNCMIVFTCFYIFCFATTWAPLAFVICSETFPLRVKAKCMALAQASNWIWGFLISFFTPFITDAINFNYGYVFMGCLCFSYFYVFFFVPETKGLTLEEVNTMWEEGVLPWKASQWVPPSRRGADYDADALMHDDTPWYKRFL

SEQ ID NO: 345 - DNA, 1671 bp, Candida glabrata
  CDS (1)..(1671)
atgagtagttctaataaagattccgagtcttttgagaattatccttcgcaaaattctgacaacagctacaagagggatgatctggatccagataccctcgagaaggaggccaagatcgaaaaccctaacggtaagagcgcctacatcgcagtgagtatctcctgtgctttggtcgctttcggtggtttcatcttcggctgggataccggtaccatttccggtttcgtcaaccaaactgacttcatcagaagaatcggttccaagcacgctgatggtacctcatacttgtccaaggttagaaccggtctagttgtcggtatcttcaacatcggttgtgccatcggtggtgttgttttgtctaaaatcggtgatactaaaggtcgtaaggccggtctggtgactgtcgtgctaatttacattgtcggtatcgtgattcaaatcgctaccattgacaagtggtaccaatacttcatcggtagaatcatctccggtttgggtgttggtggtatctctgtgctttccccaactctaatttctgaagtcgctcctaaggaattgagaggttctttggtctctctataccaaatcatgatcactttgggtatcttcttgggttactgtactaactacggtaccaagaactactccaactctgtccaatggagagttcctttgggtctatgtttcgcttgggctttgcttatgatcggtggtatgaccttcgttccagaatccccacgttacttgatcgaagccggagatgacgatgctgctcgtaagtctctatgtgctgccaacaagttgccagctgaacacccattcatcgaacaagaattcaccatcttgaaagccaaggtcgaagaagctaatgccgctggtactgcttcttggtccgaattgatcactggtaagcctgctatgttgagacgtaccattatgggtatcatgattcaatctttgcaacaattgactggtgacaactacttcttctactacggtactactgttttcaaggctgttggtttggaagattctttccaaacctctatcgttttcggtgtcgttaacttcttctctaccttcttatctttgttcaccgtcgaccgtttcggtcgtcgtaactgtttgctgtacggtgccgccggtatggtctgctgttacgttgtctacgcttccgttggtgttaccagattatggccaaatggtcaaggtaatggctcttccaagggtgccggtaactgtatgatcgtcttctcctgtttctacatcttctgtttcgctaccacctgggctccaattgcttacgttattatctccgaatccttcccattgagaatcaagaccaaggccatgtccattgcctctgcttccaactggatctggggtttcttgattgccttcttcacaccatttattaccaatgccattaacttctactacggttacgtctttatgggctgtatggtctttgcttacttctacgttttctttttcgtcaacgaaactagaggtttgactttggaagaagtcgatgagatgtacgccgaaggtgttctaccatggaagtcctccaagtgggtcccagaatccgaaagagatgacagctatgacgccgatgctttacttcatgatgacacaccatggtacaagagagtcattggtagaaattaa

SEQ ID NO: 346 - protein, 556 aa, Candida glabrata
MSSSNKDSESFENYPSQNSDNSYKRDDLDPDTLEKEAKIENPNGKSAYIAVSISCALVAFGGFIFGWDTGTISGFVNQTDFIRRIGSKHADGTSYLSKVRTGLVVGIFNIGCAIGGVVLSKIGDTKGRKAGLVTVVLIYIVGIVIQIATIDKWYQYFIGRIISGLGVGGISVLSPTLISEVAPKELRGSLVSLYQIMITLGIFLGYCTNYGTKNYSNSVQWRVPLGLCFAWALLMIGGMTFVPESPRYLIEAGDDDAARKSLCAANKLPAEHPFIEQEFTILKAKVEEANAAGTASWSELITGKPAMLRRTIMGIMIQSLQQLTGDNYFFYYGTTVFKAVGLEDSFQTSIVFGVVNFFSTFLSLFTVDRFGRRNCLLYGAAGMVCCYVVYASVGVTRLWPNGQGNGSSKGAGNCMIVFSCFYIFCFATTWAPIAYVIISESFPLRIKTKAMSIASASNWIWGFLIAFFTPFITNAINFYYGYVFMGCMVFAYFYVFFFVNETRGLTLEEVDEMYAEGVLPWKSSKWVPESERDDSYDADALLHDDTPWYKRVIGRN

SEQ ID NO: 347 - DNA, 1650 bp, Candida glabrata
  CDS (1)..(1650)
atgtctgaagaatcacaatctgctctctcggcctccaacagcaaagttgaaagagaggacgagttcaaggcttacaccgatgaggatggccaaccaatggttgagatcccaaagaagcctgcttccgcttacgttgctatttccatcttctgtctattcatcgctttcggtggtttcgttttcggttgggatactggtaccatttctggtttcgttgcccaaactgatttcatcagaagaatgggtcaaactcgtgctaatggtactcactacttgtctaaggttagaaccggtttaattgtttctattttcaacatcggttgtgccattggtggtgttgtcttgtccaagctaggtgatgtttacggtcgtaagatcggtttgatcagtgtcgttgtcatctacattgtcggtatcgttattcaaattgctaccattgacaagtggtaccaatacttcatcggtagaattatctccggtttgggtgttggtggtattgccgtcttgtctcctatgttgatttctgaagtctctccaaagcacatgagaggttctttggtttcctgttaccaactgatgattacctgtggtatcttcttgggttactgtactaactacggtaccaagaactactccaactctgtccaatggagagttccattgggcctatgtttcgcctgggctctattcatgatcggtggtatgaccttcgttccagaatccccacgttacttgattgaggttggtagagttgaagaagccagaagatccattgctatctctaacaaggtttctccagatgatccagctgtcactttcgaagttgaaaatgtccaagccggtgttgaagctgaaagattggctggttctgcttcctggggtgaattgttctccaccaagaccaagattttccaacgtttgattatgggtatcatgattcaatctttgcaacaattgacaggtgacaactacttcttctactatggtactactgttttcaaggctgttggtttggaagattctttcgaaacctccattgtcattggtattgttaacttcgcttccactttcgttgccttgtacgttgttgaccgtttcggtcgtcgtagatgtctattgtggggtgccgctgctatgactgcttgtatggttgtcttcgcttctgtcggtgtcaccagactatatcctcacggtatgaaacagccatcatccaagggtgctggtaactgtatgattgttttcacctgtttctacattttctgtttcgctaccacctgggctccaattccatttgttgtcaactctgaaactttcccattgagagtcaaggccaagtgtatggctattgcccaagcttccaactggatctggggtttcttgattgccttcttcactccatttattaccaatgccattaacttctactacggttacgtgttcatgggctgtctatgtttctcctacttctacgttttcttcttcattccagagaccaagggtctaactttggaagaagtcaacactatgtgggaagaaggtgtcttggcttggaagtctccaaactgggttccaccatccaagagagatgcttcttacgatgctgacgctttgatgcacgatgacaagccatggtacaagagattctattaa

SEQ ID NO: 348 - protein, 549 aa, Candida glabrata
MSEESQSALSASNSKVEREDEFKAYTDEDGQPMVEIPKKPASAYVAISIFCLFIAFGGFVFGWDTGTISGFVAQTDFIRRMGQTRANGTHYLSKVRTGLIVSIFNIGCAIGGVVLSKLGDVYGRKIGLISVVVIYIVGIVIQIATIDKWYQYFIGRIISGLGVGGIAVLSPMLISEVSPKHMRGSLVSCYQLMITCGIFLGYCTNYGTKNYSNSVQWRVPLGLCFAWALFMIGGMTFVPESPRYLIEVGRVEEARRSIAISNKVSPDDPAVTFEVENVQAGVEAERLAGSASWGELFSTKTKIFQRLIMGIMIQSLQQLTGDNYFFYYGTTVFKAVGLEDSFETSIVIGIVNFASTFVALYVVDRFGRRRCLLWGAAAMTACMVVFASVGVTRLYPHGMKQPSSKGAGNCMIVFTCFYIFCFATTWAPIPFVVNSETFPLRVKAKCMAIAQASNWIWGFLIAFFTPFITNAINFYYGYVFMGCLCFSYFYVFFFIPETKGLTLEEVNTMWEEGVLAWKSPNWVPPSKRDASYDADALMHDDKPWYKRFY

SEQ ID NO: 349 - DNA, 1659 bp, Candida glabrata
  CDS (1)..(1659)
atgtctgatcaagaatcaagatcacaatctgtcttgtcagcctccaacagtaaggctgacagagaagacgaattcaaggcttatgtcgatgaggaaggtcaaccaatggttgaaattccaaagaagcctgcttccgcttacgtctctatttccatcttctgtctattcatcgctttcggtggtttcgttttcggttgggatactggtaccatttctggtttcgttgcccaaactgatttcatcagaagattgggtcaaactcgtgctaatggtactcactacttgtctaaggttagaactggtctagtcgtctccattttcaacatcggttgtgctatcggtggtattgttttgtctaagttgggtgatatgtatggtcgtaagatcggtttgatcagtgtcgttgtcatctacattgtcggtatcgttattcaaattgctaccattgacaagtggtaccaatacttcatcggtagaattatctccggtttgggtgttggtggtattgccgtcttgtctcctatgttgatttctgaagtctctccaaagcacatgagaggttctttggtttcctgttaccaactgatgattacctgtggtatcttcttgggttactgtactaactacggtaccaagaactactccaactctgtccaatggagagttccattgggcctatgtttcgcctgggctctattcatgatcggtggtatgaccttcgttccagaatctccacgttacttgattgaggttggtagagttgaagaagccagaagatccattgctatctctaacaaggtttctccagatgatccagctgtcactttcgaagttgaaaatgtccaagctgctgttgaagctgaaagattggctggttctgcttcctggggtgaattgttctctaccaagactaaggttttccaacgtttgattatgggtatcatgattcaatctttgcaacaattgacaggtgacaactacttcttctactatggtactactgttttcaaggctgttggtttggaagattctttcgaaacctccattgtcattggtattgttaacttcgcttccactttcgttgccttgtacgttgttgaccgtttcggtcgtcgtagatgtctattgtggggtgccgctgctatgactgcttgtatggttgtcttcgcttctgtcggtgtcaccagactatggccaaatggtcaagaccaaccatcctccaagggtgctggtaactgtatgattgttttcacctgtttctacattttctgtttcgctaccacctgggctccaattccatttgttgtcaactctgaaactttcccattgagagttaaggccaagtgtatggctattgcccaagcttccaactggatctggggtttcttgattgccttcttcactccatttattaccaatgccattaacttctactacggttacgtgttcatgggctgtctatgtttctcctacttctacgttttcttcttcattccagagaccaagggtctaactttggaagaagtcaacactttgtgggaagaaggtgtcttgccatggaagtctccaaactgggttccaccatccaagagagatgcttcttacgatgctgacgctatgatgcacgatgacaagccatggtacaagagatttgtttaa

SEQ ID NO: 350 - protein, 552 aa, Candida glabrata
MSDQESRSQSVLSASNSKADREDEFKAYVDEEGQPMVEIPKKPASAYVSISIFCLFIAFGGFVFGWDTGTISGFVAQTDFIRRLGQTRANGTHYLSKVRTGLVVSIFNIGCAIGGIVLSKLGDMYGRKIGLISVVVIYIVGIVIQIATIDKWYQYFIGRIISGLGVGGIAVLSPMLISEVSPKHMRGSLVSCYQLMITCGIFLGYCTNYGTKNYSNSVQWRVPLGLCFAWALFMIGGMTFVPESPRYLIEVGRVEEARRSIAISNKVSPDDPAVTFEVENVQAAVEAERLAGSASWGELFSTKTKVFQRLIMGIMIQSLQQLTGDNYFFYYGTTVFKAVGLEDSFETSIVIGIVNFASTFVALYVVDRFGRRRCLLWGAAAMTACMVVFASVGVTRLWPNGQDQPSSKGAGNCMIVFTCFYIFCFATTWAPIPFVVNSETFPLRVKAKCMAIAQASNWIWGFLIAFFTPFITNAINFYYGYVFMGCLCFSYFYVFFFIPETKGLTLEEVNTLWEEGVLPWKSPNWVPPSKRDASYDADAMMHDDKPWYKRFV

SEQ ID NO: 351 - DNA, 1728 bp, Yarrowia lipolytica
  CDS (1)..(1728)
atgaagctgtttaaacgagaagcgccccaaggaacagtcagaactagctactttggaagtagaggcacgcggctgcatcggatcattgcagccgtggctggaatcggcttcttgctgtttggatatgacaccggagtcatgggcagtttgttgaccctgccgaccttcattcaccagtttccaactatggatagcacgtctccacatctggatgcaaagacaaagtcgttccattcgacggtccagggcacagccgtggccatctacgagattgggtgcatgttgggtgctctgtttacaatgtggggaggagacaagctgggtagacgaaagataatcttcattggctccataattgtcaccattggagcgattcttcaatgtgcttcgtattcgctcggtcaatttgtgactggaagagtcattgctggtattggagtcggtttcactacagctacagtgccaatgttccaggctgagtgtgctcgtcctgaacggagaggggccctggtgatgcttggaggagccctgacaactggaggaattgctctcagttactggatcgactttggcttttatttcgtcaagcgaaatgactcggactggagattcccggtagcttttcagatcctcttctccctcattctgtcgtgcacagtcctgtaccttcccgagtcccccagatggctcattaagaagggacgctatgaagaagcagcaggagtgtttgcagccctggaagatgtgcccattgacgacatctatgtatctcagcaactcatgcaggtcaaagagtcgctcatggtaggccaacttgcacaggaaggcattgagggagatgaagcacgacgacgaatcgcttcaggagacgtggagcttggagaagagccgccgttcaggaaacagttggttctgctcttcacctttggcaaaaaaaaacaccttcatcgagccatgttggcttactctcaacagatcatgcaccaaatgtgtggaatcaacctcatctcatattacgcagcctacattttccagacttctatcggtatgagcccgctcaactcacgaattctggcggcttgtgatggaacagagtacttcctggcgtcctggatcgccttctacaccattgagaggttcggacgaagaaagctcatgctgtttggaaccattggacaagcctgtacgatggctattctagcaggaacagtctacgcagcatcttcagtaaaagacggtggcctagacaaacctcaggctggcattgcagcagcagtgttcctgtttgttttcaacaccttcttctccattggctggctaggtatggcgtggctgtaccctgcggaaatcgcccccattgaaatcagagccatttcccagggtctgtccacatccggaaactgggtcttcaatttcctggtcgtcatgatcacccccgtggccttcaactccatcaagtggagaacttacatcatctttgcgtgcatcaacgtcgccatggtcccctccatctacttcttcttccccgaaaccatgggccgatcgctcgaagaaatcgatctcattttcgaagactccaaccccagaactccttgggacgtggttggtattgcaaagcgacttcctaggggtaccctggatggagttgttccttcagacatggagctggagaaggagatcgagcatgtcagcgtcaagtctttgggaggtgccactattcgtggatag

SEQ ID NO: 352 - protein, 575 aa, Yarrowia lipolytica
MKLFKREAPQGTVRTSYFGSRGTRLHRIIAAVAGIGFLLFGYDTGVMGSLLTLPTFIHQFPTMDSTSPHLDAKTKSFHSTVQGTAVAIYEIGCMLGALFTMWGGDKLGRRKIIFIGSIIVTIGAILQCASYSLGQFVTGRVIAGIGVGFTTATVPMFQAECARPERRGALVMLGGALTTGGIALSYWIDFGFYFVKRNDSDWRFPVAFQILFSLILSCTVLYLPESPRWLIKKGRYEEAAGVFAALEDVPIDDIYVSQQLMQVKESLMVGQLAQEGIEGDEARRRIASGDVELGEEPPFRKQLVLLFTFGKKKHLHRAMLAYSQQIMHQMCGINLISYYAAYIFQTSIGMSPLNSRILAACDGTEYFLASWIAFYTIERFGRRKLMLFGTIGQACTMAILAGTVYAASSVKDGGLDKPQAGIAAAVFLFVFNTFFSIGWLGMAWLYPAEIAPIEIRAISQGLSTSGNWVFNFLVVMITPVAFNSIKWRTYIIFACINVAMVPSIYFFFPETMGRSLEEIDLIFEDSNPRTPWDVVGIAKRLPRGTLDGVVPSDMELEKEIEHVSVKSLGGATIRG

SEQ ID NO: 353 - DNA, 1647 bp, Trichoderma reesei
  CDS (1)..(1647)
atgcccattggcaacatctacgtgatcgccggcgtgtccgtcgtcggcggcgcgttgttcggcttcgacatctcgtctgtgtcggcccagctggccgagcagtcgtacctctgctacttcaaccaagatgagaatccgcccaccaccgtcgatggcacctgtggtggcccgcggtccctcgtccagggcggcatcacggcctccatggctgctgggtcctggctgggcgccctgatctcgggtcccctgtctgatcgcctgggccgcaagtactccatcatggtcggatgtatcatttgggttattggctccaccctctcgtgcgcttctcaaaacattggcatgctcattgtcgcccgtatcatcaacggtctctccgtcggtatcgaatctgctcaggtccccgtctacattgccgagatttcgcctccctccaagcgcggccgcttcatcggcatgcagcagtgggccatcacctggggcatcctcatcatgtactacatctcctacggctgctccttcatcggcaagcagaaccctctcgagtacaacactgcctcgtggcgtattccatggggtctgcagatgattcccgccttcttcctcttcttcatgatgatgccgcttcccgagtctccccgttggctcgcccgcaaggaccgctgggaggactgccgcgccgtgctcaccctcgtccacggcaagggcgatcccaaccacccctttgttgcctacgaactgcaggacatcaaggacatgtgcgagtttgagcgtcgccatgctgatgtcacctacctcgacctgttcaagcccaacatgctcaaccgcacattcattggtctctttacccagatctggtcccagctgacgggcatgaacgtcatgatgtactacattgccaacatcttctccatggctggctacagcggcaacgccaacctgctcgcctcgtccatccagtacatcatcaacgtgctgatgaccattcccgccctgctttgggtcgacaaatggggtcgccgtcccacgctgctcgtcggttccgtcctcatggccctgtggatgtacgccaacgcgggtatcctcgccacctacggtgaagtcgtccccggcggcattgatcacgtcgctgcccagtcgatgcgtgtctcgggcgcccctgccaagggtctcattgcctgcacgtacctgtttgtggcctcgttcgcgcccacctggggtcccgtctcgtggacctaccctccggagctgttccccctccgcctccgaggcaagggcgtggctctggcgacttccggaaactgggccttcaacacggcgctgggtctcttcaccccggtggcctttgccaacatcaagtggaagtcgtacctcatctttgccatcttcaacactgtcgccttcttccacgtcttcttcgtcttccccgagacggccggcaagacgctcgaggagacggaggccatgttcgaggatcccaacggcatcaagtacctgggcacgcccgcgtggaagacgagggtggccacgagcctcacggagcgtgccgagcacggcgacattgaggccaagattggccatgacacggagaagcctccggtccacactcacgaggaggagaaggccagcactccccctccccagtag

SEQ ID NO: 354 - protein, 548 aa, Trichoderma reesei
MPIGNIYVIAGVSVVGGALFGFDISSVSAQLAEQSYLCYFNQDENPPTTVDGTCGGPRSLVQGGITASMAAGSWLGALISGPLSDRLGRKYSIMVGCIIWVIGSTLSCASQNIGMLIVARIINGLSVGIESAQVPVYIAEISPPSKRGRFIGMQQWAITWGILIMYYISYGCSFIGKQNPLEYNTASWRIPWGLQMIPAFFLFFMMMPLPESPRWLARKDRWEDCRAVLTLVHGKGDPNHPFVAYELQDIKDMCEFERRHADVTYLDLFKPNMLNRTFIGLFTQIWSQLTGMNVMMYYIANIFSMAGYSGNANLLASSIQYIINVLMTIPALLWVDKWGRRPTLLVGSVLMALWMYANAGILATYGEVVPGGIDHVAAQSMRVSGAPAKGLIACTYLFVASFAPTWGPVSWTYPPELFPLRLRGKGVALATSGNWAFNTALGLFTPVAFANIKWKSYLIFAIFNTVAFFHVFFVFPETAGKTLEETEAMFEDPNGIKYLGTPAWKTRVATSLTERAEHGDIEAKIGHDTEKPPVHTHEEEKASTPPPQ

SEQ ID NO: 355 - DNA, 2048 bp, Equus caballus
  CDS (178)..(1752): n means a or g or c or t/u
ttgctatgcatccaacgcgttgggagctctcccatatggtcgacctgcaggcggccgcgaattcactagtgattctaatacgactcactatagggcaagcagtggtaacaacgcagagtacgcggggacacactcactgcaggacctggaattagaggaagactcccgacccataaaatgacagaacataaggtcactgggaccttggcgttcactgtcttcactgccgtgctgggttccttccagtttggatatgacattggtgtgatcaatgcacctcaagaggtaataatatcccattatagacacgttttgggtgttccactggatgaccgaaaagctattaataactatgctatcaacagtacgaaggaactgcccacagtcccatccctaaggactccaacaccaacttcttcggctgaggaagaggctatggcatctgccagccacatcatcatgttgtggtccctgtctgtgtccagctttgcagttggtggaatgttcgcatcattctttggtgggtggcttggggaccggcttggaagaatcaaagccatgttggtagcaaacattttctcaatagttggagctctcttgatggggttttcgaaattgggaccatctcacattcttataatttcaggaagaggcatatcaggactttactgtgggctaatttcaggcttggttccaatgtacattggtgaagttgctccaaccacactcagaggtgccatcggtactcttcaccagctggccattgtcacgggcattctcattagtcagattgttggtcttgactttatcctgggcaatcagaagctgtggcacatccttcttggcctgtctgcggtgccagctgtcctccagtctctaatgctcttcttctgtccagaaagccccagatacctttacattaagttggatgaggaagtcaaagcaagtaaaagtttgaaaagactcagaggaggtgctgatgtcaccaaagacatcattgagatgagaaaagaaaaggaagaagcatcaagtgagcagaaagtctccatacttcagctcttcaccaattccagttaccgacagcctatcctagtggcgttaatgctacacctggctcagcaattttctggaatcaatgggatcttttactactcaaccagcatttttcagacggctggaatcagccaacctgtttatgcaaccattggagttggtgtcgtcaacacagttttcactgttgtctctgtattccttgtggagaaggcagggcgacgctctctgtttctaatcggaatgagtgggatgtttctctgtgccatcttcatgtcagtgggacttatgctactgaataaactggcttggatgagttacgtgagcatgacagccatcttcctttttgtcagtttctttgaaattgggccaggccccatcccctggttcatagtggctgagtttttcagtcaaggaccacggcctgctgctttggcaatagctgcattcagcaactggacctgcaatttcattgtagctctgtgtttcccatacattgcggacttctgtggaccttatgtgttcttcctttttgctggagtggtcctagcctttactctgtttacatttttcaaagttccagaaaccaaaggaaagtcgtttgaagaaattgcggcagaattccgaaagaagagtggatcggcccaagcaccaaaagctgctgtcgaaatggaattccttggagctacagagactgcgtagagacaacctgctttttgatgtgaccagaaacaggatggaagctgtgtgtttttaaatgacgattcttttgagaattttatatctgcatcttgaagtattgntttattttctaaagagcttttatgggctctgattagaaacgtcatcaagtattaccaaagaaagtatttttttttaaagttaagagaatctatttttgatggtaaaactctgtaattaaagtaaacccaaaaagtcgagttcatttcgctgcattaaatggcaagtctggcctaaaaaaaaaaaaaaaaaaaaaa

SEQ ID NO: 356 - protein, 524 aa, Equus caballus
MTEHKVTGTLAFTVFTAVLGSFQFGYDIGVINAPQEVIISHYRHVLGVPLDDRKAINNYAINSTKELPTVPSLRTPTPTSSAEEEAMASASHIIMLWSLSVSSFAVGGMFASFFGGWLGDRLGRIKAMLVANIFSIVGALLMGFSKLGPSHILIISGRGISGLYCGLISGLVPMYIGEVAPTTLRGAIGTLHQLAIVTGILISQIVGLDFILGNQKLWHILLGLSAVPAVLQSLMLFFCPESPRYLYIKLDEEVKASKSLKRLRGGADVTKDIIEMRKEKEEASSEQKVSILQLFTNSSYRQPILVALMLHLAQQFSGINGIFYYSTSIFQTAGISQPVYATIGVGVVNTVFTVVSVFLVEKAGRRSLFLIGMSGMFLCAIFMSVGLMLLNKLAWMSYVSMTAIFLFVSFFEIGPGPIPWFIVAEFFSQGPRPAALAIAAFSNWTCNFIVALCFPYIADFCGPYVFFLFAGVVLAFTLFTFFKVPETKGKSFEEIAAEFRKKSGSAQAPKAAVEMEFLGATETA

SEQ ID NO: 357 - DNA, 1629 bp, Aspergillus fumigatus
  CDS (1)..(1629)
atgtccatccttgctctggtcgaagatcgaccaactccaaaagaggtctacaactggaagatttacctgctggccgccgtggcatccttcacatcatgcatgatcggctatgacagtgcctttatcggaaccactctcgccctcagctccttcagggaagagtttgggttcagcaccatgagcaagacggcggtcaatctggtaagcgccaacatcgtctcctgctaccaggccggcgccttctttggcgcttttttcgcctaccctattggtcacttctggggtaggaaatggggcctgctatttgccggtacgattttcacccttggcgctggtctcatgcttggtgccaacggtgatcgggggctgggcctgctttatggagggcgtgttctggccggtcttggtgtcggtgcgggctcgaatatcactcccatctacatttcggagatggctccaccctcgattcgtggacgactggttggagtgtacgagttgggctggcagattggtggtctggtgggcttctggatcaattacggtgtcagtgaaaccctggctcccagccacaagcagtggatcattccctttgctgtgcagttgattccatccggtctgctcctcattggtgcagttttcctcaaagagtctccgcgctggctgttctcgcgcggacgtcgggaagatgccatcaagaatctctgctggatccgccagctgcctgcggatcacatatacatgatcgaggagatcggcgcggtcgaccaggccttggaggagcagcgcaccaccattggccttggcttctggaagccgttcaaggccgccggaaccaacaaaaaagtcatgtatcgcctcttcctgggaagcatgctcttcttctggcaaaacggcagtggcatcaatgccatcaactactatagccccacggtgttcaagagcattggtctccatggggcaaacaccagcatgttcagcaccgggatttttggagtcgtcaagaccgtggtcacctttgtctggctcctttacctaatcgaccgcgtgggacggcgtctgctgctgttgatcggagctgccggcgcagcagtctgcttgcttattgttggcgcttatatcaagatcgccgacccggcctctaaccctacccaggagatgactgggggcggcattgcggccatgttcttcttttatctttacactgttttttacactccgtcgtggaacggcactccttgggtgatgaattcggaaatgttcgagcccaacatgcgctcccttgcgcaggcctgcgcggccgcgtccaactggctctggaactttctcatctcgcgtttcacaccgcagatgttcgccaagatggagtacggcgtgtggttcttctttgcatctttgatgttgctgtccatcgtttttgtgttcttccttgttccggagaccaagggcatcccgctggagagcatggatgtcttgtttgagtcgaagccgatttggcgtgctcatgcgacggtcctggccaaactgcgagaagatgaggaacagttccggcatgatatcgaggaatcggggtatagcaagactggtgagcagcaggtggagcacgtgtccgaggatctgcccaaggtctag

SEQ ID NO: 358 - protein, 542 aa, Aspergillus fumigatus
MSILALVEDRPTPKEVYNWKIYLLAAVASFTSCMIGYDSAFIGTTLALSSFREEFGFSTMSKTAVNLVSANIVSCYQAGAFFGAFFAYPIGHFWGRKWGLLFAGTIFTLGAGLMLGANGDRGLGLLYGGRVLAGLGVGAGSNITPIYISEMAPPSIRGRLVGVYELGWQIGGLVGFWINYGVSETLAPSHKQWIIPFAVQLIPSGLLLIGAVFLKESPRWLFSRGRREDAIKNLCWIRQLPADHIYMIEEIGAVDQALEEQRTTIGLGFWKPFKAAGTNKKVMYRLFLGSMLFFWQNGSGINAINYYSPTVFKSIGLHGANTSMFSTGIFGVVKTVVTFVWLLYLIDRVGRRLLLLIGAAGAAVCLLIVGAYIKIADPASNPTQEMTGGGIAAMFFFYLYTVFYTPSWNGTPWVMNSEMFEPNMRSLAQACAAASNWLWNFLISRFTPQMFAKMEYGVWFFFASLMLLSIVFVFFLVPETKGIPLESMDVLFESKPIWRAHATVLAKLREDEEQFRHDIEESGYSKTGEQQVEHVSEDLPKV

SEQ ID NO: 359 - DNA, 1653 bp, Leptosphaeria maculans
  CDS (1)..(1653)
atggcttcgacgatgaaaggggaaggccatgtcgctgagcgcgtcgagtcggcatctgctcactatgttaccgacgacacaaacacggccatcgataatgaacgtaatatgaccgtcagacagtcgttgcggttctggtggaaggctattgtattctcctttgtcatctcactgtgcgtggtcatggaggggtacgatacgagtctgatgaacaagttcttcgccttcactcctttcaagaaccgttttggagatcaggtcgacgcagacgggattccgcttgtgtcgtcgcgttggcagactattattttgaacggcacacaggtcggatgtatattgggcctgattatcaacggatatataaccgagtggattggatacaagaagacaatgattgggagtatggtgtttatgaccggagcaatcctcatccccttcttttcgaccagcctggagatgttcctcgtcggtggtatcatccaaggtctaccatggggtgtcttccagacccttgccatctcctacgccgcagacctatgccctattcatcttcgaggctacatgacatcctggatcaacatgtgctgggtcatcggcggcctcttgtccactggtattctaaccgggttaatgaagaacaattcgcaatggggctaccgcatcccctttgcgctccaatgggtctggcccatccccatcatcctcgccacactcctcgcgcctgaatctccctggtggctcgtacgtcaaggccgcaacggaagaagccaaagccgcgatccgcaaaatcaccacgcctactccggggtccagtttgacgtcgactcccacgttgagatgatggtcgtcaccaatcaatatgaaaaggaagtcggcgcgggtaccaactactggcacctgttccgcggaagcgaccttcaccgcacggaggtttcggctatggcgtttgtcacccaggcgctagttggcacgacttttatggggtttggggtccaattctttttgggtgtcggtctgaagcaggaggattctttctatctgactgttgggcaagactgcctgggtttaattggctgtttcattgcgtggtggattatgacgagatttggccgtcgacccatctacctcaccggtctctgtgccatctttctcatcctgctgattgtcggattccttgggcttgcaccgccaacaaacgaaagcgcaggcttagcaggcggcatattcatcgtccttatgattttctgcttccagctttcactgggtccaatttgctactcgctagccgctgaaatcccctcttcccgcctacgcgtgaaaactgtggccctctctcgcgcctcttacaattccattgtctttgtaacaaacaccattatgccgaaaatggtcggccgcaacgactggaactggggtgcaaaaggcggatttttctgggccggtattgccgcccttttcattgtgtggggctactttcgcctcccggagccgaaggggtttacgtactctgagctggatttgctgtttgagcacagagtttctgcgcggaagtttacgagggagagggtggaggttctgaggccagcgttgggtggcggggtggggaagttggatgagaaggagtcgattgagagggtcggggatggggcgtag

SEQ ID NO: 360 - protein, 550 aa, Leptosphaeria maculans
MASTMKGEGHVAERVESASAHYVTDDTNTAIDNERNMTVRQSLRFWWKAIVFSFVISLCVVMEGYDTSLMNKFFAFTPFKNRFGDQVDADGIPLVSSRWQTIILNGTQVGCILGLIINGYITEWIGYKKTMIGSMVFMTGAILIPFFSTSLEMFLVGGIIQGLPWGVFQTLAISYAADLCPIHLRGYMTSWINMCWVIGGLLSTGILTGLMKNNSQWGYRIPFALQWVWPIPIILATLLAPESPWWLVRQGRNGRSQSRDPQNHHAYSGVQFDVDSHVEMMVVTNQYEKEVGAGTNYWHLFRGSDLHRTEVSAMAFVTQALVGTTFMGFGVQFFLGVGLKQEDSFYLTVGQDCLGLIGCFIAWWIMTRFGRRPIYLTGLCAIFLILLIVGFLGLAPPTNESAGLAGGIFIVLMIFCFQLSLGPICYSLAAEIPSSRLRVKTVALSRASYNSIVFVTNTIMPKMVGRNDWNWGAKGGFFWAGIAALFIVWGYFRLPEPKGFTYSELDLLFEHRVSARKFTRERVEVLRPALGGGVGKLDEKESIERVGDGA

SEQ ID NO: 361 - DNA, 1542 bp, Aspergillus parasiticus
  CDS (1)..(1542)
atggttgctggcggtggaattgtttcttcatccggcatggatgcataccgggccctgccaaacaatacgaactcgaactggttcaaggacaagggcctccggcgtctgaatttcggcctcatgcttatgtttgcatccgctgcagcaaatgggtatgatggggctttgatgaatggtctcctgactctccctatgtgtgagtttcctttgtcaagttgtcctcacctctggcgaatgttcacctttattccagcttcgtacttcgcggattacttcggccgcaagatgtctgtcgcacttggatcggccatcatgattgtcgcgagcgttatccaagcggcaaccgtcggccgctgggccttctttggaacgagaatcgcgatgggtatcgggctgggctttgcacagacagctgccccgccgctgactactgagatagctcatccgcggcatcgtggcgttgtgacggccatttttcaggctacgtggtactggggtgctatcctagctgctgcggtgtgcttggccactctttatgtggagggaagtacttggtcctggcggattccatgccttgtccaatgtttcttccctgctgttcagttgctaggactactcatcgttccagaaagcccgaggtggctcgtgtcgaaggacaggcgagacgaggccttgcaaatcctcgcccgctaccatgggaattgtgacacgtcagatccattggttcagttcgagttttctgagatctgcagtgcgatcgagctagaaaactcagtcgcccataagagtggttggtctgcgttcattgcaaccaagggagctcggcatcgccttgcaatttgtctgttggtcggggttatgatccagtgggcaggcaatggtgtcatttcctactatcttgcaccgatccttcgatccgtcggcattaccaatcctacgcagcaatccgccatcaacctgggcctgcaggcgtggaacgcagtctgcgccgcgggaggcgccgtcgctgcagagaaatacggccgacgccctctctggatgctctccactgtacttatgctcctattctttaccctggcgactgtcctttctgccgtctttgacgaatcagccataaaagctgctggtagtgcggttgtcgcattcctctatctgttctacggcgcgtacgatatcgcctataccccgctctcaattgcataccctgtcgagatcatgccattctacctgcgcaccaagggcttatcgttaagcttaacggcgcagtttggggcgggcttcttcaaccagttcgtcaaccccatcgctcttggtgcgataaaatggaagttttatttcgtgtaccttggtctgttggttatctttttgggcattgtttactttgtgtttccggagacaaagggccacaccctggaggagatcgctgtcatcttcgacggtcctggggcagagacggaggtacagcgggatctggccgctatcattgcggtggagagggaggtaaaggctcctatgaaggaggagttggaacacgctccgtag

SEQ ID NO: 362 - protein, 513 aa, Aspergillus parasiticus
MVAGGGIVSSSGMDAYRALPNNTNSNWFKDKGLRRLNFGLMLMFASAAANGYDGALMNGLLTLPMCEFPLSSCPHLWRMFTFIPASYFADYFGRKMSVALGSAIMIVASVIQAATVGRWAFFGTRIAMGIGLGFAQTAAPPLTTEIAHPRHRGVVTAIFQATWYWGAILAAAVCLATLYVEGSTWSWRIPCLVQCFFPAVQLLGLLIVPESPRWLVSKDRRDEALQILARYHGNCDTSDPLVQFEFSEICSAIELENSVAHKSGWSAFIATKGARHRLAICLLVGVMIQWAGNGVISYYLAPILRSVGITNPTQQSAINLGLQAWNAVCAAGGAVAAEKYGRRPLWMLSTVLMLLFFTLATVLSAVFDESAIKAAGSAVVAFLYLFYGAYDIAYTPLSIAYPVEIMPFYLRTKGLSLSLTAQFGAGFFNQFVNPIALGAIKWKFYFVYLGLLVIFLGIVYFVFPETKGHTLEEIAVIFDGPGAETEVQRDLAAIIAVEREVKAPMKEELEHAP

SEQ ID NO: 363 - DNA, 1548 bp, Oryza sativa
  CDS (1)..(1548)
atgtctggaggtggatcaattgccaacgatggtgaagaggccgccggcggcggcggcggcggccgtggcgaggtgacatttacagttgtgatgagctgcctcacggcgggcgccggcgggctcttgcttgggtacgacatcggtgttacaggcggggtgacgcagatggaatcgttcctgcaggcgttcttcccggaggtcctgcggaagatgtccagcgcgaagcaggacgcgtactgcatcttcgacagccaggtgctcaacgccttcgtctcctccttctacctctccaccatggtcgccagccttgtcgccggccacctaaccaagacgctggggaggaggaactcgctgctgatcgccggcgtgctcttcttcgccggcaccctcctcaacctggccgccgtgaacatcagcatgctcatcatcggccgcatcctcctcggcgtcgccgtcggcttcagtagcttggctgcaccggtgtacctagcggagatagcgccggcgcggtggcgcggcgcgttcacggcctccataggcctcttcggcaacttgggtttcttgatggctgacatgatcaactaccgcgccactaccatggcgaggtggggttggcgcctctctctcggcgccggcatcgtcccggccgtcatcgtcatcgtgggcgccgcgttcatcccggacacgcccaacagcctcgcgctgcgcgggaggctcgacgaggcccgagactcgctgcggcgcatccgcggggccgccgatgtggacgccgagctcaaggacatcgtccgcgctgccgaggaggaccggaggtacaagtcgggcgcgctgcggcggcttctccgtcgcgagtaccggccgcacctggtgatggccgtgctaatcatggtgttcttcgagatgacgggagccatcgtggtggccatcttcacgccgctcctcttctacaccgtcgggttcacgagccagaaggccatcctcgggtccatcatcaccgacgtcgtcagcatcgtctccgtcgctgccgccgcggccgtggtcgaccgccacgggcggcgtagactcttcatggtgggcggtgccgtactgatcctgtgccaggtggccatggcgtggatcttcggcgcgcagctgggcgctgacggtgggagggcgatgccgcgggggtacgccgtcgcggtggtggcgctcgtgtgcacgtacacggcggggctaagcgtgtcgtggggctcgctgtcgtcggtggtcaccagcgagatcttcccgctggaggtgaggtcggcggcgctggggctgggcggcaccatctcgtcggcgctcacgttcatgcagtcgcagtcattcttggagatgctgtgcagcttcaagtacggcgccttcgcctactacgccggatggttggtgatgatgacggcgttcgtggcggcgttcctgccggagacgaagggggtgccgatcgagtccatgggcgcggtgtgggcgcagcattggtactggaagcgctttgtcaagctggcaccggccaagcaggccgatgggccagaatga

SEQ ID NO: 364 - protein, 515 aa, Oryza sativa
MSGGGSIANDGEEAAGGGGGGRGEVTFTVVMSCLTAGAGGLLLGYDIGVTGGVTQMESFLQAFFPEVLRKMSSAKQDAYCIFDSQVLNAFVSSFYLSTMVASLVAGHLTKTLGRRNSLLIAGVLFFAGTLLNLAAVNISMLIIGRILLGVAVGFSSLAAPVYLAEIAPARWRGAFTASIGLFGNLGFLMADMINYRATTMARWGWRLSLGAGIVPAVIVIVGAAFIPDTPNSLALRGRLDEARDSLRRIRGAADVDAELKDIVRAAEEDRRYKSGALRRLLRREYRPHLVMAVLIMVFFEMTGAIVVAIFTPLLFYTVGFTSQKAILGSIITDVVSIVSVAAAAAVVDRHGRRRLFMVGGAVLILCQVAMAWIFGAQLGADGGRAMPRGYAVAVVALVCTYTAGLSVSWGSLSSVVTSEIFPLEVRSAALGLGGTISSALTFMQSQSFLEMLCSFKYGAFAYYAGWLVMMTAFVAAFLPETKGVPIESMGAVWAQHWYWKRFVKLAPAKQADGPE

SEQ ID NO: 365 - DNA, 1584 bp, Oryza sativa
  CDS (1)..(1584)
atggccagagggggagcgatggtcgcggcggcggatgccggcgccggcgccggcgtggcgcccgggtacagcagcgagatcacgttcaccgtggtgatgagctgcctcatggcggcctccggcgggctcattttcggctacgacatcagcatcacaggtggactgacgcagatgcagtcgttcctcgaggcgttcttcccagacatctgggcgaagatgaacaacgccgagcaggacgcgtactgcatcttcgacagccaggtgctcaccaccttcgtctcctcgctctacctcgccggcgttttcgcctgcctcatcgccggccacgtcacccggagggtgggccggaggaactccatgctcatcggcgcctctctcttcttcgtcggcgccatcctcaactgcgccgccgtcaacatcgccatgctcgtcatcggccgcatcctcctcggcttcgccgtcggcttcaccaaccagtctgcgccggtgtacctggcggagatagctccggcgcggtggcgcggggcgttcacgagcatcttccacttcttcctcaacgtggggatgttcgtggccgacctggtgaactaccgcgccaacaccatcccggtctggggctggcggctgtcgctcggcgtcgccgtcgtcccggccgccgtcatcctggtgggcgccgcgttcatcccggacacgcccaacagcctcgtcctgcgcgggaagctcgacgaggcccgcgcctcgctgcgccgcatccgcggagccgccgccaacatcgacgccgagctcaaggacatcgcccgcgccgcggaggaggaccggcagcaccacaccggcgcgttccggcgcatcgtgcggcgggagtaccgcccgcacctggtgatggcgatcgccatcccggtgttcttcgagctgacggggatgatcgtggtgacgctgttcacgccgctgctgttctacacggtggggttctcgagccagaaggccatcctggggtccatcatcaccgacgtggtgagcctggcgtccatcgcggcggcggcgctgaccgtggacaggtacgggcggcggacgctgttcatggtgggcggcggcgtgctgctggtgtgcctgacgggcatggcgtggacgtacggggcgcggctggggagcgacggcgggaaggcgatgccgcgcgggtacgcggtggcggtggtggcgctggtgtgcctgtacgacgccgggttcggcatctcgtgggggcccctcaagtggatcatccccagcgagatcttcccgctggaggtgaggtcggcggggcagagcatgagcgaggccatctcgctggcgctcaccttcgcgcagacacagtcgttcctccggatgctgtgcagcttcaagttcggcgccttcgcgtacaacgccgcgtgggtggtggtcatgacggcgttcgtggcgctcctcctgccggagaccaagggggtgcccatcgagtcgctcggcgcggtgtgggcgcagcactggtactggaagcgcttcgtcaagccgccgccgccgccgccatcgacggcggcggagaccaagcaggcggacggggctccggcatga

SEQ ID NO: 366 - protein, 527 aa, Oryza sativa
MARGGAMVAAADAGAGAGVAPGYSSEITFTVVMSCLMAASGGLIFGYDISITGGLTQMQSFLEAFFPDIWAKMNNAEQDAYCIFDSQVLTTFVSSLYLAGVFACLIAGHVTRRVGRRNSMLIGASLFFVGAILNCAAVNIAMLVIGRILLGFAVGFTNQSAPVYLAEIAPARWRGAFTSIFHFFLNVGMFVADLVNYRANTIPVWGWRLSLGVAVVPAAVILVGAAFIPDTPNSLVLRGKLDEARASLRRIRGAAANIDAELKDIARAAEEDRQHHTGAFRRIVRREYRPHLVMAIAIPVFFELTGMIVVTLFTPLLFYTVGFSSQKAILGSIITDVVSLASIAAAALTVDRYGRRTLFMVGGGVLLVCLTGMAWTYGARLGSDGGKAMPRGYAVAVVALVCLYDAGFGISWGPLKWIIPSEIFPLEVRSAGQSMSEAISLALTFAQTQSFLRMLCSFKFGAFAYNAAWVVVMTAFVALLLPETKGVPIESLGAVWAQHWYWKRFVKPPPPPPSTAAETKQADGAPA

SEQ ID NO: 367 - DNA, 1536 bp, Oryza sativa
  CDS (1)..(1536)
atgccggaatccaccaagctcacggccatggctgtcgaccccaagaagaagaacgccagctatgcattcacctgcgccatcctcgcctccatggcctccatcattctcggctatgacatcggggtgatgagcggcgcatcgctgtacatcaagaaagacctgaagatcactgacgtgcaggtggagatcctgatgggcatcctgaacatctactcgctcgtcggctccttcgccgcggggaggacggcggactggatcggccggcggttcaccgtcgtcttcgctgccgccttcttcttcgccagagctctactcatggggttctccggtgactacgccactctcatggtcggccgcttcgtggcgggcgtcggcgtggggtacgcgatcatgatcgcgcccgtgtacacggccgagatctcgccggcgtcgtcgcgtggcttcctcacgtcgttcccggaggtctccatcaacctcggtatcctcctcggctacgtctccaactatgctttcgcgcgcctgccgctctccctcgggtggcgcgtcatgctcggcgtcggcgcggcgccatccgtgctgctcgcgctcatggtgctcggcatgccggagtcgccacggtggcttgtcatgaagggtcgcctcgccgacgccaaggctgtgctggagaagatcgctgacacgccggaggaggcgtcggagcggctcgctgacatcaaggcggcggctggcatcccagatgacctcgacggcgacgtggtcaccgtgtccaagaagagaggcggcgaggaggggcaggtttggagggagctcgtcgtgtccccgaccccggccatgcggcgaatcgtgctcgcggcggtcggcctccacttcttccagcaggcgtcgggcgtcgactccgtcgtgctctacagcccgcgcgtgttccagagcgcgggcatcaccggcgacgaccagctcctgggcaccacctgcgccgtcggcttcgccaagacggtcttcatcctggtcgccgcgttcctgctcgaccgcgccggccggcggccgctgctgctgaccagcacgggcgggatggtcttctccctcgtcggcctcgcgacggggctcaccgtcgtgggcggcagcccggacgcccaggtgcccagctgggccgtcggcctgtgcgtcgcgtccatcctggcctacgtcgccttcttctccgtcggcctcgggcccatgtccggcgtgtacacctcggagatcttcccgctgcgggcgcgcgcgctgggcttcgcggtcgccgtggcgtgcaaccgcgtcaccagcggcgtcatctccatgaccttcctgtcgctctccagcgccatcaccatcggcggcagcttcttcctctacgccgccatctcgtcgctcgcgtgggtgttcttcttcactcgcctcccggagacgcgcggccagacgctggaggagatcggcaaggtgttcggcatggacgacacggccatggaagcagaggactccgccgcgtacagggaaagactcttggcaacttctccatga

SEQ ID NO: 368 - protein, 511 aa, Oryza sativa
MPESTKLTAMAVDPKKKNASYAFTCAILASMASIILGYDIGVMSGASLYIKKDLKITDVQVEILMGILNIYSLVGSFAAGRTADWIGRRFTVVFAAAFFFARALLMGFSGDYATLMVGRFVAGVGVGYAIMIAPVYTAEISPASSRGFLTSFPEVSINLGILLGYVSNYAFARLPLSLGWRVMLGVGAAPSVLLALMVLGMPESPRWLVMKGRLADAKAVLEKIADTPEEASERLADIKAAAGIPDDLDGDVVTVSKKRGGEEGQVWRELVVSPTPAMRRIVLAAVGLHFFQQASGVDSVVLYSPRVFQSAGITGDDQLLGTTCAVGFAKTVFILVAAFLLDRAGRRPLLLTSTGGMVFSLVGLATGLTVVGGSPDAQVPSWAVGLCVASILAYVAFFSVGLGPMSGVYTSEIFPLRARALGFAVAVACNRVTSGVISMTFLSLSSAITIGGSFFLYAAISSLAWVFFFTRLPETRGQTLEEIGKVFGMDDTAMEAEDSAAYRERLLATSP

SEQ ID NO: 369 - DNA, 1891 bp, Plantago major
  CDS (146)..(1738)
ttccaagtctccaagctaattgagacttgtccaaagttcaatttcactagccaaacacacaagtaggctcacacttttacaacctcatcatatatccactaatttggccttcaattttatcacacttgttgaaaccctaaccatcatgaatagtgaacaccataactccggtggccttgcttctttttcggttgatgctggtaagtctcaaaagccagacgcggcgtcagttctcgacactcttcctaagaagccggtgacgaggaacaaatatgctttggccatttctattctggcttcaatgacttctgtcttgcttggatatgatacgggagtgatgagtggagctacactatacatcaaggacgacttgaaaatctcggacgtccaagtggagctcctagtcgggaccattaacatctactcccttgtgggctctgcagtcgcgggtcggacctccgactgggtgggacggcgctacactaccgtatttgcctccgtggtcttctttgtaggcgcgatcctcatgggaatcgcaacaaactatgtttttctcatggcgggaaggttcgtagccggtataggagtcggatatgcccttatgattgcgcctgtgtatgcagcggaggtagctcccgcatcttgccgtggcttcctcacctccttccctgaagtcttcatcaattttggagttctacttggttttgtatcaaactatgcgttcgcgaagtttcctcttaagctaggatggcgaatgatgctaggagtaggagcaattccagcggtcttcctagccatcggggtaatatacatgcctgaatcccctcgttggctagtcttacaaggccgccttggtgacgcaagaagggtgctagacaaaacgtctgactcactcgaagaatcaaagcttaggcttgcggatatcaaagaggctgcaggaataccggaagactgtaatgatgattttgttcaggtccagaaacactcccagggccagggggtgtggagagagcttctcctccatcccacaaaaccggttcttcacatccttatttgtggtgttggcatccacttctttcagcagggtatcggtatcgactcagtggtgttgtacagtcccagaatctacgatagagctgggatcacggacacttcagataagttgcttgcgaccattgccgttgggattagcaagacgttcttcattttgatcaccacattctatgttgacaggttcggtcgtcgctttctgctactcgtaagttgtgctggggttgctttgagcatgttcgccctaggaactgtcttaacaataattgaccgcaatccggatgcaaagcaaaccggcgtcttggttttggtggtgctcttgacgatggtgatagtgggattcttctcaatgggattgggacctatagcgtgggtgtacagctctgagattttccccctaaaacttagggcacagggttgcggcttaggagtggcgatgaaccggttcatgagtggtgtgatcttgatgtcatttatatcgttgtacaaagagataacaattggcgggtcattcttcttgtttggtggtattacgacactcgggtggattttcttcttcacattgtttccggagactcgagggaggacgttggaggaaatggagggtctctttggaactttcttcaaatggaggactacaatgaaagagttggacgccaagaagaggagtggtactgatggtgcctaagtatttagtagtgagttacattttttcttgttgactgttatagttctttattcataattagttatatgtaatatgaaaagctatgagagttgatatctcttcgtgtaatctttgatcgttttggtaataatacaaattataaaaaaaaaaaaa

SEQ ID NO: 370 - protein, 530 aa, Plantago major
MNSEHHNSGGLASFSVDAGKSQKPDAASVLDTLPKKPVTRNKYALAISILASMTSVLLGYDTGVMSGATLYIKDDLKISDVQVELLVGTINIYSLVGSAVAGRTSDWVGRRYTTVFASVVFFVGAILMGIATNYVFLMAGRFVAGIGVGYALMIAPVYAAEVAPASCRGFLTSFPEVFINFGVLLGFVSNYAFAKFPLKLGWRMMLGVGAIPAVFLAIGVIYMPESPRWLVLQGRLGDARRVLDKTSDSLEESKLRLADIKEAAGIPEDCNDDFVQVQKHSQGQGVWRELLLHPTKPVLHILICGVGIHFFQQGIGIDSVVLYSPRIYDRAGITDTSDKLLATIAVGISKTFFILITTFYVDRFGRRFLLLVSCAGVALSMFALGTVLTIIDRNPDAKQTGVLVLVVLLTMVIVGFFSMGLGPIAWVYSSEIFPLKLRAQGCGLGVAMNRFMSGVILMSFISLYKEITIGGSFFLFGGITTLGWIFFFTLFPETRGRTLEEMEGLFGTFFKWRTTMKELDAKKRSGTDGA

SEQ ID NO: 371 - DNA, 1987 bp, Plantago major
  CDS (116)..(1705)
ccagatgttccaataaaactctctctttctcaaagtctttctcgcaagtcttcttaataacactttcacttataagctagctagtcaattaaaccaacactacttgttttcaactatgactgctgatcaccagaagtcaagtgttgcttcttttgccgtctcctccggtgatgccggaaagctcggcttgtcgtcgactctcgacacactccctaagaagccccttaagaggaacaagtatgctttagccatctccattcttgcttccatgacctctgtcttgcttggatacgattgtggagtgatgagcggagctacacaattcatacaagaagatctgataatcactgacgtccaagtggaactcctggtggggaccatcaatatttactccctagtcgggtctgcggtggctggtcgaacttccgactgggtagggaggcgctacactatcgtgttcgcatccacgatattcttcctaggcgcgatccttatggggttcgcgaccaactacgcgttcctaatggtgggtaggttcgtagccggtattggggttggatacgcgcttatgatcgccccagtttatgcagccgaggtggctccggcttcgtgtcgtggttttctcacgtcattccctgaagtgttcatcaattttggtgtactacttggctatgtatcaaactttgcttttgccaaacttcctctcacgctaggatggagaatgatgctcggagtcggagccgttccgtctgtcctcctcggtgtcggtgtgctttacatgccagagtcccctcgttggctcgtcttacaaggtcgcctgggggatgcaaagaaagtgttggacaaaacatccgactccctcgaagaatcgaaactaaggctcgctgacatcaaagaggctgccggagtacccttagactgccatgacgagattgttcaggtccaaaaacgatcccaggggcaaggcgtgtggaaagagctcctcctccacccgacaaaaccggttcttcacatccttatatgtggcgttggcattcacttcttccagcagggtattggtatcgactcagtggtgctgtacagcccaaggatctacgagaaagccgggatcaagaacacttctgacaagttgcttgccacaattgccgtcggggtcagcaagaccttcttcatattgatcactaccttctttgttgacaggttcggacgtcgtccattgctactcacaagttgtgccggtgttgccttgtccatgttcgccctcggcaccagcctgaccataatagaccgcaatcccgacggcaacattaaaggtctcttgattttcgctgttatcctgacaatggcaatagtcggtttcttctcgatgggattgggacctatcgcgtgggtgtacagctccgagatcttcccgctgaagctcagggctcaaggatgcagtatgggagtcgcaatgaataggttcatgagtggtgtgatactcatgtcattcatatcgctctacaaggccataacaattggcggcgcgttcttcttgttcggtggtataacaaccgtggcgtttatcttcttctacaccctgtttccggagacacagggaaggactttggaggaaatggaggagcttttcggcactttcttcagctggaggactagaatgaaagagctggacgccaagaagaagactggttctgaagctacctaagtcatcttatgtgctgaatttatcctagttttctccatcttatgaggagaaaaacaatgagatggtagatggatcctctttagttctgaagatgtaataagactctgatgatactctctagtctctacaatgcctatctgttacaggagattcgaacataaatgtatcaataacttgcataagacaaatcgttatctaagatctttagtaatatcaggttaacatctaacctgtttgctatgtatgtaacaaatgtttgctgtatacgttaatgatttttcg

SEQ ID NO: 372 - protein, 529 aa, Plantago major
MTADHQKSSVASFAVSSGDAGKLGLSSTLDTLPKKPLKRNKYALAISILASMTSVLLGYDCGVMSGATQFIQEDLIITDVQVELLVGTINIYSLVGSAVAGRTSDWVGRRYTIVFASTIFFLGAILMGFATNYAFLMVGRFVAGIGVGYALMIAPVYAAEVAPASCRGFLTSFPEVFINFGVLLGYVSNFAFAKLPLTLGWRMMLGVGAVPSVLLGVGVLYMPESPRWLVLQGRLGDAKKVLDKTSDSLEESKLRLADIKEAAGVPLDCHDEIVQVQKRSQGQGVWKELLLHPTKPVLHILICGVGIHFFQQGIGIDSVVLYSPRIYEKAGIKNTSDKLLATIAVGVSKTFFILITTFFVDRFGRRPLLLTSCAGVALSMFALGTSLTIIDRNPDGNIKGLLIFAVILTMAIVGFFSMGLGPIAWVYSSEIFPLKLRAQGCSMGVAMNRFMSGVILMSFISLYKAITIGGAFFLFGGITTVAFIFFYTLFPETQGRTLEEMEELFGTFFSWRTRMKELDAKKKTGSEAT

SEQ ID NO: 373 - DNA, 1677 bp, Ashbya gossypii
  CDS (1)..(1677)
atgcaggcaacaacatctgcttccacggatgtggatgcatataaaaaggacatcaccgtcagacggcgtagccagccatgcagcagttccagcgggagcttgaaagtgatgaatactgagaccaaagcgatggatacccggtcggtcctggagttgaaggagaaggaggagtacggcgtgtatgaggctgcgggatcgactgacagatccatctctctctccggggccagcccggtgccggaggggtctctggtacggcctgtgctgtactgcctgtctgttgccttctgtgggattatcttcgggtgggatctcggcacaatcgggggtatttcgacgatgccctcgttccaaaacacactgggcccccggttcaacggggataccgggctgcacgagtttccgggtagattgctggggctgttgatcgggattttcaacattggatgtgcaattggcggtctgacgattgccaggctaggcgacattaagggcagaaaaatagcaattctcacatcgctgcttgtgtatgccgtcggaatgttcgtccaactgggatccggacacttttggtaccgctattttattggcagactgatagctggacttgcagtgggcgctactatggtgctggtaccaatgtttttgtctgagttggctccggtgcggatccggggcgcgatgattgtcttataccaggtggtgatctgtctgggtatcgctctgggcagcatagtgaactatgcttgtaaggagctggtccacgacacgctgtcgaacatgacgtggaaggtgccgattttcttccagattgggtttaccgttcttctctcgctggctttgctgatcacgccagagtcagcggagttccttgccatgaagggccacttggaaaaggccaagcgctccttcgcggtgatgaacggtttgtcaaaggatcatccgttcgttgaggagcgggtcgcgtccttcgttcaagtcagtatgaagtctgacgacattgagcattccggtgacagatgggagttcatcagaggtaatcctcgtctaggtctccgtctatttattggtgtgactgttatggctctacagatgttgtctggtgtgaactactttttctactacgggacaacattgttcagatttgtgggtattgaagatgcctatgtcacgtctatcatcattggctgcgttgacttgctgggtacctttattggtgtttacatcgtcgaaagacttggccggaagatctgcttgttatccggtgcaacaggtatgttcatctgtatgacagtctacgcgtgtcttggttcttttgctttgaaagatgattcgaacaacaagacagtaggtgcagtgatgatcttcttcacctgtgttttcgttatgttctttgctgctacctctgggccagtatccatggtggtaatgtctgaaatcttccccatcaggacgaaggttatgtctatggctatctgtacctccgtgaactggttggtcaactttttgattgcatttgtgacgccagatgtcactgatgcaattaattatcgtttcgggtttgtcttctccggctgcctattattctcgatagtgtttttcatctacttggtccctgagaccaaggggttgacacatgaacaggtggatgccatttacgagaaaacccatgactaa

SEQ ID NO: 374 - protein, 558 aa, Ashbya gossypii
MQATTSASTDVDAYKKDITVRRRSQPCSSSSGSLKVMNTETKAMDTRSVLELKEKEEYGVYEAAGSTDRSISLSGASPVPEGSLVRPVLYCLSVAFCGIIFGWDLGTIGGISTMPSFQNTLGPRFNGDTGLHEFPGRLLGLLIGIFNIGCAIGGLTIARLGDIKGRKIAILTSLLVYAVGMFVQLGSGHFWYRYFIGRLIAGLAVGATMVLVPMFLSELAPVRIRGAMIVLYQVVICLGIALGSIVNYACKELVHDTLSNMTWKVPIFFQIGFTVLLSLALLITPESAEFLAMKGHLEKAKRSFAVMNGLSKDHPFVEERVASFVQVSMKSDDIEHSGDRWEFIRGNPRLGLRLFIGVTVMALQMLSGVNYFFYYGTTLFRFVGIEDAYVTSIIIGCVDLLGTFIGVYIVERLGRKICLLSGATGMFICMTVYACLGSFALKDDSNNKTVGAVMIFFTCVFVMFFAATSGPVSMVVMSEIFPIRTKVMSMAICTSVNWLVNFLIAFVTPDVTDAINYRFGFVFSGCLLFSIVFFIYLVPETKGLTHEQVDAIYEKTHD

SEQ ID NO: 375 - DNA, 1608 bp, Ashbya gossypii
  CDS (1)..(1608)
atgaccgtttctgaaggtatgacgccgtctaaaagcgagctctcgggagatggttcgaattcgcatcccattgagagcaagaaagatattgtatcggtaatctcgacagagacaaagccattttcagcttatatctttgcgtgcttatgctgcttcatggttgcattcggtggctttatttttggatgggataccggtacgatttctggcttcgtcaaacaaacagatttcatagcgcgttttggccagctgagcccgagtggagagtatgaactcagtgatgacaggactggattgattgtctcgatctttaacattggttgtgctgttggtggtatattcttatccaagattggtgatgcctatgggcgtaaaatcggtcttgcgactgtgacggcagtttatgtcatcgggatagttatccaaatcagcgcaagtgacaagtggtaccaatatttcgttggtagaatcatttcaggtttaggtgtgggtggtattgccgttctttcgcccatgttgatctctgagacctccccaaagcacttgagaggctctcttgtgtcatgttaccaacttatgattaccgcgggtatctttctcggatactgcacgaattatggaacaaaaaccaattacactgactccagacaatggagaattccattggggttgggttttgcctgggctctcctaatgattggaggcatggccttcgttccggagtccccacgttacttggtggaggccgaaaacctacccaaggcccggatgtctattgcgagggccaacaaggttgcagaagaccaccctatcgtcgagcatgagctaaatactttgcagactgcaatcgagcttgaaaagctagcgggtaaggctcggatcgttgacctgtttaacgttaaaaagaagattttccaacggttgattattggtatttttatccagtctttgcagcaacttattggtaacaactatttcttctactacgggaccaccatatttaacgctgtcggaatggacgatccgttcgtcacgtcgattgtgctgggtatcgtgaactttggctcaacctttttctctctgtacaccgttgacaaatttggcagaagaaagtgtttgatatggggcgcctttgccatggctatttgtatggcaatttttgcttccgttggcgtcacgaagttgtggccaaatggcgaggatcaaccatcctccaagccagcaggtaacgttatgattgtcttcacctgcatttacatcttcttcttcgccaccacctgggctccgattgcctatgttatcatttccgagatatacccacttagagtgaaggctagagctatggcgcttgcaacagctgcaaactggatatggggtttcttgattgccttctttaccccacgaatcaccagtgccatcaagttttgctacggctacgtctttatgggctgtctgatcttcgctttcttctacatcttcttcttcgtcccagaaacgaagggcctgacattggaggatgtcgacgagatgtggcaagagggtgtggtgccgtgggggtccgagagctggctacctcgtagcgacagggaagttgcccacgacgcctaa

SEQ ID NO: 376 - protein, 535 aa, Ashbya gossypii
MTVSEGMTPSKSELSGDGSNSHPIESKKDIVSVISTETKPFSAYIFACLCCFMVAFGGFIFGWDTGTISGFVKQTDFIARFGQLSPSGEYELSDDRTGLIVSIFNIGCAVGGIFLSKIGDAYGRKIGLATVTAVYVIGIVIQISASDKWYQYFVGRIISGLGVGGIAVLSPMLISETSPKHLRGSLVSCYQLMITAGIFLGYCTNYGTKTNYTDSRQWRIPLGLGFAWALLMIGGMAFVPESPRYLVEAENLPKARMSIARANKVAEDHPIVEHELNTLQTAIELEKLAGKARIVDLFNVKKKIFQRLIIGIFIQSLQQLIGNNYFFYYGTTIFNAVGMDDPFVTSIVLGIVNFGSTFFSLYTVDKFGRRKCLIWGAFAMAICMAIFASVGVTKLWPNGEDQPSSKPAGNVMIVFTCIYIFFFATTWAPIAYVIISEIYPLRVKARAMALATAANWIWGFLIAFFTPRITSAIKFCYGYVFMGCLIFAFFYIFFFVPETKGLTLEDVDEMWQEGVVPWGSESWLPRSDREVAHDA

SEQ ID NO: 377 - DNA, 1641 bp, Ashbya gossypii
  CDS (1)..(1641)
atgtctgcagcaattgcacaacctgacaaccgctccgtgatgagcacacattcgtctacagcatcgaacaagccttcgaaagaagagaacaaggagtctggcctagttgagatcccagtgaagcctgcctccgcctatattacggtgtctttgttgtgtatcctagttgcatttggtggtttcatctttggatgggatacaggtacgatttctggtttcgtgaaccagtccgattacaagaatcgctttggtgaattgaatgagagtggtgactactacctatctgacaacagaactggcctgattgtggctatcttcaacattggttgtgccgttggtggtattttcttgtctaagtttgctgatatgtacggccgtcgtatcgggttgatgattgttaccctagtctacgttattggtatcgttgtccagataagttccaccgacaaatggtaccaatactgtattggcagagtcatctctggtctaggtgttggtggtattgctgttttgtcgccaatgttgatctccgagacctctccaaagcacttgagaggcatgttggtttcttgctatcaattgatgattactgctggtatctttgtcggttactgcgccaactacggtacaaaagccaaatatgaagactcgaagcaatggagaatcccattgggtctttcttttgcgtgggctatccttatgatcggaggtatggtcctcgttccagagtctcctcgttacttggtcgaggtcaacaaatatgaggatgctaagagatctctagccagatccaacaaggttcctgtggacgacccatcgatccaagctgagtttgacaacatccatgctggtattgagttggagagaatggcaggttccgcttcttggggtgagctattctctactaagagcaagattctacagcgtgttattatgggtgttatgatccaatctctacagcagctaactggtaacaactacttcttctactacggtactactattttcaagtctgtcggtttggaggattctttccagacctcgatcatcttgggtgctgtgaacttcggttccacctttgttgctgtctgggctgtcggtaaatttggcagaagacggctgatgctagccggtgccgcggctatgactgtctgtatggtgatcttcgcttctattggtgtgactaagttgtggcctaacggggaggaccagccttcatctaagccagctggtaacgtcatgatcgtcttcacctgtatctacattttctgcttcgcgactacctgggcaccaattccgttcgtcatcgtttcggagactttcccattgagagtcaaggccaagggtatggctattgccacagccgcgaactggatctggggtttcttgatcgccttcttcactcctaagatcaccaacgccatcaagttcaactacggctacgtgttcatgggctgcttgatcttcgccttcttctacatgttcttctttgtcccagagacaaagggtttgactttggaagaggtcgaggagatgtggcaggagggtgtcgtcccatggaagtccgagtcctggactccttcctacaagagaaatgcttacgagactgaggaggtgaagccagagaagacctgggcttaa

SEQ ID NO: 378 - protein, 546 aa, Ashbya gossypii
MSAAIAQPDNRSVMSTHSSTASNKPSKEENKESGLVEIPVKPASAYITVSLLCILVAFGGFIFGWDTGTISGFVNQSDYKNRFGELNESGDYYLSDNRTGLIVAIFNIGCAVGGIFLSKFADMYGRRIGLMIVTLVYVIGIVVQISSTDKWYQYCIGRVISGLGVGGIAVLSPMLISETSPKHLRGMLVSCYQLMITAGIFVGYCANYGTKAKYEDSKQWRIPLGLSFAWAILMIGGMVLVPESPRYLVEVNKYEDAKRSLARSNKVPVDDPSIQAEFDNIHAGIELERMAGSASWGELFSTKSKILQRVIMGVMIQSLQQLTGNNYFFYYGTTIFKSVGLEDSFQTSIILGAVNFGSTFVAVWAVGKFGRRRLMLAGAAAMTVCMVIFASIGVTKLWPNGEDQPSSKPAGNVMIVFTCIYIFCFATTWAPIPFVIVSETFPLRVKAKGMAIATAANWIWGFLIAFFTPKITNAIKFNYGYVFMGCLIFAFFYMFFFVPETKGLTLEEVEEMWQEGVVPWKSESWTPSYKRNAYETEEVKPEKTWA

SEQ ID NO: 379 - DNA, 1620 bp, Ashbya gossypii
  CDS (1)..(1620)
atgagccgtcaggttttacacagtgatatgcggtccgtgggtacagaggtatccgcggcatcgcaaaagaagtatttgatggaagaaacagtcgacataccaacaaaaccggctacggcatacattacagtttgtttgctctgtgtatttgttgcatttggtggctttatttttggctgggataccggtaccatttctggttttgtcaatcagacagactttaggcggcgttttgcccaagtgaatgatgaaggcggatactactggtccaatgccagagttggtcttattgttgcgatctttaatattggctgcgcagttggcggtatcattctatccaggttgggcgatatgtatggacgccgcattggcttgatgatcgttagtctcatttatgtggttggtataattattcaaatttcatccaacactaaatggtatcaatactgtattggcagagtcatctctggtctaggtgttggtggtattgctgtgttgtcgcctatgttgatttcagagacatcgccaaaacatttgagagggacactagtttcatgttaccagttaatgattacggccggtatattattaggctattgcgcgaactacggtacgaaaagcagatacgatgactcaaggcaatggcggattcctttggggctctgctttttgtgggctatattcatgattactggtatggcgttcgtgccagaatcccctcgttatttgatcgaaaaagataaaattgaagaggctaaaagatctctagcaacatcaaataaagttccggtagatgatccggctattctggcagaagtcaataacatccaagctggtgtggagttagaaagaatggcaggttccgcttcctggggtgaattattcaccgtccgcaccaagattctccaacgagtgatcatgggtgctatgatacagtcgttacaacaacttacaggtaacaattatttcttctactacggtaccacgatttttgattccgtcggtttggaggatgcgttcaagacatccatcattttaggtgccgtaaactttggttccacctttgtggcaatgtacactgtcgatagatttggcaggaggaaatgtttgctctacggtgccgcggcaatggccgtttgtatggttatttttgcctccgttggtgtgacaagactatggcccaatggacccgatcagccttcttccagaccggcaggcaatgctatgattgtttttacctgcctctacattttcttctttgcaactacctgggccccaattgcgtatgtcattgtttcggagactttcccattaagagtcaaagccaagggcatggctatcgccacagccgcgaattggatatggggctttttgatcgccttctttacaccatacattaccaatgcgatcaggttttactacggctacgtgttcatgggttgtttgatctttgcgttcttctacatcttcttctttgtccccgagacaaagggtttgactttggaagaggtcgaggagatgtggcaggaaggtgtggtaccttggcgttcagaatcatgggtaccctctgcaaggcggcacgcgccgtactccagtgacaaacaagctgccggcatatga

SEQ ID NO: 380 - protein, 539 aa, Ashbya gossypii
MSRQVLHSDMRSVGTEVSAASQKKYLMEETVDIPTKPATAYITVCLLCVFVAFGGFIFGWDTGTISGFVNQTDFRRRFAQVNDEGGYYWSNARVGLIVAIFNIGCAVGGIILSRLGDMYGRRIGLMIVSLIYVVGIIIQISSNTKWYQYCIGRVISGLGVGGIAVLSPMLISETSPKHLRGTLVSCYQLMITAGILLGYCANYGTKSRYDDSRQWRIPLGLCFLWAIFMITGMAFVPESPRYLIEKDKIEEAKRSLATSNKVPVDDPAILAEVNNIQAGVELERMAGSASWGELFTVRTKILQRVIMGAMIQSLQQLTGNNYFFYYGTTIFDSVGLEDAFKTSIILGAVNFGSTFVAMYTVDRFGRRKCLLYGAAAMAVCMVIFASVGVTRLWPNGPDQPSSRPAGNAMIVFTCLYIFFFATTWAPIAYVIVSETFPLRVKAKGMAIATAANWIWGFLIAFFTPYITNAIRFYYGYVFMGCLIFAFFYIFFFVPETKGLTLEEVEEMWQEGVVPWRSESWVPSARRHAPYSSDKQAAGI

SEQ ID NO: 381 - DNA, 1644 bp, Ashbya gossypii
  CDS (1)..(1644)
atgacactggtggacaagcttttgctcagaaatattgaatacaagggcaccgcgtacgactactttcccaaggtctacaatgtgtacctggtggcggttgttgcgtgcatctcggggatgatgtttggctttgatatctcgtcgatgtcttcgatgcaggactttgagccctacaaggactactttaaacatccaaacgaactgacgcagggcggtatcacggcctcgatggctgctggttccctgttaggatccatcctttcgcccggtatctcggacgcttttggtcgtcgggtgtcattgcacatgtgttccagtctgtggattattggcgcggtgctgcaaactgcagcgcagaaccaggcgatgctttttgtggggcgcattgttgcggggcttggtgttggcttcgggtcatcggtcgcgccagtgtacactgctgaggtgtctccgccaaagatcagaggtgctgtgggaggtttgttccagctgtcggtcacggtcgggatcttggtcatgttcctgatcgggtacggatctgtgtcgttgaattcggtggcgtccttccgtgtggcgtggtcaatgcaactcgtgccaggcgtggtgttgctgttggccacattcctgcttcctgagtcacctcggtggctagctaaccatggccggtgggatgagaccactcttgttgtcgagaaagtcgggcgcagtgtcaatgtcagcgatgaagagctgcgcatacacatcaacgagatccgcgagcgcgtggccctggatgaaatggcccgcgatttcacttacgccgacctgttccgccgcaagacacaacgcaagattttcattggtatggctgcgcagatgtggcagcaactctgtggtatgaatgtgatgatgtactatattgtccatgtgttcaaaatggctggattctcgggcaatcagaacctggtctcttcgatagtgcagtatgtgctaaacgtgggcatgaccatcccctctctatttttggttgatcgtgcagggcgccggcctgtcttgatcatcggaggtgtgttgatgttcacctggctttacgctgtggccggaattcttgccacttattctgttcctcgccctaatggcgtggaaggcaacaccactgttcggattgagattccgcccgagaggagctccgcggccaaagctgtcattgtctgttcttatctgttcgtgtgttcctttgctcctacctggggtatcggtatctgggtgtactgcgcagagattttcaataacattgagcgtgcccgcggttcggctctgtgtacctctgtcaactgggccttcaactttgcccttgccatgtttgtgccaacggcgtttaagaatatcacttggaggacatacattatttttggcacattctctgtcgcgctgacgatccacgcattcctgtcgttccctgaaacaaagggtaagactctagaggaaattgacgaaatgtgggacgcccatattccggcctggcgcaccgccagttacaagcccgagcttgcccaaatggcagcgccaaaactttcttcaggcagcatttccgacgccacaggcgggcttcacgagaaaaaggcggctgccggcagccctggtgccagtgctggctcttcctag

SEQ ID NO: 382 - protein, 547 aa, Ashbya gossypii
MTLVDKLLLRNIEYKGTAYDYFPKVYNVYLVAVVACISGMMFGFDISSMSSMQDFEPYKDYFKHPNELTQGGITASMAAGSLLGSILSPGISDAFGRRVSLHMCSSLWIIGAVLQTAAQNQAMLFVGRIVAGLGVGFGSSVAPVYTAEVSPPKIRGAVGGLFQLSVTVGILVMFLIGYGSVSLNSVASFRVAWSMQLVPGVVLLLATFLLPESPRWLANHGRWDETTLVVEKVGRSVNVSDEELRIHINEIRERVALDEMARDFTYADLFRRKTQRKIFIGMAAQMWQQLCGMNVMMYYIVHVFKMAGFSGNQNLVSSIVQYVLNVGMTIPSLFLVDRAGRRPVLIIGGVLMFTWLYAVAGILATYSVPRPNGVEGNTTVRIEIPPERSSAAKAVIVCSYLFVCSFAPTWGIGIWVYCAEIFNNIERARGSALCTSVNWAFNFALAMFVPTAFKNITWRTYIIFGTFSVALTIHAFLSFPETKGKTLEEIDEMWDAHIPAWRTASYKPELAQMAAPKLSSGSISDATGGLHEKKAAAGSPGASAGSS

SEQ ID NO: 383 - DNA, 1995 bp, Ashbya gossypii
  CDS (1)..(1995)
atgctgaaaagtgttgagaagttaacacttccacaagtaatatcacagaggcttactttccactatcgactgaggcgcaagcctgaggagatagaggagaactgcatctcatccgagacctccgatgagaagcactcgaagggctgcaacgatcagaagaatgcaagccactatgagcagcctgtgatggtgaccgatttgagagatgattcagaagggttttccatccaggagaccgaactagaacggccagcgatgcgacagtctaataagatgtcaattctggtgggcatatttgttgcggtcggtggctttctatatgggtacgataccggcctcattaacagtatcaccgagatgagcttcgtcaagaagcattttgcacccaatcatgtcaactttacctcgatggagatgtccatacttgtctctttcctgtcacttgggaccttcattggtgcacttgcggccccgctgctggcagactcctacggaagaaaatcgactgtcatattcagtacattcataatgttcttggaaggcacgttgctgcaggtcagcgcaactagtatggcgcttctagtggcaggtcgtgttgcctccggggtggctgtgggactaatatctgtggttgtgccgttataccaaggcgaagcggcgcagaaatggtgtcgtggtgccattatctgtacatatcagtgggccataacctgggggttgcttgtctcgagcgctgtttctcagggcacatatctgaggaacgacgcctcgtcctacagaataccaattgcgctgcaatacgtgtggtgcatcattcttgggtcgggaatgcttctgctgccagagagcccacgttattacgtcctgagggaccagctggacaaggccgctctatccctgtccttcttgcgaggagtgccgcacgatgacgccggcctcctggaagaactggtagagatcaaggcgaactatgactatgagatgtcgttgaagtcatcttcgtatcttgactgttttcgaactagtgagcacagacccaagcagcaaattaggatgctttcagggattttgttgcaggcattccagcagttttcgggcatcaatttcattttctattacggggtcaacttcttcagcagcacaggcattagcaagagctatcttgtatcgttcgttacttacgccgtaaatgtcgtcttcaacatacccggtctatttctcgtcgagtatgctggccgccggaagctgcttctggtcggcggcgtgctgatgaccatctccaatttcatcatcgcaatagtgggtgtgtccaccgattcagttatcgctaagaaggttatgatcgtgttcatctgcatgttcatcgccgcattctccgcaacttggggaggcgtcgtctgggtcatgtccgccgagatgtatccgttgggcgtccgctccaaatgcgcggccatctgcgcggcatccaactggctcgttaactttgtctgcgcgatgattaccccgtacctcattgatataagctcctacacgtcccgcctcggtagcaccatcttctttgtctggggttcgctcaacgccattggcgttatggtcgtctacctgactgtctatgagaccagcggtctaacactcgaagaaattaatgaactctaccgccgctgtccatccagcctggcgtcctgtgcatggaaccggcgtatcaaaagttccccagaagactaccacctcaccgtcaccggccggtgcgctcccagtgaacaccaagaccatgtcgatctcggcaacggtctctgtctggccacgtatcaccgtgccccgccttcaataatttcggaatcctccaatagcagtagcgacagcgttgtcaattccggcgctggcgctggcggtcccgctgccgcgcctgcgggcatcaacgcttacatgtctgacctaatgaacaatattgtcgtaaacacacattctactcccgcagcaggcacaagtacatag

SEQ ID NO: 384 - protein, 664 aa, Ashbya gossypii
MLKSVEKLTLPQVISQRLTFHYRLRRKPEEIEENCISSETSDEKHSKGCNDQKNASHYEQPVMVTDLRDDSEGFSIQETELERPAMRQSNKMSILVGIFVAVGGFLYGYDTGLINSITEMSFVKKHFAPNHVNFTSMEMSILVSFLSLGTFIGALAAPLLADSYGRKSTVIFSTFIMFLEGTLLQVSATSMALLVAGRVASGVAVGLISVVVPLYQGEAAQKWCRGAIICTYQWAITWGLLVSSAVSQGTYLRNDASSYRIPIALQYVWCIILGSGMLLLPESPRYYVLRDQLDKAALSLSFLRGVPHDDAGLLEELVEIKANYDYEMSLKSSSYLDCFRTSEHRPKQQIRMLSGILLQAFQQFSGINFIFYYGVNFFSSTGISKSYLVSFVTYAVNVVFNIPGLFLVEYAGRRKLLLVGGVLMTISNFIIAIVGVSTDSVIAKKVMIVFICMFIAAFSATWGGVVWVMSAEMYPLGVRSKCAAICAASNWLVNFVCAMITPYLIDISSYTSRLGSTIFFVWGSLNAIGVMVVYLTVYETSGLTLEEINELYRRCPSSLASCAWNRRIKSSPEDYHLTVTGRCAPSEHQDHVDLGNGLCLATYHRAPPSIISESSNSSSDSVVNSGAGAGGPAAAPAGINAYMSDLMNNIVVNTHSTPAAGTST

SEQ ID NO: 385 - DNA, 1642 bp, Drosophila melanogaster
  CDS (119)..(1453)
cgaacttagtagtatatgattcttacgttcagtagaacgaactattgatactaggcagtctttgcacgcacacactaatagttagagtgtaatttgcctctgtttcaaaattgtaaaaatgggaactgccactcagtttattgttggtttcatcggcgccctgggcgccttttgtctaggcgcagtgatcggctggtcaggaccggtggaaaatgaagtcaagaattctaacgcgtacaactttacccctcgtcaaacggaatggggcctggtgggatctctgatgactctgggtgcagctttctcgtgcattccggtgggcgtgctcattggtaagatcgggcggaagacgacaatgctaatcctgctgccaccgttctttatcggatggctcctgatcctcctggcatcgcacatagcaatgctgctgctcggacgcttcgtagtgggattctgcggaggagccttctgcgtgacttgtcccatgtacgtgactgagatagcccaggtccagtaccgcggaaccatgggatgcttcttccagctgctaatcgtttttggtattctgtacgcctttgtggttggaggttttgtaaagaccttctactttaatattgcttgcgcaattttgcccgtaatcttttttgtcttgatgatttttatgccggaatctccgatttttctggcccaaaagggaaaagccgagaaggcggagaaatctcttaaatttctgcgcggaaaggatgcggatgtgagcggtgagctgaaggaaatgagcgccgagggccaaaaggagaaggctagcgttgggaaaatcctatgccgcaggattaccctcaaggggctgttcctctccatcggtctcatgttgttccagcagatgacgggcatcaatgcgattattttctattctacattcatctttgagacggctggatcgaccctggagcccagaatatctacaattattgtgggcattgtgcaggctattgccactatcatttcgatcctggttattgagaaagtcggtcggaagatactcctattggtgtccgcctgcatgatgggtatcagcaccctgatcatggctctttactttggcatgttgatgaaatctggagtcggctggctggccctaattgccgtttgtgtttttattattggattctccctgggattcggtccagttccctggctgatgatggccgagctctttgccgaggatgtaaaggccctagcaggatcgattgccgggactacaaattggtgttttgcttttatcgtgacccttcttttccctgttcttaacgatattattggagcaaccgcgtgctttgcaatcttcttcggatttgcggtggccgcctttgtcttcattctcttcctaattcccgagacaaagggaaaaacgcttaacgagattcaggccaagatgggcgagaaggccgaatagtacttgcaatcttttgatatcatcagggattcaagtctatggatctctgaccaaacttttgataaattttcgtggaattggaactgaatatttgtaccgtcaaatgcaatcaaatgcatttaaatttatgtcttaacatttttctacatgatgttattatgaataaaatgccacctcttgacattttaa

SEQ ID NO: 386 - protein, 444 aa, Drosophila melanogaster
MGTATQFIVGFIGALGAFCLGAVIGWSGPVENEVKNSNAYNFTPRQTEWGLVGSLMTLGAAFSCIPVGVLIGKIGRKTTMLILLPPFFIGWLLILLASHIAMLLLGRFVVGFCGGAFCVTCPMYVTEIAQVQYRGTMGCFFQLLIVFGILYAFVVGGFVKTFYFNIACAILPVIFFVLMIFMPESPIFLAQKGKAEKAEKSLKFLRGKDADVSGELKEMSAEGQKEKASVGKILCRRITLKGLFLSIGLMLFQQMTGINAIIFYSTFIFETAGSTLEPRISTIIVGIVQAIATIISILVIEKVGRKILLLVSACMMGISTLIMALYFGMLMKSGVGWLALIAVCVFIIGFSLGFGPVPWLMMAELFAEDVKALAGSIAGTTNWCFAFIVTLLFPVLNDIIGATACFAIFFGFAVAAFVFILFLIPETKGKTLNEIQAKMGEKAE

SEQ ID NO: 387 - DNA, 1620 bp, Neurospora crassa
  CDS (1)..(1620)
atggagcacgatcactccgcctccgacattgagaaggaggccgtcactgtggcccggccacagggcgatgtcacccgcgttgaggctcccgttaccctcaaggcgtacatgatgtgcgtctttgccgctttcggcggtatattcttcggctacgactcaggttacatttctggtgtcatgggcatgaagtactttatcgaaaccatcaacggacccggcgccaccttcctgccatccaaggaaaagtcgctcatcacctccattctctctgccggtaccttctttggcgccctcatgggcggtgatctcgctgactgggttggccgtcgtcctaccatcatcttcggctgcctcgtcttcatcgtcggtgttgttctccagactgcctcccagagcttgggtctcatcgttgccggccgtctcgtcgctggtttcggtgtcggtttcgtctcggccattatcatcctgtacatgtctgagatcgcgccccgcaaggtccgcggtgccatggtgtccggctaccagttctgcatctgcctgggtctgctcctggcctcgtgcgttgactacggcacccagaaccgcaccgacagcggctcttatagaatcccgattggtctccagatggcctgggccctcattcttgctactggtatctttttccttcctgaatcccctcgcttcttcgtcaagaaaggcaagctcgacaaggccgccggcgtgctctcccgcctgcgcgaccagccgctcgattccgactacgtcagggacgaacttgccgagatcgttgccaaccacgaattcgaaatgaccgtcgtcccctacggcaactacttccagcagtgggccaactgcttccgcggctccatctggcagggcggttcttacctccgccgcaccattctgggcacttcgatgcagatgatgcagcagtggacgggaatcaactttatcttttactttggcaccaccttcttccagcagctcggcaccattgacaaccccttcctgatgtctctggtcactactcttgtcaacgtctgctccacccccatctccttttacaccatggagaagctcggccgtcgtaccctcctcatctggggcgctctcggcatgctgatctgcgagttcatcgtcgccatcgttggcacctgcaggccggatgataccatggccatcaaggccatgctcgcctttatctgcatctacatcttcttctttgctaccacctggggtcctgcttcctgggtcgtcatcggcgaagttttccctcttcccattcgtgccaagggtgttgccctttccaccgcctccaactggctctggaactgcatcatcgccgtcatcaccccctacatggtcgatgaggataagggcaacctgggccccaaggtgttctacatctggggtggcctctgcacctgctgcttcatctacgcctacctgcttgtgcccgagaccaagggcctcacgctcgagcaggtcgaccaaatgctttccgagtctaccccccgcacctcgaccaagtggaagcctcacaccacttatgctgctgagatgggcatgaccgagaagactgttgctggccacgctgagaaccgcagcgatagcgagtaa

SEQ ID NO: 388 - protein, 539 aa, Neurospora crassa
MEHDHSASDIEKEAVTVARPQGDVTRVEAPVTLKAYMMCVFAAFGGIFFGYDSGYISGVMGMKYFIETINGPGATFLPSKEKSLITSILSAGTFFGALMGGDLADWVGRRPTIIFGCLVFIVGVVLQTASQSLGLIVAGRLVAGFGVGFVSAIIILYMSEIAPRKVRGAMVSGYQFCICLGLLLASCVDYGTQNRTDSGSYRIPIGLQMAWALILATGIFFLPESPRFFVKKGKLDKAAGVLSRLRDQPLDSDYVRDELAEIVANHEFEMTVVPYGNYFQQWANCFRGSIWQGGSYLRRTILGTSMQMMQQWTGINFIFYFGTTFFQQLGTIDNPFLMSLVTTLVNVCSTPISFYTMEKLGRRTLLIWGALGMLICEFIVAIVGTCRPDDTMAIKAMLAFICIYIFFFATTWGPASWVVIGEVFPLPIRAKGVALSTASNWLWNCIIAVITPYMVDEDKGNLGPKVFYIWGGLCTCCFIYAYLLVPETKGLTLEQVDQMLSESTPRTSTKWKPHTTYAAEMGMTEKTVAGHAENRSDSE

SEQ ID NO: 389 - DNA, 1968 bp, Neurospora crassa
  CDS (1)..(1968)
atgggccacaatccagacctggacagtagcggcactgccggagaacccaaaggtgtcaccggctcgcacattgaacaaacctcgtccaacctcgaagccaacatcaacctcgaagccaagctcaagaacccgctcgacggcctttcccgcgtcgagctcctgtcacgcgtcgagaccttttgcgccgaaaagaacctaaccgagcacctccctcttttccgtaagggagcactcatcgcccagtccccggacagctatgcgtccatctcgggcccggaagccttggacgatgaggagaaggcagtacttttgaaggaggtcgaacacaagtggcggctgccggcaagactgttcctgacgattgctacttgctcgatcggtgctgctgtccaaggttgggatcagacgggcacgaatggcgcgaatatcttctttcccaactattacggtatcggaggcgacactgcgagggagaagttgcttgtcggattgatcaatgctgggccctatattgggagcgcattcatcggttgctggctttctgatcccatcaacaactggattggtcgtcgtggtgttatctttgtctctgctcacttctgtatctggcccgtcatcggttctgctttctgtcacacatggccccagcaactggcctgccgtctgctgatgggtatcggtatgggtgtgaaggcatcaacggtgccgatctatgccgcggaaaactcgcctgcttctattcgaggtgcgctggtcatgtcatggcagatgtggacagccttcggcatcttcttgggcactgcctttaaccttgccgtcttccacgccagctccaacgttaactggcgcctcatgctcggtgcccccttcattcccgccgtacccctgcttctgctcatctatctttgccccgagtccccgcgctggtacatgaagaagggccgctacccagaagcctggaaatccatggtcaagctgcgcaaccaccccatccaagttgcccgcgacatgttctacatccactcgcaattggaagtcgagcaccagctcctcgccggctccaactatgccaagcgcttcgtcgagctcttcaccgtccctcgtgttcgccgcgccaccctcgccgctttcaccgtcatgattgcccagcagatgtgcggaatcaacatcatcgccttttacagcaccaccatcttcaaggattccggctccaccgaattccaagccctgctttcctccttcggcttcggtctagtcaattggctctttgccttccccgccttctggactatcgacacttttggccggcgctctctgcttctttttaccttcccgcaaatgatgtggaccctgctagcagccggcctcttcaccttgctcgacatgggtcccgcccggaccgggctcgtcgccttattcgtcttcctcttcgccgcgttctactcacccggtgaaggtcctgtccccttcacctactcggccgaagtcttccccctctctcacagagaagtaggcatgggcttcgccgtcgccacctgcctcttctgggcatctgttttgggtattaccttccccttcttgcttgactctctcggcaccgtcggcgcctttggtctgtacgcgggcttcaacctagtggcgtttattgccatcttcttggtcgtgccggagacgaagcagaagacgctcgaggagttggattatgtctttgctgtgaagacgagcaagttcatgtcgtatcagtgcaccaaggcgctgccgtggttcatcaagaggtgggtgttttggcagaggaatgcaaagctggagccactgtatgagtttgatcggatcaaggaggcggagaaggagaggagagcagaggaggagagaagggcaaaggagacgggaacgatcacctctactgctacaggagctgagttggatgagaagaagggactgagtcatgttaatgctcctaattcttag

SEQ ID NO: 390 - protein, 655 aa, Neurospora crassa
MGHNPDLDSSGTAGEPKGVTGSHIEQTSSNLEANINLEAKLKNPLDGLSRVELLSRVETFCAEKNLTEHLPLFRKGALIAQSPDSYASISGPEALDDEEKAVLLKEVEHKWRLPARLFLTIATCSIGAAVQGWDQTGTNGANIFFPNYYGIGGDTAREKLLVGLINAGPYIGSAFIGCWLSDPINNWIGRRGVIFVSAHFCIWPVIGSAFCHTWPQQLACRLLMGIGMGVKASTVPIYAAENSPASIRGALVMSWQMWTAFGIFLGTAFNLAVFHASSNVNWRLMLGAPFIPAVPLLLLIYLCPESPRWYMKKGRYPEAWKSMVKLRNHPIQVARDMFYIHSQLEVEHQLLAGSNYAKRFVELFTVPRVRRATLAAFTVMIAQQMCGINIIAFYSTTIFKDSGSTEFQALLSSFGFGLVNWLFAFPAFWTIDTFGRRSLLLFTFPQMMWTLLAAGLFTLLDMGPARTGLVALFVFLFAAFYSPGEGPVPFTYSAEVFPLSHREVGMGFAVATCLFWASVLGITFPFLLDSLGTVGAFGLYAGFNLVAFIAIFLVVPETKQKTLEELDYVFAVKTSKFMSYQCTKALPWFIKRWVFWQRNAKLEPLYEFDRIKEAEKERRAEEERRAKETGTITSTATGAELDEKKGLSHVNAPNS

SEQ ID NO: 391 - DNA, 1572 bp, Neurospora crassa
  CDS (1)..(1572)
atgggcttgtcactcaagaagcctgaaggtgtgccgggcaagtcatggcccgccattgtcattggcttgtttgtcgcctttggtggtgtactctttgggtatgacactggcactattggcggtatccttgctatgccctattggcaagatttgttttcgacaggttacagaaacccagagcatcacttggacgttaccgcgtcgcagtctgccactatcgtctccattctgtctgctggaaccttctttggcgctcttggtgccgctccccttgccgactgggctggacgacgcttgggccttattctgtcgtcgtttgtgtttatcttcggtgtcatcctgcagaccgcagccgtcagcattcctctttttctggctggccgattctttgctggattgggagttggtctcatatcggcaaccatccccctctatcaatccgagactgccccgaaatggattcgtggtgtcatcgtcgggtcctatcagctagccattaccatcggtcttcttcttgcctccattgtcaacaatgccacgcataacatgcagaacaccggctgctatcgcatccccatagctgtccaatttgcatgggcgatcatcctgatcgttggcatgatcattcttcccgaaactccacgctttcatatcaagagagacaatctcccagccgccactaggtctctagctatcctccgccgtctggagcagaaccatccagcgatcatcgaagagctttccgagatccaagccaatcatgaatttgagaagagcctcgggaaggcgacctacttggactgcctcaagggcaatttactcaagcggctccttactggctgttttctccagagcctgcagcagttgactggcatcaactttatcttctactacggcacacagttcttcaaaaactccggattctcagactcgtttctgatatccttgatcactaatcttgtcaatgtcgtgtcgacccttcccggactctacgccatcgacaaatggggccggaggcctgttttactctggggagctgttgggatgtgtgtctgccagttcatcgttgctattcttgggacaacaacgacaagtcaagatgcaagcggaatgatcattgtgcataatctcgccgcacagaaagcagctattgcattcatctgcttctacatctttttcttcgctgcatcttggggtccagttgcctgggtcgttacaggcgagatcttcccccttaaagtccgcgccaagtcgctctccataactacagcgtcgaattggctgctcaactgggccattgcttacagcacaccttaccttgtcaactacggccctggcaatgcgaacctgcagtccaagatcttcttcgtctggggcggatgctgcttcatctgcatcgcattcgtttacttcatgatctatgagacaaaaggtctcacactggagcaggttgacgagctatatgaagaggtctcggatgccaggaagagtattggttgggtgccgaccatcactttccgggagatccgggaggaaaagaaaaatatatgcgtggcggctgctcttaagtag

SEQ ID NO: 392 - protein, 523 aa, Neurospora crassa
MGLSLKKPEGVPGKSWPAIVIGLFVAFGGVLFGYDTGTIGGILAMPYWQDLFSTGYRNPEHHLDVTASQSATIVSILSAGTFFGALGAAPLADWAGRRLGLILSSFVFIFGVILQTAAVSIPLFLAGRFFAGLGVGLISATIPLYQSETAPKWIRGVIVGSYQLAITIGLLLASIVNNATHNMQNTGCYRIPIAVQFAWAIILIVGMIILPETPRFHIKRDNLPAATRSLAILRRLEQNHPAIIEELSEIQANHEFEKSLGKATYLDCLKGNLLKRLLTGCFLQSLQQLTGINFIFYYGTQFFKNSGFSDSFLISLITNLVNVVSTLPGLYAIDKWGRRPVLLWGAVGMCVCQFIVAILGTTTTSQDASGMIIVHNLAAQKAAIAFICFYIFFFAASWGPVAWVVTGEIFPLKVRAKSLSITTASNWLLNWAIAYSTPYLVNYGPGNANLQSKIFFVWGGCCFICIAFVYFMIYETKGLTLEQVDELYEEVSDARKSIGWVPTITFREIREEKKNICVAAALK

SEQ ID NO: 393 - DNA, 1614 bp, Neurospora crassa
  CDS (1)..(1614)
atgtacaaaatcggcaacatctacttcatcgccgccgtcgccgtcatcggcggcgcgctatttggcttcgatatttcttccatgtcagctatcatctcgactcagccgtacctctgccagttcaaccagctcggccacaacgaaaagggcttgtgcctcggtcctaccaacgatgttcagggtggtatcacagccgccatgcctggtggttcgtggctcggcgctctctgctctggttttgtctccgatactttcggccgcaaacgctccattcagataggttccgtgatttggattattggttccgtcatcgtctgcgcgtctgtcaacattcctatgttggttgtcggtcgcatcatcaacggattttcggtcggaatatgctctgcccaagtccctgtctacatttccgagatcgcccttccatcgaagcgcggtcgccttgtcggtttccagcaatgggctatcacctggggcattctgatcatgttctttatctgctatggctgctcgttcatgaagggaacggccgccttcagagttccttggggtcttcaggccatccctgccgccctcctctttctcggccttgtcttcctccccgagtcgccccgctggctttgcaagaaggacagatgggacgaggcaaaggatgtgcttaccttggttcacggaaaaggaaatcccaactccccgtgggtgcaccgtgagatgcaagagattcgcgagatggtcgagttcgagcgcgccaatgctgatgtcagctacttcgaactgttcaagcccaacatgatcaaccggacctcgattggcgtttttactcagatatggtctcagttgaccggtatgaatgtgatgatgtactacataacctacgtcttcacaatggccggtcttgccgatggaagcgagaatgctgtccttctccctagcggtatccagttcgtcattaacgtcgtcatgacgataccggctcttctttggatggatcgctggggtcgccgtccgaccctgctggttggtgcattcttcatgtgcctctggctctgtgtcaatgccggcttgtttgctgtttattcacgacctgcccgccctggcgagttcacttccccggccgagtccatggctatcactggcgctccagccaaagccgtcattgcttcaacttatctctttgtcgcatctttcgcacccacttggggtcctgtttcgtggacctatcccccggagctttacccgcttcgtctccgcggaaaagccgttgccctctgcacttcagccaactgggctttcaactttgcccttgcctacttcgttcctcctgcttttgctaacattacctggaaaacctacgtcatcttcgctacgttctgcgcggccatgttcatccacgtctttttcatgttccccgagaccgccaacaagcctcttgaggaagtcgaggagatctttgacgataccaagcctggagccatcaagtacatcggcacccccgcttggaagacaagaaacactcgcaatcttacgctcaagcaggagcacaacgatactctctcgtcggaggagaagattggcttggaggagcacgctcacaaggaaaccaccggcagatga

SEQ ID NO: 394 - protein, 537 aa, Neurospora crassa
MYKIGNIYFIAAVAVIGGALFGFDISSMSAIISTQPYLCQFNQLGHNEKGLCLGPTNDVQGGITAAMPGGSWLGALCSGFVSDTFGRKRSIQIGSVIWIIGSVIVCASVNIPMLVVGRIINGFSVGICSAQVPVYISEIALPSKRGRLVGFQQWAITWGILIMFFICYGCSFMKGTAAFRVPWGLQAIPAALLFLGLVFLPESPRWLCKKDRWDEAKDVLTLVHGKGNPNSPWVHREMQEIREMVEFERANADVSYFELFKPNMINRTSIGVFTQIWSQLTGMNVMMYYITYVFTMAGLADGSENAVLLPSGIQFVINVVMTIPALLWMDRWGRRPTLLVGAFFMCLWLCVNAGLFAVYSRPARPGEFTSPAESMAITGAPAKAVIASTYLFVASFAPTWGPVSWTYPPELYPLRLRGKAVALCTSANWAFNFALAYFVPPAFANITWKTYVIFATFCAAMFIHVFFMFPETANKPLEEVEEIFDDTKPGAIKYIGTPAWKTRNTRNLTLKQEHNDTLSSEEKIGLEEHAHKETTGR

SEQ ID NO: 395 - DNA, 1989 bp, Neurospora crassa
  CDS (1)..(1989)
atggttctattcaagcgccctcccgatgagaaggggtccgtatggttctccgttctgatcggcgtcttcgtggcctttggcggtcttctttttggctatgacaccggcaccatcagcggcgtcattgccatgaaatattggaacgagcgtttctccactggctacatcgatgctgatgggaggccggccattagcccgtcccaatcttccctcattgtgtctatcctttcggctggtaccttcttcggtgctttggcttctcccttgctggcggataagattggtcggcgatggggtatcatcatatcctcttgggtcttcaactttggcgtgtccatgcaagtaatttctgtcgccattcctctgtttgtagccgggagattctttgccggccttggagttggcctgctttcggctcttgtcccgctctatcaatccgagaccgcccccaaatggatccgtggaatgatcgtaggcgtatatcaacttgcaatcaccatcggcatccttttcgccgccatagtcaataatggcactcatgaacgggaggacaccggctcgtacagaattcccattgctctccagtggctcttctcgctcactctcatcattggcatgcacttccttcccgaaactcccaggtattgcatcaagcgaggcgacatgacccgtgccacccgagccctggccagaatccgctgcctgtcgcccaatgatcccgccatccttgcggagatggaagagatccgtgcaaactaccaatatgaactgtcactcggtaacagcagctacctggactgcttccgtaagggcatgttgaagaggatgctcacaggcatggtacttcaaatcctgcagcaacttaccggcgtcaacttcattttttactacggtactcaattcttcgagaactcgggcatctcgaattccttcttgattagtatgatcctagccacagtcaacgttctctcgacggtccccgctgtcttcatgttcgacaagttcggtcgccgccctttactcttgtggggtggtgtagccatgcacatatgccactttatcgtcgctacactcggtacatcgacaacgagtcagactgccaccggggtcattatcgtgctcaacgttgctgctcaaaaagcatcaatcacttttgtgtgcttgttcattgccttcttcgccgcaacatggggtcccttggcgtgggtggtaactgcagaattgtacccactgaagcatcggtcgcagatgttgagcattagcacagctacaaacaaacatgttccttcattttcaactccggattctgtctactaccatgacattctggggtggttagtaaactgggccatcgcctactcgactccttacctcgtcaactatggtcccgggtacgcaaacctccagtcaaagatcttcttcgtctggggtacggcctgcatgctctgcgtcggctttgtctacttttacatctatgagacaaagggtctatctctggaggagatcgacgaaatgtaccagacaccaaatctcaaggctaaggacagcagcaagtggcggccgagcgtccatttccgagaaaccccgctcacggagatcacataccacaaggctactggtggaagtcctgctcaggccgaggctgctccagtagctgagaccgcggagagagctgagcgcgaggctgttcctacccttcctaatcttactacagctcccaagattgggcctcctcctcctcctcctgaaagtgacgatgtcctgaagactctgcaagacgctgtccttcgtcctgcaggagctttcgcccaccctgctacgctgaacccggcctggaattcccattctcccttgtccgcacaaattgcgccgtcgaatcttccgtcttcctctcttgcttccaacaggtctgccccgtccctgggcacgactcccaacgaaggtggaactagttcaccccacccagcgcgaagaagcttcgggcgttga

SEQ ID NO: 396 - protein, 662 aa, Neurospora crassa
MVLFKRPPDEKGSVWFSVLIGVFVAFGGLLFGYDTGTISGVIAMKYWNERFSTGYIDADGRPAISPSQSSLIVSILSAGTFFGALASPLLADKIGRRWGIIISSWVFNFGVSMQVISVAIPLFVAGRFFAGLGVGLLSALVPLYQSETAPKWIRGMIVGVYQLAITIGILFAAIVNNGTHEREDTGSYRIPIALQWLFSLTLIIGMHFLPETPRYCIKRGDMTRATRALARIRCLSPNDPAILAEMEEIRANYQYELSLGNSSYLDCFRKGMLKRMLTGMVLQILQQLTGVNFIFYYGTQFFENSGISNSFLISMILATVNVLSTVPAVFMFDKFGRRPLLLWGGVAMHICHFIVATLGTSTTSQTATGVIIVLNVAAQKASITFVCLFIAFFAATWGPLAWVVTAELYPLKHRSQMLSISTATNKHVPSFSTPDSVYYHDILGWLVNWAIAYSTPYLVNYGPGYANLQSKIFFVWGTACMLCVGFVYFYIYETKGLSLEEIDEMYQTPNLKAKDSSKWRPSVHFRETPLTEITYHKATGGSPAQAEAAPVAETAERAEREAVPTLPNLTTAPKIGPPPPPPESDDVLKTLQDAVLRPAGAFAHPATLNPAWNSHSPLSAQIAPSNLPSSSLASNRSAPSLGTTPNEGGTSSPHPARRSFGR

SEQ ID NO: 397 - DNA, 1557 bp, Neurospora crassa
  CDS (1)..(1557)
atggggctcgggcttaagctaccgacaatctacaatgtccaccttgtggctatcattgccaccttgggtggtgcactcttcggctttgatatctcctccatgtccgccatcgtcgtgaccgaccaatacctcacctacttcaacaacccccatgatatcatccaaggagccatcggctctgcccttgctgctggctccgtcgtcggttccgccatcgccggtcctctttccgacaagatcggtcgtcgtgactccatctttttcgcctgcttcttctggctcattggtacctccgtccaggttgcctgcaagaactatggccagctcatcgccggccgtgtgctcaacggctttaccgtcggcatcacttcctcccaggttcccgtgtaccttgccgagatcgccaaggcagagaagcgtggttccttggtcatcatccagcaactcgccatcgagtttggtatcttgatcatgtactttatcggctacggctgtgcgtcgatcgagggccctgcttcgttccggaccgcttggggcattcagtttatcccttgctttttcctcatggtcggtcttcccttcttgcctaggtcgcccagatggctggccaaggtcggtagggaccaggaggccattgctgtcctggctaacatccaggctgatggcaacgttgatgacccgagagtcgttgctgagtgggaggagattgtcaccgttatgaacgccgagcgtgaggccggtaagggatggaggaagtttgtcaagaacggcatgtggaagcgaaccatggctggcatgactgtacaggcttggcagcaactcgccggcgccaacgtaatcgtctactacctaacctacatcgcccaaatggccggactcacaggcaacgtcgccatggtaacctcgggcatccaatacgccgttttcatcatcttcaccggcgtcatgtggctcttcatcgacaagaccggtcgtcgcacccttttagtttacggcgccttgggaatggccttctgccactttgtcgtcggcggcgtcatgggcgcgcaccacgacaacgttccggacggcgtcggcggcaacgccaacattgtcattagcgtgcacaagggcgcgcccgccaacacggtcatcctgttctcgtacctgctcattgtcgtctacgccttgacgctcgctcccgtctgctggatctacgccgccgaggtctggtcgttgggcactcgcgctacgggcatgtccatggctgccatgtccaactgggtgttcaactttgcgctgggcatgttcacgccgccggcgtttgtcaatattacgtggaagctgtttatcattttcggggtgctttgcgtcacggcggcggtctggttctggttgttttacccggagacgtgtggtaagacgctggaggagattgagatcctgtttggtgatcagggtcctaagccgtggaagacgaagaagggcgagtcgagacttacggcggagattgaggctgtcaaggcgaggaagacggtggagcacgagattgaggtgcatgagcatgagaaggtttag

SEQ ID NO: 398 - protein, 518 aa, Neurospora crassa
MGLGLKLPTIYNVHLVAIIATLGGALFGFDISSMSAIVVTDQYLTYFNNPHDIIQGAIGSALAAGSVVGSAIAGPLSDKIGRRDSIFFACFFWLIGTSVQVACKNYGQLIAGRVLNGFTVGITSSQVPVYLAEIAKAEKRGSLVIIQQLAIEFGILIMYFIGYGCASIEGPASFRTAWGIQFIPCFFLMVGLPFLPRSPRWLAKVGRDQEAIAVLANIQADGNVDDPRVVAEWEEIVTVMNAEREAGKGWRKFVKNGMWKRTMAGMTVQAWQQLAGANVIVYYLTYIAQMAGLTGNVAMVTSGIQYAVFIIFTGVMWLFIDKTGRRTLLVYGALGMAFCHFVVGGVMGAHHDNVPDGVGGNANIVISVHKGAPANTVILFSYLLIVVYALTLAPVCWIYAAEVWSLGTRATGMSMAAMSNWVFNFALGMFTPPAFVNITWKLFIIFGVLCVTAAVWFWLFYPETCGKTLEEIEILFGDQGPKPWKTKKGESRLTAEIEAVKARKTVEHEIEVHEHEKV

SEQ ID NO: 399 - DNA, 1626 bp, Neurospora crassa
  CDS (1)..(1626)
atgggcggtgcaggtggtgactttgggggttccgaccccgtcatctcccgcctcgccaaagaggacccaatcccgtggtacaagaaacccaacctgcgattcctctactttatgctcttcccgacatgtatgggcatcgagttgacgtcggggtttgattcccagatgatcaacgccctgcagattttggagtcttggatccagtactttgacaacccgcagggtgctctcaaaggcatcatcagcgcagcatactctcttggtgccatcttgtctcttcccctggtacccatcatcaacgacaggttcggtcgaagatggtccatcgctctcggttccatcgtcatgattgtgggcgccatcattcagggtttctcccagcatgtcggcatgtacatcgtcgcccgtatgattctcggcttcggcatccccacttgcatcgtctccggctcctccctgatcggcgaacttgcctacccgaaagagcgtcccgtcttgacctcgctcttcaacgtgtcctatttcgtcgggcaaatcgttgctgccgccattgtctttggcaccaatagcatcgcaagcaattggggctggagaatcccctcgcttctccagatttgtccttcactgcttcaacttgcctttgtctttttcatccccgagagtccccgctggctaatcaccaaagaccgctctcaagaagcccacgacattctgaaaaagtaccacggagaaatggagcgcggtgaggaatttgtcgccgccgagttcgcccagatgcaagccgtcattcgtctcgaatacgaaaccgtctccaagagctcgtggatggatctcctccggaccccgggcatgcgcaagcgtcttctcatctcgtccatgctcggtctcttcacccagtggtccggaaacaccctgatctcctacttcctcggcgacctcctcaagatgattggcttcaccgactcgacctttatccaaaagatcaacgtctccatcgcctgctggagtttgttctgcggtgtgactgtctcgctccttgtcacccgtatcagacgtcgtatcatgtacatggcctgcaccatcagcttgctgctgtgctatatcgcatggactgtctccatggagcgcgccatgacaggcaaggcgaatggcacacccaataacggggccaacatcgccaccctcttcttcatctacatgtattcgccgtgctataacatgggttataacgccctgacctacacctacatggtggaagtctggccctatgccgagcgctcccgtggtatcgccgtcttccagctctttggtcgtttggccggcttcttcaccacctttgtcaaccccatcggtctcaagaatgttggctggaagtacctcatctcgtactgctgctggctcgcattcgaggtctgctttgtttacttcatgttccctgaaaccatgggtcggacgctcgaagagcttaccttcatgttcgagggcgaggaccttcaaagacaggccaatgccgctgccgagaaggtggtcaaccacactgagcatgacacgactggccttggtaggcgcagcaccaacgaaaacaagctgggcggctcggctgaggtaaaggagcatgtcccatga

SEQ ID NO: 400 - protein, 541 aa, Neurospora crassa
MGGAGGDFGGSDPVISRLAKEDPIPWYKKPNLRFLYFMLFPTCMGIELTSGFDSQMINALQILESWIQYFDNPQGALKGIISAAYSLGAILSLPLVPIINDRFGRRWSIALGSIVMIVGAIIQGFSQHVGMYIVARMILGFGIPTCIVSGSSLIGELAYPKERPVLTSLFNVSYFVGQIVAAAIVFGTNSIASNWGWRIPSLLQICPSLLQLAFVFFIPESPRWLITKDRSQEAHDILKKYHGEMERGEEFVAAEFAQMQAVIRLEYETVSKSSWMDLLRTPGMRKRLLISSMLGLFTQWSGNTLISYFLGDLLKMIGFTDSTFIQKINVSIACWSLFCGVTVSLLVTRIRRRIMYMACTISLLLCYIAWTVSMERAMTGKANGTPNNGANIATLFFIYMYSPCYNMGYNALTYTYMVEVWPYAERSRGIAVFQLFGRLAGFFTTFVNPIGLKNVGWKYLISYCCWLAFEVCFVYFMFPETMGRTLEELTFMFEGEDLQRQANAAAEKVVNHTEHDTTGLGRRSTNENKLGGSAEVKEHVP

SEQ ID NO: 401 - DNA, 1752 bp, Neurospora crassa
  CDS (1)..(1752)
atgggtggcggaggcggctccggcgcagctggtttttatgatgccgctcttcagaggcgtgaggcagtgatggggaagagtggccctgcagcacttgtcaagaacttccgggtcttttctattgcatgcttcgcatgtatcggtggtgtgctctatgggtacaaccaagggatgttttcgggtgtcctcgccatgccagcctttcagaaacacatgggcgaatacgatccgatagacgagaacgcgagtcagacaaagaagggctggctaaccgcaattcttgagctcggtgcttggcttggtacgcttctgtctgggttcatggcagaggttctctcgagaaagtacggtgtgctagtggcgtgcttggttttcatgctgggtgtggtcatccaagccacgtctatctctggaggacatgagaccattcttgccggacggtttatcacgggtatgggtgtcggatccttagccatgatcattcccatttacaactcggaagttgcaccacctgaggtccgtggagctcttgttgctctccagcagttggctatctgcttcggtatcatggtcagcttctggattgactacggaaccaactatatcggcggcaccaagctcgagacccaatccgacgccgcctggcttgtacccgtctgcctgcaactcgcccctgctctcattctgtttttcggcatgatgttcatgcccttctccccacgctggctcatccaccatggccgcgaggcggaagctcgaaagatcctctccacccttcgcggtctaccgcaagaccacgagcttgtcgagctcgagttcctcgaaataaaggctcagtctctctttgaaaaacgcagcattgccgagttgtttcccgaattgcgcgagcagactgcctggaatacctttaagctccagtttgtcgccatagagaagcttttccggacaaaggcaatgttccgacgcgttatcgtggcaaccgtaaccatgttcttccagcagtggtccggcatcaacgcgattctctactacgccccgcaaatcttcaagcagcttggactgagcggcaacacaacctcactcctggctacgggtgtagtaggcatcgtcatgttcatcgcaacggttcctgccgtgctgtggatcgaccgtgttggtcgcaagcccgtgcttactatcggtgccctcgggatggctacctgccatatcatcatcgctgtcattgttgccaagaacgtggaccaatgggagactcataaggctgctggatgggctgctgtagccatggtctggctattcgtcattcactttggatattcatggggtccatgtgcctggatcattgttgctgagatctggccgctgagtacgagaccatatggtgtctctctaggagcttcgagcaactggatgaacaactttatcgtcggtcaggtcacgccggatatgttaaaagcgatcccgtacggaacgtatatcatcttcgggttgttgacttatatgggcgccgcctttatctggttctttgtgccggagacgaagagattaaccttggaagagatggacatgatcttcggatccgaaggcactgcacaagccgacaatgagcgcatggaggagatcaatgctgagattggtcttacccgattcctgcaaggtggtagtggtgcaaaccaaggtgctgctgatggaagtgatactggttatgatgcggagaaggggaagagcgaacactattctcagcatgtctaa

SEQ ID NO: 402 - protein, 583 aa, Neurospora crassa
MGGGGGSGAAGFYDAALQRREAVMGKSGPAALVKNFRVFSIACFACIGGVLYGYNQGMFSGVLAMPAFQKHMGEYDPIDENASQTKKGWLTAILELGAWLGTLLSGFMAEVLSRKYGVLVACLVFMLGVVIQATSISGGHETILAGRFITGMGVGSLAMIIPIYNSEVAPPEVRGALVALQQLAICFGIMVSFWIDYGTNYIGGTKLETQSDAAWLVPVCLQLAPALILFFGMMFMPFSPRWLIHHGREAEARKILSTLRGLPQDHELVELEFLEIKAQSLFEKRSIAELFPELREQTAWNTFKLQFVAIEKLFRTKAMFRRVIVATVTMFFQQWSGINAILYYAPQIFKQLGLSGNTTSLLATGVVGIVMFIATVPAVLWIDRVGRKPVLTIGALGMATCHIIIAVIVAKNVDQWETHKAAGWAAVAMVWLFVIHFGYSWGPCAWIIVAEIWPLSTRPYGVSLGASSNWMNNFIVGQVTPDMLKAIPYGTYIIFGLLTYMGAAFIWFFVPETKRLTLEEMDMIFGSEGTAQADNERMEEINAEIGLTRFLQGGSGANQGAADGSDTGYDAEKGKSEHYSQHV

SEQ ID NO: 403 - DNA, 1698 bp, Neurospora crassa
  CDS (1)..(1698)
atgtcctccaaagagacagcctccaccatggcggagaaggatgtcgaacaccccatcgacacccccgtagccatcaccgcagaagtcgaagagaaatatggcatcaaagcccactggaaatgtctcgccgcctgcactctggtgtccatgtgtcccttccaatacggccttgactttggtttgatcggcgggctgcaggccatgattggttttctcaaggtcttcggccacccagccccccacgtcgccggcggctggaacatctccccctcccgtcaacaactcatctcctcgctcatgaccctcggcgccttcctgtcttcctccctcgccggccccaccgccacttttctttcacgccgccaaactatctgggctgcttctttgctatgtatcgtctccaacgtcatcatgatggccaccacctccatcggcgggctctacgccggccgcttgttacttggtctagcaaacgggttctacatgaccttttcgcagctttacatccaagaggtagcgccggctcggtatcgcggactgatgatttccagttttcaggtgtggacgagcgtaggtacagtgattggcggggtggtggataactttactgagaagattgatggaagggatagttacttgatcccgctgggattgatctttgtgtttcctgtggtgattagtctgggactgtttgcggttcctgaaagtccacggtggttgatgatgcaaggacgcgaagagcaggcgagaaagagtctaaggtggcatcgcccgtattcggatcggatggtggaggaggagatcagggatattcagctggcgctggcggcggagggggagacggtcaagggggcgagtgtgtgggatatgtttagggatccggtggataggagacggacggtgttggcggtttgcgggttgacggtgcagggggcgtcgggggctatgtatatgattgcatacggcacatacttcttcaagatggctggtatcggcaagccgttcgaaaaccacgtcatcttgacatcccttggcgtggtggccatcctcgtcaactcggctatggtcacgcactttggtcgtcggcgcatcttcctcatcagcggtctgatcctctgcggtgttgcccagctccttatagccgttgtgtataccgtcaagccgggcaccaagtccaccggtcaagccatagttggactcgctgttgtctatatcctggggtataacggcatggtagcgacgtatgcgtggatctcaggcggcgaactcccctcgcagaggttgcggtcgtatacgttcggactggcgacagcgattggattctttgcggcttggttgacgacgtttacggcgccgtactttatcaatcccgagtcgatgaactgggggccaaaatatgggtatatctggacgccatcgtgttggatttctgctctctgggtgtacttttacctaccggaagtcaagggccgtaccttggaggagattgaccaaatgttcgaggcgcggttgccggcgaggaagtttcgcaaatacgtgtgtgttggtcgcgatggtggtggtggtggtggtggtggtggtggtggtggtggtggtggtggtggtgcaaacgagtcggacaagaacagtgtcaattgggagaagaagggcgacgaggtggtgcatgcggaagaggtgaagcgggtggtgtccagttag

SEQ ID NO: 404 - protein, 565 aa, Neurospora crassa
MSSKETASTMAEKDVEHPIDTPVAITAEVEEKYGIKAHWKCLAACTLVSMCPFQYGLDFGLIGGLQAMIGFLKVFGHPAPHVAGGWNISPSRQQLISSLMTLGAFLSSSLAGPTATFLSRRQTIWAASLLCIVSNVIMMATTSIGGLYAGRLLLGLANGFYMTFSQLYIQEVAPARYRGLMISSFQVWTSVGTVIGGVVDNFTEKIDGRDSYLIPLGLIFVFPVVISLGLFAVPESPRWLMMQGREEQARKSLRWHRPYSDRMVEEEIRDIQLALAAEGETVKGASVWDMFRDPVDRRRTVLAVCGLTVQGASGAMYMIAYGTYFFKMAGIGKPFENHVILTSLGVVAILVNSAMVTHFGRRRIFLISGLILCGVAQLLIAVVYTVKPGTKSTGQAIVGLAVVYILGYNGMVATYAWISGGELPSQRLRSYTFGLATAIGFFAAWLTTFTAPYFINPESMNWGPKYGYIWTPSCWISALWVYFYLPEVKGRTLEEIDQMFEARLPARKFRKYVCVGRDGGGGGGGGGGGGGGGGGANESDKNSVNWEKKGDEVVHAEEVKRVVSS

SEQ ID NO: 405 - DNA, 1647 bp, Neurospora crassa
  CDS (1)..(1647)
atggttctggggaaaaagtcaatcaaaatcaatggcgccgacattggcgtcgaagccatccttctcggtgccgtcaccgcgataggaggcttccttttcggctatgacaccggtcagatctcgggcatgcttctattcagcgacttcaagaacagatttggccagatcacccaaccagatggatcaaaggaattcgagtccatcatccagtcactgctagtatctcttatgagtatcggtacactcctcggttctttgacttcatcatacaccgccacctggtggggccgccgcaagtcccttacattcggcgtcggtctcttcatcatcggcaacatcattcagatcaccgcaatgcactcctgggtacacatgatgatgggccgcttcgtcgccggtctaggcgtcggtaccctctccgtcggtgtgcccatgttccaatccgagtgctcccctagagaaatccgtggtgccgtcgtcgcctcttaccaactgctcatcacctttggtatcctcatcgccaacattgtcaactacggcgtgcgcgagatccaggagcaggacgcttcctggcgtatcgtcattggtttgggtatctttttctcgcttccgcttggcgtgggagtgctgttggtccccgaaagcccaaggtggctggcgtccaaggaggattgggagggagcccgcatgtcgatggcgagactgagaggcttgaagcatgacccgcataacgagctggtggaggatgatatgaaggagatgcgggaggttttggagaaagagcggactgcggccgtgggaacttggaaggagtgtttcatccccaacaagaacggtgttcccaagcaggtgtaccgcacattcctgggtatcggcatccacttcctgcaacagtggactggcgtcaactacttcttctactatggcgccaccatcttccagtcggcgggtatcaaggaccccattcaaacacagctcatcctcggcgctgtcaacgtcttctcaaccctgttcggtctctgggtcgtcgagcgcttcggacgcagatggccgctgttcatcggtgctatctggcaggcgtcttggctggccgtgttcgcttccatgggcaccgctctcgaacccgaccaaaacaaggcgtcgggtattgtcatgatcgtctcggccgcactcttcatcgcttcctttgcttgcacctggggtcccattgcttgggtcgtcatcggcgagagtttccctctgcgcacccgtgccaagcaggcttcgcttgccacggctggtaactggcttggaaacttcatgatctccttcctcacccccctcgccaccgatggcatcggctatgcctacggctacgtctttgtagccaccaacatcatgggcgcacttttggtctggttcttcctgtacgagtccaccagcttgtccctcgagaacgtcgacctcatgtacagcgagccgggcatcaagccgtggaactcgcacaagtggatgccgcctggctacatcacgcgcatgcagcgcgatgatgagtacttccaccatcctgagaagggtggttcggatggtcttgaaatcacgaatggaagcaaggagatgcacccccacgaggagagggaagagaaggttattaaccatagggtttag

SEQ ID NO: 406 - protein, 548 aa, Neurospora crassa
MVLGKKSIKINGADIGVEAILLGAVTAIGGFLFGYDTGQISGMLLFSDFKNRFGQITQPDGSKEFESIIQSLLVSLMSIGTLLGSLTSSYTATWWGRRKSLTFGVGLFIIGNIIQITAMHSWVHMMMGRFVAGLGVGTLSVGVPMFQSECSPREIRGAVVASYQLLITFGILIANIVNYGVREIQEQDASWRIVIGLGIFFSLPLGVGVLLVPESPRWLASKEDWEGARMSMARLRGLKHDPHNELVEDDMKEMREVLEKERTAAVGTWKECFIPNKNGVPKQVYRTFLGIGIHFLQQWTGVNYFFYYGATIFQSAGIKDPIQTQLILGAVNVFSTLFGLWVVERFGRRWPLFIGAIWQASWLAVFASMGTALEPDQNKASGIVMIVSAALFIASFACTWGPIAWVVIGESFPLRTRAKQASLATAGNWLGNFMISFLTPLATDGIGYAYGYVFVATNIMGALLVWFFLYESTSLSLENVDLMYSEPGIKPWNSHKWMPPGYITRMQRDDEYFHHPEKGGSDGLEITNGSKEMHPHEEREEKVINHRV

SEQ ID NO: 407 - DNA, 1533 bp, Neurospora crassa
  CDS (1)..(1533)
atgaacggaatcaaggacctgggcctgggcttctccaaagcctcgacgcgcttgcatttctttagtctgttgcttgctcttggctcatttgtctggggatacaacgttggcgttctcgcctcggtcctcgcccatccaggcttccgcgagaccatccctggctatggtccatataagcgcggcctcatcacatccatcaactacctcggcacatggctgagttacatcttcttctcccgtcccgcgacggatctgctcggccgtcgctatgctgccatggtgggcatgtccgtgttatgcgtaggccaggcacttcaggctgctgcgtctgggtcggtggctcttagtatggtgatatttggacgggttgtttctggcttgggcaccggtattgtctcgacgagtgtgccattgtatcagagtgaaattgccccggccaaacagcgaggcagacttgttgttttgaaccatgtcgggtttgtagccggacttgcctctggcttctgctcacacggctacctcagcggatggcgcctgtccgtgtccctctccttcatccccgccctcatcttcttcgtcggcctccccttcctgcacgagtctccgcggtggctcgtcgagcacggccgccctgacgaagccctcaaagccctgcagttctaccgcgaaggatccttcaccccttcgcaaatccaaagcgaactgacagacatcaagcgcaatgtgtgcgcctaccaggccactagcctgaagaaatggacctcccttttcaccaaccccagcttgttcacgcgcctgtggcgagctgcactgctccatttcatggcgcagatgtgcggcgctacggccatgaagtattatctgccggacctgtttagggtgttgggactgagcccgcgcgtgtcgctgctggcgggcgggatcgagagcaccctgaagattgggtgtacggtgttggagatgtttgttattgataaggtgggaaggaggatgacactggctgttggggcggggattatggcttttgcattgttgatcaacggtgccctccccctcgcttaccccaacaacaccaaccgcgcctcagactacacctgcgtcgtcttcatcttcatctactcgcttggctacagcatgggtttcggcccggcagcttgggtctacgggtctgagatcttccccactgccgctcgcgcgcgtggtttgagcttcgctgcttctggtggcgcggtcgggtcaatcattgtttcccaactgtggcctatcgggatcgcagagcttggctcgaagatttacttcttcttcatggcggtcaatttggcgtgcgtaccgattatcttcttgctctatcctgagaccaagggacgtccgctggaggatatggaggtgctgtttggcgggtatgagggtggaactccgtcaactacgtctttgcttttggctgatgagagggaagatgggaacgaggaggacgaggagaatgagacactgggtaggccgttgcttggtgatggaagaggcatggcaaggtag

SEQ ID NO: 408 - protein, 510 aa, Neurospora crassa
MNGIKDLGLGFSKASTRLHFFSLLLALGSFVWGYNVGVLASVLAHPGFRETIPGYGPYKRGLITSINYLGTWLSYIFFSRPATDLLGRRYAAMVGMSVLCVGQALQAAASGSVALSMVIFGRVVSGLGTGIVSTSVPLYQSEIAPAKQRGRLVVLNHVGFVAGLASGFCSHGYLSGWRLSVSLSFIPALIFFVGLPFLHESPRWLVEHGRPDEALKALQFYREGSFTPSQIQSELTDIKRNVCAYQATSLKKWTSLFTNPSLFTRLWRAALLHFMAQMCGATAMKYYLPDLFRVLGLSPRVSLLAGGIESTLKIGCTVLEMFVIDKVGRRMTLAVGAGIMAFALLINGALPLAYPNNTNRASDYTCVVFIFIYSLGYSMGFGPAAWVYGSEIFPTAARARGLSFAASGGAVGSIIVSQLWPIGIAELGSKIYFFFMAVNLACVPIIFLLYPETKGRPLEDMEVLFGGYEGGTPSTTSLLLADEREDGNEEDEENETLGRPLLGDGRGMAR

SEQ ID NO: 409 - DNA, 1695 bp, Neurospora crassa
  CDS (1)..(1695)
atggcttcacccgacccccggaccacagccaacccgtcatccgacgacattgtatttagtgattcgaaaggccaacacgatgtcctccataactcggatgaggtccgacgcaccgacactacggacaggatcatccaaaatgccaaaacagcaaccgacaaggagcaaaagatgacgctgttgcagggcatcaagctgtacccaaaggcgattgcgtggagcatgctcatctcgacgtgcatcgtcatggagggttacgatgtctgtctgattaacaatttctacgccttcccccagtttgctcgcaagtacggcgaggagatagcgccgggccactgggaggttcctgctcgctggcaggctggtcttagtaatggcgccaacgtgggagagttgatcggccttctcatcaatggatatgtatcagaacgtttcggttatcggtacaccgttatcggctgcttgatgctcatttgcgcgtggacttccctgttctttacggcgcagaatgtccagacgttgttggctgctgagattctttgcggcatcccatggggcgtcttccaaactctcaccatcacctacgcctccgaagtctgccccgtcgccatgcgcggctaccttaccacctacgtcaacttctgctggggcgtgggccaggaaatcgccatcggagtcatcatgtccatgctcaagcgcgacgacgaatgggcctaccggatcccctacgccctgcaatggatgtggcccgtacctctggccttgggaatcttcttcgcacccgaatcgccttggtggctcgtccgcaagggtcgtctggatgacgccaagaagtctctcctccgtctgaccagcgtgaaccgcgaaaccgatttcaatgcggacgagaccgtcgccatgatggttcacaccaccgccctggaggagaagacgacgcagggagcgaccttttgggattgcttcaagggccatgatctcaggagaacggagattgtgtgcatggtgtgggcgattcagaatctgagtggaaactcgttctcgaattactcgacgtatttcctcaagcaggccggcctggacgatgatgacgcctatgcgtttgctctcgggcagtacgctatcaacatggcgggcgtgtttggcgcgtggttcttgatgagccgcggcattggacggagagctctttacctgtatgggttgtgcggtctattctgcatgctctttgtgctgggtttccttggtcttgttcccgaagcgcacaacagggaggcttcgattgcgactggcagtatcatgttgggctgggctttggtgtaccagttgacagtcggaacggtctgctactcgcttgtcagtgaaatctcgacgagaagactgcagatcaagaccattgctcttggtcgtgtgctttacattattgtcggcatcgtcactgccgtcctcacaccctacatgctcaaccccggcgcctgggactggtccaactttaccggtttcttctggcccaccggccgcacctttgccgagctcgacctcctcttctcaaagggcatcagcgcgcgcaagttcgctgagaccaaggtggatgtattcgctgatgaggctgcgtccctcgatagctcggtgttgcaaaagtacgagaagggcttggatatgtcccaaactgacagcaaggctagtggcagtggggtataa

SEQ ID NO: 410 - protein, 564 aa, Neurospora crassa
MASPDPRTTANPSSDDIVFSDSKGQHDVLHNSDEVRRTDTTDRIIQNAKTATDKEQKMTLLQGIKLYPKAIAWSMLISTCIVMEGYDVCLINNFYAFPQFARKYGEEIAPGHWEVPARWQAGLSNGANVGELIGLLINGYVSERFGYRYTVIGCLMLICAWTSLFFTAQNVQTLLAAEILCGIPWGVFQTLTITYASEVCPVAMRGYLTTYVNFCWGVGQEIAIGVIMSMLKRDDEWAYRIPYALQWMWPVPLALGIFFAPESPWWLVRKGRLDDAKKSLLRLTSVNRETDFNADETVAMMVHTTALEEKTTQGATFWDCFKGHDLRRTEIVCMVWAIQNLSGNSFSNYSTYFLKQAGLDDDDAYAFALGQYAINMAGVFGAWFLMSRGIGRRALYLYGLCGLFCMLFVLGFLGLVPEAHNREASIATGSIMLGWALVYQLTVGTVCYSLVSEISTRRLQIKTIALGRVLYIIVGIVTAVLTPYMLNPGAWDWSNFTGFFWPTGRTFAELDLLFSKGISARKFAETKVDVFADEAASLDSSVLQKYEKGLDMSQTDSKASGSGV

SEQ ID NO: 411 - DNA, 1683 bp, Neurospora crassa
  CDS (1)..(1683)
atggcggaccaaaaaccccttacctcttcgcctgaagaggccacagaggcgggcaccactaccactaccaccatcccccaagcccaaatccaagacgacgtcgtcctcgtcgaagccaaacacgccgccgacaccgagcacgaaatgaccctcctccgcgccatccagctctaccccaaagccatcggctggtccgtcctactctcttcgaccttgatcatggagggctacgacctcgccctcctggggagcttatacgcctcccccgttttcaacaagaaattcggcgagctcaacccggccacgggcaagtacgccgtctctgctgcttggcagtcgggtctgtccaacggggcaagagccggagagatttttggcttgatctttgctggatgggcggctgatcggatcgggtacaagaagacgacgattgcgagtctggtgttgatgattacctttatttttgtcttgttttttgcgccgaatgtgaaggtgttggtggttggggaggttctttgtggtatcccctggggtgcctttcagagcgttacacccgcctatgcctccgaggttgcgccgatggtgcttcgcccgtacctgacaaccttcatcaacatgtgctgggtaattggccagttcttcgctgccgccgtcaacaagggctccgtgggccggactgatcagtgggcgtacaggattccctttggcgtgcagtgggtgtggccaattcccatcctcgccgggctcgtctttgctcccgagtcgccttggtggtatgtccgacatgacaggagggaggaggccaagcagtcgctcctccgtttgacttcgaggaatcaacccgggttcaacgtggacgagacgctggctatgattgagcataccaacgagctcgagaagcagatgaaggagggtgtcactttccgcgactgcttcaggggtgttgatcttcgccgtacggagatcgtcgtgggcatttggcttgtccagaccctcggcggccagaacctgatgggttacttctcctacttcctcacgcaagccggcatggacccgagcaactcgttctcgctctccatgggccagtacgccctcggtatggtcggcaccgccgggtcgtggttcctcatgtcacgcgtcggccgtcgacgcatccattttagcggtctctgcgcgcagttctgtctgctcgccatcgtcggctgtctctcctttggcggaaacaaggcctctgtgtgggccatcggcggcgtactcgtcgcgttcacgttcgtctacgactttgctgtcggtccggtgacgtactgtctcatctccgagctgtcgtcaactcgtctaaaggccaagaccatcgtgcttgcccgtgcagcgtacaatgctagtaacatctttgtcaatgtaatgacgaattaccagctgagctcgacggcgtggaattggggcgctaggacggcgttcttctgggcgggcagctgcttgttgtcggctatatgggtgttctttagactgccggagccgaaggggaggacatatgccgagttggatattttgtttgagaagaaggtgacagcgaggaagtttaggaagaccaaagttgatccttttgacttgcgcagtcatggcgagaagaagatgtcgcttgagaagatggagagtcatgaggggaaggaaatcgaggcttaa

SEQ ID NO: 412 - protein, 560 aa, Neurospora crassa
MADQKPLTSSPEEATEAGTTTTTTIPQAQIQDDVVLVEAKHAADTEHEMTLLRAIQLYPKAIGWSVLLSSTLIMEGYDLALLGSLYASPVFNKKFGELNPATGKYAVSAAWQSGLSNGARAGEIFGLIFAGWAADRIGYKKTTIASLVLMITFIFVLFFAPNVKVLVVGEVLCGIPWGAFQSVTPAYASEVAPMVLRPYLTTFINMCWVIGQFFAAAVNKGSVGRTDQWAYRIPFGVQWVWPIPILAGLVFAPESPWWYVRHDRREEAKQSLLRLTSRNQPGFNVDETLAMIEHTNELEKQMKEGVTFRDCFRGVDLRRTEIVVGIWLVQTLGGQNLMGYFSYFLTQAGMDPSNSFSLSMGQYALGMVGTAGSWFLMSRVGRRRIHFSGLCAQFCLLAIVGCLSFGGNKASVWAIGGVLVAFTFVYDFAVGPVTYCLISELSSTRLKAKTIVLARAAYNASNIFVNVMTNYQLSSTAWNWGARTAFFWAGSCLLSAIWVFFRLPEPKGRTYAELDILFEKKVTARKFRKTKVDPFDLRSHGEKKMSLEKMESHEGKEIEA

SEQ ID NO: 413 - DNA, 1794 bp, Neurospora crassa
  CDS (1)..(1794)
atgtccaataacgacaaccttgcccctcgaggaccacacacatccgacgatgaggagaaaacagcatcaacgccccctctctccaccgcggcacacgaaaatgccacaccccaccgcacccagttcttcggtgcgagtgaatacgaccaagatctagcccttcttgccgagaaaagggagcaagaaatgagtttcaagcgcgcattcatgggagatctatgtttgatcatgtactcgctcggctactccgggactatcatcatggagggttacggcatggcactcctcacgtatttcttcagcgtggaatctttcaacgcgaagttcggtgtcttcgacaccacgaccggaaaatatgagcttgcgtacaaatggaaggcccttttgcccttgttggcccaagtcggcgcgatcttcggcgtcgtccttacatcattcttcgtgaagtggtttgggtacaagcacaccgttcttttcatgctcatcctctgcgcggcatttggcttcgtacccttcttcgccaacaacgtcgtcatcttggcgatcggctgtctggcccagggcatcccgtggggcctatttcaagtcgctagtcccgcctactcctccgaaattgcttcattgcggatgcggccaatcttgaccacatggaacaatctttgctggatcatcggtcaactcttggcctctgccgtcgcctatggcttccatagtcttcaaaatgagtgggcctacagggtgcccttcgccctgaactgggtcttcatcgcctttctctttgttgccattttcgttgcccccgagtctccatactggtatctccagaaaaacagggtagaggatgctcacaaggccatcaagaagctcgtccgcaagggatccgaggaacgcacccaggagaagcttgctttgatgcagcacgccatctgccatgaaatgaagcacgttgccgacaaccagaccagatggcagagaatcagcgccatgttcagaggcactgacagaaggcgtaccgaaattacctgcaatacatggatgattcaagccctctgcggttcgagcctcattggttgggctcccaagctattcgagtctgtcggcatggcaagcgacaaggcactggccatgaacattgccttgccctgtgccggaattgtgggcacaattgcgtcttggtggttgatgcaaaagatgggacgtcgacggatctttttctggggcctaatcagcatggccatcgtgctcactgtgtgcggttccgcctcactagctacaactccggagtccgtgtccgctgccggagcgatccttgttgtgtatactgccatctatgacctgactatcggccccatttgctactcaattgtttccgatatcccttcggttcgcctccgcacagagaccattgctctcgcacgtggcctttacctggcggccaatctcttcaatctgttccttacccccaagatgctcggaatggactcgaagagctggaattggggcgccaagacgggttttctttacgcaggcatctgtggtctcggagctctgtacacgttctaccgcatcccggaaaccaaggatatctctgtccgaggactcagcattcttttcaacgagaaagtgaaggcgagcaaattcagcgctacgaaggctgcggagctggaaaaatcgcagggggctgcagcttccatgactagcatcagcgataacaccgtctcagtccttgaccagactgtggagcctaagattgcttctcccgctagggctgcgtctgttaagaacaacaactga

SEQ ID NO: 414 - protein, 597 aa, Neurospora crassa
MSNNDNLAPRGPHTSDDEEKTASTPPLSTAAHENATPHRTQFFGASEYDQDLALLAEKREQEMSFKRAFMGDLCLIMYSLGYSGTIIMEGYGMALLTYFFSVESFNAKFGVFDTTTGKYELAYKWKALLPLLAQVGAIFGVVLTSFFVKWFGYKHTVLFMLILCAAFGFVPFFANNVVILAIGCLAQGIPWGLFQVASPAYSSEIASLRMRPILTTWNNLCWIIGQLLASAVAYGFHSLQNEWAYRVPFALNWVFIAFLFVAIFVAPESPYWYLQKNRVEDAHKAIKKLVRKGSEERTQEKLALMQHAICHEMKHVADNQTRWQRISAMFRGTDRRRTEITCNTWMIQALCGSSLIGWAPKLFESVGMASDKALAMNIALPCAGIVGTIASWWLMQKMGRRRIFFWGLISMAIVLTVCGSASLATTPESVSAAGAILVVYTAIYDLTIGPICYSIVSDIPSVRLRTETIALARGLYLAANLFNLFLTPKMLGMDSKSWNWGAKTGFLYAGICGLGALYTFYRIPETKDISVRGLSILFNEKVKASKFSATKAAELEKSQGAAASMTSISDNTVSVLDQTVEPKIASPARAASVKNNN

SEQ ID NO: 415 - DNA, 1578 bp, Neurospora crassa
  CDS (1)..(1578)
atgggcatcttcaacaagaagcccgtggctcaggccgtcgacctcaatcagatacaggaggaggctcctcagtttgagagggttgactggaagaaggaccccggtcttcgcaagctctacttctacgccttcattctttgcattgcttcggccaccaccggttacgatggcatgttcttcaactcggtgcagaacttcgagacctggattaagtactttggcgacccgcgaggatccgagcttggtctgctcggtgctctctaccagattggttccattggctccatcccctttgtccccctccttaccgacaactttggccgcaagacccccatcatcatcggctgcgttatcatgatcgtcggtgccgttctccaggccacggccaagaacctcgatacattcatgggcggccgtaccatgctcggctttggcaactccctcgcccagatcgcctcccccatgcttctcaccgagctcgcccatcctcaacaccgcgctcgtctcaccaccatctacaactgcttgtggaacgttggtgccctcgtcgtctcgtggttggcctttggcaccaactacatcaacaacgactggtcatggcgcattcccgccttgctccaggctttcccctccatcattcagctcctcggtatctggtgggttcccgagtctccccgtttcctcatcgccaaggacaagcacgacgaggccctccacatcctcgccaagtaccacgccaacggcgaccccaaccaccccaccgtccagtttgagttccgcgagatcaaggagaccatccgcctcgagatggaatcgaccaagaacagcagctacctcgacttcttcaagagccgcggcaaccgctaccgcctcgccatcctcctctcgctcggcttcttctcccaatggtccggcaacgccatcatctccaactactcctccaagctgtacgagaccgccggcgtcaccgactccaccgccaaactcggtctttccgccggacagaccggtctcgcgctcatcgtgtccgtcaccatggcgctgctcgtcgacaagctcggtcgtcgtcttgctttcctcgcttccacgggcggcatgtgcggcacctttgtcatttggacgttgacagccggcctgtacggcgagcaccgcctcaagggcgccgacaaggccatgatcttctttatctgggtgttcggcatcttctactcgctcgcctggtccgggttgctggtcggctacgccatcgaaatcctcccttaccgacttcgcggcaaggggttgatggtcatgaacatgtcggtgcagtgcgcgctgacgctcaatacttatgcgaaccctgttgcgtttgattactttggtcctgatcactcgtggaagctttatcttatttacacttgctggatcgccgccgagttcgtcttcgtcttcttcatgtacgtcgagaccaagggccccacgctcgaggagcttgccaaggtcattgatggcgatgaggccgatgttgcccacatcgacattcaccaggtcgagaaggaggtggagattcacgagcatgagggcaagtctgttgcttga

SEQ ID NO: 416 - protein, 525 aa, Neurospora crassa
MGIFNKKPVAQAVDLNQIQEEAPQFERVDWKKDPGLRKLYFYAFILCIASATTGYDGMFFNSVQNFETWIKYFGDPRGSELGLLGALYQIGSIGSIPFVPLLTDNFGRKTPIIIGCVIMIVGAVLQATAKNLDTFMGGRTMLGFGNSLAQIASPMLLTELAHPQHRARLTTIYNCLWNVGALVVSWLAFGTNYINNDWSWRIPALLQAFPSIIQLLGIWWVPESPRFLIAKDKHDEALHILAKYHANGDPNHPTVQFEFREIKETIRLEMESTKNSSYLDFFKSRGNRYRLAILLSLGFFSQWSGNAIISNYSSKLYETAGVTDSTAKLGLSAGQTGLALIVSVTMALLVDKLGRRLAFLASTGGMCGTFVIWTLTAGLYGEHRLKGADKAMIFFIWVFGIFYSLAWSGLLVGYAIEILPYRLRGKGLMVMNMSVQCALTLNTYANPVAFDYFGPDHSWKLYLIYTCWIAAEFVFVFFMYVETKGPTLEELAKVIDGDEADVAHIDIHQVEKEVEIHEHEGKSVA

SEQ ID NO: 417 - DNA, 1614 bp, Neurospora crassa
  CDS (1)..(1614)
atgggtctttcgataggaaataggatcctccggaaaattgtcaaaaatgaggccatggcagaagatcccccagagatctatggctggcgtgtctatctcctagcgtgctctgcctgcttcggcgccatgtctttcggctgggattcctccgtcatcggcggcgtcatcgaactcgaaccctttaaacacgactttggcttcatcggcaacgataaagccaaggccaacctgggcgccaatatcgtctctaccctccaagccggctgcttcctcggtgcgctgatcgcctcacctataaccgatcgcttcggccgcaagtggtgtctcatcgctgtctccctggtcgtcatcatcggtatcatcatgcaagccgccgcctcaggcaacctcgcacccatgtacattggccgtttcgtcgccggcgtgggcgtcggcgccgccagctgcatcaaccccgtctttgtgtctgagaacgctccccgctcgatccgcggtctgttgacgggcctctaccaactcttcattgtcaccggcggcatgatcgcattctggatcaactactccgtctctctgcacttcaagggcaaatccatgtacatcttcccgctcgccatccaaggtcttcccgccggccttttgtgcgtctgcatgctcctctgccacgaaagcccgcgctggctggcccgtcgtgaccgatgggaagaatgcaagtctgtgctggcgcgcatccgcaacctccccccagaccacccgtacatcgtcgacgagttccgcgagatccaggaccagctcgaacaggagcgtcgtctccagggcgacgccacttactgggacttgacccgcgatatgtggaccgtcgccggcaaccgcaagcgcgccctgattagtattttcttgatgatctgccagcaaatgacgggcaccaacgccatcaacacgtacgcgcctaccatcttcaagaacttgggtatcaccggcacgtcgactagcttgtttagtaccggcatctatggtattgtcaaggtcgttagctgcgtcattttcttgctgttcttggccgactcgctgggtcgtagacgttcgctgctgtggacgtcgattgcgcagggtcttgctatgttttatattggcctttatgtccgcatctcgccgccgattgatggccagccggtgccgcctgcgggttatgtagcgttggtgtgcatatttctgtttgctgctttcttccaatttggctggggtcctgcctgctggatctacgcctcggaaatccccgccgcccgcctgcgctccctcaacgtgtcctacgccgccgcgacgcagtggctgttcaatttcgtcgtggcccgcgccgtgcctactatgctggtcacggtcggcccccacggttacggcacctacctcatctttggcagcttctgcctcagcatgtttgtctttgtctggttcttcgtgcccgagacaaagggtatctcgcttgagcacatggatgagctgtttggcgttactgatgggcctgccgctgagaagtcgtcggtgcatggtggagatgatgtcgggtcggagatggggaagggggatcagaagtcgaagcatgtggaggtttatgtttaa

SEQ ID NO: 418 - protein, 537 aa, Neurospora crassa
MGLSIGNRILRKIVKNEAMAEDPPEIYGWRVYLLACSACFGAMSFGWDSSVIGGVIELEPFKHDFGFIGNDKAKANLGANIVSTLQAGCFLGALIASPITDRFGRKWCLIAVSLVVIIGIIMQAAASGNLAPMYIGRFVAGVGVGAASCINPVFVSENAPRSIRGLLTGLYQLFIVTGGMIAFWINYSVSLHFKGKSMYIFPLAIQGLPAGLLCVCMLLCHESPRWLARRDRWEECKSVLARIRNLPPDHPYIVDEFREIQDQLEQERRLQGDATYWDLTRDMWTVAGNRKRALISIFLMICQQMTGTNAINTYAPTIFKNLGITGTSTSLFSTGIYGIVKVVSCVIFLLFLADSLGRRRSLLWTSIAQGLAMFYIGLYVRISPPIDGQPVPPAGYVALVCIFLFAAFFQFGWGPACWIYASEIPAARLRSLNVSYAAATQWLFNFVVARAVPTMLVTVGPHGYGTYLIFGSFCLSMFVFVWFFVPETKGISLEHMDELFGVTDGPAAEKSSVHGGDDVGSEMGKGDQKSKHVEVYV

SEQ ID NO: 419 - DNA, 1641 bp, Neurospora crassa
  CDS (1)..(1641)
atggcgcctccaaagttcctgggcctctcaggccgaccgctctctctagctgtctcgactgtagccaccacgggcttccttctcttcggctatgaccaaggtgtcatgagcggcatcattaccgcccccgctttcaacaacttcttcacaccaaccaaagacaactcgaccatgcagggtctcatcactgccatctacgaaattggatgcttgattggtgccatgttcgtcctctggaccggcgatttgttgggtagacgcaggaacatcatggtgggcgccttcattatggctctcggtgtcattattcaggttacctgtcaggctggatccaacccttttgctcagctgttcgtcggcagagtcgtcatgggtattggcaacggcatgaacacttcgaccattcccacttatcaaggcggtgtcattgcctttggtactttgattgcttattggatcgactatggtgcatcttacggtcccgatgacctcgtttggcgcttccccatcgctttccagcttctcttcgccatcttcatctgcgtccccatgttttaccttcccgagtcgcccagatggctcctcagccatggccggacccaagaagctgacaaggtcattgctgccctccgtggctacgagatcgatggtcccgagaccatccaagagcgcaacctcattgttgactccctgcgtgcctctggaggtttcggccaaaagagcactcccttcaaggccctcttcactggcggcaagacccagcatttccgtcgtctcttgctcggttccagctcccagttcatgcagcaagttggtggttgcaacgccgtcatctactacttccccattctgttccaggattctattggcgagtcccacaacatgtccatgttgctgggcggtatcaacatgatcgtctactccatcttcgctaccgtttcctggttcgccattgagcgtgtcggtcgtcgtcgtctgttcttgatcggcaccgttggccagatgctctccatggtcatcgtcttcgcctgcttgatccccgacgaccctatgaaggcccgcggtgccgcggtcggtctcttcacttacattgcctttttcggtgccacttggcttcccctcccctggctctaccccgccgaggttaaccccatccgcacacgtggaaaggctaacgccgtctccacctgctccaactggatgttcaacttcctcatcgtcatggtcacccccatcatggtcgacaagattggctggggaacttacctcttcttcgcggtcatgaacggctgcttccttcccatcatttacttcttctaccccgagactgcgaaccgctcgctcgaggagatcgacatcatcttcgccaagggcttcgtcgagaacatgtcgtacgtcactgccgccaaggagctgcctcacctcactgccgaggagatcgagtcctatgccaacaagtatggcctcgtcgaccgcgattccaacggcgagggcggcaaccgccatgacgaggagaagacgcgcgaccgccccgaccagagtgacagcgactcccccgctcacgtcgagattgatgttgtcgacgagcacggtgtcgagtccggcttcggtgatggtattaacaccaaggaaacacgttaa

SEQ ID NO: 420 - protein, 546 aa, Neurospora crassa
MAPPKFLGLSGRPLSLAVSTVATTGFLLFGYDQGVMSGIITAPAFNNFFTPTKDNSTMQGLITAIYEIGCLIGAMFVLWTGDLLGRRRNIMVGAFIMALGVIIQVTCQAGSNPFAQLFVGRVVMGIGNGMNTSTIPTYQGGVIAFGTLIAYWIDYGASYGPDDLVWRFPIAFQLLFAIFICVPMFYLPESPRWLLSHGRTQEADKVIAALRGYEIDGPETIQERNLIVDSLRASGGFGQKSTPFKALFTGGKTQHFRRLLLGSSSQFMQQVGGCNAVIYYFPILFQDSIGESHNMSMLLGGINMIVYSIFATVSWFAIERVGRRRLFLIGTVGQMLSMVIVFACLIPDDPMKARGAAVGLFTYIAFFGATWLPLPWLYPAEVNPIRTRGKANAVSTCSNWMFNFLIVMVTPIMVDKIGWGTYLFFAVMNGCFLPIIYFFYPETANRSLEEIDIIFAKGFVENMSYVTAAKELPHLTAEEIESYANKYGLVDRDSNGEGGNRHDEEKTRDRPDQSDSDSPAHVEIDVVDEHGVESGFGDGINTKETR

SEQ ID NO: 421 - DNA, 1644 bp, Neurospora crassa
  CDS (1)..(1644)
atggctcacagcataaacgaaaaggaggccatgggtgcccatgacgatgccttcccagaatccgatattactgtccagttggcccatgatgtcgacaacacaaagtactcgccctggtccaagagcatgttccgcctctaccttgtcctcgcgtgtgcctacctctgcggatgtctcaatgggtacgatggaagtctgatgggaggcttaaacggtatgaaagcctaccagaactacttccatatgtccactgcaggctcgggaaccggccttgttttcgccatgtataacattggcagtgttgctgccgttttcttcaccgcccctgtcaacgactggttcgggcgtcgctggggcatgttcacaggtgctcttgtcattatcattggcacgtgtgtccaagccacgacacataccaaatcccagttcctaggcggtcgcttcgtcctcggtttcggcgtcagcttctgttgcgtatcagccccttgctatgtcagcgagatggctcaccccaagtggcgcggcaccctgacaggcttgtataatacgacctggtacattggctctattatcgcttcgtgggtcgtctatggttgctcctatatcgagaacaacaaggacgcgtggcggattcccatctggtgccaaatgatcacctccggaatcgtgtgcttgggagtcttttggttgcccgagagtcccaggtggctcgtggctcaagacaggtacgaagaagctgccaaaatcctggccacctaccacggcgaaggccggctcgaccaccctctagtacagctgcaactcaaggagatggccaaccagatctcgtcagaggcatccgacaagaagtggtacgattaccacgagctttggaacactcactccgcccgtcgccgccttatctgcgtcctcggcatggcctgctttggccaagtcagcggcaatagcttgtcctcctattacatggtcaacatgctcaaatcagccggtattaccgatgagcacaaggtattggcgctgaacggtatcaacccggccttgtcgctcatcggcgccgtaatgggagcacgcatgaccgatgtcgttggccgccgtcctcttctgctctacacaatcgtcttctcttccacctgcttcgccattatgacgggtaccagtaaactcgcaatgccgggccatgttggtaaccttgacgacgctgatactcaagctctcaccccatcccaacgtgctgccgctaacacgaccattgcctttatctttatatttggcattgtcttttctttcggatggacggccttgcagtccatgtatattgcggagacactccctacagctacccgcgcaaaaggcactgctgtcggaaatttcgtatctgctgcttcgtctgtcgttcttcaatattcctctgggcctgctttcgagaagatcgggtactacttttatctcgtttttgtgttttgggacctcattgaaggtgtcctgatcttcttctatttccctgaaaccaaggatcgcaccctcgaagaactcgaggaagtgttctcggctcctaacccggtcaagaaaagcctggagaagaggagtgcgcagacagtattgaacaccatgggagcgccggatgacgagaaagttacaatttag

SEQ ID NO: 422 - protein, 547 aa, Neurospora crassa
MAHSINEKEAMGAHDDAFPESDITVQLAHDVDNTKYSPWSKSMFRLYLVLACAYLCGCLNGYDGSLMGGLNGMKAYQNYFHMSTAGSGTGLVFAMYNIGSVAAVFFTAPVNDWFGRRWGMFTGALVIIIGTCVQATTHTKSQFLGGRFVLGFGVSFCCVSAPCYVSEMAHPKWRGTLTGLYNTTWYIGSIIASWVVYGCSYIENNKDAWRIPIWCQMITSGIVCLGVFWLPESPRWLVAQDRYEEAAKILATYHGEGRLDHPLVQLQLKEMANQISSEASDKKWYDYHELWNTHSARRRLICVLGMACFGQVSGNSLSSYYMVNMLKSAGITDEHKVLALNGINPALSLIGAVMGARMTDVVGRRPLLLYTIVFSSTCFAIMTGTSKLAMPGHVGNLDDADTQALTPSQRAAANTTIAFIFIFGIVFSFGWTALQSMYIAETLPTATRAKGTAVGNFVSAASSVVLQYSSGPAFEKIGYYFYLVFVFWDLIEGVLIFFYFPETKDRTLEELEEVFSAPNPVKKSLEKRSAQTVLNTMGAPDDEKVTI

SEQ ID NO: 423 - DNA, 1572 bp, Neurospora crassa
  CDS (1)..(1572)
atggctcaaggcaacaacaacaacaaggcagatgccgccagcaaggatatcaaagcaattgtccaccatgataccggcctggacgaagccatccacttcgaacgttccctaacctttctccaagcctgcgccctctacccctccgccatcctgtggtccgccttcgtctccatgggcgtcataatgctcgccttcgacccgcagctcctaggcaacttgtacgccatgccgcaattccgcaaagactttggctatctctataaaaatgactacatcatcagcgcgccctggcagaccggcctatcaatgggtaatcccgtggggcaagtcgtcggcgctttgattgcgggatacccgatggagcggttcgggaggaagtggacttttggggcttgcgtggcgctgacggcttgtcttatttttatccagttcttcgcccgctcgctgcaggtgttgctggttggtgagcttttggggggtctggtgctggggtgttatgccgtcattgcacctgcttactcgtccgaggtgtgcccgatggctcttaggggggtgttgacgagctatgtcaacttgtgctttgttattggtcagttgttggggaacgcagtatgtgctggaacgagcaagttgagcaatcattgggcgtattcaattccgtttgcgctgcagtggttttggtgcttggttatactattggggctggcgtgggtgccggaaagtccgtggtggttggtaaggaaggggaaactggatgaggctgagatggtgctgcgtaggctggcatcggacaaggttgatgtgggaaagacgttgacagtgattgtggaaacggatcggttggagcaggagttggagatggggagtacttattgggactgctttaggggagtgaatctccggaggacggaaatttccatgggtgtttattgtacccaggtcctgagtgggatttacctgatcaattatgggacgtatttctttcagctcgctggtttggacaacgacgaagcatttgacatgggaattggatttttagccgtcggcttcctcggcactatcatttcctggcccctgttgatccgctacggtcgccgaaagatcttcaacaccggcctcctagtcctcgtcttccttcaaatcattattggcattcttgactgcattcctggccggcccagtggcgttatttggaccgaatcctcactgatgctagtgtggaacttcttctacgatatatctgtcggccccgtctgcttcgtcattatatccgaagccagcgccaccagggtgcgatccaagagcattgccctcgcgactgccgctcaaggcgctcttggctgtgtgatgacggttgcgattccttatatgatcaaccctgatcaggcgaacatgcaggggaaattgggtttcttctttgggggtcttgctgcgatgtgcctggtttggtcgtatttgagggttccggagacgagcgggaggacgtatgaagaattggatatcctgtttgagaggaagatcggagcaaggcagtttcaagaatacgttatcgagagtgaaggtgtcgactga

SEQ ID NO: 424 - protein, 523 aa, Neurospora crassa
MAQGNNNNKADAASKDIKAIVHHDTGLDEAIHFERSLTFLQACALYPSAILWSAFVSMGVIMLAFDPQLLGNLYAMPQFRKDFGYLYKNDYIISAPWQTGLSMGNPVGQVVGALIAGYPMERFGRKWTFGACVALTACLIFIQFFARSLQVLLVGELLGGLVLGCYAVIAPAYSSEVCPMALRGVLTSYVNLCFVIGQLLGNAVCAGTSKLSNHWAYSIPFALQWFWCLVILLGLAWVPESPWWLVRKGKLDEAEMVLRRLASDKVDVGKTLTVIVETDRLEQELEMGSTYWDCFRGVNLRRTEISMGVYCTQVLSGIYLINYGTYFFQLAGLDNDEAFDMGIGFLAVGFLGTIISWPLLIRYGRRKIFNTGLLVLVFLQIIIGILDCIPGRPSGVIWTESSLMLVWNFFYDISVGPVCFVIISEASATRVRSKSIALATAAQGALGCVMTVAIPYMINPDQANMQGKLGFFFGGLAAMCLVWSYLRVPETSGRTYEELDILFERKIGARQFQEYVIESEGVD

SEQ ID NO: 425 - DNA, 1509 bp, Mycobacterium bovis
  CDS (1)..(1509)
atgacgacgctgtggcagcctcatcgaaatgactacagccctataccaggacgcggggttcacgcccgccggggcgcccgacgaccccgaccgcgtggtggacgtgctgagcgccccggtaccggtcaactgaccagatcggggcgccgggcgctcctcgtcgggctcaccgccgccagcgtcggcgtcctctacgggtacgacctttccgccatcgcgggtgcgttgctgtctctcagcgaggaattcgaactcaccactcgagaacaggagttgctgaccaccacggcggtgctcggccagatcgccggggcgcttggcggcggcatcctcgccaacgcgatcggacgcaagaaatcggtggtgctcatcgtcgccggctacgcagtgttcgccctgctcggcgcgacctcggtgtccgtaccgatgctggtggtggcgcgtctgctgctgggtgtgacaatcggcctgtcggtggtggtggtgccggtgtatgtggccgagtcggcgccggcggcggtgcgtgggtcgttggtgaccgcgtatcagctggcgacgcttagcggcatcgtcgtcggttacctggtcggctacctgttggccggatcgcacggctggcgcgcgatgttcgggctggccgccgcgccggccacgctgctgttgccgttgttgtggcgcatgcccgataccgcccgctggtatctgctcaagggccggatcgccgacgcgcgtagcgcgctgcggcggatccagccggaggccgacatcgatgccgagctggccgatatggcggccgcggtcgacgaacgcggcggcggtatcggcgaaatggtgcggcggccgtatctgcgggccacgctgttcgtcatcgcgctcggcttcctcgtccagatcaccgggatcaacgcgatcatctactacagtccgcgacttttcgccgccatgggcttcgcgggctatttcgcgatgcttgccctgcccgcgatggtgcaagtcgccggcttggcggcggtgtgtgcctcgctgtttctggtcgatcggctgggccgtcgcccgatcctgttgtccggcatcgcgacgatgatcaccgcagatgccgtgctgatcaccgtattcgccaacgactccgatggtggcacggggctggtgttggggttcgccggcgtgctgctgttcatcatcgggttcaacttcggattcggctcgctggtctgggtgtacgccgcggagagcttcccgtcccggctgcggtcgatgggatcgagcctgatgctcacctcgacactgacggccaacgcgatcgttgccgccttctcgctcaccatgctgcgtgtgctcggcggcgcaggcgttttcgcggtcttcggcacgttcgccgtcgtcgcgttcgtggtcgtgtaccgctttgcgccggagaccaagggccgcaaactcgaggagatccggcacttctgggagaacggcggccgctggcccgccgagcggtcaccggcggcggacgaaccgtga

SEQ ID NO: 426 - protein, 502 aa, Mycobacterium bovis
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPDTARWYLLKGRIADARSALRRIQPEADIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSLMLTSTLTANAIVAAFSLTMLRVLGGAGVFAVFGTFAVVAFVVVYRFAPETKGRKLEEIRHFWENGGRWPAERSPAADEP

SEQ ID NO: 427 - DNA, 2251 bp, Oryza sativa
  CDS (152)..(1723)
gttcgacatctcccacctttctcgcgcccccattggattgggggcgtccgccattgatgaccagctccgaatctagtacggcgaatcgcccgcggcaaggagcagcgtcgccgtcgcccgtggatcgccgggagcccggagggaggcggcgatggcgggcgcggaggccgccaatggcaggaacaagtacgcggttcttgatcccagcgacgagccggaggggcggaggaggccctcggcgtgggagcggaggagcaaggagcggttcgtgctcgcctgcgccatcttcgcctcgctcaacgccatcctcctcggctacgatgttggtgtaatgagtggcgcaataatctacattcagaaagatcttcacattaccgaatttcaggaagaaatcctagttggttgcttgagtgtggtttcactcttgggaagtctgtcaggaggaagaacatctgatgcaattggcaggaaatggacaatggctcttggtgcaattgtcttccaggctggtgcagccataatgacgttcgccccttcattcaccgtgctcatgatcgggaggctccttgctggtgtgggcattggctttggtgccatggtatctgcagtctatatcgctgagatatcccctgcagctgcccgtgggactctcacatccctccctgagatctgtatcaatttagggatcctccttggttatgtttccaactatgctttctcgggcctttcagagcatatcaattggaggattatgcttggtgttggtatcctcccatctgtcttcattggatttgcactttttgtgatcccagaatcacccaggtggttgatgatggaaaagagagttccagaagccagggcagtattgctgcagataagtgagtctgaagctgaggttgaagaaaggattgctgagattgaggaagctgcaaatcttcttaaatcgacgaaatccgaggacaaggcagtgtggatggagctgttgaacccttctcctgctgttcgtcggatgctatatgctggctgtggtatccaaatgttccagcagatcacgggtattgatgctactgtctattacagcccaactattttcagagatgccgggatcaagtctgatcaggagcttcttgcagccacagtggctgttggttttactaagacagtgttcatattggttgcaattttcctcattgataaagttggacgcaaaccgcttctttatgttagcaccattggaatgactatgtgcttatttgtcttggggattgcactcacattgcaaaagcatgccatgggacttatttctccaagaattgggattgacctagcagtttttgcagtttgtggaaatgtggctttcttttcaattggcatgggtccaatatgttgggtcttgtcttcagagatatttcctttgagattacgagctcaagcatcggcactaggtcaagtaggtggtagagtgagcagtggtttggtttccatgtcatttctttccatggcccgtattatatcagtggcaggaatgttctttgtctttgcggttatctcgactgtctctgtggcctttgtgtatttctgcgtgccagaaacgaaagggaaaactctggagcagattgagatgatgtttgaaggtgggaaagaatggagagggagtgagatagagcttgaggatacacaacatttaatacagagcagcaagaagtctgtgtctctaggctgacactattagaaacaataaattcgaaatcattcgatgttcaatgatgaaccatacttatcctgcttccatcgcctacgggattctgaaattcaggtctgcaaaatgatcaggctgccttggactgctacggattttgagggcttaacacgagtatattaggtgtaggcgcaaaacagcatgtaaatgtctgctttacacaactacatcccaaaatgttacctgggaggacacagatgatgttgtatatggcggtatcttccacctaccaaaaaatatagttgttgaagttccttattccacagtttaattttaatagaggaagaggtgtgtgatttccaactgaatgaattctgtgtgattcttgatccagctttttgatttagtccttcatgatattgtagtactgtggctttgttggtctagtataaaaccttcaagaccatgccatgtctatagctttgcattgacgtgcagagttctgtaaataccagatttggatgattcattctgtcaaattaattatttact

SEQ ID NO: 428 - protein, 523 aa, Oryza sativa
MAGAEAANGRNKYAVLDPSDEPEGRRRPSAWERRSKERFVLACAIFASLNAILLGYDVGVMSGAIIYIQKDLHITEFQEEILVGCLSVVSLLGSLSGGRTSDAIGRKWTMALGAIVFQAGAAIMTFAPSFTVLMIGRLLAGVGIGFGAMVSAVYIAEISPAAARGTLTSLPEICINLGILLGYVSNYAFSGLSEHINWRIMLGVGILPSVFIGFALFVIPESPRWLMMEKRVPEARAVLLQISESEAEVEERIAEIEEAANLLKSTKSEDKAVWMELLNPSPAVRRMLYAGCGIQMFQQITGIDATVYYSPTIFRDAGIKSDQELLAATVAVGFTKTVFILVAIFLIDKVGRKPLLYVSTIGMTMCLFVLGIALTLQKHAMGLISPRIGIDLAVFAVCGNVAFFSIGMGPICWVLSSEIFPLRLRAQASALGQVGGRVSSGLVSMSFLSMARIISVAGMFFVFAVISTVSVAFVYFCVPETKGKTLEQIEMMFEGGKEWRGSEIELEDTQHLIQSSKKSVSLG

SEQ ID NO: 429 - DNA, 1648 bp, Orobanche ramosa
  CDS (46)..(1605)
acagttagacaaacatttccttcttcttctccacttcgaatttcaatgacggagcaattgggggcggcggccaaattccgtcggtccggcggatctccgacgaaagcactcatcaataaacctaagaagaatatgtatgctttactgatctccgttatggcgtcgatgacatctatccttctcggatatgataccggggttatgagcggggcgaccctttacataaaaaaggatttgaaaatcacagacgtacaggtcgagattttggtgggtttaatcaatatctactcgctgatcgggtcggccgtagctggtcggacctccgattacttggggcgccggataaccatagttatcgcgtcggttatcttcttcgtcggagctgctgtgatggggctggccaacaattacgcggtgctgatggtggggcggttcgtggctgggctcggcgtcggctacgcgctgatgatcgcgccggtttacgcggctgaggtggcaccggcttcgtctcgcggcttcttgacttcttttccggaggttttcatcaatttcggcgttttacttggatacttatcaaactatgcatttgccaaattttccttgaaattgggctggcgcctcatgcttggtgtcggcgcactccctgctatcttcatcggccttgcggtgattgttatgcccgaatcccctcgttggctggtcatgcagggccgtctgggtgacgccaagaaagtgctcgacagaacgtccgactcgccacaggaagcccaattaagactcgccgacattatggaagccgccggcctgccagaggattgccacgacgacgtcgtcccggtcctcaagcaggaccgcggcggcggcggcgtctggaaggagctgattgtccacccgaccaagcccgtcctccacatcaccattgctgccgtgggctgccagttttttcagcaggccagcggcattgatgccgtggtgatgtacagcccgaggatctacgaaaaggccgggatcacgagcgacgagaagaagctgctcgccaccatagccgtcgggctctgcaagacggtgttcatcctcgtgacgactttcatggtggacaggatcggacggcgtgtgttgctcctcaccagctgcggcggcctcgtgctgtcgatgttgactctggctacgggattgaccgtgatcgatcactacggcgccgacaggttcccttgggtcgtggtcttatgtgtcctaacgacgtattcttcggtcgcgttcttttcgatggggatgggtcccattgcgtgggtgtacagttcggagatcttcccgttgaaattgagagctcagggttgtggtttgggagtcgcaataaaccgcgccaccaacggcgtgatactgatgtcgtttatatcgctctacaatgccatcactattggcggagctttctatttgttcagcggtatcggtatcgtaacttggatctttttctttacgttgttgccggagacgaggggaagaaccttggaggatatggaggtactgtttggcactttctttaaatggaggacaaccatgagagagttgcataagaaggaagcagaagatgctttgtatgcctaaagtgataaatttaagtagtgtgtgcattagattgttatattgg

SEQ ID NO: 430 - protein, 519 aa, Orobanche ramosa
MTEQLGAAAKFRRSGGSPTKALINKPKKNMYALLISVMASMTSILLGYDTGVMSGATLYIKKDLKITDVQVEILVGLINIYSLIGSAVAGRTSDYLGRRITIVIASVIFFVGAAVMGLANNYAVLMVGRFVAGLGVGYALMIAPVYAAEVAPASSRGFLTSFPEVFINFGVLLGYLSNYAFAKFSLKLGWRLMLGVGALPAIFIGLAVIVMPESPRWLVMQGRLGDAKKVLDRTSDSPQEAQLRLADIMEAAGLPEDCHDDVVPVLKQDRGGGGVWKELIVHPTKPVLHITIAAVGCQFFQQASGIDAVVMYSPRIYEKAGITSDEKKLLATIAVGLCKTVFILVTTFMVDRIGRRVLLLTSCGGLVLSMLTLATGLTVIDHYGADRFPWVVVLCVLTTYSSVAFFSMGMGPIAWVYSSEIFPLKLRAQGCGLGVAINRATNGVILMSFISLYNAITIGGAFYLFSGIGIVTWIFFFTLLPETRGRTLEDMEVLFGTFFKWRTTMRELHKKEAEDALYA

SEQ ID NO: 431 - DNA, 1608 bp, Oryza sativa
  CDS (1)..(1608)
atggggcttcgtgccaccgaggcggcgacgggcaacggcggcggcatgaggagccttccggatttcttggggaggaagagcaagtacgtgcgcatggacgacgtgctcccggatgagcagggagatggcggcggcggcggcggcgtcgttcgtgtccgcggcggcggcggcagcgggagatacgtctttgcctgctctgtcttcgcctccctcaaccatgtcctgctcggctacgatgttggtgtgatgagtggctgcatcatattcatccagaaggacctccacatcagtgaagtgcagcaagaagtgctcgtcgggtgcctcagcttcatctccctcctcggcagcctcgccgccgggaggacgtccgacgccgtcggccggaaatggaccatcgggctcgccgctgccgtgttccaggccggcgcggccgtcatgacgctcgcgccgtccttcgccgtgctcatgatgggccggctgctggccggcatcggcatcgggatcgggatcatggtggcgccggtgtacatatcggagatcacgccggccacgctgcgggggtcgtacgcctcgttcccggagatcttcatcagcctcggcatcctcctcggctacgtctccaacctcgccttctccggtctccccgaccacatcaactggcgagtcatgctcgccgccggcatcgtcccttccatctccgtcgcgttcgtgctgctggtgatcccggagtcgccgcggtggctcgtcatgcagggccgggccgccgaggcgcgcgcggtgcttctcaaggtcaccgatggcgaggacgaggcgcaggagaggctcgccgagatcgaggaggcggcgcgcgtcacggccaccggcaacggcaaggccgtgtggcgcgagctcctgaggccgtcgccggtgatccgccgcatgctggtgaccggcatcggcgtgcagctcttccagcagatcaccggcatcgacgcgctggtctactacagcccgacgatattccgggacgccggcatcaccaccgagagccagctgctcgccgccaccgtcggcgtggggctctccaagacggtgttcatcgtgatcgccatcgtcctcgtcgaccgcgtcgggcggaagccgctgctgtacgtcagcacggccgggatcaccgcgtgcctggccgcgctcgccgcgtcgctctccctgctcgcgcacggcgcgctgccgcgggcggcggcgatcggggcggccatcctgacggtgtgcggcttcgtggcgttcttctcggtggggatcgggccgatcaacatggtgctgagctcggagatctacccgctgcggctgcgcgcgcaggcggtggcgctcggcttcgccgtgaacaggctgaccagcggcgcggtggccatgtcgttcctgtccatctgcggcgccgtgtccgtcgcgggtgccttcgccgcgttcgccgccatctcggcgctgtccgtggtgttcgtccacgtgttcgtgccggagatgagcggcaagtcgctggagcagatcgagtccctgttcggcgccggcgccggcgccggcgaggtggagctcggtgacgcggaacatctggtacaagggaaagaaatgagctga

SEQ ID NO: 432 - protein, 535 aa, Oryza sativa
MGLRATEAATGNGGGMRSLPDFLGRKSKYVRMDDVLPDEQGDGGGGGGVVRVRGGGGSGRYVFACSVFASLNHVLLGYDVGVMSGCIIFIQKDLHISEVQQEVLVGCLSFISLLGSLAAGRTSDAVGRKWTIGLAAAVFQAGAAVMTLAPSFAVLMMGRLLAGIGIGIGIMVAPVYISEITPATLRGSYASFPEIFISLGILLGYVSNLAFSGLPDHINWRVMLAAGIVPSISVAFVLLVIPESPRWLVMQGRAAEARAVLLKVTDGEDEAQERLAEIEEAARVTATGNGKAVWRELLRPSPVIRRMLVTGIGVQLFQQITGIDALVYYSPTIFRDAGITTESQLLAATVGVGLSKTVFIVIAIVLVDRVGRKPLLYVSTAGITACLAALAASLSLLAHGALPRAAAIGAAILTVCGFVAFFSVGIGPINMVLSSEIYPLRLRAQAVALGFAVNRLTSGAVAMSFLSICGAVSVAGAFAAFAAISALSVVFVHVFVPEMSGKSLEQIESLFGAGAGAGEVELGDAEHLVQGKEMS

SEQ ID NO: 433 - DNA, 1617 bp, Oryza sativa
  CDS (1)..(1617)
atggggctccccggcgccgagccgccggcggccagcggcggcggcctccctggattcttcggcggcaagagcaagtacgtccgcatggacgacgtgctgccgcaggagcaggaggaggacggcgtcggcggcggaggcggaggcgtccgcgtccgccggagccacagcagcaggcgctacgtcttcgcctgctctgtcttcgcctccctcaactccgtcctcctcggctacgatgttggtgtgatgagcggctgcattctcttcatccagagagacctccacatcaatgaagtgcagcaagaagtgctcgtcgggtgcctcagcttcatctccctcctcggcagcctcgccggcggaaggacgtcggacgccgtcggccggaaatggacgatcggcctcgccgccatcgtgttccaggccggcgcggccgtcatgacgctcgccccgtcgttcgaggtgctcatggtcgggaggctgctggccggcgtcggcatcgggttcggcgtcatgatcgcgccggtgtacatcgccgagatctccccggcggcgtcgcggggctccttcacctccttcccggagatcttcatcaacctcggcatcctcctcgggtacatctccaactacgccttctccggcctcccggaccacgtcagctggcgcgtcatgctcgccgtcggcatcctcccgtcggtgtccatcgcctttgcactgctggtgatcccagagtcgccgcggtggctggtcatgaagaacagggccgacgaggcgcgcgaggtgcttctcaaggtcaccgacagcgaggacgaggcgaaggagaggcttgccgagatcgaggccgccgccgccgtcgcgagcgccggcaagtacggcgacaagacggtgtggcaggagctgacgaggccgtctccggtgatccggcggatgctcatcaccgggctaggcatccagtgcttccagcagatcaccggcatcgacgcgctcgtctactacagcccgacgatattccgggacgccgggatcaccaccgagagccagctcctcgtcgccaccgtcgccgtcgggttcttcaagacggcgttcatcgcgcttgccatcgtgctcatcgaccgcgtcgggaggaagccgctgctgtacgtcagcacggtcggcatgacggcctgcctcgtcgtgctcgcggcgacgctcgccgcgctcgcgcacgggtcggcgtccaggagcgctggcatcgccgtcgccatcctgaccgtgtgcggcgacgtcgcgttcttctccgtcgggatagggcccatctgctgggtgatgagctcggagatcttcccgctccggctgcggtctcaggcggcggcgctcggcgcggtgatgaacagggtgaccagcggcgccgtggccatgtccttcctgtccgtctgccgcgccatctcggttgccggcgccttctccgtcttcgccgtcatatccgccctgtccgtcgtgttcgtctaccggtacgtgccggagacgagcggcaagacgctggaagagatcgagctgctcttcggcggcggcggcggcgacggcgaggcggcgcggggagaggtggagctcggtgacggcgagcacctggtgcacaagggatga

SEQ ID NO: 434 - protein, 538 aa, Oryza sativa
MGLPGAEPPAASGGGLPGFFGGKSKYVRMDDVLPQEQEEDGVGGGGGGVRVRRSHSSRRYVFACSVFASLNSVLLGYDVGVMSGCILFIQRDLHINEVQQEVLVGCLSFISLLGSLAGGRTSDAVGRKWTIGLAAIVFQAGAAVMTLAPSFEVLMVGRLLAGVGIGFGVMIAPVYIAEISPAASRGSFTSFPEIFINLGILLGYISNYAFSGLPDHVSWRVMLAVGILPSVSIAFALLVIPESPRWLVMKNRADEAREVLLKVTDSEDEAKERLAEIEAAAAVASAGKYGDKTVWQELTRPSPVIRRMLITGLGIQCFQQITGIDALVYYSPTIFRDAGITTESQLLVATVAVGFFKTAFIALAIVLIDRVGRKPLLYVSTVGMTACLVVLAATLAALAHGSASRSAGIAVAILTVCGDVAFFSVGIGPICWVMSSEIFPLRLRSQAAALGAVMNRVTSGAVAMSFLSVCRAISVAGAFSVFAVISALSVVFVYRYVPETSGKTLEEIELLFGGGGGDGEAARGEVELGDGEHLVHKG

SEQ ID NO: 435 - DNA, 2574 bp, Oryza sativa
  CDS (569)..(2089)
gcgaagcgtatcggcttcatcgccaatcgatgatgcgacgatgctgatctgatcatctgaacccaacaaaatttctccttcaaaacctgcaagctcaccttcttctcccccagctctctcctccgatcatttgcccaaccaccacccagcccgccagccgtgcgagcgcagctttcctatttaagccgcgcctcgctggctcgctgccgctgcccctgcctcttccccgaatgctggtctctcgtcgccccgtcccctggaatctctccctttctaccttggtccgggaccgcggctcctgaaatctctctctgtccctagaaatttctgcgcgcgtcttccgttcttctccccggtttggttggttcccgagcctgtgacctcgggggcggccgaaaggttggattttgtagagcaggctttacttgcatctgggcaaagattggattttttttgtggagcgattttggggtcgttgttttttggtgcttgtttgctgaagtttggattttgggaggagtttggggggggggggggggttcggtcagatttggtgggagcggagggcatgacgatcgatttgtccatgcccgggagctccgggctcctggacgacgtaggggggaagaagcacatgaatttcttcagcaaccgctacgtgctcgcgctcacgggcgccgcaggaatcggcgggttcctctttggctacgacacaggtgtcatatctggagcccttttgtatattcgggatgactttccagcagtcagagacaattatttcttacaggagacaatcgttagcatggcattggtaggagccatcattggagcagctggcggcggctggatcaatgatacatacggccgtaggaagtctactcttgtggctgacatgctgtttgcacttggctcacttgttatgtgtgctgctggtggtccttacattctgattcttggaaggcttcttgttggcttgggtgtgggtatagcatcagtcacagcgccagtttacattgctgaagctgctccttcggaaattaggggaggtttggtgtcaactaatgtactcatgattactggtggtcaattcttctcctacctcatcaatcttggctttactgaggttcctggaacatggcgctggatgctcggagttgctgctgtgcctgcaattctacagtttgttctgatgctttttttgccagaatctccccgttggcttttctggaaggatgagaaagcaaaagctatttctgtcctagagaagatttatgactctgaccgtctagaggaagaggtagagcttcttgcttcttcttcaatgcatgaatttcagtctgatggtactgggagctatttggacattttcaagtcaaaggaactaaggctagcattttttgctggagctggtcttcaggcgttccagcaatttactggcatcaacactgtcatgtactacagcccaacaattgtccagatggctgggtttacctccaacaagttggcattgctcctttccctcatagtcgctggtatgaatgccgctgggaccattgttggaatctacctgattgaccgctgtggccggcgtcgcctggcccttacaagcttggctggtgtggtggtctccctcgccatcctagcaatggccttcatactgcagtcatcatcagatatctgttcgaatgcactcaatggtgcctgccaaggtgcactgggatggttcgcggtggcgggactcgctctatacatcgccttcttctccccaggtatggggccagttccatgggcagtgaactccgagatctaccccgaggcataccgtggaatgtgtggtggcatgtcagccactgtcaactgggtatctaacctgattgtggcacaaacattcctctcgatcgtcgggttggttgggaccggcctgaccttcctgatcatcgccggaatagcggtgctggccttcatcttcgtggctctctacgtgccggagactaaaggcctcagctttgagcaggttgagctcctgtggaaggagagagcatggggaaaccagggcaatcgccagagccttttgggcgctgcaccgtagtgagccagctctcatcctgcttgcccttgctggcaagggtcggtggctggctccctttttaagatggccgtgccaccctcagtttctatcggctctctctagctgggaagttttaggaagatctggatgcagaccaaattttattacgtggtagcgactagatcattgttctgtcacctggcatgtattgtcaatttctcatggtggaaactgggataatttcagcattgggtgggtgaagaatcaggttgtgttggtgtcgaatcttgtatacatgggaaggactgtacgagctatactggttgtgcattgccgtcacaagtgtatagttccggtgctagatgtgccggggagacggttaaaaacctgttatggacagaaacaggaatgaaaattatcgctttaatattcttgctcgttattcctccaccaggtgtatctgacttggcaaaccttgagagttatatgcagatgatgtattttgt

SEQ ID NO: 436 - protein, 506 aa, Oryza sativa
MTIDLSMPGSSGLLDDVGGKKHMNFFSNRYVLALTGAAGIGGFLFGYDTGVISGALLYIRDDFPAVRDNYFLQETIVSMALVGAIIGAAGGGWINDTYGRRKSTLVADMLFALGSLVMCAAGGPYILILGRLLVGLGVGIASVTAPVYIAEAAPSEIRGGLVSTNVLMITGGQFFSYLINLGFTEVPGTWRWMLGVAAVPAILQFVLMLFLPESPRWLFWKDEKAKAISVLEKIYDSDRLEEEVELLASSSMHEFQSDGTGSYLDIFKSKELRLAFFAGAGLQAFQQFTGINTVMYYSPTIVQMAGFTSNKLALLLSLIVAGMNAAGTIVGIYLIDRCGRRRLALTSLAGVVVSLAILAMAFILQSSSDICSNALNGACQGALGWFAVAGLALYIAFFSPGMGPVPWAVNSEIYPEAYRGMCGGMSATVNWVSNLIVAQTFLSIVGLVGTGLTFLIIAGIAVLAFIFVALYVPETKGLSFEQVELLWKERAWGNQGNRQSLLGAAP

SEQ ID NO: 437 - DNA, 2710 bp, Kluyveromyces lactis
  CDS (428)..(2014)
cgtttaggaaactctagcatctgtacgaggtttctctgaaatgaaacttttttttattgtgtcagttgtaatgtatgaaatgtgacgcaagtcggcatacaaaaaaaaaaattcatgataccaaaaggaaataatcctcgataaagtgaggttgaatgtgggaattcgagttagaaactctagatgtgaaatctctattggaactcagtatttatgacttttggaaacttttcaatgtacgaaaattttgtataaatacaggacaaagtacactgtcttgaacacttgaaacttgaataacgtattctcgtcttcaagaatgatcaaaggtctcatttagaaacgcctaataagtttaaacttacaaaatcacccagtgtcgataacaaaacttcaaggatctagctgtcatacatcaacaattgaaatgtccttagatacagaatcatttgaaactgctgaaaaagcaattgaggtagtcacaaaggaaatggtatctttgacaaattactcagccattggatcattaaccagtcagttatctcagaatgacactaagtcaggtggaattgaacagaaaaagttaccgttgaaaccaatattattgtgtctggctacttcttttgcagggtttatctttggctgggatgttggcacaattggtgggattacaaacatggtatcatttcaaaacttttttggtaccaactttgattcttcgagtaatacacactactttccaaaacttcttattggattaatcgtttccattttcaatatcagttgcgcacttggtggattatttctagtgaagattgctgatattaatggaagaaaaccaggtatttatgctgcaatcactatctattcgttgggaacattgattggctggacatgtggctcctcttggtggtatttcttcttcgcaaggttcatttcaggacttggtgttggtgctactgcggtgatgataccaatgtttatagccgaatctgctcccatcaacattcgtggtgccatggttgtgctctaccagttaatgatcactcttggaattttgctcggaaatgtcatcaactattgttgcagatccactttacacgaaacagataatgccacatggaagatccctgtaggattaggaaacgtctgggccgctatcgtcgcgctaggtgttcattttatgcctgaatcaccagtttttcttaccaagaggttaggaagcgctctcaaagctaaggcagcttttgcccatatgaacaatttggacgtagatgatccaattgtggatagtcatattaggaagatgatggaatcagctgacgcggaggtatctactcacaatgatatgaagaacagcaggtttgaattcatactcggtcaaccaagattaggttttagactatttattggtattatggtgatggcgtttcaacagctatccggtgcaaattacttcttctattatggtacaacacttttcaactctgtgggaattgaagacccatacttaacgtcgattttattgtcttctgtcaacttcatatctacctttttcggtatttatttagttgaaaagttaggcagaaaagcatgcttaattcttggttccgcgggtatgtttacctgtatgtccgtgtatgcgtcagtcggatcgttcgcacttaataagtcgcctcaaaactctggtgcgattatggttaccttcacgtgtgtttacatcatgttctttgcatgcacatcgggacctgtgtcctttgtcgtcatttcggagttgtttccaagcaggacaaaagcgatatccatggcagtgtgtacctcaatcaattggctttgcaacttcttcatttctttatgcacaccatatgtcactgataagataggcttcaagtttgggttcgtttttgctggttgtctatttgtctcattctggttcttcactttcttattgaaggaaactaagaacaaaactcctgaacaggttgacgcattgtattctattgacaagcaataggcaatggaccatacaggtatacttctacaaacaaagaaatttacaatgagctcaactgttcacataatctactgaagcctcccgatttctctgttcgagtgtgcgcttgaatcgctctccttcatataatttcactgtgtaaaacctattaactttctcattacgtatcattttacaagtgtctcaatggcattaaatttgtaattatttcagaagaattttaataacaaggcatttctgtctcccagccctgtgatatcttaatacttctatttactcttgtgttgttttatcgggctctcacttatcaatcaccgaagatgattcctgattcctcatatatttactcaacaagaaaaaaaggaagagatggcaatatgtaattgaaaatatgaaagcactcacatactatgattcaaaaatccagcaattggttgtaagccaaataaaccggtgatcgagagcactgagtattgttgctcaacgatgtttaaaagaggttcaaacagagctacttcgtcttctcaagggcagcaaccagaaaatcctccctctctgaaatatcagtcgtcaagttcacgatactcttttcatcgacagtacaacacaggttttggaacttcaccttttaggatatcacctaagtataaaccagatagccgcactcccttcagttttgatggtacgggaaatgtt

SEQ ID NO: 438 - protein, 528 aa, Kluyveromyces lactis
MSLDTESFETAEKAIEVVTKEMVSLTNYSAIGSLTSQLSQNDTKSGGIEQKKLPLKPILLCLATSFAGFIFGWDVGTIGGITNMVSFQNFFGTNFDSSSNTHYFPKLLIGLIVSIFNISCALGGLFLVKIADINGRKPGIYAAITIYSLGTLIGWTCGSSWWYFFFARFISGLGVGATAVMIPMFIAESAPINIRGAMVVLYQLMITLGILLGNVINYCCRSTLHETDNATWKIPVGLGNVWAAIVALGVHFMPESPVFLTKRLGSALKAKAAFAHMNNLDVDDPIVDSHIRKMMESADAEVSTHNDMKNSRFEFILGQPRLGFRLFIGIMVMAFQQLSGANYFFYYGTTLFNSVGIEDPYLTSILLSSVNFISTFFGIYLVEKLGRKACLILGSAGMFTCMSVYASVGSFALNKSPQNSGAIMVTFTCVYIMFFACTSGPVSFVVISELFPSRTKAISMAVCTSINWLCNFFISLCTPYVTDKIGFKFGFVFAGCLFVSFWFFTFLLKETKNKTPEQVDALYSIDKQ

SEQ ID NO: 439 - DNA, 1848 bp, Saccharomyces pastorianus
  CDS (1)..(1848)
atgaagggattatcctcattaataaacagaaaaaaagacaggaacgactcacacttagatgagatcgagaatggcgtgaacgctaccgaattcaactcgatagagatggaggagcaaggtaagaaaagtgattttgatctttcccatcatgagtacggtccaggttcactaacaccaaacgataataatgaagaagtccccgaccttctcgatgaagctatgcaggacgccaaagaggcagatgaaagtgagaggggaatgccactcatgacagctttgaagacatatccaaaagctgctgcttggtcactattagtttccacaacattgattcaagagggttatgacacagccattctaggatctttctatgccctgcctgtttttcaaaaaaaatatggttctttgaatagcaatacaggagattatgaaatttcagcttcctggcaaattggcttgtccttatgcgttacggctggtgaaattgtaggtttgcaaatgactgggccttttgtagattatatgggtaatcgctatacattgattttggcattgattcttcttgctgcattcacctttattctgtatttttgcaagggtttgggtatgattgctgtgggacaagtattgtgtggtatgccatggggttgtttccaatgtttgaccgtttcttatgcttctgaaatttgtcctatggccctaagatactatttgacgacttattctaatttatgttggacgttcggtcaacttttcgctgctggtattatgaaaaactcccaaaataagtaccctaactcagaactaggatataagctaccttttgctttgcagtggatctggcctgctcctcttgcaataggtattttttttgcaccagagtctccatggtggctggttaaaaaaggaaggattgatcaagcaaggagatcacttgaaagaacattgagtggtaaaggacccgagaaggaattactggtaagtatggagctagataatatcaaagtaaccattgaaaaggaaaaaaagctgtcagactcagaaggttcctattgggattgtctgaaggacagtgttaataggagaagaacgagaatagcttgtttatgttgggtcggtcaaaccacctgtggtacatcattaattggtaattcaacttacttttatgaaaaagctggagttggtactgatacggctttcactttcagtattatccaatattgtcttggtattgccgcaacatttctttcttggtgggcttcaaaatattttggtaggtttgacctttacgcatttggattggctatacaaacagtttcattgtttatcataggaggtttgggatgctccgactcgcatggcgctgaaatgggaagtggttctcttttaatggttctttccttcttctacaatttgggtattgctcccgttgtgttttgcttagtgtccgaaataccatcctcaaggctaagaactaaatcgattattctggctcgtaacgcatataatatggcatctattgtaactactgttttgatcatgtaccaattgaactcagaaaaatggaactggggtgccaagtcgggctttttctggggagggttatgttttgccactctagtttgggccgtaattgacctaccagaaactgctggcaggacttttattgagataaatgaattgtttagacttggtgttccagcaagaaagttcaagtcgactaaagtcgacccttttgcagctgccaaagcagcagctgcagaaattaatgttaaagatccgaaggaagatttggaaacttctgtggtagatgaagggcgaagcaccccatctgttgtgaacaaatga

SEQ ID NO: 440 - protein, 615 aa, Saccharomyces pastorianus
MKGLSSLINRKKDRNDSHLDEIENGVNATEFNSIEMEEQGKKSDFDLSHHEYGPGSLTPNDNNEEVPDLLDEAMQDAKEADESERGMPLMTALKTYPKAAAWSLLVSTTLIQEGYDTAILGSFYALPVFQKKYGSLNSNTGDYEISASWQIGLSLCVTAGEIVGLQMTGPFVDYMGNRYTLILALILLAAFTFILYFCKGLGMIAVGQVLCGMPWGCFQCLTVSYASEICPMALRYYLTTYSNLCWTFGQLFAAGIMKNSQNKYPNSELGYKLPFALQWIWPAPLAIGIFFAPESPWWLVKKGRIDQARRSLERTLSGKGPEKELLVSMELDNIKVTIEKEKKLSDSEGSYWDCLKDSVNRRRTRIACLCWVGQTTCGTSLIGNSTYFYEKAGVGTDTAFTFSIIQYCLGIAATFLSWWASKYFGRFDLYAFGLAIQTVSLFIIGGLGCSDSHGAEMGSGSLLMVLSFFYNLGIAPVVFCLVSEIPSSRLRTKSIILARNAYNMASIVTTVLIMYQLNSEKWNWGAKSGFFWGGLCFATLVWAVIDLPETAGRTFIEINELFRLGVPARKFKSTKVDPFAAAKAAAAEINVKDPKEDLETSVVDEGRSTPSVVNK

SEQ ID NO: 441 - DNA, 1927 bp, Prunus cerasus
  CDS (56)..(1585)
aatttgcttctctctaaatcacactgttctgcaatcaaacaccacagagctcaagatgactgaccggagagctcaagacaacgccgtttccggccagcccctgctcaagaagaagcccaaaagaaacctgtacgccatcggttgcgccattttggcttccatgacttcaatcttgctgggctacgatattggcgtgatgagtggggcttcaatctacatacagaaggacctgaaaatctcggacgtggaagttgagatcctcatagggattctgaacctctactcgctcatcggctccgccgccgccggccgaacttctgactggattggccgccggtacactatcgtcttcgccggagccatattcttcaccggagctctcctcatgggcttggccacgaactacgccttcctcatggtcggtcggttcgtagccggaatcggcgtcggctacgccctcatgatcgctccggtctacaacgccgaggtctctccggcgtcttctcgcggcgctctcacgtctttcccggaggtctttgtcaatattggcatattattggggtacgttgccaactatgccttctccgggcttccgattgatttgggctggcggctcatgctcggagttggcgtatttccctccgttattctcgccgtcggtgtcttatcaatgcctgagtcgccccgctggcttgtcatgcagggtcggctcggcgaggccaagcaagtcctcgacaaaacctcggactccttggaagaggctcagcttcggctagctgacatcaaagaagccgcgggcatccctgagcattgcgttgaagacgttgttcaggttcccaagcacagccacggcgaggaagtgtggaaggagttgctcctccatccaacgccccctgttcgtcacattttaatagcagccattggtttccacttcttccaacagttgtcaggtatcgacgccctcgttttgtacagcccaaggatctttgaaaaggctgggatcaccgactccagcacgttgctgctcgcaacagtggccgttggattttccaagaccattttcaccctggttgccataggtttcctcgatcgagtcggacgacgcccgttgcttctaacgagcgtggccgggatgatagcctcgcttctctgtctcggtacgagcctcacaatcgtcgatcatgaaaccgagaagatgatgtgggcgtctgttttgtgcttgaccatggtattagcctacgtcgggttcttctcgatcgggatggggcccattgcgtgggtctacagctctgagatcttcccgttgaagctacgtgctcaaggttgcagcatgggaacagccgtgaataggattatgagtggagtcctctcaatgagttttatctcgctgtataaggcgataacgatgggggggaccttctttctttatgcaggaattgctacggttggttgggtgttcttttatacaatgctcccggaaacacagggtagaacccttgaagacatggaggtcttgtttggcaagttctggaggtggagagaaggctatgcactgctcagaaacaaaagggccgtcgtatgctagtgagtatacttgggtgatgtggtatatgaaagcacttgaactctagagtagggtgtttgattgaaaaattgttgtatgcgtcggttatatatttgtcgctacaaatgctcctattagagaagacagtagcgctcggcctggtcctatttttggaggtccgatggtcggagaagaagccaagtcaatcatggagcgtgttactactacccatgaaatttcttctatgaagattttagtacaagttaagatgaacgaaacaatagttaagatgaaatttgttatatatgtattgtgccaaatttgttttccatttgttgcttttaaaaaaaaaaaaaaaaaaaa

SEQ ID NO: 442 - protein, 509 aa, Prunus cerasus
MTDRRAQDNAVSGQPLLKKKPKRNLYAIGCAILASMTSILLGYDIGVMSGASIYIQKDLKISDVEVEILIGILNLYSLIGSAAAGRTSDWIGRRYTIVFAGAIFFTGALLMGLATNYAFLMVGRFVAGIGVGYALMIAPVYNAEVSPASSRGALTSFPEVFVNIGILLGYVANYAFSGLPIDLGWRLMLGVGVFPSVILAVGVLSMPESPRWLVMQGRLGEAKQVLDKTSDSLEEAQLRLADIKEAAGIPEHCVEDVVQVPKHSHGEEVWKELLLHPTPPVRHILIAAIGFHFFQQLSGIDALVLYSPRIFEKAGITDSSTLLLATVAVGFSKTIFTLVAIGFLDRVGRRPLLLTSVAGMIASLLCLGTSLTIVDHETEKMMWASVLCLTMVLAYVGFFSIGMGPIAWVYSSEIFPLKLRAQGCSMGTAVNRIMSGVLSMSFISLYKAITMGGTFFLYAGIATVGWVFFYTMLPETQGRTLEDMEVLFGKFWRWREGYALLRNKRAVVC

SEQ ID NO: 443 - DNA, 2032 bp, Prunus cerasus
  CDS (74)..(1690)
gcacgaggcacttctgcaatttgaggccatttttctaggcaactgtccagtctctgtctctgtctctaagaagatggctgaccggagagctgaatataatgccgtcgtctccggccaaccccagaaaaacatagcagactttgatcccccggggaagccaaagagaaacaagtacgcctttgcttgtgccatcttggcttccatgacttccatcttgcttggttacgatattggtgtgatgagtggagctgtaatctacataaaaaaagacctcaaagtcagcgacgtagaaattgaggttcttgtcggtattctgaacctttactccctcatcggctcggccgcagctggcagaacttccgactggatcggccgtcggtacaccatagtcctcgctggagccatcttcttcgccggagctctcctcatgggatttgcccccaactatgcctttctcatgttcggccggtttgtcgccggaattggagtcggctacgccctcatgatcgctccggtctacaccgccgaggtctctccggcgtcgtctcgtgggttcctcacatctttcccagaggtgtttatcaatgctgggatattgttcggctacgtgtccaattatggcttctcaaagctcccaactcacttgggatggcggctcatgctcggtgtgggagccatcccctctattttcctagccatcggcgtcttagccatgcccgagtcgcctcgttggctcgtcatgcagggtcggctcggcgacgccaggaaagtcctcgacaaaacctcagactccctagaagagtccaagcttcggctaggcgaaatcaaagaagccgccggcatccccgaacactgcaacgacgacatcgttgaggtcaagaagcgcagccaaggccaagaagtgtggaaacagttgctccttcgtccaacaccggccgtccgtcatattttaatgtgtgccgttggtttacacttctttcagcaagcgtcaggtatagacgccgtcgttttgtacagcccaaggatctttgagaaggctgggatcaccaaccccgaccatgtcctactctgcaccgtcgccgttggattcgtcaagaccgttttcatcttggtcgccacgtttatgctcgatcggatcggaagacgtccgttgcttctaactagtgtggccggcatggtattcacgcttgcatgtctcggtttgggccttacgattatcgatcacagcggggagaagatcatgtgggctattgctttgtccttgaccatggtattagcatacgtcgcgttcttctcgatcgggatgggccccatcacatgggtctacagctctgagatcttcccgttgcagctacgtgctcagggttgcagtataggagtggccgtgaacagggtggtgagtggggtcctctcgatgacttttatttctctgtataaggccatcacaattggcggggccttctttctttttgcggcaattgcagcggttggttggacgttctttttcacaatgctcccagaaacacagggtagaacccttgaggacatggaagtcttgtttggaaaattctacaggtggagaaaagccaatgcactcctcaaacagaagaagcaagttgatcatggtgatggcaacaacaatcccaacaaccctcaaatccaattgggaacaaaagggcaagctaattagattagttaatccacttgatggtagtatattgtagtagatatagactcttaaaagttattgtgtgcttcagttatatgtaattcacaagtacaagtatttcttctctgaatcggctataaaagatgaaggggttttcgacgaaagagaggaaaaaagagtttgtaagcaatcaagaaaaacaaagttcagatcaaattaattagatatgtattgtacaagtttgtgcttcaaaatgtgtttttccatttggaacttttatttgtacttttccaaagcaatgagaatagggccacaatcgacccatgatagataaaaaaaaagaaaaaaactcgaaggggggcc

SEQ ID NO: 444 - protein, 538 aa, Prunus cerasus
MADRRAEYNAVVSGQPQKNIADFDPPGKPKRNKYAFACAILASMTSILLGYDIGVMSGAVIYIKKDLKVSDVEIEVLVGILNLYSLIGSAAAGRTSDWIGRRYTIVLAGAIFFAGALLMGFAPNYAFLMFGRFVAGIGVGYALMIAPVYTAEVSPASSRGFLTSFPEVFINAGILFGYVSNYGFSKLPTHLGWRLMLGVGAIPSIFLAIGVLAMPESPRWLVMQGRLGDARKVLDKTSDSLEESKLRLGEIKEAAGIPEHCNDDIVEVKKRSQGQEVWKQLLLRPTPAVRHILMCAVGLHFFQQASGIDAVVLYSPRIFEKAGITNPDHVLLCTVAVGFVKTVFILVATFMLDRIGRRPLLLTSVAGMVFTLACLGLGLTIIDHSGEKIMWAIALSLTMVLAYVAFFSIGMGPITWVYSSEIFPLQLRAQGCSIGVAVNRVVSGVLSMTFISLYKAITIGGAFFLFAAIAAVGWTFFFTMLPETQGRTLEDMEVLFGKFYRWRKANALLKQKKQVDHGDGNNNPNNPQIQLGTKGQAN

SEQ ID NO: 445 - DNA, 2012 bp, Malus domestica
  CDS (104)..(1579)
gcacgaggaagataatgccctccccgcacctccgatcaaagttgatccgcggaagaagcccaagaggaacaagtatgcgctcgcttgtgctattctggcctccatgacttcaatcctgatgggttatgatattggagtgatgagcggagcttcaatctacatcgaaaaggacctcaaggtcacggacacgcaaatcgagatcatgatcggtgttattgaaatctactccctcattgggtccgccatggccggaaaaacttccgactgggtcggccgccgctacaccatagtcatctccggagcgattttcttcatcggagcgattctcatggggttctccaccaactacaccttcctcatgtgcggccgctttgtcgccggcatcggagtcggctacgccctcacgattgctcccgtctacagcgccgaggtctctccgacgtcgtctcgcggcttcctcacgtctttcccagaggtgtttgtgaatattggcatattattggggtatttatccaactatgccttctccttttgccctcttgacttggggtggaggctcatgctcggtgttggcgcaattccctcagttggtcttgccgtcggtgtcttggcaatgcctgagtcgcctcggtggctcgtcatgcagggtcgactcggcgaagccaagcgagtcctggacagaacctcagactccaaagaagagtccatgctcagactagccgacatcaaagaagctgctggaatccccgaggagtgcaatgacgatatcgttcaggtctctggtcacagccacggtgaaggcgtgtggaaggagttgcttgttcatccgacaccaaccgttcgtcatattttaattgcagccatcggtttccacttctttcagcaagcctcaggtatagacgcccttgttttgtacagtccaagagtctttgcaaaggctgggatcaccagcacaaaccaattgctactctgcactgtgggagttggactttccaaaactgtcttcaccttagtcgcgacttttttccttgatcgggttggacggcgtccactactgttaacgagtatggctggtatggtaggtgccctggtgtgtcttggtacaagccttaccattgttgatcaacacgaaggggttagaatgacgtgggcagttattttgtgcttgtgctgcgtattagcctatgtcgggttcttctcaagtgggattgggcccattgcctgggtgtacagctctgagatcttcccgttgaggctgcgggctcaagggtgtggtatgggagtggccgtgaataggttgatgagtggcatcctctcaatgaccttcatttcgttgtataaggccatcacaatgggtggtaccttctttctttatgcggccatcggcactgttggttggatcttcttttttacgatgctcccggaaacacaaggcagaacccttgaagatatggaggtcttgtttggtaagttccacaagtggagaaaagccaataaactgctcgaaaagaaaaagcgagttgctcatggtgatattggcacgagtgatccggacaacagggcgcacctcttagcttagtgagtgaatttaaacaagtactagaactacacaacatctcttgaattaaaacaaatttattgtacgcacccggtatattaagggtgattccgcccactggatcctaattttggaggttcagtggtcgtttactatcctaggaactgcctatccgacgatcgaaaattgctcgtcttaatttggtgacaaaggattgatgattttcgagcccggaaacgaggacggagcttctatccaatgaagaacaccaacctaagatgaagttaggtatgtattgtacaagtttgttggtcggactgtcgttttttcagtatttgccgtggctttttatttgttgtggatacattggcacccaactaccggagaatattgttttggtgtcgattgtaataaaacatttcctcttgaaaaaaaaaaaaaaaaaaaaaaaaaa

SEQ ID NO: 446 - protein, 491 aa, Malus domestica
MTSILMGYDIGVMSGASIYIEKDLKVTDTQIEIMIGVIEIYSLIGSAMAGKTSDWVGRRYTIVISGAIFFIGAILMGFSTNYTFLMCGRFVAGIGVGYALTIAPVYSAEVSPTSSRGFLTSFPEVFVNIGILLGYLSNYAFSFCPLDLGWRLMLGVGAIPSVGLAVGVLAMPESPRWLVMQGRLGEAKRVLDRTSDSKEESMLRLADIKEAAGIPEECNDDIVQVSGHSHGEGVWKELLVHPTPTVRHILIAAIGFHFFQQASGIDALVLYSPRVFAKAGITSTNQLLLCTVGVGLSKTVFTLVATFFLDRVGRRPLLLTSMAGMVGALVCLGTSLTIVDQHEGVRMTWAVILCLCCVLAYVGFFSSGIGPIAWVYSSEIFPLRLRAQGCGMGVAVNRLMSGILSMTFISLYKAITMGGTFFLYAAIGTVGWIFFFTMLPETQGRTLEDMEVLFGKFHKWRKANKLLEKKKRVAHGDIGTSDPDNRAHLLA

SEQ ID NO: 447 - DNA, 1563 bp, Neurospora crassa
  CDS (1)..(1563)
atggtcggcggcggcccccaatctgacaatgtcatccatcggatggccatggatgatcccattccatggtggaagaagccccatctgcggaacatgtacctgcttcttttcccctgtgtcatcggtatcgagatgacgtcggggttcgattcacaaatcatcaactccgcacagttgttgcctgcgtggaaaaaatacttcggccacccaaccggcggctacagcggcattctcgcttccgctcttcctctcggttccgtcctcggtctgcccttcatcccgctgattaacgacaactttggccgtcgatggtgcatcatgtttggttcctgcatcatgatcatcggcacattcattcagggtttttcgaagaacgcccccatgtacatcattgcccgcgccatcattggtttcggtctcccctacgccattgtcgccggctcatgcttgattggcgaactcgcataccccaaggaacgtcccattctgacatccctcttcaacgcctgctacttcatcggcgccatcgtggccgctggctgcacgtatggtacacaacgaattacaaacgattggtcatggcgaattccctcccttcttcaaatggctccttccctcctccaagtcatctttgtcttcttccttccagaatctccgagatacctgatgagtaaacatcgacttgaggaagcaaagaatgtgctcatccgctaccatgccgaaggaaacgcggacagtgacttcgtcaaggcggaaattgccgagatcaaagtcactctcgagattgagttggagcattcgaagcagtcgtgggcggatatgatccggaccgccggtatgcgtcgccgcgtgctcatcggttctttgctcggccttttcactcaactctcaggcaatgtcgtcatttcgtactttctcggtgacgttctcaagttgatcggctacacggatcccagctttcagaccaagtataacttgggtaaccagtgctggagtttggtctgcggtgtcagcgccgcgatggtggttatgcggttccggcgcaggaccatgtacctgacgggcatcttttcgattttggcagtctacgttggctggacggtgtgcacggcggtgtttattgcgtacaagaatcccgtggccgccaagtttagtttgttctggatctatgcttatagtccggcttacaacttgtgtttcaacgctcttacctatacctacctcgtcgaaatcttcccctacgcccaacgcgcccgcggcatcgccatcttccagttctggggcaaggcggcgcagttcttcggcaccaacgtcaacccgatcggcacccaggccattggctggaagtacctgcttgtgtactgctgctggatctttgccgaggcggcgctcatctggttcttgtggccggagacgtcgaatcgtagtttggaggagttggctttcttgtttgagaataaggaagacctggctcagttgcagcagaagagggtagagactgaaaagggggttggagaactggataatgagaagcattctgttgttcacgagaggcaggtttga

SEQ ID NO: 448 - protein, 520 aa, Neurospora crassa
MVGGGPQSDNVIHRMAMDDPIPWWKKPHLRNMYLLLFPCVIGIEMTSGFDSQIINSAQLLPAWKKYFGHPTGGYSGILASALPLGSVLGLPFIPLINDNFGRRWCIMFGSCIMIIGTFIQGFSKNAPMYIIARAIIGFGLPYAIVAGSCLIGELAYPKERPILTSLFNACYFIGAIVAAGCTYGTQRITNDWSWRIPSLLQMAPSLLQVIFVFFLPESPRYLMSKHRLEEAKNVLIRYHAEGNADSDFVKAEIAEIKVTLEIELEHSKQSWADMIRTAGMRRRVLIGSLLGLFTQLSGNVVISYFLGDVLKLIGYTDPSFQTKYNLGNQCWSLVCGVSAAMVVMRFRRRTMYLTGIFSILAVYVGWTVCTAVFIAYKNPVAAKFSLFWIYAYSPAYNLCFNALTYTYLVEIFPYAQRARGIAIFQFWGKAAQFFGTNVNPIGTQAIGWKYLLVYCCWIFAEAALIWFLWPETSNRSLEELAFLFENKEDLAQLQQKRVETEKGVGELDNEKHSVVHERQV

SEQ ID NO: 449 - DNA, 1614 bp, Neurospora crassa
  CDS (1)..(1614)
atgacagacaacccagaagagcccttgatcgccaacactcaatcgacggagagggaccaagatgatggcagccatgatgtcgaacatgcgcatgattcccggggagggaaacagcacatatcaccgcccggcctgttcatctggctactcaccttttccgccggaataagcggtctactcttcggctacgacacaggcgtaataagcgccacccttgtctctatcggtacctccctctcgcaccggcccctgacctcgctcgacaaatccgtcatcacctcatgcacctccctcttcgccctgctcgcgctacccttcgcctccgcgctcgccgacgaccggggccgcaagcgcgttgtcctcttcgccgacaccctcttcatcatcggcgccctctgccaggccgccagccggaccgtcgaggtcatggtaattgggcggtcggttgtcggcatagccatcggcgccgccagcttcgtgacgccgctgtacattgccgagctggcgcctgcgacgcaccgcggccggttggtgacgatgaacattgtgtttatcacgcttgggcaggtggttgcgtacgtggtaggctggatctttgggacgtatggtagtccggagacgacggggtggagatggatggtcgggttgggcgcggtgccggcggtttgtcaggtggtcatcttgttgtggatgccggagagcccgaggtggttggtgaaggacggaaggtcgcaagaggcaagagcggtgattgctaagattgccgcgggggatgatgcgcaggatccgtcgacgaggagggaagtggatgctgtgttgaagagcatcgagattgaggtgagagaggaggctacggctatgagactgggtggcgccggggccgggtatgcaaatgggaatgcagtgaatgcgtggatggaggctatgcgggaactgatcagggtgaggaggaacagacgggcattggcaattgcttgtctcctccagggtcttcagcagctgtgcggatttaactcgctcatgtacttctcggccacgatattcacgatggtggggttttcagagccgactttgacctcgctagtcgttgcagtcaccaactttgccttcaccttagttgccctggtgttgatcgaccgggtgggaaggagacgcattctactctggtctcttccctttatgattgcaggtctggtgcttgccggctatggcttttcgttcatcgagctcccgaattcagagaccagctcgccctcgacaacgggaggtcagggcggggccgtcattattttggcgagcatcatgatttatgtggctggctatgccatcggactgggcaatgtgccctggatgcagagcgagctcttctcactgagtgttcggtcagtgggcagtggtgttgcaacagcgaccaactggagcgccaactttgtgattggactgacgttccttccgctgatggaggccttgtcgccgtcttggacgtttgtcctgtacgcagtgatctgcgcggttgggtatggcctgatttggacggtataccctgaaaccgcagggctgagcttggaagatgcggcgacccttctagaagcggatgactggggggtgcggtaa

SEQ ID NO: 450 - protein, 537 aa, Neurospora crassa
MTDNPEEPLIANTQSTERDQDDGSHDVEHAHDSRGGKQHISPPGLFIWLLTFSAGISGLLFGYDTGVISATLVSIGTSLSHRPLTSLDKSVITSCTSLFALLALPFASALADDRGRKRVVLFADTLFIIGALCQAASRTVEVMVIGRSVVGIAIGAASFVTPLYIAELAPATHRGRLVTMNIVFITLGQVVAYVVGWIFGTYGSPETTGWRWMVGLGAVPAVCQVVILLWMPESPRWLVKDGRSQEARAVIAKIAAGDDAQDPSTRREVDAVLKSIEIEVREEATAMRLGGAGAGYANGNAVNAWMEAMRELIRVRRNRRALAIACLLQGLQQLCGFNSLMYFSATIFTMVGFSEPTLTSLVVAVTNFAFTLVALVLIDRVGRRRILLWSLPFMIAGLVLAGYGFSFIELPNSETSSPSTTGGQGGAVIILASIMIYVAGYAIGLGNVPWMQSELFSLSVRSVGSGVATATNWSANFVIGLTFLPLMEALSPSWTFVLYAVICAVGYGLIWTVYPETAGLSLEDAATLLEADDWGVR

SEQ ID NO: 451 - DNA, 1596 bp, Emericella nidulans
  CDS (1)..(1596)
atggctttcaagaagtcctacaatgtttacttcctttgcgggttcatgacccttggtggtggtctgttcggtttcgacatctcgtcgatgagtggtgtcttgggtaccgcggcctacaacaactactttcaggtcggcggcggcaattacaaacagggtggaatcacttgtgctatgccatttggatcgctcgtcggtgccctagcctccagtttccttgccgacaaatactcgcgtgtcactgcaattcagttctcgtctactttgtggattattggatcagtctttcaatgtgccgccaacggtatccccttgctggtcgtcggtcgtgtcattgcaggcctctgcgttggcatcgcctcagctatggttccggtctacatcgccgaagtgagcccaaagcatatccgagggcgaatgatatcgctacagcaatgggcaatcacctggggtatcctgatccagtacttcattcaatacggcgctagcaacgtcgacggcgggcctgacaatgaaacccagagcacagcggccttccgaattccatggggtatccagattgtccccggtgtaatttacttcgttggtttgtttctataccctaaatcgccccgctggctggcgagcaaggaccgctgggacgagtgcatgcatgtcctcgcccgcctccacgggaacggagacatgaaccacccccttgttctggcccagtacaaggaaattcaggacgcgctcgcccttgaacgtgagcaggctagcaccagctatcaggagctcatcaagccacgcatcgcaaagcgtgttttcctgggcatgagtctgcagatgtggtcgcaattgtcgggaatgaacgtcatgatgtactacatcgtctacatcatgcagtccacaggagcgggctcccctcttctaacagcttccattcaatacatccttaacacggcccttactctcccagcgattctctggctcgaccgcttcggccgccgccctgcgatcctcattggcttcaccatgcaagcaatcttcctttacattgagggtggcctgcaagccggctatggtcgctcgactcgaccgtccgacgacctaaacgccatctcctggaccgtggcggaccacccgggtgtgggcaaggctatcatcgccatgtcgtacctctttgtctgctccttcgcaacgaccattggtccaacttcctggacctacccggctgaaatctacccggccaaggtccgtgccaaggctgtctcactggctacggcgtccaactggacctggaactgtctccttgcgctctttgttccgccacttctgtggaatatcaactggaagatgtacatgattttcgcagccttcaacactgtcgccgccttgcacatgttcctgaccgcccctgaaacaaaaggatacacgcttgaggagatggacgaggtctttgagagcggcatcgcgccctggaagaaaaggaagatcagctcccgtcttgagcagatcgagagggagattgccgagggtaacctcaaggttacggaccggactggtcccgtcgatcctgtgcaggagaacgttggtgaaccggagaaggcggtgtaa

SEQ ID NO: 452 - protein, 531 aa, Emericella nidulans
MAFKKSYNVYFLCGFMTLGGGLFGFDISSMSGVLGTAAYNNYFQVGGGNYKQGGITCAMPFGSLVGALASSFLADKYSRVTAIQFSSTLWIIGSVFQCAANGIPLLVVGRVIAGLCVGIASAMVPVYIAEVSPKHIRGRMISLQQWAITWGILIQYFIQYGASNVDGGPDNETQSTAAFRIPWGIQIVPGVIYFVGLFLYPKSPRWLASKDRWDECMHVLARLHGNGDMNHPLVLAQYKEIQDALALEREQASTSYQELIKPRIAKRVFLGMSLQMWSQLSGMNVMMYYIVYIMQSTGAGSPLLTASIQYILNTALTLPAILWLDRFGRRPAILIGFTMQAIFLYIEGGLQAGYGRSTRPSDDLNAISWTVADHPGVGKAIIAMSYLFVCSFATTIGPTSWTYPAEIYPAKVRAKAVSLATASNWTWNCLLALFVPPLLWNINWKMYMIFAAFNTVAALHMFLTAPETKGYTLEEMDEVFESGIAPWKKRKISSRLEQIEREIAEGNLKVTDRTGPVDPVQENVGEPEKAV

SEQ ID NO: 453 - DNA, 1407 bp, Bacteroides thetaiotaomicron
  CDS (1)..(1407)
atgaaaacaacaattaatctgggttatatcatattcctttcagtcgttgctgctttaggaggctttctgttcggttatgacacagctgtcatatccggcacaatagctcaggtgacacatctgtttcagttggacaccttgcaacaaggatggtatgtaggatgcgcattgatcggatcgattgtcggtgttctcttttccggaatattgagcgacagcatcggacgtaaaagaacaatgatactttctgccattctgttttctacatcagcaatcggctgtgctttttgcattgactttaaccagttagttgtttatagaatcataggtggcatcggaattggtgttgtttctattgtatctcctctttacatttccgaagtttccgtcgcacaattcagaggcaggatggtctccctgtatcaactggccgtaactgtcggttttctaggagcttatcttgtcaactaccagttattggcatattcagagagtggaaaccacttacctatcgcctggttagaaaaaatagtagttacagaagtgtggagaggtatgttaggcatggagacattaccagccataatattctttattattatctttttcatacccgaaagccccagatggctgatagtaaaaggacaagaaaggaaagccacttatattctggaaaagatctacaattcatttaaagaggctgatttccagctaaacgagacaaaatccgtccttgtttccgagacccgttcagaatggtctatccttctgaaaccaggtattctgaaagcagtcattatcggtgtatgtattgctattctgggacagttcatgggggttaatgcagttctttactacgggccttccatttttgagaatgccggtctttcaggaggggattctctgttctatcaggttcttgtaggacttgtgaatacactgaccactatcctggcacttctcatcattgacaaagtaggacgcaagaaactgatatattatggggtatccggaatggtcgtttcattgatactcattggcagttatttcctcttcggaaatgcctggaatatttccagcctgtttctgttagccttctttctgtgttatgttttttgttgcgccatttccatttgcgctgtgatattcgtacttctctctgagatgtaccctaccaaaatacgcggattagcaatgtccattgccggattcgctctttggatcggtacctatctgatcggacagctaaccccctggatgctccagaatcttactccagccggaacattcttcctgttcgccatcatgtgtgtaccgtatatgctcattgtctggaaactcgtaccggaaactaccggaaagtctctggaggagattgaaagatactggacccgttcggaacggtaa

SEQ ID NO: 454 - protein, 468 aa, Bacteroides thetaiotaomicron
MKTTINLGYIIFLSVVAALGGFLFGYDTAVISGTIAQVTHLFQLDTLQQGWYVGCALIGSIVGVLFSGILSDSIGRKRTMILSAILFSTSAIGCAFCIDFNQLVVYRIIGGIGIGVVSIVSPLYISEVSVAQFRGRMVSLYQLAVTVGFLGAYLVNYQLLAYSESGNHLPIAWLEKIVVTEVWRGMLGMETLPAIIFFIIIFFIPESPRWLIVKGQERKATYILEKIYNSFKEADFQLNETKSVLVSETRSEWSILLKPGILKAVIIGVCIAILGQFMGVNAVLYYGPSIFENAGLSGGDSLFYQVLVGLVNTLTTILALLIIDKVGRKKLIYYGVSGMVVSLILIGSYFLFGNAWNISSLFLLAFFLCYVFCCAISICAVIFVLLSEMYPTKIRGLAMSIAGFALWIGTYLIGQLTPWMLQNLTPAGTFFLFAIMCVPYMLIVWKLVPETTGKSLEEIERYWTRSER

SEQ ID NO: 455 - DNA, 1407 bp, Bacteroides thetaiotaomicron
  CDS (1)..(1407)
atgaagtctacaattaactttggctatcttattttcctttctgttgtagcagctttgggaggatttttgttcggatatgatactgctgttatatccggaacaatcgctcaggttactcaactttttcaactggatacgttgcaacaggggtggtatgtgggatgtgctttaataggttctatcgtcggtgttctttttgccggtatcctgagtgataagctgggacgaaaaatgacgatgattatttcagcgactctgttttctacatcggctttaggttgtgcgatctccgcagacttcacccaattggtagtctatcgtattattggtggagttggtattggtgttgtgtcgattgtttctcctttgtatatatctgaagtggctgtggcacaatatagagggcgtttggtatctttatatcaattggctgtgacagttggatttttaggagcttatttgattaactatcaattgctggcttatgctgaaagtggtaatcagttaagtatggactggttgaataagatatttgttactgaagtctggcgaggaatgttgggaatggaaacattgccggctgtgttattcttcatcattatcttctttattccggagagtcctcgttggctgatcgtaagaggtaaagaagaaaaagctgtcaatatattagaaaggatatataattcagtttcagaggctgcaagtcaattaaaagaaacgaaatctgtattgacgtctgaaacaaaatctgaatgggctatgttaatgaaacccggaatttttaaagcggtcatcattggtgtatgcattgctattttgggacagttcatgggtgtaaatgctgtactttattatggcccttccattttcgaaaacgcaggactttcaggaggagattctttgttttaccaagttctcgtaggactagtcaacactctgaccaccgttcttgctcttgtgatcattgacagggtcggccgcaagcaactggtctattacggagtttcgggtatggttgtctccctcctgctgatcggcgtttacttcctcttcggtgattcctggggagtatccagcctcttcctgcttgttttcttcctgttctatgtattctgctgtgccgtctccatctgtgccgtggtgttcgtgctcctttcggagatgtaccccaccaaggtacgcgggctggcgatgtccattgcaggattcgccctgtggataggaacgtacctgatcggacagttaaccccctggatgctccagaatctcacccccgccggaacattcttcctgttcgcagtcatgtgcgtgccgtatatgctcatcgtatggaaactcgtgccggagaccacaggaaagtcactggaagagattgaaagatactggacccggtcggaacagtag

SEQ ID NO: 456 - protein, 468 aa, Bacteroides thetaiotaomicron
MKSTINFGYLIFLSVVAALGGFLFGYDTAVISGTIAQVTQLFQLDTLQQGWYVGCALIGSIVGVLFAGILSDKLGRKMTMIISATLFSTSALGCAISADFTQLVVYRIIGGVGIGVVSIVSPLYISEVAVAQYRGRLVSLYQLAVTVGFLGAYLINYQLLAYAESGNQLSMDWLNKIFVTEVWRGMLGMETLPAVLFFIIIFFIPESPRWLIVRGKEEKAVNILERIYNSVSEAASQLKETKSVLTSETKSEWAMLMKPGIFKAVIIGVCIAILGQFMGVNAVLYYGPSIFENAGLSGGDSLFYQVLVGLVNTLTTVLALVIIDRVGRKQLVYYGVSGMVVSLLLIGVYFLFGDSWGVSSLFLLVFFLFYVFCCAVSICAVVFVLLSEMYPTKVRGLAMSIAGFALWIGTYLIGQLTPWMLQNLTPAGTFFLFAVMCVPYMLIVWKLVPETTGKSLEEIERYWTRSEQ

SEQ ID NO: 457 - DNA, 1404 bp, Staphylococcus epidermidis
  CDS (1)..(1404)
atgttgaaacgctttcataaaggcattataattagtctagctatagaaaaaggaatgatacgaatgaaagcaaataagtatttaatctttattttgggagcacttggtggcttattatatggttatgataatggtgtgatttccggtgctttattatttatacataaagacatacctctcaatagtacaactgagggtatcgttgtgtcttcaatgttaattggcgcaatagtcggtgcgggaagcagtgggccacttgctgataaattaggtcgtcgacgtctagtaatgctcatcgctattgtatttattattggggcactgattcttgctgcatcaaccaatttagcattattaattattggacgtttaattattggtttagcagtgggtggttcgatgtctacggtacctgtttatttaagtgaaatggcaccgacagaatatcgtggctcactaggttcacttaatcaactaatgattacaattggtattttagcagcatatttagtcaactatgcatttgcggatattgagggttggcgttggatgctaggattagcagttgttccatcggttattttacttgtgggtatttattttatgcctgagagtccaagatggttacttgaaaatagaaacgaagaagccgctcgtcaagtgatgaagattacttatgacgatagcgaaattgataaagaacttaaagagatgaaagaaattaacgctatctctgaatctacatggacagtcattaaatcaccatggttaggtagaatattaattgtaggttgtatatttgctattttccagcaatttattggtatcaatgcagtcattttctattcatcttcaatctttgctaaggctggactgggtgaagcggcgtctatattaggttcagttggtataggaactattaatgttcttgtaacaatagttgccatttttgtagtagataagattgatcgtaaaaaactacttgttggtggtaatattggtatgattgcctcattattaattatggcaatcttaatttggacaattggaattgcttcatcagcgtggattattattgtttgtttatcattatttattgtattctttgggatttcttggggacctgttctatgggttatgctacctgaattattcccgatgcgcgcacgtggcgctgctacgggcatttcagcgcttgtgctaaatatcggaacgcttatcgtgtcattgttcttcccaatattaagtgatgcattaagtacagaatgggtatttttaatctttgcattcataggtgttttagcgatgattttcgtaattaaattcttaccagaaacacgcggacgtagtttagaagaaatagaatatgaattacgtgaacgtacaggagcaagaactgaataa

SEQ ID NO: 458 - protein, 467 aa, Staphylococcus epidermidis
MLKRFHKGIIISLAIEKGMIRMKANKYLIFILGALGGLLYGYDNGVISGALLFIHKDIPLNSTTEGIVVSSMLIGAIVGAGSSGPLADKLGRRRLVMLIAIVFIIGALILAASTNLALLIIGRLIIGLAVGGSMSTVPVYLSEMAPTEYRGSLGSLNQLMITIGILAAYLVNYAFADIEGWRWMLGLAVVPSVILLVGIYFMPESPRWLLENRNEEAARQVMKITYDDSEIDKELKEMKEINAISESTWTVIKSPWLGRILIVGCIFAIFQQFIGINAVIFYSSSIFAKAGLGEAASILGSVGIGTINVLVTIVAIFVVDKIDRKKLLVGGNIGMIASLLIMAILIWTIGIASSAWIIIVCLSLFIVFFGISWGPVLWVMLPELFPMRARGAATGISALVLNIGTLIVSLFFPILSDALSTEWVFLIFAFIGVLAMIFVIKFLPETRGRSLEEIEYELRERTGARTE

SEQ ID NO: 459 - DNA, 1545 bp, Aspergillus niger
  CDS (1)..(1545)
atgagattaccaaaaattaaaatgcctcgtaagaggccgcaagatgaactcaatggtgatgtgctgcagcaagaggcgcaagctaccggccccaatggccagaaatctgaagaggggattgtggatacacctatccctctgctcacgtggcgttctttcttaatgggcattttcgtgtcaatgggtggtttcctcttcggctacgacactggccaaatttcaggcttcttggagatgccgaactttctccaaagatacggacaacagcaagctgacggaacatactatttctccaatgcccgttcgggtctgattgtcgcgctgctttcaataggtaccttgatcggcgcccttattgcagctcccatcgcagatcgtgttggccggaaatggtccatcagcggctggagtgccatggtgtgtgtcggtatcaccatacaaatatcttcccctttcggaaagtggtaccaggtagccatgggtcgttgggtcgctggtctcggcgttggggctctatcattgcttgttcccatgtaccaagcggaaactggaccgaggcacattcgtggatctcttgttagcacttatcagcttttcatcacccttggaatcttcgtcgccaactgtatcaacttcggaacagaagctcgaaatgatacaggctcctggcgtattcccatgggcatcacctacatctgggccatgatcctgggcttcggaattgcactattccccgaaagtgcccggtacgactatagacatggaagggaggcgaaagcagctcgtaccctatcgagaataagttcgtggaaggaacaggaacgcggagagataacctggtctcatcttttccatgcaccccgcatgaagtatcgcgtcgcagtgggagtcgcccttcaagcactgcaacagttaacgggagcgaattactttttctactacgggacgacgatctttcgaggcgccgggatttcaaattcctacgtaacacaaatgattcttggcggtgtgaatttcggaacgacgttcctagggctgtacctgatcgagaactacggtcgtcgtcgatccctgataactggagcattgtggatgtttgtttgtttcatggttttcgcctccgtgggccatttctctctagaccatgaaaacccagaacggacacacacagctggcgtggtcatggttgttttcgcctgtcttttcattctcggtttcgcatcaacatggggtcccatggtgtggaccattatcgcagagctgtatccctccgaattccgtgcccgcgccatgtctctcgccacagcatccaattggctctggaacttccttctcgcctttttcacccccttcatcaccagtgccattgacttccgcctcggctacgtctttgccggctgcctcttccttgcggcgggcctggtttacgtggcagtcattgaaggtcgtggccgtacattggaagagatcgataccatgtacgttatgaaggtgccgccctggaaagagctccaagtatgtatttccggacatcgatccatatga

SEQ ID NO: 460 - protein, 514 aa, Aspergillus niger
MRLPKIKMPRKRPQDELNGDVLQQEAQATGPNGQKSEEGIVDTPIPLLTWRSFLMGIFVSMGGFLFGYDTGQISGFLEMPNFLQRYGQQQADGTYYFSNARSGLIVALLSIGTLIGALIAAPIADRVGRKWSISGWSAMVCVGITIQISSPFGKWYQVAMGRWVAGLGVGALSLLVPMYQAETGPRHIRGSLVSTYQLFITLGIFVANCINFGTEARNDTGSWRIPMGITYIWAMILGFGIALFPESARYDYRHGREAKAARTLSRISSWKEQERGEITWSHLFHAPRMKYRVAVGVALQALQQLTGANYFFYYGTTIFRGAGISNSYVTQMILGGVNFGTTFLGLYLIENYGRRRSLITGALWMFVCFMVFASVGHFSLDHENPERTHTAGVVMVVFACLFILGFASTWGPMVWTIIAELYPSEFRARAMSLATASNWLWNFLLAFFTPFITSAIDFRLGYVFAGCLFLAAGLVYVAVIEGRGRTLEEIDTMYVMKVPPWKELQVCISGHRSI

SEQ ID NO: 461 - DNA, 1584 bp, Aspergillus niger
  CDS (1)..(1584)
atggcgccgacctacgctggcctgtcgggcaggaaactgtccctggccgtctcgacgattgcgacgatgggtttcttgctgttcggttatgatcagggtgtcatgtccggtattatcagcgataccgctttcgaagacctcttcaccgcgaccaagaacaatccaaccatgcaagccttggttacatccgtttatgagttaggttgtcttgtgggtgccatgttcgctctcttcttcggtgacaagactggacgtaaatggatgatcttctcgggtgccattgtcatgattattggtgtcgtcatccaggttacctcgtatgccggacacatcccgcttctgcagttcttcattggtcgtgtcatcaccggtatcggtaacggcatgaacacctcgactatcccgacctaccaggccgagtgctccaagaccagcaaccgtggtctgctcatctgtattgagggtggtatcatcgccatcggaactgcgattgcctactggattgactatggtgcccacttcggtaacaaggacctggtgtggcgtttccccattgccttccagatcttctttggtctcatcatcatcgtcggcatgtggttccttcccgactctccccgttacctcatctccaaggaccgcgtccaggagggtgagtacgtgcttgctgccttgggtggctgggagatccatgaccacgagacccagctccagaagcagctggtcattgactccattagagcttcgaacgccgctggcaaggatgtcggataccgtgaccttctcactggtggccgctcccagcacttccgtcgtatggttatcggttcctcctcgcagatcttccagcaactcggtggttgcaacgctgtcatctactatctccctgtgctgctccaggactcccttcacgagactgagaacttctctctggtcattggtggtgtcaacatgattgtctacgctatctttgccactttctcctggttcttcattgaaaagatcggtcgtcgcaagcttttcctgggtggatctttccttcagtgcattgccatggttatcacctttgcctgtttgatccctggtgaccaggagactgccaagggtgctgtcttcggtctgttcctctacatggccgctttcggtgccgcttggttgcctctgccctggttgtaccctgctgagctgtcccccatcaagacccgtgccaaggccaacgctgtctcgacctgcagcaactggctcttcaacttcctgattgtcatgatcacccccgtcatggtctcccacatcggctggggtacttacctgttcttcgccgtcctcaacggcctgttcatccccttcatctggttcttctaccccgagaccgccaaccgcagtctggaggagatcgatatcatcttcgccaagggttacaccgagaacatcagctacgtgcgcgctgcccacgagctgcccaagctcaccgacgaggaagtcgagcagaaggccatggagtacggcttcggaggtgccagcgacgaggagaaggtcaccaccgccgaggtctcgggctccaacagcgcccgcgagtcggagtaa

SEQ ID NO: 462 - protein, 527 aa, Aspergillus niger
MAPTYAGLSGRKLSLAVSTIATMGFLLFGYDQGVMSGIISDTAFEDLFTATKNNPTMQALVTSVYELGCLVGAMFALFFGDKTGRKWMIFSGAIVMIIGVVIQVTSYAGHIPLLQFFIGRVITGIGNGMNTSTIPTYQAECSKTSNRGLLICIEGGIIAIGTAIAYWIDYGAHFGNKDLVWRFPIAFQIFFGLIIIVGMWFLPDSPRYLISKDRVQEGEYVLAALGGWEIHDHETQLQKQLVIDSIRASNAAGKDVGYRDLLTGGRSQHFRRMVIGSSSQIFQQLGGCNAVIYYLPVLLQDSLHETENFSLVIGGVNMIVYAIFATFSWFFIEKIGRRKLFLGGSFLQCIAMVITFACLIPGDQETAKGAVFGLFLYMAAFGAAWLPLPWLYPAELSPIKTRAKANAVSTCSNWLFNFLIVMITPVMVSHIGWGTYLFFAVLNGLFIPFIWFFYPETANRSLEEIDIIFAKGYTENISYVRAAHELPKLTDEEVEQKAMEYGFGGASDEEKVTTAEVSGSNSARESE

SEQ ID NO: 463 - DNA, 1752 bp, Aspergillus niger
  CDS (1)..(1752)
atgggtgtctctaatatgatgtcccggttcaagcctcaggcggaccactctgagtcctccactgaggctcctactcctgctcgctccaactccgccgtcgagaaggacaatgtcttgctcgatgacagtcccgtcaagtacttgacctggcgctccttcatcctgggtatcgtcgtgtccatgggtggtttcatcttcggttactctactggtcaaatctctggtttcgagactatggatgacttcctccaacgtttcggtcaggaacaggcggatggatcctatgctttcagcaacgtccgtagtggtctcattgtcggtctgctgtgtatcggtactatgatcggtgccctggttgctgctcctatcgcagaccgcatgggccgcaagctctccatctgtctctggtctgtcatccacatcgtcggtatcatcattcagattgccaccgactccaactgggtccaggtcgctatgggtcgttgggttgccggtctgggtgttggtgccctctccagcattgtccccatgtaccagagtgaatctgctccccgtcaggtccgtggtgccatggtcagtgccttccagctgttcgttgccttcggtatcttcatctcctacatcatcaacttcggtaccgagagaatccagtcgactgcttcctggcgtatcaccatgggcattggcttcgcctggcccttgattctggctgttggctctctcttcctgcccgagtctcctcgtttcgcctaccgtcagggtcgtatcgatgaggcccgtgaggttatgtgcaagctgtacggtgtcagcccgaaccaccgcgtcatcgcccaggagatgaaggacatgaaggacaagctcgacgaggagaaggccgccggtcaggctgcctggcacgagctgttcaccggccctcgcatgctctaccgtaccctgctcggtattgctctgcagtccctccagcagctgaccggtgccaactttatcttctactacggaaacagtatcttcacctccactggtctgagcaacagctacgtcactcagatcattctgggtgctgtcaacttcggtatgaccctgcccggtctgtacgtcgtcgagcacttcggtcgtcgtaacagtctgatggttggtgctgcctggatgttcatttgcttcatgatctgggcttccgttggtcacttcgctctggatcttgccgaccctcaggccactcctgccgctggtaaggccatgatcatcttcacttgcttcttcattgtcggtttcgccaccacctggggtcctatcgtctgggccatctgtggtgagatgtaccccgcccgctaccgtgctctctgcattggtattgccaccgctgccaactggacctggaacttcctcatctccttcttcacccccttcatctctagctccattgacttcgcctacggctacgtctttgctggatgctgtttcgccgccatcttcgttgtcttcttcttcgtcaatgagacccagggtcgcactcttgaggaggttgacaccatgtacgtgctccacgtcaagccctggcagagtgccagctgggttcccccggagggcattgtccaggacatgcccgccccccttcctcttccaagcaggagggtcaggctgagatggctgagcacaccgagcccactgagctccgcgagtaagccactcgcactcgcgcgaactcattttgctagttgctcttgtacattgaacctgcatcttaagctttga

SEQ ID NO: 464 - protein, 583 aa, Aspergillus niger
MGVSNMMSRFKPQADHSESSTEAPTPARSNSAVEKDNVLLDDSPVKYLTWRSFILGIVVSMGGFIFGYSTGQISGFETMDDFLQRFGQEQADGSYAFSNVRSGLIVGLLCIGTMIGALVAAPIADRMGRKLSICLWSVIHIVGIIIQIATDSNWVQVAMGRWVAGLGVGALSSIVPMYQSESAPRQVRGAMVSAFQLFVAFGIFISYIINFGTERIQSTASWRITMGIGFAWPLILAVGSLFLPESPRFAYRQGRIDEAREVMCKLYGVSPNHRVIAQEMKDMKDKLDEEKAAGQAAWHELFTGPRMLYRTLLGIALQSLQQLTGANFIFYYGNSIFTSTGLSNSYVTQIILGAVNFGMTLPGLYVVEHFGRRNSLMVGAAWMFICFMIWASVGHFALDLADPQATPAAGKAMIIFTCFFIVGFATTWGPIVWAICGEMYPARYRALCIGIATAANWTWNFLISFFTPFISSSIDFAYGYVFAGCCFAAIFVVFFFVNETQGRTLEEVDTMYVLHVKPWQSASWVPPEGIVQDMPAPLPLPSRRVRLRWLSTPSPLSSASKPLALARTHFASCSCTLNLHLKL

SEQ ID NO: 465 - DNA, 1593 bp, Aspergillus niger
  CDS (1)..(1593)
atggctgaaggcttcgttgacgcctcgcgcgtcgaggccccagtcaccctcaagacctacttgatgtgtgcctttgcggcttttggtggtatcttcttcggttatgactctggttatatcagcggtgtcatgggaatgagatacttcatcgaggagtttgagggcttggactataacactacccccaccgattccttcgtcctcccgtcctggaaaaaatcgttgatcacgtcgatcctctcggctggaaccttctttggtgccctcattgctggtgacttggcagactggttcggtcgtcgcactaccattgtcagtggttgtgttgtcttcatcgttggtgttatcctgcagaccgcttcgacctccttgggtctgcttgttgccggccgtctggtcgcgggatttggtgtgggcttcgtctccgccatcattatcctgtacatgtctgagattgcacctcgcaaggttcgcggtgctattgtctcagggtaccagttctgcatcaccatcgggctcatgttggcctcgtgcgtcgactacggcactgagaaccgtctcgactctggctcctaccgtatcccaatcggcctccagctcgcctgggccttgatcctgggaggtggtctgctctgcctgcccgagtcccctcgttactttgttaaaaagggcgacctggctaaggctgcggaggttcttgcccgcgttcgtggtcaaccccaagactcggattatatcaaggatgagctggcggagattgtggcaaatcatgagtacgagatgcaggtgattccggaaggtggatatttcgtcagctggatgaactgcttccgtggcagtatattctcgcccaacagcaatctccgtcggactgtcctaggtacttctctgcagatgatgcaacagtggaccggtgtcaactttgtcttctactttggaacgacctttttccagtcgctgggaaccatcgatgaccccttcctcatcagcatgattaccactatcgtcaacgtctgctcgacccccgtctcgttctacacaattgagaagtttggccgccgttcgctccttttgtggggagcacttggtatggtcatctgccagttcattgtcgctatcgtcggcaccgtggacggtagcaataagcacgctgtcagtgcagagatttctttcatctgcatttacatcttcttctttgctagcacgtggggcccgggcgcctgggttgtgattggcgagattttccccctacctattcggtcgcgtggtgtggctctgtcgacggcatcgaactggctgtggaattgcatcatcgctgtcatcaccccttacatggtcgacaaggacaagggtgacttgaaggccaaggtgttcttcatctggggctcgctgtgtgcctgcgcttttgtctacacgtacttcctaattccggagaccaagggtcttactcttgagcaggtggacaagatgatggaagagaccacgcctcgcacctcagccaagtggactccacatggcaccttcacggccgagatgggtcttactgcgaatgccgtggccgaaaaggctactgcggttcaccaggaggtgtga

SEQ ID NO: 466 - protein, 530 aa, Aspergillus niger
MAEGFVDASRVEAPVTLKTYLMCAFAAFGGIFFGYDSGYISGVMGMRYFIEEFEGLDYNTTPTDSFVLPSWKKSLITSILSAGTFFGALIAGDLADWFGRRTTIVSGCVVFIVGVILQTASTSLGLLVAGRLVAGFGVGFVSAIIILYMSEIAPRKVRGAIVSGYQFCITIGLMLASCVDYGTENRLDSGSYRIPIGLQLAWALILGGGLLCLPESPRYFVKKGDLAKAAEVLARVRGQPQDSDYIKDELAEIVANHEYEMQVIPEGGYFVSWMNCFRGSIFSPNSNLRRTVLGTSLQMMQQWTGVNFVFYFGTTFFQSLGTIDDPFLISMITTIVNVCSTPVSFYTIEKFGRRSLLLWGALGMVICQFIVAIVGTVDGSNKHAVSAEISFICIYIFFFASTWGPGAWVVIGEIFPLPIRSRGVALSTASNWLWNCIIAVITPYMVDKDKGDLKAKVFFIWGSLCACAFVYTYFLIPETKGLTLEQVDKMMEETTPRTSAKWTPHGTFTAEMGLTANAVAEKATAVHQEV

SEQ ID NO: 467 - DNA, 1584 bp, Emericella nidulans
  CDS (1)..(1584)
atggcagacgcggtgattgctggtcagcgcgtggaggccccggtcacatggaaggcgtaccttatgtgcgtgttcgcggcctttggtggtatattcttcggctacgactctggctatattaatggagttatgggcatggattatttcatccaagaatttacaggaaaggtcaaaagcgaaactcccgccgcgcagtttgtgatttcatcgtcgaataaatcccttatcacctctatcctgtctgcggggacgttctttggcgctattattgccggtgacctggcagagtggtacggccgtcgcatcacgattatcaatggctgcggagtctttatggctggtgtggcttttcagattgcctctaccaccgtgcccatgcttgtcgtcggccgattgatcgcaggcgttggtgtcggttttgtctctgcgatcatcattctgtacatgtctgagatttctcctcgaaggttccgtggtgctatcgtatcgggctatcagttttgcatcaccattggtttgatgctggcctcctgcgtgaactatgggacggagaaccggaatgattcgggctcataccgtatcccgattgccctccaactcctctgggcgatcattcttgggataggtctgttcgtccttccagagtctccccgttattatgttcggaaaaacaatctggctgaagcagccaaaaccctcgctcgcgtgcgaggccagcccccggagtcagagtatatcacgcaagagctggcagaaatcgtggccaacaatgaatacgagatgcaggttattccccagggcggctattttgctacgtggttgaactgcttccgtggaggtctccggtctcctaacagcaaccttcgtcgtgttatccttgggacctctcttcagatgatgcaacaatggactggagtgaacttcgtcttctattttggtactacgtttttccagaacctcggtaccattgacgaccctttcctcatcagcatgatcaccacgattgtcaatgtcttttctactccgatctccttttacacgatggagaagctcggtcgtcgccctctactgctttggggcgctctgggcatggtcgtctgccaatttattgtggcgatcgctggaaccgtggatggagacaacagtaaaaccgtctcggcgcaaatctcgtttatctgcatttatatctttttctttgcttccacttggggccctggcgcttgggtcgttattggcgagattttcccgctgcccattcgttctcgtggcgttgcgctatcaacagcctccaactggctttggaactgcattattgcagttatcacaccgtacatggttgatatcgacaaggggaacctcaagtcccgagtgttctttatctggggatccctgtgtgcctgcgcatttgtctatgtctacttcctgattcccgagacaaaaggcctcaccctcgaacaagtcgacaagatgatggaggagactactcctcgcacatctgccaaatggaagcctcactctacctttgcgaccgagatgggtatgactgagaaaaatgcgagtacaaccgtggaaagcgctgcctaa

SEQ ID NO: 468 - protein, 527 aa, Emericella nidulans
MADAVIAGQRVEAPVTWKAYLMCVFAAFGGIFFGYDSGYINGVMGMDYFIQEFTGKVKSETPAAQFVISSSNKSLITSILSAGTFFGAIIAGDLAEWYGRRITIINGCGVFMAGVAFQIASTTVPMLVVGRLIAGVGVGFVSAIIILYMSEISPRRFRGAIVSGYQFCITIGLMLASCVNYGTENRNDSGSYRIPIALQLLWAIILGIGLFVLPESPRYYVRKNNLAEAAKTLARVRGQPPESEYITQELAEIVANNEYEMQVIPQGGYFATWLNCFRGGLRSPNSNLRRVILGTSLQMMQQWTGVNFVFYFGTTFFQNLGTIDDPFLISMITTIVNVFSTPISFYTMEKLGRRPLLLWGALGMVVCQFIVAIAGTVDGDNSKTVSAQISFICIYIFFFASTWGPGAWVVIGEIFPLPIRSRGVALSTASNWLWNCIIAVITPYMVDIDKGNLKSRVFFIWGSLCACAFVYVYFLIPETKGLTLEQVDKMMEETTPRTSAKWKPHSTFATEMGMTEKNASTTVESAA

SEQ ID NO: 469 - DNA, 1599 bp, Aspergillus oryzae
  CDS (1)..(1599)
atggttgccggcggtggagttgtttcttcttccggcatggatgcataccgggccctgccaaacaatacgaactcgaactggttcaaggacaagggcctccggcgtctgaatttcggcctcatgcttatgtttgcatccgctgcagcaaatgggtatgatggggctttgatgaatgggctcctgactctccctatgtgtaagtttcctttgtcaagttgtcctcacctctggcgaatgttcacctttattccagcttcgtacttcgcggattacttcggccgcaagatgtctgtcgcacttggatcggccatcatgattgtcgcgagcgtgatccaagcggcaaccgtcggccgctgggccttctttggaacgagaatcgcgatgggtatcgggctgggctttgcgcagacagccgccccgccgctgactactgagatagctcatccgcggcatcgtggcgttgtgacggccattttccaggctacgtggtactggggtgctatcctagctgctgcggtgtgcttgggcactttttatgtggagggaagtacttggtcctggcggattccatgccttctccaatgtttcttccctgctgttcagttggtaggactactcatcgttccagaaagcccgaggtggctcgtgtcaaaggacaggcgagacgaggccttgcaaatcctcgcccgctaccatgggaattgtgacacgtcagatccactggttcagttcgagttttctgagatctgcagtgctatcgagctagaaaactcagtcgcccataagagtggttggtctgcgttcattgcaaccaagggagctcggcatcgccttgcaatttgtctgttggtcggggttatgatccagtgggcaggcaatggtacgtacagggctatccacctactcctgtctatcttgctgattattttgtccctaggtgtcatttcctactatcttgcaccgatccttcgatccgtcggcattaccaatcctacgcagcaatccgccatcaacctgggcctgcaggcgtggaacgcagtctgcgccgcgggaggcgccgtcgctgcagagaaatacggccgacgccctctctggatgctctccactgttcttatgctcctattctttaccctggcgactgtcctttctgccgtctttgacgaatcagccatcaaagctgctggcagtgcggttgtcgcattcctctatctgttctacggcgcgtacgatatcgcctataccccgctctcaattgcgtacccggtcgagatcatgccattctacctgcgcaccaagggcttatcgttaagcttaacggcgcagtttggggcgggcttcttcaaccagttcgtcaaccccatcgctctcggtgcgataaaatggaagttttatttcgtgtaccttggtctgttggttatctttttgggcattatttactttgtgtttccggagacaaagggccacacactggaggagattgctgtcatcttcgatggtcctggggcagagacggaggtacagcgggatctggccgctatcattgcggtggagagggaggtaaaggctcctatgaaggaggagttggaacacgctccatag

SEQ ID NO: 470 - protein, 532 aa, Aspergillus oryzae
MVAGGGVVSSSGMDAYRALPNNTNSNWFKDKGLRRLNFGLMLMFASAAANGYDGALMNGLLTLPMCKFPLSSCPHLWRMFTFIPASYFADYFGRKMSVALGSAIMIVASVIQAATVGRWAFFGTRIAMGIGLGFAQTAAPPLTTEIAHPRHRGVVTAIFQATWYWGAILAAAVCLGTFYVEGSTWSWRIPCLLQCFFPAVQLVGLLIVPESPRWLVSKDRRDEALQILARYHGNCDTSDPLVQFEFSEICSAIELENSVAHKSGWSAFIATKGARHRLAICLLVGVMIQWAGNGTYRAIHLLLSILLIILSLGVISYYLAPILRSVGITNPTQQSAINLGLQAWNAVCAAGGAVAAEKYGRRPLWMLSTVLMLLFFTLATVLSAVFDESAIKAAGSAVVAFLYLFYGAYDIAYTPLSIAYPVEIMPFYLRTKGLSLSLTAQFGAGFFNQFVNPIALGAIKWKFYFVYLGLLVIFLGIIYFVFPETKGHTLEEIAVIFDGPGAETEVQRDLAAIIAVEREVKAPMKEELEHAP

SEQ ID NO: 471 - DNA, 1943 bp, Arabidopsis thaliana
  CDS (139)..(1650)
ctgcaaattcgaagctccgttgagctcgaatcagagaagtagctatttcgtacaaccccagaacgatatatttttttctgggtttccttgaacataccacactcacggtcacgggatccataccaagcttccgtagccatggggtttgatcccgagaaccaatcgatctcttccgttggacaggttgttggtgattcttcttcaggtgggattactgctgaaaaggaacctttgttaaaggaaaaccacagcccagagaactactctgttcttgcagccattcctccgtttctctttccagctcttggagcattgctttttggttatgaaattggtgcaacatcttgtgctatcatgtctcttaagtcgcctactctaagtggaatttcatggtacgacttgtcttcagtggatgttggtataattaccagtggctcactgtatggtgccttaattggctccattgttgcatttagtgttgccgacattataggaaggagaaaggagctgattttggctgcattcttgtatcttgttggagccattgtgactgtagtagcacctgtcttttccatactgataattggacgagttacgtatggcatggggattggactgaccatgcacgcggctccaatgtacattgcagagactgctccaagtcaaatacgtggacggatgatatcactaaaggaattctccactgtccttgggatggttgggggttatggaatcggtagcctttggattacggttatttctggttggcgttacatgtacgcaacaattctcccttttccagttattatgggaactggaatgtgttggctaccagcatctccgaggtggcttttactgcgcgctctccagggacaaggaaatggggagaatcttcaacaggctgcgattagatctctttgtcgccttagagggtctgtcatagctgactcagcagctgaacaagtaaacgaaatattggctgaactttcccttgtgggtgaagacaaagaagctacatttggtgaattatttcgaggcaaatgcttgaaagctctcactatagcaggagggttagtcttgttccaacagataactgggcaaccaagtgtactatattatgcaccatcaatactacagactgccggcttttctgctgcagctgatgcaactcggatctcaattctgctcggcctattgaagttggttatgacaggagtttctgtgatagttatcgacagagttggaaggagacctttacttctttgtggtgttagcggaatggtgatctcattgttcctcctgggatcctactacatgttttataaaaatgtaccagctgttgctgtagctgcattgctactgtatgtaggctgttaccagctgtcctttggccctattggttggctgatgatttcagagatatttcccttaaaattaagaggtagaggaatcagtctagcagtgcttgtgaattttggcgcaaacgcacttgtgacattcgctttctcaccgctaaaggagctgttaggagctggaatactgttctgtgcatttggagtgatatgtgtcgtgtctctcttcttcatatactacattgtgccagagacaaagggtctcactcttgaagaaattgaagccaaatgtctctaaaaggttactcatcttagctccactttctgtgctgcttcattgcttgaggatctaaatcgcaaacgcaccagccgcatgtgtagtcactagtcagccatttatcgcggaattttcactgtttggatatcttttaaagaatggttgtatctagcggcaaaatttggtgcgttggaaaagttttaaaattcgaaagtttgcttaatttgtattttaaaacacgcattcaaaattttgtgattgtatgaaaataatgtgagattcaaaattttatgaaacaatattgtaacgtcgtc

SEQ ID NO: 472 - protein, 503 aa, Arabidopsis thaliana
MGFDPENQSISSVGQVVGDSSSGGITAEKEPLLKENHSPENYSVLAAIPPFLFPALGALLFGYEIGATSCAIMSLKSPTLSGISWYDLSSVDVGIITSGSLYGALIGSIVAFSVADIIGRRKELILAAFLYLVGAIVTVVAPVFSILIIGRVTYGMGIGLTMHAAPMYIAETAPSQIRGRMISLKEFSTVLGMVGGYGIGSLWITVISGWRYMYATILPFPVIMGTGMCWLPASPRWLLLRALQGQGNGENLQQAAIRSLCRLRGSVIADSAAEQVNEILAELSLVGEDKEATFGELFRGKCLKALTIAGGLVLFQQITGQPSVLYYAPSILQTAGFSAAADATRISILLGLLKLVMTGVSVIVIDRVGRRPLLLCGVSGMVISLFLLGSYYMFYKNVPAVAVAALLLYVGCYQLSFGPIGWLMISEIFPLKLRGRGISLAVLVNFGANALVTFAFSPLKELLGAGILFCAFGVICVVSLFFIYYIVPETKGLTLEEIEAKCL

SEQ ID NO: 473 - DNA, 2234 bp, Kluyveromyces lactis
  CDS (402)..(2102)
cccatgtcttttaatttctccagtcagttcctgaggcccagccagtttctgtggttttttccccggatcttttactggtgactacaaaggcaattttttttccttccgcttttcgtttttagcgtggagtaagcaatagatagggctttcttatggtattgatccgctaattcaaactggacctatctcgtcgacaaatttgtatataatacgaagagaattcgcttactttcgtccaaattatccaaccccattgtcaaataagaatatatttgtgtacttctactctcgtatttactagatcaaaaaattagaaagctacagtattaatagcatattggtccgctaagttaaagctattagagcgtagaggttgttgatattaaaaaggttaagaaacaatgtctagtaatctgtctgaaaaagcagttgaccagcaaaaagaattcggcttgcttaagagtacgagttctgttgactcggtacacgaagttgaagccggtgtgaaagtcggtgaagatgacgacaattattttttcagtgaagatcaaatcttaacacagattaaggtgtacgaagatgaaattgcaaatactccagttactaagacgctaagacaacgtatgagaagaatggaattttgtgaagtgaacttctcaaataaaacgtatatggttattatgcttggttttttcgcatcatttgcaggtattttgtcaggtgtggatcaatcgaccatttcaggtgccagttatggtatgaaggcatcgttgaaattgacttccgatgaagattccttgatttcctctttaatgcctttgggtgcggtcggtggttctatcttgttaactccattaagtgaatatttcggtagaaaagttgccttagtgatctcatgtattttttataccattggtggtattttgtgtgccgctgctcaggatgttcatacaatgtatgcaggcagattcttgatcggtgttggtgtcggtattgaaggtggtggtgttggtgtttatattgctgaatctgtcccatctaccgtgcgtggttccttagtttcgttgtatcaattcaatattgcccttggtgagttggttggttatgtcattggtgtcattttcttcgatgtcaaaggtggttggagatatatgttaggttcctctttggtattttctaccatcttatttgttggtttattcttcttacctgaatcccctcgttggttgatccacaagggttatgatgtagaagcttataaggtctggcgtagattgagagacacatcggatctaggcaataaaagagaattcttggaaatgaaacatgcagctgaacaagatagacaattgaaagaacaagaatctcgcttcaagagtatgtttgacttgatcttaatcccaagaaatcgtcgtgcattgttatactccattatgatggtctctttgggtcaattgactggtattaacgcaatcatgtattatatgtccacgttgatgggacagatcggtttctctccaaaacaagccgtcgctatgtctatggttggtggtgctgctttgttaataggtaccattccagcaatcctatatatggataaatttggtagacgtccatggtctatgaccattatcggtttctccgtaggtctagttctcgtcggtgttggttatcagatcgatttgaataccaacttggctgctgctgaaggggtttacttaaccggccagattttgtataacatcttctttggtacttatgccactttgacctgggttgttccttctgagtctttctctttggctacaagatcgatcggtatgacgatttgctctgctttcttatacttatgggccttcactgttacttataacttcaacaaaatgaaggacgctttcacatacactggtttgactttaggtttctatggtggtattgctattgttattggtattccataccaattgttgtttatgccagaaaccaaagataaaactttggaagaaatcgatgatatctttgagatgccaactagacaattggtcaaacaaaatttgaagaacttaaaagattacgtttctggtaaccgtaaatctatttaattctctgtcttatgctaataaaactgaatgaagtaaggagttcactttgaaatcgatcctgaaagtgggagcttatttctatcatatgttttgagctgtatagacacaggataggggttactctctccgatc

SEQ ID NO: 474 - protein, 566 aa, Kluyveromyces lactis
MSSNLSEKAVDQQKEFGLLKSTSSVDSVHEVEAGVKVGEDDDNYFFSEDQILTQIKVYEDEIANTPVTKTLRQRMRRMEFCEVNFSNKTYMVIMLGFFASFAGILSGVDQSTISGASYGMKASLKLTSDEDSLISSLMPLGAVGGSILLTPLSEYFGRKVALVISCIFYTIGGILCAAAQDVHTMYAGRFLIGVGVGIEGGGVGVYIAESVPSTVRGSLVSLYQFNIALGELVGYVIGVIFFDVKGGWRYMLGSSLVFSTILFVGLFFLPESPRWLIHKGYDVEAYKVWRRLRDTSDLGNKREFLEMKHAAEQDRQLKEQESRFKSMFDLILIPRNRRALLYSIMMVSLGQLTGINAIMYYMSTLMGQIGFSPKQAVAMSMVGGAALLIGTIPAILYMDKFGRRPWSMTIIGFSVGLVLVGVGYQIDLNTNLAAAEGVYLTGQILYNIFFGTYATLTWVVPSESFSLATRSIGMTICSAFLYLWAFTVTYNFNKMKDAFTYTGLTLGFYGGIAIVIGIPYQLLFMPETKDKTLEEIDDIFEMPTRQLVKQNLKNLKDYVSGNRKSI

SEQ ID NO: 475 - DNA, 1476 bp, Corynebacterium glutamicum
  CDS (1)..(1476)
atggctagtaccttcattcaggccgacagccctgaaaaaagtaagaagctgcccccactcacagaaggtccgtatagaaagcggctattctacgttgcactagttgcgacgtttggtgggctgctcttcggatatgacaccggagtaatcaacggtgcactcaacccaatgacacgtgagctcggactaaccgcgttcaccgagggtgttgtaacttcttccctgctgtttggtgcagcagctggtgcgatgtttttcggtcgcatttccgacaactggggtcgccggaaaacaatcatctcacttgcagtagctttctttgtcggcaccatgatctgcgtgtttgctccatcttttgcagtaatggttgtcggacgtgtgcttcttggactcgcagttggtggcgcttccactgttgtccctgtctacctggctgaacttgctccttttgaaatccgtggctcactggctggccgtaatgagttgatgattgttgttggtcagctcgcagcttttgtcatcaatgcgattattggaaatgtttttggacaccacgatggtgtgtggcgctacatgctggcaattgccgcaatcccagcaattgccctcttctttggaatgctccgagttccagaatccccacgctggcttgttgagcgaggacgcattgatgaggctcgcgcagttcttgaaaccattcgccctctagaacgtgcccatgcagaagttgctgatgttgaacacctagcaagagaagagcacgccgtttccgagaagtccatgggcttaagggaaattttgtccagcaagtggcttgtgcgcatcctcctggtaggtatcggattgggtgtcgcacagcagctgaccggcatcaactccatcatgtactacggccaggttgttctcattgaggctggtttctccgagaatgcagctctgatcgccaacgtggcgccaggagtgatcgcagttgtcggtgcattcatcgcactgtggatgatggatcgtatcaaccgccgtaccaccctcattaccggttattctctcaccaccattagccacgtattgatcggtatcgcatccgtagcattcccagtcggcgatcctcttcgcccctacgttatcttgactctggttgtggtcttcgtgggatccatgcagaccttcctcaacgtagctacctgggttatgctctctgagctcttcccgctggcaatgcgcggtttcgcaatcggtatctcagtgttcttcctctggatcgcaaacgcgttcctcggattgttcttcccaaccatcatggaagcagtaggactaaccggaaccttcttcatgttcgccggaatcggtgtggttgccttgatcttcatctacacccaggttcctgaaactcgtggacgtaccttggaggagattgatgaggatgttacttccggtgtcattttcaacaaggacatccgaaaaggaaaggtgcactaa

SEQ ID NO: 476 - protein, 491 aa, Corynebacterium glutamicum
MASTFIQADSPEKSKKLPPLTEGPYRKRLFYVALVATFGGLLFGYDTGVINGALNPMTRELGLTAFTEGVVTSSLLFGAAAGAMFFGRISDNWGRRKTIISLAVAFFVGTMICVFAPSFAVMVVGRVLLGLAVGGASTVVPVYLAELAPFEIRGSLAGRNELMIVVGQLAAFVINAIIGNVFGHHDGVWRYMLAIAAIPAIALFFGMLRVPESPRWLVERGRIDEARAVLETIRPLERAHAEVADVEHLAREEHAVSEKSMGLREILSSKWLVRILLVGIGLGVAQQLTGINSIMYYGQVVLIEAGFSENAALIANVAPGVIAVVGAFIALWMMDRINRRTTLITGYSLTTISHVLIGIASVAFPVGDPLRPYVILTLVVVFVGSMQTFLNVATWVMLSELFPLAMRGFAIGISVFFLWIANAFLGLFFPTIMEAVGLTGTFFMFAGIGVVALIFIYTQVPETRGRTLEEIDEDVTSGVIFNKDIRKGKVH

SEQ ID NO: 477 - DNA, 2187 bp, Drosophila melanogaster
  CDS (198)..(1688)
tccttggagaaattcagttcagctcggacgctcgtcgcgccatccacacgtttcgatagttaagcctttcagggaactggagcgatcgaaaaattggcagtagcaaaataaacactaataaaacgaacatataacctcgcatttgcgggttaatcggctaatcgtctaaatagtgctgttttggaagttattgaaacatggtggctaccgaggaacttaaaacgaccgtcagtcaagaggacggagactcacgcaatccaataacctatgatcttctacaagaaaatcagtcgaagacttcaaagacccggcaatatgtggcggctatgataatttgtttgggtgcggttgccgctggaactgcgttatcctggacgtctcctgtttttccgcagatatctgccggaaacgaaagcagtttcaattccacaactggcggtatttccaactcgacttccaacgagaatgacattcgactgactgattcgcaaaaaacattggtgggttccatgttgcccttcggcgccctttttggagccctcccctctggatatattgccgataggatcgggcgacgttatacagctatggtcatggacattcccttcatcttggcctggatcacgcttagtttcgccaattccgtcggctggctttacttgggccgatttttaattggtatcgcaacgggcagcttctgcgtggtggctcctatgtacatttcggaaatcgcggagactagcattcgcggcagtctaggcacattgttccagttgctccttacgattggtatcctgtttatctacgtggtgggagctttggtgtcatggaaaactctgagcctgctctgtctaatcatacccatcctgctgctcgtcggcctgtttatcgtgcccgagacgccagtgtatctacttaaaaacggtaagcgctccgaggccaatcgcgcactaaaatggctgtggggagattactgcaacaccagcaacgccatccaggccatccaaaacgacctggaccagactggagtggatgcctccgtgaaggatttgttcagcaaccgcgcctcgcggaacggtatggtgatctcagtgctgctgatggtcttccagcagttctccggcatcaatgccgtaatcttcttcatgaacgagatcttcgagtctagcagcacgctgaatcccaacgtctgcaccatagtggtgggtgtggtgcaggtgatcatgaccctggcctcctccctgctgatcgagaaggccggccgcaagatcctgctgatcttcagcagcaccatcatgactgtctgcctggccatgctgggtgcttacaacacaatcaatcggcacaccgatctgtcccagtccattggctggttgcccctgctctgcatagtgctgttcatcgtgagcttctccgtgggctatggccccattccttggatgatgatgggcgagctcttcatgccggacgtgaagggcatcgccgtctccctgagcgtaatgatgaactgggtgtgcgtgtccctggtcacatggctcttcggcgtgctcaatgctggcggtgctgatgtgccgttctggttcttcagcgcctggatgggggtggccactgcctacgttgccatcgccttgcaggagacgaagggcaagagtgccagtcaaatccagagctggttgagcggacgttgaggatcacagaaggactccatgccatagtttattctagctgaatgccattgaactcgtagttgaataagcagcccttgaaaagatacttttgaatactttttatatgttatttctattttcaacgatttacaagaaattacctctggcacaattgaacttcagccaagatatgtaacctattcttaattttattacaattttttcggactcaaggccaacctagcttattggtgttccacgatgttcagatacgtagtatagtttaactagttcctaagtactcaaggtcacgcccaaatatctatataagattcaatggacttccacttccacccagttacatatgtacgtgctctccttttgtataaaccacctgctgtataaacacacgtactttaggattgcaaagacaaatacctatatttatacttctgtgtgctaattttaacaaatgtacatatatatttgataataaaagtaagctgtacaggaacctgca

SEQ ID NO: 478 - protein, 496 aa, Drosophila melanogaster
MVATEELKTTVSQEDGDSRNPITYDLLQENQSKTSKTRQYVAAMIICLGAVAAGTALSWTSPVFPQISAGNESSFNSTTGGISNSTSNENDIRLTDSQKTLVGSMLPFGALFGALPSGYIADRIGRRYTAMVMDIPFILAWITLSFANSVGWLYLGRFLIGIATGSFCVVAPMYISEIAETSIRGSLGTLFQLLLTIGILFIYVVGALVSWKTLSLLCLIIPILLLVGLFIVPETPVYLLKNGKRSEANRALKWLWGDYCNTSNAIQAIQNDLDQTGVDASVKDLFSNRASRNGMVISVLLMVFQQFSGINAVIFFMNEIFESSSTLNPNVCTIVVGVVQVIMTLASSLLIEKAGRKILLIFSSTIMTVCLAMLGAYNTINRHTDLSQSIGWLPLLCIVLFIVSFSVGYGPIPWMMMGELFMPDVKGIAVSLSVMMNWVCVSLVTWLFGVLNAGGADVPFWFFSAWMGVATAYVAIALQETKGKSASQIQSWLSGR

SEQ ID NO: 479 - DNA, 1972 bp, Trichoderma harzianum
  CDS (123)..(1754)
tggagctccaccgcggtggcggccgctctagaactagtggatcccccgggctgcaggaattcggcacgaggtcaccacgattcatggtcaaggtcctctacacaaagcatcaagagtgagccatggctatcggcaacatctacgtgattgccggcgtgtccgtcgtcggcggcgcgctcttcggcttcgacatctcgtctgtgtcggcccagctggccgagcagtcgtatctctgctacttcaaccaggatgagaaccctccaaccacggccgatggcaaatgtggtggtccgcggtctctcgtccaaggtggtatcaccgcctccatggctgctggctcctggctgggagctctgatctctggtcccctgtctgatagactgggccgaaagtactccatcatggtcggatgtatcatctgggtcattggttccactctctcctgtgcctcccaaaacattggtatgctcattgtcgcccgtatcatcaacggtatctccgtcggtatcgaatctgctcaggtccccgtctacattgccgaaatctctcctccctccaaacgtggtcgcttcattggtatgcagcaatgggccatcacttggggcattctcatcatgtactacatctcctacggctgctccttcattggcgaagacaaccccgtcagctacaacaccgctgcctggcgtatcccatggggtcttcagatgatccccgccttcttcctcttcttcatgatgatgccccttcccgagtctcctcgttggcttgcccgcaaggaccgctgggaggactgccgagctgtccttactctcgtccacggcaagggtgaccctaaccacccctttgtcgcctacgaactgcaggacatcaaggatatgtgcgagtttgagcgccagcatgccgatgttacttacctcgatctgttcaagcctcgcatgatcaaccgtaccttcattggtctcttcactcagatctggtcgcagttgactggcatgaacgtcatgatgtactacattgccaacatcttctccatggctggttacagtggcaacgccaacctgcttgcctcgtccattcagtacatcatcaacgtcctcatgactattcctgccctactctgggtcgacaaatggggtcgccgtcccacgcttcttatcggttccgtactcatggccctgtggatgtacgccaacgccggtattctcgccacctacggtgaagtcgttcccggcggtatcgaccacgttgctgcccagtcgatgcgtgtcaccggtgcccctgccaagggtctcatcgcctgcacatatcggtttgtggcttcctttgcgcccacctggggtcccgtctcctggacctaccctccggagctgttccctctccgtctccgaggcaagggtgtcgccatggccacctctggaaattgggccttcaacactgctctgggtctctttacccccgtggcctttgccaacatcaagtggaagtcgtacctcatcttcgccgtcttcaacactgttgccttcttccacgtcttcttcgtcttccccgagactgccggaaagactttggaagagactgaggccatgtttgaggaccccaacggcattccctacatgggaactcccgcctggaagaccaaggtcgcaaccagcctcactgtccgtgccgaacagggcgacctcgaggccaagattgcccacgataccgagaagcctccgatccacactcacgaggaagagactacccagtaaatgggaaatttaataacatcttgacgatgataatcttgtgcagggcggtaggctttagttgataccctgggggaagtgtggcctcgtcccacaaggaaccttatgatgcaaatgtttaatagtcgtactataccaataccatcacatgttgcattttgaaaaaaaaaaaaaaaaaaaactcgagggggggcccggtacccaattcgccctatagtgaa

SEQ ID NO: 480 - protein, 543 aa, Trichoderma harzianum
MAIGNIYVIAGVSVVGGALFGFDISSVSAQLAEQSYLCYFNQDENPPTTADGKCGGPRSLVQGGITASMAAGSWLGALISGPLSDRLGRKYSIMVGCIIWVIGSTLSCASQNIGMLIVARIINGISVGIESAQVPVYIAEISPPSKRGRFIGMQQWAITWGILIMYYISYGCSFIGEDNPVSYNTAAWRIPWGLQMIPAFFLFFMMMPLPESPRWLARKDRWEDCRAVLTLVHGKGDPNHPFVAYELQDIKDMCEFERQHADVTYLDLFKPRMINRTFIGLFTQIWSQLTGMNVMMYYIANIFSMAGYSGNANLLASSIQYIINVLMTIPALLWVDKWGRRPTLLIGSVLMALWMYANAGILATYGEVVPGGIDHVAAQSMRVTGAPAKGLIACTYRFVASFAPTWGPVSWTYPPELFPLRLRGKGVAMATSGNWAFNTALGLFTPVAFANIKWKSYLIFAVFNTVAFFHVFFVFPETAGKTLEETEAMFEDPNGIPYMGTPAWKTKVATSLTVRAEQGDLEAKIAHDTEKPPIHTHEEETTQ

SEQ ID NO: 481 - DNA, 1830 bp, Arabidopsis thaliana
  CDS (74)..(1522)
acatctatctctttctctctctttccttgcaaattttcagctctcaaagagttaagagttagagagagagaggatggccattagggaaatcaaagatgtagagaggggtgaaatagtgaataaggtagaagatcttgggaaaccatttttgactcatgaagatgatgaaaaagagagtgagaataatgaatcatatttgatggttctcttcagtacttttgttgctgtctgtggctcctttgagtttggctcttgtgttggatactcagcgcctactcagtcatctataagacaagatctcaatctctcccttgcagagttctccatgtttggatccatcttaactatcggtgcaatgcttggtgctgttatgagtgggaaaatttcagatttctccggccgaaaaggggcaatgaggacatcagcttgcttctgcattacaggttggctcgctgtcttcttcaccaagggggcattgttacttgatgtaggaaggttctttacaggatatggaattggagttttttcttatgtggtccctgtgtacattgctgagatatctcccaagaatctccgaggtggactcacaacactgaaccaactcatgattgtgatcggctcatcggtttctttcttgatcggatctctcatttcttggaaaactcttgccctaaccggacttgctccctgcattgttttgctctttggcttgtgcttcatacccgaatctcctcgatggctggcaaaagcaggccatgagaaagagtttcgcgtagccctgcaaaagctgcgaggaaaagatgcagatatcacaaatgaagcagacggtattcaagtctcgattcaagctctagagattcttccaaaagcaagaatccaagaccttgtgtccaagaaatatggtcgatctgtcatcattggtgtttccctgatggtattccaacagtttgttggaatcaatgggatcggattctacgcaagtgaaacgtttgtaaaagccggatttacctctgggaaactaggaacaatcgctatcgcttgtgttcaggtgccaataactgttcttggaacaatcttgatagataaatctggacgaaggccactaattatgatttcagctggtggtatcttcttgggatgcatactcacaggcacatctttcttactcaagggacagagcttgttgcttgaatgggtcccttccttagccgttggaggtgtacttatctatgtagctgctttctccatcggaatgggacctgttccttgggtgataatgtctgagatatttccgataaacgtaaagggaatcgcaggaagcttagtggtactagtgaattggtctggtgcttgggctgtttcttacactttcaacttcctcatgagctggagctctccaggtacattctatttgtactcggcttttgcagctgcgacgataatatttgtggcgaagatggtgccagagacgaaagggaagacactggaagagatccaagcttgtattcgaagagaaacataagaagaaagatacaatcaatgttatgggaatgttatcaaatgaaaagactcgaactattcccgttggtgagctcaaagtggagtagagtaaaaattatcgccgggagataacgttgaaagtccgatgatgaggcataagggttttgcatgaatgttatgagaataggtttacttttatgtatttgttcacgttttaagttttcatcaaataggtttttgattggtatacagtatgtggaatattaatagaatggagtggcagatttcatattcaatcattctacatgctttcaatcaaaccaagtccgt

SEQ ID NO: 482 - protein, 482 aa, Arabidopsis thaliana
MAIREIKDVERGEIVNKVEDLGKPFLTHEDDEKESENNESYLMVLFSTFVAVCGSFEFGSCVGYSAPTQSSIRQDLNLSLAEFSMFGSILTIGAMLGAVMSGKISDFSGRKGAMRTSACFCITGWLAVFFTKGALLLDVGRFFTGYGIGVFSYVVPVYIAEISPKNLRGGLTTLNQLMIVIGSSVSFLIGSLISWKTLALTGLAPCIVLLFGLCFIPESPRWLAKAGHEKEFRVALQKLRGKDADITNEADGIQVSIQALEILPKARIQDLVSKKYGRSVIIGVSLMVFQQFVGINGIGFYASETFVKAGFTSGKLGTIAIACVQVPITVLGTILIDKSGRRPLIMISAGGIFLGCILTGTSFLLKGQSLLLEWVPSLAVGGVLIYVAAFSIGMGPVPWVIMSEIFPINVKGIAGSLVVLVNWSGAWAVSYTFNFLMSWSSPGTFYLYSAFAAATIIFVAKMVPETKGKTLEEIQACIRRET

SEQ ID NO: 483 - DNA, 1599 bp, Neurospora crassa
  CDS (1)..(1599)
atgggtctcttctcgaaaaagtcggctgcgccgcagacccaatcacaagatgagatcgatctcgctgctgagcagaaggtcactttccgtgccgtcttcctcggtgttgtcgcctccgtaggtggcttcatgtttggctacgtcagtggtcaaatttctggtttcttcgacatggaagacttcggtcgtcggttcggtaactaccaagacgcggatggctgggtcttctcagcataccgccagggtgctattgtcgccctactccctgctggtgcccttcttggttcgctcgttgccggtagaattgcggatacccttggtcgccgtatcgccatctctgcgtccgcccttttctcctgcatcggaacaattatcgagatcgcctccaccacgcactgggcccagtttgcggtcggtcgtcttatcaccggtattggtatcggtgctctctccgtcgtcgtcccgatgtaccagtctgagtccgcgcccgccatcctccgtggtatcctcgtctcgtgctaccagctcttcatcactcttggtatctggaccgctgagatgatcaactacggtactcacgacctcagcaactccgcctcttggcgtattcccaacggtatctccttcctctgggctttggttctcggtggcggaatattgttccttcctgagtctccccgttatgcctaccgtgttggtcgcgaggacgaggctcgcaacaccattgcccgccttgccggtctcgagcccagcgcccgctctgtcaacatgcaaatcgatgagatccgtatgaagcttgaggaggagaaggctggtgccgacaccaagtggtacgagatcttcggacctgctctgttgcgccgcacccttatcggtatcattcttcagtctggccagcagcttactggtgccaacttcttcttctactacggaaccacgattttcaaggctactggtcttagcgactcttacgttacccagatcattcttggttccgtcaacgctggatgcactgttgctggtctctgggttgtcaagaatgttggccgccgtaaggccctcatcggtggtgccctctggatgaccatgtgcttcttggtctactctttcgtcggaagatttgtgctcgaccccgtcaacccggctagcactcctcaggccggcaacgtcctcattgtcttctcctgcttcttcatcgtcgcctttgccaccacttggggtcctctcgtctgggccgtcgttgctgagctctaccctgctcgctaccgtgctcctgccatggccttggccaccgcttccaactggctgtggaacttcctcatgtccctcttcacgcgccccatcaccgactccattggctacttctatggcttggtgttcgccggatgctgccttgccctcgccgctttcgtttggctctttgtgatcgagtccaaggaccgcacccttgaggagatcgagaccatgtacaaccagaaggtcagccctaggcactccacccactggcacgctgaggtcccttcgggaccgcgggatgcggaggagaagcccgaggttcacagtggttctgcgacaacctcaagccatggagaggtttag

SEQ ID NO: 484 - protein, 532 aa, Neurospora crassa
MGLFSKKSAAPQTQSQDEIDLAAEQKVTFRAVFLGVVASVGGFMFGYVSGQISGFFDMEDFGRRFGNYQDADGWVFSAYRQGAIVALLPAGALLGSLVAGRIADTLGRRIAISASALFSCIGTIIEIASTTHWAQFAVGRLITGIGIGALSVVVPMYQSESAPAILRGILVSCYQLFITLGIWTAEMINYGTHDLSNSASWRIPNGISFLWALVLGGGILFLPESPRYAYRVGREDEARNTIARLAGLEPSARSVNMQIDEIRMKLEEEKAGADTKWYEIFGPALLRRTLIGIILQSGQQLTGANFFFYYGTTIFKATGLSDSYVTQIILGSVNAGCTVAGLWVVKNVGRRKALIGGALWMTMCFLVYSFVGRFVLDPVNPASTPQAGNVLIVFSCFFIVAFATTWGPLVWAVVAELYPARYRAPAMALATASNWLWNFLMSLFTRPITDSIGYFYGLVFAGCCLALAAFVWLFVIESKDRTLEEIETMYNQKVSPRHSTHWHAEVPSGPRDAEEKPEVHSGSATTSSHGEV

SEQ ID NO: 485 - DNA, 1860 bp, Oryza sativa
  CDS (3)..(1736)
acatgtcggccaccacgtccaattcccggcggctatgcaacggccggggacaggtcatacctgggcccaccttaccagaggctgtcaagatgggcccacacgccattcggattgtagtcggagggctcggagaaggcgagctctcgaccgccactactgtacacggcccagagcgagcctcctcctcctctgcaccaccggagatggcttccgccgcgctgccggaggccgtcgcgccgaagaagaagggcaacgtccggttcgccttcgcctgcgccatcctcgcctccatgacctccatcctcctcggctacgatatcggggtgatgagcggggcgtcgctgtacatcaagaaggacttcaacatcagtgacgggaaggtggaggttctcatgggcatactgaacctctactcgctcatcggctccttcgcggcggggcggacgtcggactggatcggccggcggtacaccatcgtgttcgccgccgtcatattcttcgcgggggcgttcctcatggggttcgccgtcaactacgccatgctcatgttcggccgcttcgtggccggcatcggcgtgggctacgcgctcatgatcgcgccggtgtacaccgccgaggtgtcgccggcgtcggcgcgtggcttcctgacgtcgttcccggaggtgttcatcaacttcggcatcctgctcgggtacgtctcgaactatgctttctcccgcttgccgctgaacctcgggtggcgcatcatgctcggcatcggcgcggcgccgtccgtgctgctcgcgctcatggtgctcggcatgccggagtcgccgcggtggctggtcatgaagggacgcctcgcggacgccaaggtggtgctggagaagacctccgacacggcggaggaggccgcggagcgcctggccgacatcaaggccgccgccggcatccccgaggagctcgacggcgacgtggtgaccgtccccaagagagggagcggaaacgagaagcgggtgtggaaggagctcatcctgtccccgaccccggccatgcggcgcatcctgctgtcgggcatcggcatccacttcttccagcaggcgtcgggcatcgactccgtcgtgctctacagcccgcgcgtgttcaagagcgccggcatcaccgacgacaaacacctcctcggcaccacctgcgccgtcggtgtcaccaagacgctcttcatcctcgtggcgaccttcttcctcgaccgcgtcgggcggcggccgctgctgctgagcagcacgggcgggatgatcctctccctcatcggcctcggcgccgggctcaccgtcgtcggccagcaccccgacgccaagataccttgggccatcggcctaagcatcgcctccaccctcgcctacgtcgccttcttctccatcggccttggccccatcacgtgggtgtacagctcggagatcttcccgctccaggtgcgcgcgctgggctgctcgctcggcgtcgccgccaaccgcgtcaccagcggcgtcatctccatgaccttcctgtcgctgtccaaggccatcaccatcggcggcagcttcttcctctactccggcatcgccgcgctcgcctgggtgttcttctacacctacctcccggagacccgcggccggacgctggaggagatgagcaagctgttcggcgacacggccgccgcctcggaatcagacgagccagccaaggagaagaagaaggtggaaatggccgccactaactgatcaaactaaccgcaaaatcaccaaatcctaagggttttcttgcaaaaacgtgtgctgtactggctagctagcaagtagtagcagcaacgtgggaagattcgctgatccggcgttgctggagagc

SEQ ID NO: 486 - protein, 577 aa, Oryza sativa
MSATTSNSRRLCNGRGQVIPGPTLPEAVKMGPHAIRIVVGGLGEGELSTATTVHGPERASSSSAPPEMASAALPEAVAPKKKGNVRFAFACAILASMTSILLGYDIGVMSGASLYIKKDFNISDGKVEVLMGILNLYSLIGSFAAGRTSDWIGRRYTIVFAAVIFFAGAFLMGFAVNYAMLMFGRFVAGIGVGYALMIAPVYTAEVSPASARGFLTSFPEVFINFGILLGYVSNYAFSRLPLNLGWRIMLGIGAAPSVLLALMVLGMPESPRWLVMKGRLADAKVVLEKTSDTAEEAAERLADIKAAAGIPEELDGDVVTVPKRGSGNEKRVWKELILSPTPAMRRILLSGIGIHFFQQASGIDSVVLYSPRVFKSAGITDDKHLLGTTCAVGVTKTLFILVATFFLDRVGRRPLLLSSTGGMILSLIGLGAGLTVVGQHPDAKIPWAIGLSIASTLAYVAFFSIGLGPITWVYSSEIFPLQVRALGCSLGVAANRVTSGVISMTFLSLSKAITIGGSFFLYSGIAALAWVFFYTYLPETRGRTLEEMSKLFGDTAAASESDEPAKEKKKVEMAATN

SEQ ID NO: 487 - DNA, 1569 bp, Uromyces fabae
  CDS (1)..(1569)
atgcctgcggttatggccggcccggtctctttcgccccgccggagggtaaatctagtaaggtcgcgattgtcattgctgtatttgccgcctttggtggcttcttatatggatatgacactggttacattgccggagttaaagccatgcccttttggctacgctctgctggacagcgcggacctgatggtaaatacatgatcactacaagccaagactcaatggttactagtattctttcagttgggactttcgtgggagctcttttagcctatcctatcggtgacaggttcggacgaagaattggcataatgattgcctgtgcaattttttctgttggtgttgctctgcaaactgcctcaaccaagataccaatgttcgtcgtcggcagagtttttgctggcttaggagttggggtagcttcttgtcttgtgccaatgtatcaatcagaatgtgcaccaaaatggatacgtggagggattgtcgcgtgctaccaatgggctattaccattggtttattagttgcctcaattacggtcaacgcaacgaaagatttcgacagtgccaactcataccgcattcccattggtattcagtttatttgggctgcaatccttactatcggtttgcttgtgttacccgaatcgccgagatacttactactcaagggcagggaagacgaggcttggaaatctttaagtcgcctctacagcgctccatacgatgacccagatgtacaagcagaattctcagaaatcatggctagtttggaaaaagagagatcgttcggaaaaaccacgttactagactgcttcaaaacagacaaaagaaaaaatctccaaaggactttgacaggtttgggcgttcagggatggcaacaagcgtcgggaattaattttttcttttattacggtacaacgttcttcaaaaatgcgggaatcgaaaacgcgtttctagtgacggtcgcaactaatgtagtcaatgtggttatgactataccaggaatttgggccgtagacaaagtaggtcgcagaacgatgatgatttgtggggcagcgatgatgttcacatgtgaacttatcctggcttgcgttggtactttcactgcaactagcaacctagcctcgcagaaagttctcgtggccttctcttgtatcttcatcggtctttttgcggccacttggggcccgattccctgggttgtgacaagcgagatttatccgctcgcgacccgtggtaagcaaatggcaatgtcaaccgcctcaaattgggcagtgaattttttcattggtttcattacgccatacttggtcgattcgggtgccggtcaagccggcttgggtgttaaagtcttctggctttgggctgctttgtgctttggagccatggtgttctcattcttacttatccctgagacgaaaggactttcgctggagcaagttgacctcctttacactaattctaccgtccttaagagcaatacctacaggagccagttgatcgcaaacaacttgcacgagggtatgacacctgcagaaaaggcataccaagagaaattggaacatatttga

SEQ ID NO: 488 - protein, 522 aa, Uromyces fabae
MPAVMAGPVSFAPPEGKSSKVAIVIAVFAAFGGFLYGYDTGYIAGVKAMPFWLRSAGQRGPDGKYMITTSQDSMVTSILSVGTFVGALLAYPIGDRFGRRIGIMIACAIFSVGVALQTASTKIPMFVVGRVFAGLGVGVASCLVPMYQSECAPKWIRGGIVACYQWAITIGLLVASITVNATKDFDSANSYRIPIGIQFIWAAILTIGLLVLPESPRYLLLKGREDEAWKSLSRLYSAPYDDPDVQAEFSEIMASLEKERSFGKTTLLDCFKTDKRKNLQRTLTGLGVQGWQQASGINFFFYYGTTFFKNAGIENAFLVTVATNVVNVVMTIPGIWAVDKVGRRTMMICGAAMMFTCELILACVGTFTATSNLASQKVLVAFSCIFIGLFAATWGPIPWVVTSEIYPLATRGKQMAMSTASNWAVNFFIGFITPYLVDSGAGQAGLGVKVFWLWAALCFGAMVFSFLLIPETKGLSLEQVDLLYTNSTVLKSNTYRSQLIANNLHEGMTPAEKAYQEKLEHI

SEQ ID NO: 489 - DNA, 1620 bp, Aspergillus oryzae
  CDS (1)..(1620)
atgactccagagaaggccgctatgtctgaacatattgaaaacgataacccagcgaggcatgatgatatcgacctccccaacagtagcgaggcacataccgccattgcgaaagaacgtgagatgactctatggcaagcgctaagactttatccgaaggcggtggcgtggtctcttctgttctcctgtgccattatcatggaaggctacgatgttgttcttatcggttccttcctcgcatttcctgccttcaacgaaaaatacggaggtctcatgtccgacgggacatatgggctcgaagctaggtggcaagcaggtgttaacaacgcgatggcctgcggccagattatcggactttttctcaatggactggtctcagagcgcttgggataccgaaagaccctgatggcatgccttgccgcgaccgttggtttcgttttcattctgttctttgcgcccaatattcaaactctcgttgtcggcgagctctttatgggcatccctcttggtgtataccaaaccctcgttgtgacatacgcatccgaagtgtgccctgtcgcattgcgcgcatatctcaccacctatgttaacctttgctgggtgctaggtcaattgctcgcctctggcgtgctgaagggtctggccgagcgcaccgatcaatgggcataccgtatcccctttgctctgcagtggatctggccaattcccattttcatcggggtgtttctggcccccgagagcccctggtggctcgttcgacaagaccgccgcgaagatgccgtcaaggcattgaaacgactgaccagcgctaacgcagacttcaacgccgaagaaaccgtcgcaatgatcgtatacaccgacgcactcgagcgacgtgctgaaaccggtacctcctaccttgactgcttcaagaaaagcgacttacgccgaaccgaaatctcctgctgcgcatgggcggcgcagagtctatgtggcgcaggcctcatgggctattcgactgtcttttaccagcgcgcaggtctcgccgtgtcgcagtccttcaccatgtcgctcgtgcaatatgccctaggcgtggtggggacattcgtctcctggacactaatgtcgtacttcggccgtcgcaccctctacgtcggcggtctatttatcctagccatcgtattattcgtcatcgggttcgtctccatcgctccatccacacccgccatctcctgggccaccggctccatgcttctcgtctatacctttatctacgactcctccatcggccccgtctgcttcgccctcgtctccgaaatcccatcctccagactccgtaccaagaccgtcgtgctggcccgaaacgtctacaatatcctcaacctcgtcaccggaatcattatcccgtatatgctgaacgtcgacgcatggaactggcgcggtaaatcaggtttcttctggggtgcactctgcgtttgctgcttgacgtggtcgttcttccggctgccagaacctaagggacggtcgtatgctgagttggatctgttgtttgagagaggggtgaagacgagggagtttgcgactgctaagactgggttggaggatttgcagggcgaggggaaggatgatatggtgaaggtttga

SEQ ID NO: 490 - protein, 539 aa, Aspergillus oryzae
MTPEKAAMSEHIENDNPARHDDIDLPNSSEAHTAIAKEREMTLWQALRLYPKAVAWSLLFSCAIIMEGYDVVLIGSFLAFPAFNEKYGGLMSDGTYGLEARWQAGVNNAMACGQIIGLFLNGLVSERLGYRKTLMACLAATVGFVFILFFAPNIQTLVVGELFMGIPLGVYQTLVVTYASEVCPVALRAYLTTYVNLCWVLGQLLASGVLKGLAERTDQWAYRIPFALQWIWPIPIFIGVFLAPESPWWLVRQDRREDAVKALKRLTSANADFNAEETVAMIVYTDALERRAETGTSYLDCFKKSDLRRTEISCCAWAAQSLCGAGLMGYSTVFYQRAGLAVSQSFTMSLVQYALGVVGTFVSWTLMSYFGRRTLYVGGLFILAIVLFVIGFVSIAPSTPAISWATGSMLLVYTFIYDSSIGPVCFALVSEIPSSRLRTKTVVLARNVYNILNLVTGIIIPYMLNVDAWNWRGKSGFFWGALCVCCLTWSFFRLPEPKGRSYAELDLLFERGVKTREFATAKTGLEDLQGEGKDDMVKV

SEQ ID NO: 491 - DNA, 1725 bp, Oryza sativa
  CDS (1)..(1725)
atggtgaaaggagctcacaaaatgggagaaatgtctgacctttggagagaggctcagtgtttggagactgtcatttgcactgttttatccaatttggagatagtgctaatcgaaatcgacaatggtgtgcaacctagtgcctaccattacatagtctcaaagaaagttacacaaggagaagaaggagaagacgacgcagctgccatgggagaagagaagcagaatgacgagaggaagaacaagtacgccgtcgggtgctccatcatcggctccatcatctcggtcctcatgggctatgacactggtgtgatgagtggggcgatgctgttcatcaaggaggacctgaagacgaacgacacgcaggtgcaggtcctcgccgggatcctcaacgtgtgcgcgctcgtcggctccctcaccgccggccgcgtctccgactgcgtcggccgccgcctcaccatctccctcgccgcctgcatcttcctcgtgggctccgtcctcatgggcctcgcgcccaacttcgccacgctcctcgccggccgctgcgtcgccggcgtcggcgtcggctacgcgctcatgattgcgccggtgtacgccgccgagatcgcctccgccgacatccgcggctcgctcacctcgctcccggagatctgcatcagcttcgggatactcatcggctacgtggccaactacctgctcgccaagctgccgctggtgtacgggtggcgcgccatgctcggcctcggcgcgctcccgagcgccgcgctcgcgctcggcgtgctcgccatgcccgagtccccgcggtggctcgtcgtccagggccgcgccgaggaggcgctctccgtgctccgccgcgtgtgcgacaggcccagcgaggccgacgcgcggctcgcggagatcaaggccgcggcggggctcgccgacgacgacggcgccgccgccaacgcgggcagcggcggcaagggcgtgtggagggagctgttcctgcacccgacgccgccggtgcggcgcatcgtcatcgccgccctggggatccacttcttccagcacctcaccggcatcgaggccgtggtgctctacagcccgcgcatcttcaaggcggccggcatcgccagccgcaactcggtgctcgctgcgaccatcggcgtgggcgtcaccaagacggcgttcatcctcaccgccatcctcctcgtcgaccgcataggccggcggccgctctacctgtcaagcctcgccggcatcatcgcctcgctcgcctgcctcggcatgggcctcaccgtcatcgagcggtcgccgccgcaccactcgccggcgtgggccgtcgtgctcgccatcgccaccgtgttcaccttcgtcgcctccttctccatcggcgtcgggccgatcacctgggcctacagctcggaggtgtacccgctccgcctccgcgcgcagggcgccagcgtcggcgtcgccatcaaccgcgtgatgaacgccggcgtgtccatgacgttcgtgtcgctctacaaggccatcaccatcggcggcgccttcttcctcttcgccgggctcgccgtcgccgccgccacgttcttctacctcctgtgcccggagacgcagggcaagccgctggaggagatcgaggaggtgttcagccaggggtggcgcgcgcggcgccgggcgtcggcggcggccgtcgagatgccggcctccggcggcggcggcggcggcggcgccccgatggcgtag

SEQ ID NO: 492 - protein, 574 aa, Oryza sativa
MVKGAHKMGEMSDLWREAQCLETVICTVLSNLEIVLIEIDNGVQPSAYHYIVSKKVTQGEEGEDDAAAMGEEKQNDERKNKYAVGCSIIGSIISVLMGYDTGVMSGAMLFIKEDLKTNDTQVQVLAGILNVCALVGSLTAGRVSDCVGRRLTISLAACIFLVGSVLMGLAPNFATLLAGRCVAGVGVGYALMIAPVYAAEIASADIRGSLTSLPEICISFGILIGYVANYLLAKLPLVYGWRAMLGLGALPSAALALGVLAMPESPRWLVVQGRAEEALSVLRRVCDRPSEADARLAEIKAAAGLADDDGAAANAGSGGKGVWRELFLHPTPPVRRIVIAALGIHFFQHLTGIEAVVLYSPRIFKAAGIASRNSVLAATIGVGVTKTAFILTAILLVDRIGRRPLYLSSLAGIIASLACLGMGLTVIERSPPHHSPAWAVVLAIATVFTFVASFSIGVGPITWAYSSEVYPLRLRAQGASVGVAINRVMNAGVSMTFVSLYKAITIGGAFFLFAGLAVAAATFFYLLCPETQGKPLEEIEEVFSQGWRARRRASAAAVEMPASGGGGGGGAPMA

SEQ ID NO: 493 - DNA, 1440 bp, Zymomonas mobilis
  CDS (1)..(1440)
atgaataacaattcagaaatagaaaatgatacccaaactaacgttcgaaataccgtatcagattttattggttcacaattatatttgctcggtaccgttctggtaacggctattgctggctttctttatgggtatgacacgggtattatttcaggcgcattgatgaatattgcgcatgacttcaaactggatgcccatcaacaagaaattattactagtattctcttatttggtgccgtgatcggctctctggtctgtggtcgactgtctgcttttgttggccgccgtcatatgattatgattgtgaccgctattttcggtttcagtgtgattgccgcagacgcccccacggctttctggttaggtgcagcccgcttggttctcggcttcgccgttggcggatcatcacaaattgtgcctgtctatatcgccgaattggcaccagctgaccaacgtggtcgcatggtaaccttctataatatttcgattggtcttggtattctggcggcgggtattgtcggcgctttccttcaggaagaatggacatggcggacaatgttcagcgtcgcggctattccggcggctgttttattctgctcaatgatgatgcttcccgaaagtcctcgctggttggtgcggcaggaacgcgttgaagaagcgcgtgatatgctggataccgtccgcgaaacagatcacgaagtcaccaaagaacttcgctctatcaagaaaaatcagcaaccggacgaaggaagcggctcaagatggctggaaagcttggcacagccttgggtgcgccctgccctgatcgcaggtctaggcgtcgctgcttttacccagctttccggcattgaaatgatgatctattataccccgaccttcttgcgggattccggcttcactgaaaaaatggcctattattcggctttgggtgtcgcccttatttatgtcatcatgacaaccatcgggaaattgttggtcgatcatgtcggtcgtcgtaaattagctttatgcatgatgccgctggccgctctcagcctttttgcattgggtattgcctttaacctgccggggggtgcttcggaacatcgctggcttattcttgcctgtctgtttgcctttatggttttcaatgcgggtggtattcaggttatcggctggcttattggttcggaagtctatccgctctgtattcgcgctcgtgccaccagccttcacgctgcgactttgtggggttccaacctcattttaacgtcaactgcgttaacgatgaccagcttattgggcatcggtggttccatgtggttctatggcggtctgaatgctttgggttttgttttcgtctatttcatggtgccggaaaccaaaggccgcagtttggaagaaatcgaatccagcctgaaagatggcagcttcttaccgagtaaaaaagcctccgcctaa

SEQ ID NO: 494 - protein, 479 aa, Zymomonas mobilis
MNNNSEIENDTQTNVRNTVSDFIGSQLYLLGTVLVTAIAGFLYGYDTGIISGALMNIAHDFKLDAHQQEIITSILLFGAVIGSLVCGRLSAFVGRRHMIMIVTAIFGFSVIAADAPTAFWLGAARLVLGFAVGGSSQIVPVYIAELAPADQRGRMVTFYNISIGLGILAAGIVGAFLQEEWTWRTMFSVAAIPAAVLFCSMMMLPESPRWLVRQERVEEARDMLDTVRETDHEVTKELRSIKKNQQPDEGSGSRWLESLAQPWVRPALIAGLGVAAFTQLSGIEMMIYYTPTFLRDSGFTEKMAYYSALGVALIYVIMTTIGKLLVDHVGRRKLALCMMPLAALSLFALGIAFNLPGGASEHRWLILACLFAFMVFNAGGIQVIGWLIGSEVYPLCIRARATSLHAATLWGSNLILTSTALTMTSLLGIGGSMWFYGGLNALGFVFVYFMVPETKGRSLEEIESSLKDGSFLPSKKASA

SEQ ID NO: 495 - DNA, 1766 bp, Apium graveolens var
  CDS (17)..(1558)
ggcacgaggagcttctatgattaccggcgaagtttccgtcgattcatatgatactaacaagcctaaacctaaaaggaataagtatgcttttgcttgtgctcttttagcttccatgaattccatcttactcggctatgacaccggagtgttgagtggagcatcaatatacataaaggaagatctccatttctccgacgttcaaatcgaaataatcatcggaatcatcaacatctactctcttcttggttcggccatagccggaaggacctcggactggataggcagacgttacaccatggtactagctggtatcatattttttctaggagccattttcatggggcttgctacaaactttgcctttctcatgtttggtcgctttgttgctggaattggtgtcggttatgccatgatgatcgctcccgtctacactgccgaggttgctccgtcgtcttcccgtggtttcctcacttcttttcctgaggttttcattaattctggtgtgttgctcgggtatgtatccaactttgcatttgccaagtgcccactttggttaggctggagaattatgctgggaattggagcatttccttcagttgccttggccataattgtgttatatatgccagagtccccacgttggctcgttatgcagggtcgacttggtgaagcgaggactgtacttgagaaaacttctacttccaaagaagaagctcaccaaagactgtctgatattaaggaagctgctgggattgataaagattgtaatgacgatgttgttcaagttccaaaacgtaccaaagacgaagcagtgtggaaagaattgattcttcaccctacaaaacctgttcgccacgctgcaattacgggtattggtattcatttcttccaacaggcttgtggtattgatgctgttgttttatacagccctcgaatttttgaaaaagctggtatcaaaagtaatagtaaaaagctccttgcgacaattgctgttggagtctgcaaaacagtctttattctgatatcaacgtttcagctggacaaaattggacgacgccccctgatgctaacaagtatggggggtatggttattgctctatttgtactggcaggctcattgacggttattaacaaatcacatcatactggtcattgggctggtggtttggcaatatttacagtgtatgcttttgtgtcgatattttcaagtggcatgggtccaattgcttgggtctatagctccgaggtgttccctttgaggctaagagctcaaggttgtagtatcggagtggcagttaaccgtggcatgagtggcataattggaatgacatttatatcgatgtacaaagccatgactattggtggtgcattccttttatttgctgtggttgcatctatcggatgggtctttatgtacacaatgttccccgagacacaaggtagaaatctcgaagaaattgagttattgtttggcagctactttggctggaggaagacattgaaggatttgaaggcaaaagaagctgctgaagcaaagagtcgcgagagtgaagtttagcagtcagatgaatttagggttcaaagatgttatattagctctgtgtagagggtagttttagagaagcccttagtatgtgttggagtatgtgtgattattaaccatcacccgataatttagaataagggtgtcaaagaacaattacccatttcttatgtggtaatctattgaaaagaatttgcccaatggtaaaaaaaaaaaaaaaaaa

SEQ ID NO: 496 - protein, 513 aa, Apium graveolens var
MITGEVSVDSYDTNKPKPKRNKYAFACALLASMNSILLGYDTGVLSGASIYIKEDLHFSDVQIEIIIGIINIYSLLGSAIAGRTSDWIGRRYTMVLAGIIFFLGAIFMGLATNFAFLMFGRFVAGIGVGYAMMIAPVYTAEVAPSSSRGFLTSFPEVFINSGVLLGYVSNFAFAKCPLWLGWRIMLGIGAFPSVALAIIVLYMPESPRWLVMQGRLGEARTVLEKTSTSKEEAHQRLSDIKEAAGIDKDCNDDVVQVPKRTKDEAVWKELILHPTKPVRHAAITGIGIHFFQQACGIDAVVLYSPRIFEKAGIKSNSKKLLATIAVGVCKTVFILISTFQLDKIGRRPLMLTSMGGMVIALFVLAGSLTVINKSHHTGHWAGGLAIFTVYAFVSIFSSGMGPIAWVYSSEVFPLRLRAQGCSIGVAVNRGMSGIIGMTFISMYKAMTIGGAFLLFAVVASIGWVFMYTMFPETQGRNLEEIELLFGSYFGWRKTLKDLKAKEAAEAKSRESEV

SEQ ID NO: 497 - DNA, 2041 bp, Mesembryanthemum crystallinum
  CDS (118)..(1785)
aaataacccatcttactctgagcgatcaagcgattagtgaaagataaaacaaggaaattcgatcatctctgattgcgttaacccacttggaattttgtctataatttaggtttaaagatgcaagcatcaagttgtctggtgaaagggaacttgggttttgaagttcagaaccggagaagaggggttcttgctgtggctgggcttggaggatttaagaattcaagtccaattcttagcagtaacttgagatttgtgaatggtgttattaataagaagagtagttcttgtaaattgactacttctgggtcggttttaatgggtgctggattagcaagaatgggtcttgatcatgtcttccagtccactgccaagtacagatcagtcaaggctcaagctgcttctggagattatgaagatcctgctccagtcaaatttcaaggcaaatcttctgcatcagttctgccgtatgttggtgttgcttgcttaggagcaattttgtttggatatcaccttggtgtagtaaacggagctctcgagtatttgtctcctgatctgggtattgctggcaatacggtcttacaaggatgggttgtgagtatactgcttgctggtgcaactgtgggctcatttactggtggatctttggctgataagttcggaagaacaagaactttccagttagatgcaattcctctggctataggagcctatctttgtgctacagcacagagtgtacagacaatgatgattggtcggttactttgtggcattggaataggcatatcatctgctttagttccactgtacatctctgagatctcacctactgaaattcgaggtgcacttggttctgtcaaccagctttttatttgcattgggattcttgcagcattggtggctggattgcctttggcaggaaaccctttatggtggagaacaatgtttggtattgcagctattccctctgttctattggctcttgggatggctatgtgtccagaaagtccgaggtggctttttcagcaaggaaaagttgcagaagctgagaaagcttcggcagccctatatgggaaagaaagagttcctgaagttatgaatgatttgaaagcatctgttcagggttcttctgaaccagaagctggctggtttgatctattcagtagccgctacaggaaagtggtaagcgttggtgctgcacttttcctgttccagcagatggcaggaatcaatgctgtggtatattactccacttctgtattccgcagtgctggaattgaatctgatgttgcagctagtgctttggttggggctgcaaatgtcttcggcactgctatcgcctcttctcttatggataggcaaggaagaaaaagcctactgattacaagtttctcaggaatggctgcttcaatgttgttgctgtcgctttcattcacatggcctgttctagcaccatattctggcacactcgctgtcctggggactgttctctacgtgctctccttctcgcttggtgctggtcccgtgcctgctctattacttcctgaaatttttgcctccagaatccgagcaaaagcagttgctttgtctctgggaatgcattgggcatctaatttcgtgattggtctctacttcttgagtgtggtgaccaagtttggaataagcagagtttatctgggtttcgcgtcagtttgtatgctagccgtcttgtacatagctggcaacgttgtagaaacaaaaggccgatcactcgaggaaatagagcgtgctttaagcccagctgtttgatgagtgaagatggtgtcaacagtccctagattttggagacatactagaactttagctcaaaacccttgtaaacagctgtagtgttgatatctctgtttatttatgcagtctttctccttggttatctggcttggcatcatcatctccggcctttccctgggttgattcttctctaacttaaccaaacattcaatgtaatgtttcttttgccaattcatcatccagatactcctaccgtaaaaaaaaaaaaaaaaaa

SEQ ID NO: 498 - protein, 555 aa, Mesembryanthemum crystallinum
MQASSCLVKGNLGFEVQNRRRGVLAVAGLGGFKNSSPILSSNLRFVNGVINKKSSSCKLTTSGSVLMGAGLARMGLDHVFQSTAKYRSVKAQAASGDYEDPAPVKFQGKSSASVLPYVGVACLGAILFGYHLGVVNGALEYLSPDLGIAGNTVLQGWVVSILLAGATVGSFTGGSLADKFGRTRTFQLDAIPLAIGAYLCATAQSVQTMMIGRLLCGIGIGISSALVPLYISEISPTEIRGALGSVNQLFICIGILAALVAGLPLAGNPLWWRTMFGIAAIPSVLLALGMAMCPESPRWLFQQGKVAEAEKASAALYGKERVPEVMNDLKASVQGSSEPEAGWFDLFSSRYRKVVSVGAALFLFQQMAGINAVVYYSTSVFRSAGIESDVAASALVGAANVFGTAIASSLMDRQGRKSLLITSFSGMAASMLLLSLSFTWPVLAPYSGTLAVLGTVLYVLSFSLGAGPVPALLLPEIFASRIRAKAVALSLGMHWASNFVIGLYFLSVVTKFGISRVYLGFASVCMLAVLYIAGNVVETKGRSLEEIERALSPAV

SEQ ID NO: 499 - DNA, 1530 bp, Pichia angusta
  CDS (1)..(1530)
atggtcaaacttcaatcgtattaccctctcttccgccctgggaagccaacccaacatatattgacggtcacctgcatgttcgcatttatcctgtatgggtttgaacagggagcattagcaaatgtgcagaacgaggtcgtttttcaaagccaatttggccatccccaaggaaattatctcggaattatagttgcgatctacaacctaggaagtttttttggtagcatggcaaacatctggatcggtgataagttaggcagaaagcgggccatctggctgggattcaccttggtgaccattggagtcattctgcaatgcagctcgtacagtgtggttcaactcttcatcggaagattcatttctggcctcggaacaggatttgagacaagtacaacaccgatgtatcagtctgaagtatgccacgagaaccatagaggtggcctggtggccgcagaacctcaaggtgtcgcatttggtatcactgtgtcgtactggattggctacggttgcagcaaaagaacagatcaggtttcatggagacttccagtaggtattcagatgcttttcgcggtactcgggattgtgatgttattcttctgccctgaatctccaaggtggttaatgaaagttggaagaacacaagatgcaaggtactcactagcaacgattaatggtgtgccagaggatcatccgcggatttctgccatcattgacgacattctctatcttcaaaaaatcgaaggttcaggcgataaaatcacctggggtgatattcttatgggcagagatgccatgcacggccggtttagaatcatgcttactgtatttggtcagttctggaaccagttcggaggcatcaacttggtggtttactatgtgccaatggtgttagagaataacgttggactaagttcaaacctcgcgacaattctgggtggttgcattatgctgacctttttcgcaaccggatttatccctacgctgtttttggataagatgggaagacgttttgccatggcatccggttccgctggacaatgtatttcaatgcttctcgtcactatccttttgcgtgttggtaccaaagaatcgtcagtcgccgcaactgcattcttcttcacgtttattgggttctttggctatgctatgaactgcgttccatgggtttatgctgctgaggtgctgccattgcaacttcgtgccaaaggtaatgcaatcagtgtcgcaacgaattggatttgcaattttgtgattgcgatgatcactccgatcatgactcaaaatctggcttggaagacatacattgtcttcaccttgacgaacgctgttgcaactattcacttttttgtcttctatcctgaaacctccaagagaacccttgaagacattgagaacatattcctcgattctcataccatcttctacggtctccaagagattaagaggactccaacagaacgccttacggaaaagctcatcgatatcgagcacgttgaaagtgtagaagagggctcacccgagagcgactag

SEQ ID NO: 500 - protein, 509 aa, Pichia angusta
MVKLQSYYPLFRPGKPTQHILTVTCMFAFILYGFEQGALANVQNEVVFQSQFGHPQGNYLGIIVAIYNLGSFFGSMANIWIGDKLGRKRAIWLGFTLVTIGVILQCSSYSVVQLFIGRFISGLGTGFETSTTPMYQSEVCHENHRGGLVAAEPQGVAFGITVSYWIGYGCSKRTDQVSWRLPVGIQMLFAVLGIVMLFFCPESPRWLMKVGRTQDARYSLATINGVPEDHPRISAIIDDILYLQKIEGSGDKITWGDILMGRDAMHGRFRIMLTVFGQFWNQFGGINLVVYYVPMVLENNVGLSSNLATILGGCIMLTFFATGFIPTLFLDKMGRRFAMASGSAGQCISMLLVTILLRVGTKESSVAATAFFFTFIGFFGYAMNCVPWVYAAEVLPLQLRAKGNAISVATNWICNFVIAMITPIMTQNLAWKTYIVFTLTNAVATIHFFVFYPETSKRTLEDIENIFLDSHTIFYGLQEIKRTPTERLTEKLIDIEHVESVEEGSPESD

SEQ ID NO: 501 - DNA, 1864 bp, Spinacia oleracea
  CDS (61)..(1716)
ggcacgaggcgatcgctgcttaatcaatttcaactttcggtttagaaaaagagggggaaaatgcaggcgtcaacttttatggtcaaaggcaatttgggttttgaagttcagaaccgtagagtggctgggcttgctgggttgaaagggttaagctcaatccgttccaataatctaagttttgtgaatgttaatgacaataattataagtctaatccctgtaaattgagttgtgggtccctttcgatgggtgctggatttgcaagattgggtcttgatcatgtcatgaagtcctcacccaagtacagatcagtcaaggctcaagctgcttctggaggagatcttgaagatgccactcctgtcaaatatcaaggcaaatcttctgcatcagtgttgccgtatgttggtgttgcttgtttgggagctattttgtttggatatcaccttggtgtggtaaatggagctcttgactacctatctgcggatttagctattgctggcaatactgttttacaaggatgggttgtgagcatattacttgctggagcgactgtaggttcatttactggcggatctttggctgataagtttggaaggacaaagaccttccagttagatgcaattcctcttgcaataggagcttatctctgtgccacagcacaaaatgtacagataatgatgattggtcgtttactttgtggcattggaattggcatatcatctgccttagttccgttatacatttctgagatttcgccaactgaaattcgaggtgcacttggttctgtcaaccagctttttatatgcattggtattcttgcggctttggttgctggattgcctttagcaggaaaccctttgtggtggaggacaatgtttggtattgcaacagttccctctgttctcttggctcttgggatgggcttctgtccagaaagccctaggtggctttttcagcaaggaaaaattgttgaagcagaaaaggccgtagcagccctctatggaaaagaaagggttccggaggtgattaatgatttgagagcatctgttcaaggttcttctgaaccagaagctggctggtttgatctgttcagtagccgctacaggaaagtggtaagtgttggtgctgcacttttcttgttccagcaaatggcaggaatcaatgctgttgtatattactccacatctgtattccgaagtgctggaattgcatcagatgttgccgctagtgcccttgttggagcatcaaatgttattggcactgctgtcgcctcttctttaatggacaagcaaggaagaaagagcctactgatgacaagtttctcaggaatggctgcctcaatgttgttgctgtcactatcgttcacatggaaggctctagcaccttactcgggcacacttgccgttgtgggaactgttttatatgtcctttccttttcacttggcgctggtcctgttcctgctcttctacttccagagatcttcgcatccagaatccgagcaaaagcagtggctttgtcactgggaatgcattgggcgtcaaacttcgtaattggcctttatttcttaagtgtggtgaccaagtttggaatcagcaaagtgtatttggggttcgcgtcagtgtgtgtgcttgccgtgttgtacatagctggtaacgttgttgaaacaaaaggacgatcacttgaggaaatagagcttgctctaagtccagctgtttagtttggaggatacagtttttctgtttttttgatctatagagaattatgttaataattcccggatttaggagtttgatgctagttttcatgctcgttggcacattcatgtccagacagttgtactatcaatgtcagaaattcctcgtgcc

SEQ ID NO: 502 - protein, 551 aa, Spinacia oleracea
MQASTFMVKGNLGFEVQNRRVAGLAGLKGLSSIRSNNLSFVNVNDNNYKSNPCKLSCGSLSMGAGFARLGLDHVMKSSPKYRSVKAQAASGGDLEDATPVKYQGKSSASVLPYVGVACLGAILFGYHLGVVNGALDYLSADLAIAGNTVLQGWVVSILLAGATVGSFTGGSLADKFGRTKTFQLDAIPLAIGAYLCATAQNVQIMMIGRLLCGIGIGISSALVPLYISEISPTEIRGALGSVNQLFICIGILAALVAGLPLAGNPLWWRTMFGIATVPSVLLALGMGFCPESPRWLFQQGKIVEAEKAVAALYGKERVPEVINDLRASVQGSSEPEAGWFDLFSSRYRKVVSVGAALFLFQQMAGINAVVYYSTSVFRSAGIASDVAASALVGASNVIGTAVASSLMDKQGRKSLLMTSFSGMAASMLLLSLSFTWKALAPYSGTLAVVGTVLYVLSFSLGAGPVPALLLPEIFASRIRAKAVALSLGMHWASNFVIGLYFLSVVTKFGISKVYLGFASVCVLAVLYIAGNVVETKGRSLEEIELALSPAV

SEQ ID NO: 503 - DNA, 1822 bp, Arabidopsis thaliana
  CDS (65)..(1684)
gttgttagtctactcattaatcctcacaactctctatctctctctcgccccattctctatcataatgacaggtgccacaccggaaaaccgaacggccccgtcgccaccaccggtgaaacatgtgccggagtcagttctgccggctaaaccaccaaagaggaacaattatgcattcgcgtgtgctatcttagcttccatgacttctatcctccttggttatgatataggagtgatgagtggagcaatgatttatataaagagagatttgaagattaatgatttacaaatcgggattctcgctggaagcctcaacatctattcacttataggatcttgcgccgccggaagaacctctgactggattggtcggcgttacactatcgtgttggctggagccatattcttcgccggagctatccttatgggattgtcccctaactacgctttcctcatgttcggaaggttcatcgccggtatcggcgtcggatatgctctcatgatcgcaccagtttataccgccgaagtctctccggcatcttcccgcggcttcctcaattccttccccgaggtgtttatcaacgccggaattatgctcgggtacgtatcaaatctggctttctcgaacttgccgttgaaggtaggatggagactgatgctcggaatcggagccgtaccttccgtgatactcgctatcggcgttctcgctatgccggaatctccacggtggctcgttatgcaaggccgtctcggtgatgccaagcgcgttctggacaaaacctctgattcccccaccgaagcaactctccgtctcgaagacatcaaacacgccgctggtattcccgccgattgccacgacgacgtcgttcaggtgtcgaggaggaacagtcatggagaaggagtttggagagagcttttaatccgaccaacaccagccgtgcgtcgtgttatgatcgccgcaatcggaatccatttcttccagcaagcttccggtatcgacgcggtggttctcttctcaccgcgaattttcaaaaccgccggactcaaaaccgatcaccaacagcttctagcgactgtagcagtaggagtagtgaagacatcattcatactagtcgccactttcttactcgacagaatcgggagaagaccattgcttctaaccagcgtaggaggaatggtactatctctagcagcgttagggacttctctaacgattatagaccagtcagagaagaaagtgatgtgggctgtggttgtagctatagctacggtgatgacttatgtagctacgttttcgataggagctggaccgataacttgggtttatagctcggagatattcccgttgaggttgagatcacagggctcgagtatgggtgtggtggtgaacagagtgactagtggtgtgatctcgatatcgtttcttccaatgtcgaaagcgatgactactggtggagcgttttacttgtttggagggattgcgactgtggcttgggttttcttttacactttcttgccggagacgcaagggaggatgcttgaggatatggatgagcttttcagtggtttcaggtggagagattccaagagtaagcctaagggtaaccccgagaagacggtaccgaatcccgaggttgagattggatcaaacaagcagtggaaggaaggagacacacaaagttcgtaggaaatttgatcagatatgtaatttgtatggtatgtgggtttaatgataaaacgaacaaattagcgtaacaaatttagtatgtgtgactgttttcgtaatgagagttgcaataatttaactaatataattactgagatg

SEQ ID NO: 504 - protein, 539 aa, Arabidopsis thaliana
MTGATPENRTAPSPPPVKHVPESVLPAKPPKRNNYAFACAILASMTSILLGYDIGVMSGAMIYIKRDLKINDLQIGILAGSLNIYSLIGSCAAGRTSDWIGRRYTIVLAGAIFFAGAILMGLSPNYAFLMFGRFIAGIGVGYALMIAPVYTAEVSPASSRGFLNSFPEVFINAGIMLGYVSNLAFSNLPLKVGWRLMLGIGAVPSVILAIGVLAMPESPRWLVMQGRLGDAKRVLDKTSDSPTEATLRLEDIKHAAGIPADCHDDVVQVSRRNSHGEGVWRELLIRPTPAVRRVMIAAIGIHFFQQASGIDAVVLFSPRIFKTAGLKTDHQQLLATVAVGVVKTSFILVATFLLDRIGRRPLLLTSVGGMVLSLAALGTSLTIIDQSEKKVMWAVVVAIATVMTYVATFSIGAGPITWVYSSEIFPLRLRSQGSSMGVVVNRVTSGVISISFLPMSKAMTTGGAFYLFGGIATVAWVFFYTFLPETQGRMLEDMDELFSGFRWRDSKSKPKGNPEKTVPNPEVEIGSNKQWKEGDTQSS

SEQ ID NO: 505 - DNA, 1653 bp, Pichia stipitis
  CDS (1)..(1653)
atgtcctcacaagatttaccctcgggtgctcaaaccccaatcgatggttcttccatcctcgaagataaagttgagcaaagttcgtcctcaaatagccaaagtgatttagcttccattccagcaacaggtatcaaagcctatctcttggtttgtttcttctgcatgttggttgcctttggtggcttcgtattcggtttcgataccggtacaatttccggtttccttaatatgtctgatttcctttccagatttggtcaagatggttctgaaggaaaatatttgtctgatatcagagtcggtttgattgtttccatttttaacattggttgtgcaattggtggtattttcctttctaagataggagatgtttacggtagaagaattggtatcatttcagctatggttgtatacgtcgtcggtattatcatccagatctcgtcccaagacaagtggtaccaacttacaattggacgtggagttacaggattagctgttggtactgtttcagtgttgtctccaatgttcattagtgaaagtgctccaaagcatttgagaggtactttggtatactgttaccaattatgtatcaccttaggtattttcattggttactgtgtcacttatggaaccaaagatttaaatgattcaagacaatggagagttcctttgggcttatgcttcctttgggctattttcttagttgtcggtatgttggctatgccagaatccccaagattcttaattgaaaagaagagaatcgaagaagccaagaagtcccttgcaagatccaacaagttatctccggaagatccaggtgtctacactgaacttcaattgattcaggctggtattgacagagaagctgctgcaggttctgcttcgtggatggaattgatcactggtaagccagctattttcagaagagttatcatgggaattatcttgcagtctttgcaacaattaactggtgtcaactatttcttctattacggaactacaatcttccaagctgttggtttgcaagattccttccagacttccatcatcttaggtacagtcaactttctttctacatttgttggtatttgggccattgaaagatttggaagaagacaatgtttgttagtcggttctgctggtatgttcgtttgtttcatcatttactccgttattggtacaactcatttgttcattgatggagtagtagataacgacaacacccgtcaactgtctggtaatgctatgatctttatcacttgtttgttcatcttcttctttgcctgtacatgggctggaggtgtttttaccatcatttccgaatcatatccattgagaatcagatccaaggcaatgtctattgctactgctgctaactggatgtggggcttcttgatttccttctgcactccattcattgttaatgccatcaacttcaagttcggctttgtgtttactggttgtttactcttttcgttcttctatgtctacttctttgtcagcgaaaccaaaggtttgtcgttggaagaagttgatgagttgtacgctgaaggtattgcaccatggaagtctggtgcatgggttcctccttctgcccaacaacaaatgcaaaactccacttatggtgccgaagcaaaagagcaagagcaagtttag

SEQ ID NO: 506 - protein, 550 aa, Pichia stipitis
MSSQDLPSGAQTPIDGSSILEDKVEQSSSSNSQSDLASIPATGIKAYLLVCFFCMLVAFGGFVFGFDTGTISGFLNMSDFLSRFGQDGSEGKYLSDIRVGLIVSIFNIGCAIGGIFLSKIGDVYGRRIGIISAMVVYVVGIIIQISSQDKWYQLTIGRGVTGLAVGTVSVLSPMFISESAPKHLRGTLVYCYQLCITLGIFIGYCVTYGTKDLNDSRQWRVPLGLCFLWAIFLVVGMLAMPESPRFLIEKKRIEEAKKSLARSNKLSPEDPGVYTELQLIQAGIDREAAAGSASWMELITGKPAIFRRVIMGIILQSLQQLTGVNYFFYYGTTIFQAVGLQDSFQTSIILGTVNFLSTFVGIWAIERFGRRQCLLVGSAGMFVCFIIYSVIGTTHLFIDGVVDNDNTRQLSGNAMIFITCLFIFFFACTWAGGVFTIISESYPLRIRSKAMSIATAANWMWGFLISFCTPFIVNAINFKFGFVFTGCLLFSFFYVYFFVSETKGLSLEEVDELYAEGIAPWKSGAWVPPSAQQQMQNSTYGAEAKEQEQV

SEQ ID NO: 507 - DNA, 2408 bp, Drosophila melanogaster
  CDS (316)..(1839)
agtcgcgctcccgactccaacgctgccgcaccgtaccgctttgattccaactcaatcccgcgtgcactgctggcggtgcgccgtttacaaacaattgtggtttagaattccgaactgctggggggatcgcaaactaagaatccacactcggtgtccgttgcacaacactgtttcggaacccgattacctgccttaccaccaattgctaacaattgttctaaccgtgttaacacgcacacatcgtaactgtgtgctccgagtgccttgggaagtgtttcctcaaaaagtggtgattaccaggcaaagtccactgttatggccaccaaaagccagccggcggaggctcaacaattgtacccgcagcccaacagagtggaactgctctcggcgcagacggatcccagccagaaaccgcgatggggcaacctcctgctgctggtggccctggcaaccacatttggcggcgccgtttccaccggctactgcataggcgttatcaacgccccctcgaagctgatgaaagtttggtgtaatcagaccctgcacgacacctacgggagtaacctcagcgcaggcggtctagatctcttgtggtcgtgcgtcgtttctgtgttcctggtcggaggcgccatcggttcgctgggcggagctggagcagccaataaatttggcaggaaagcatgctttcttatctgcggcgccctgttcaccgtgggagcggtgctattcttcttctgccgagcagccagctccgtggagatgctggtgatcggaaggtttgttgtgggccttgcctccggcctcgtgaccgccaccctgcccatgtacttgtccgaggtggctccaatggctctgcgcggcactctgggagtcttcattgccgtgggcgtgacggggggcgtggtagtggggcaggtctgcagtttggccaatgtcttcggtactgaggatctctggcactacgccctgactgcctacatgttccttatcctggtctgctacctgccatcatacctctttcccgagagtcccaagttcctgtatattgttaaaggaaatcgcgcagctgccaagcgggagcttcaacggctgcggggcaaggatgcggaggagcttatcgcccaagaaatggccgagatggaggcagagtctaatgccaaggtgcagacgagcagcttttgcgatgtgcttcgcgatcctcgtctcacattgcccctgatcattgtctgctgcttccatggtggtcagcagttgtcgggcattaatgcgatattttattactcggtcagcatcttcgaaaaggccggactgtccacagtggatgctcaatgggccaatttgggcgctggttgcctgaatctagctgtctctttgttgggaccttggctaatggccaagtgcaatagacgaaccttgatgatgttctcctgtgctctttgctccgtttttctgttcaccatagcctttgtgttgttttatattgaccaagttagctggtttgccattgcctgcatcgtctgcatcatgggttacatattcttctaccaattcgggctgggccccattccctactttattggcgcagaactgttcgaggtggctccccgctccgtggccatgtcgatgggcagcttggcctcgtggacgtgcaatttcataattggcatatcgttccccctgctgcagaacgcatggggcgccttcgtcttcctgcccttctccattacctgcgtgctgctcttcttgcttacgaaattctatctgccggaaacgcggggacgcgatccctcagaggtggctcccctcgtatcgaagggcttccgctccaaagtcaaataggacatagcccagtgggctcaacttccaattagccataagtagccggtggtttgtggtaatacggtttaacttcatgtgtgcagtgggtcgcttaatgattcgtccatgtcgtgtgccttttgtatgtgtcgacaataagccgaaatccacgttgttcagggataaattactcttactaaatgtaatttcccgcctagcctgtaagttcttttgtacaaaccaataaatgcgaaaattgatctaactttaagagtcaccctgtaagaaagctttgagcgctgcgtcctcttatcactgcacaagttcaattaaaacgccttgggacggaccgccaagtaatactctgttaattagatttattgttgaacaagagcgacgcggaatcactggatactcttccacggcgggtgcgttagttaattaagtgccaacgcttgaattgtttagcaataagtgcttagcatttggaaggcaaatatatcctgatctccctatatatatatgcctgtgggtaggttaataaaatgttgtattttccactacgaaagatctctgatcaattcgtaaga

SEQ ID NO: 508 - protein, 507 aa, Drosophila melanogaster
MATKSQPAEAQQLYPQPNRVELLSAQTDPSQKPRWGNLLLLVALATTFGGAVSTGYCIGVINAPSKLMKVWCNQTLHDTYGSNLSAGGLDLLWSCVVSVFLVGGAIGSLGGAGAANKFGRKACFLICGALFTVGAVLFFFCRAASSVEMLVIGRFVVGLASGLVTATLPMYLSEVAPMALRGTLGVFIAVGVTGGVVVGQVCSLANVFGTEDLWHYALTAYMFLILVCYLPSYLFPESPKFLYIVKGNRAAAKRELQRLRGKDAEELIAQEMAEMEAESNAKVQTSSFCDVLRDPRLTLPLIIVCCFHGGQQLSGINAIFYYSVSIFEKAGLSTVDAQWANLGAGCLNLAVSLLGPWLMAKCNRRTLMMFSCALCSVFLFTIAFVLFYIDQVSWFAIACIVCIMGYIFFYQFGLGPIPYFIGAELFEVAPRSVAMSMGSLASWTCNFIIGISFPLLQNAWGAFVFLPFSITCVLLFLLTKFYLPETRGRDPSEVAPLVSKGFRSKVK

SEQ ID NO: 509 - DNA, 1506 bp, Oryza sativa
  CDS (1)..(1506)
atgagcttccgcggcgaggagagcggcggcgaggatggggggcggacggcgtcggcgtcggacctgcggaagccgttcctccacacggggagctggtacaagatgtcgtcggcgggcggcggcggcgggatggggtcgcgcctcggctcctccgcctactccctccgcgactcctccgtctccgccgtcctctgcaccctcatcgtcgccctcggccccatccagttcggcttcacctgcggcttctcctcgcccacccaggacgccatcatctccgacctcggcctcaccctctccgagttctcgctgttcgggtcgctgtcgaacgtcggggcaatggtgggcgccatcgccagcggccagatcgccgagtacatcggccgcaaggggtctctcatgatcgcggcaattcctaacattattgggtggctcgcaatatcttttgcaaaggactcatcctttttgtttatgggccgattgctggaaggatttggggtcggcgtgatatcctatgtggtgccagtttatatagcagaaattgctccacaaacaatgagaggagctcttggttcagtcaatcagctttctgttactattggcatattgcttgcctacttgttaggcatgtttgttccctggagaattctctccgttctcggtattttaccatgttcaattctgatacctggattgttctttatccctgaatcaccaaggtggctggcaaaaatgggaaagatggaggattttgaatcctcgctgcaagtattgcgaggatttgaaacagacatcgctgtagaagtaaatgaaataaagagatcagttcaatcatcacggaggaggacgacaatacgatttgcagatatcaagcagaagagatatagtgtacctctaatggttggaattggtctccttgtactgcagcagttaagtggtgtgaatggcattctattttatgctgctagtatcttcaaagccgccggtcttacgaatagtaatctagcaacatttggtctgggggttgttcaggtggttgctactggagtgacaacttggttgactgacaaagctggtcgacgactcctcctcattatctctactacagggatgaccattactcttgttgttgtttctgtgtcattttttgtgaaggacaacataactaatggttctcatttatactctgtaatgagtatgctttcgctggtcgggcttgtggcatttgtgatttcattttctcttggtttgggagccataccatggatcataatgtctgagattcttcctgtaaatatcaagagccttgctggaagcgttgcaacccttgcaaactggttgacggcttggctcattacgatgacagcaagcttgatgttaagctggagcaatggaggaacatttgctatctatgctgctgtgtgtgccgggaccctcgttttcgtatgcctgtgggtgccggagactaaaggaagaacacttgaggaaattgcattttctttccggtga

SEQ ID NO: 510 - protein, 501 aa, Oryza sativa
MSFRGEESGGEDGGRTASASDLRKPFLHTGSWYKMSSAGGGGGMGSRLGSSAYSLRDSSVSAVLCTLIVALGPIQFGFTCGFSSPTQDAIISDLGLTLSEFSLFGSLSNVGAMVGAIASGQIAEYIGRKGSLMIAAIPNIIGWLAISFAKDSSFLFMGRLLEGFGVGVISYVVPVYIAEIAPQTMRGALGSVNQLSVTIGILLAYLLGMFVPWRILSVLGILPCSILIPGLFFIPESPRWLAKMGKMEDFESSLQVLRGFETDIAVEVNEIKRSVQSSRRRTTIRFADIKQKRYSVPLMVGIGLLVLQQLSGVNGILFYAASIFKAAGLTNSNLATFGLGVVQVVATGVTTWLTDKAGRRLLLIISTTGMTITLVVVSVSFFVKDNITNGSHLYSVMSMLSLVGLVAFVISFSLGLGAIPWIIMSEILPVNIKSLAGSVATLANWLTAWLITMTASLMLSWSNGGTFAIYAAVCAGTLVFVCLWVPETKGRTLEEIAFSFR

SEQ ID NO: 511 - DNA, 1767 bp, Kluyveromyces lactis
  CDS (1)..(1767)
atgcttcataagattgataacagaaagttctttattcacttcaaacaaaacagtaaagctgaattaattcaatacaactattacaacaagggacagaatcacttcacaatggattcttcatcgtccgtgcttcagaaagacacaaaacaggtcgatattgaacatagggaagaagcaagctccaacgatcagtttgtagatcaaaatgccttattagatagcttccttggtgacgtcgatgtgctgcgagcgctgatgcgactggaaaaaagtatgtctctcttagaaaggttgcgccaagtacatccgaaagctgtaggttggtccttaatgggttcaaccggcttaatcatggaagggtacgacactgctttcattaacaatctgtttgctcttccaatttttcgaaccactttcggtgaatacaatcaagcgaatgacatttgggagattccttccaaatggcaaattggtttggggatgtgtgttgcctgtggtgagattattggtttgcagataactggtatattcgcagatcgttacggttacaggcttgtgttgattgctggcttggttcttttgattgctttcaattttattctctactttgcaaacagtttgactatgattgctataggccaaattttaagtggtatcccatggggctcattccaaacactctgcgtttcatatgctagtgaggtctgtccattggttttgagatactatttgacaacatacatcaatttatgttggcttatcgggcaagtgattgccgctggagttttgaaggcatgtcaggaacatcttgccaatgatgagctaggttggagacttccatttgcgttacagtggatatggccggttcctttgattgtaggtatttaccttgctccagaatctccttggtggttggttagaaagggcaggatcgatcaagccaaacgatccgtcacaagaattctaaccctgcccacttctgaaaaggacaagctaactgacataatgatcacaaaaatgagaatgactgtcgagaaagaaaaccgtcttgcttccgaatcaagttcttatatggactgtttcaagggcattgatgcgagaagaaccaggataacgtgtctcacatgggtcatgcaaaatttaacgggatccgctttgatgggatactccacctatttctatgaaaaagccgggttggacacttctgcagccttcactttttccatcattcaatacgtgattggtattgttggtaccttaacatcatggttcctatcttccagagctggtcgcttcacgattctcttttggggtgtctttttccagacgatagttatgttcattactggtggcctcggattcagcagctctgaaggtgccagttggggtgctggttccatgttgctgatctacaacttcttttacaactccaccttaggtcctgttgtttactgtgtggtgtcagaaattcctagtgacagattgagaactaaaactgtagttctagcacgtaactcctacaacttgatagctattgtaaattctattttgacaccgtatatgttaaactccgaccaatggaactggggtgcaaagacaggtttgttctggggtggattagctgccatctcattagtttgggcttacttcgatctcccagaaactaagggcagaacatttgcagagcttgatgagttattccatcaaagagttccagcaaggaagtttaacagtacacatgtggagccttctctcgtgagacaataa

SEQ ID NO: 512 - protein, 588 aa, Kluyveromyces lactis
MLHKIDNRKFFIHFKQNSKAELIQYNYYNKGQNHFTMDSSSSVLQKDTKQVDIEHREEASSNDQFVDQNALLDSFLGDVDVLRALMRLEKSMSLLERLRQVHPKAVGWSLMGSTGLIMEGYDTAFINNLFALPIFRTTFGEYNQANDIWEIPSKWQIGLGMCVACGEIIGLQITGIFADRYGYRLVLIAGLVLLIAFNFILYFANSLTMIAIGQILSGIPWGSFQTLCVSYASEVCPLVLRYYLTTYINLCWLIGQVIAAGVLKACQEHLANDELGWRLPFALQWIWPVPLIVGIYLAPESPWWLVRKGRIDQAKRSVTRILTLPTSEKDKLTDIMITKMRMTVEKENRLASESSSYMDCFKGIDARRTRITCLTWVMQNLTGSALMGYSTYFYEKAGLDTSAAFTFSIIQYVIGIVGTLTSWFLSSRAGRFTILFWGVFFQTIVMFITGGLGFSSSEGASWGAGSMLLIYNFFYNSTLGPVVYCVVSEIPSDRLRTKTVVLARNSYNLIAIVNSILTPYMLNSDQWNWGAKTGLFWGGLAAISLVWAYFDLPETKGRTFAELDELFHQRVPARKFNSTHVEPSLVRQ

SEQ ID NO: 513 - DNA, 1557 bp, Schizosaccharomyces pombe
  CDS (1)..(1557)
atgcgcgattttcaatcacggttcgctgatcggtataatcagattacaaactcatactcttattcttcatcacgacaaggattaattaccggtatggttaatgtgggttctttcttcggttgtcttctatcttcaccagtagctgataaaattggtaagcgtctctccattattgtgtggaccacagtttatcttattggtattattattcaagtaacaacagttccctcttgggtacagatcttggtagccaaaatatggacaggtctttcgataggagcgttgtctgttatcacaccaggttatcaatcagaagttgcacctgctataatgagaggtgctatcgttacaacttatcagttatttattacgcttggtattttcatcgccgcttgcatcaatatggggacgcacaaatattctcatggaaccactgctcagtggcgtatatccattggaattaacttactctggggtatcattactttagtaggtattatatttctaccggaatcgccccgctatctaattgccattggtaaagatgatgaggctttgaagataatgtgttacaacaatgaccttccgcttgaacacgaaatcattcaaacagagtatcataccattaaatctgattgtgacgcagagttagctggtggtccggcaagatggccagaaattttcaatgcaaatattcgctatcgtacattccttggaatggctgttatgatgttccaacaacttactggtgctaattattatttctactacggtactcaggtattccgcggtaccggtatggattcaccctatttggctgccttaattccggatgctgtcaattgtggttgtacttttggagccatttttgtgcttgaattctttggacgacgttctcctttgattgttggtggtatatggcaatatatttgcttcttcatttatgcagcagttggtgatcgtgcactatatcacaaaaatggaacttcaaaccaccgtgcgggtgctgtaatgattgtgttctcatgccttttcattttttcattttctcaaacttgggcccctgccgcatacgttattgtgggtgagtcatatcctgttcgttatcgttccaaatgtgcagctgtcgctacttcagctaactggttttggaattttttgatttctttctttactcctttcatcacaaattctattggttttaagtatggttatatttttgcttcatgtaatttaacaggtgctgcaattatttttctgtttgtccatgagaccaagggtcgtacattggaagagattaatactatgtacgcatctaacttgaaaccatggatgcctcatccagagggttacagagagttcggtcgtgagcaaaacaacgcaactttgaagtctcacatcggactcaatggagaaacaaccgaacttattgaaaataccgataatcaaggagacagtgggtcattccaaacatcaaccccggatgattctagacctgaacaaaatcaagcttcagcaacatatatacgtcctgataaacgggagcctcgtctttaa

SEQ ID NO: 514 - protein, 518 aa, Schizosaccharomyces pombe
MRDFQSRFADRYNQITNSYSYSSSRQGLITGMVNVGSFFGCLLSSPVADKIGKRLSIIVWTTVYLIGIIIQVTTVPSWVQILVAKIWTGLSIGALSVITPGYQSEVAPAIMRGAIVTTYQLFITLGIFIAACINMGTHKYSHGTTAQWRISIGINLLWGIITLVGIIFLPESPRYLIAIGKDDEALKIMCYNNDLPLEHEIIQTEYHTIKSDCDAELAGGPARWPEIFNANIRYRTFLGMAVMMFQQLTGANYYFYYGTQVFRGTGMDSPYLAALIPDAVNCGCTFGAIFVLEFFGRRSPLIVGGIWQYICFFIYAAVGDRALYHKNGTSNHRAGAVMIVFSCLFIFSFSQTWAPAAYVIVGESYPVRYRSKCAAVATSANWFWNFLISFFTPFITNSIGFKYGYIFASCNLTGAAIIFLFVHETKGRTLEEINTMYASNLKPWMPHPEGYREFGREQNNATLKSHIGLNGETTELIENTDNQGDSGSFQTSTPDDSRPEQNQASATYIRPDKREPRL

SEQ ID NO: 515 - DNA, 2468 bp, Mus musculus
  CDS (34)..(1605)
cctggattaagaggacaattccacacacacacaatgtcagaagacaagatcaccggaaccttggctttcactgtcttcactgctgtactgagttccttccagttcggctatgacatcggtgtgatcaatgcacctcaagaggtaataatatcccattatcgacatgttttgggtgttccactggatgaccggaaagctgccattaactatgacgtcaatggcacagacaccccacttacagtcacaccagcatacacaacaccagctccctgggatgaagaggagactgaaggatctgctcacatagtcactatgctctggtctctgtctgtgtccagctttgcagtgggcggaatggtcgcctcattctttggtgggtggctcggggacaaacttggaaggatcaaagcaatgttggctgcaaacagcctctcattgactggagccctcttgatgggatgttccaaatttggaccggcacacgccctcatcattgctggacgaagtgtatcaggactgtattgtgggctaatttcaggactggttccaatgtacattggagagatcgctccaaccacactcaggggtgccctgggtactcttcaccaactggcccttgtcacaggcattcttattagtcagattgctggcctcagctttattctgggcaatcaggatcattggcacatcctacttggcctatctgctgtgccagctcttctgcagtgtctgctactgctcttctgtccagaaagccccagatacctttatataaagttggaagaggaagtcagggcaaagaaaagcttgaagagactaagaggaactgaggatgtcaccaaagatattaatgagatgaagaaagaaaaggaagaggcatcgactgagcagaaggtctccgtgatccagctcttcacggatgccaattaccgacagcccatcctcgtggcgctgatgctgcacatggcccagcagttctcaggaatcaatgggatattttactattcaaccagcatttttcagacagctggcatcagccagcctgtgtatgcaaccattggtgttggggccatcaacatgatcttcacggctgtctctgtgctgcttgtggagaaggcagggcggcggaccctgttcctaaccgggatgattggcatgtttttctgcaccatcttcatgtcggtgggacttgtgctgctggataaattcgcctggatgagttacgtgagcatgacggccatcttcctctttgtcagtttctttgagattgggccaggtccaatcccttggttcatggttgctgaatttttcagccaaggaccccgtcctacggctctggcactggctgccttcagcaactgggtctgcaattttgtcatcgccctctgcttccagtacattgcggacttcctcgggccttacgtgttcttcctcttcgctggggtggtcctggtcttcaccctgtttacattctttaaagttccagaaaccaaaggaaagtcttttgaggaaatcgctgcagaattccggaagaagagtggttcggccccaccacgcaaagctgctgtacaaatggaattcctggcgtcttcagagagtgtgtgaggatgacctgcctaaaaccgaggaaccgaccaggaggaaccacgcgctccctcttaaaccgattccttcctcggtgtgcgactacacccaggagtatcgtttattcatttggaagaatttttacagactccgattagaaatatcaacatatattattaccaaagaaagtatttttttaacttaaagaatctatttttgatggtaacactcttcagtaaaccagaggctattttgctactctacagggaagtgtgtaataaccttcctagccctgttctactgaaattgaagagctttcaacatatcgctgctttttaaagcacgtgactaagaaatctgcagctacaactgctatctagatatttaattacaccggaatgttcttagccccagatcagaagctaaaggacatacggctggtggcagcaaggctcacattcaaactgactttctgttacctttcctcggcttctctcacttggattagacttcgggttttgcgtacagccattttctgcatttttatatagaattcctgagtatgttaaactgtatttgtaatgagaaactcttttttatagctaccaaaagcttcctacagtgagagaaaacattttagtttctttgatgtattttgcaaggttaaatgcttgagttgttcttagctgtagagctcagattatcagttagttatattagcatccaaagcatgttagtttctcaccacttcagtctttgtgttgtacttatacttgtttttttaattgcccatggcacacacttaaaccattaggagtcaggcattttgcatattgcctaaaaatctaataaactgggtcaatcacagggaaaaaaaaaaaaaa

SEQ ID NO: 516 - protein, 523 aa, Mus musculus
MSEDKITGTLAFTVFTAVLSSFQFGYDIGVINAPQEVIISHYRHVLGVPLDDRKAAINYDVNGTDTPLTVTPAYTTPAPWDEEETEGSAHIVTMLWSLSVSSFAVGGMVASFFGGWLGDKLGRIKAMLAANSLSLTGALLMGCSKFGPAHALIIAGRSVSGLYCGLISGLVPMYIGEIAPTTLRGALGTLHQLALVTGILISQIAGLSFILGNQDHWHILLGLSAVPALLQCLLLLFCPESPRYLYIKLEEEVRAKKSLKRLRGTEDVTKDINEMKKEKEEASTEQKVSVIQLFTDANYRQPILVALMLHMAQQFSGINGIFYYSTSIFQTAGISQPVYATIGVGAINMIFTAVSVLLVEKAGRRTLFLTGMIGMFFCTIFMSVGLVLLDKFAWMSYVSMTAIFLFVSFFEIGPGPIPWFMVAEFFSQGPRPTALALAAFSNWVCNFVIALCFQYIADFLGPYVFFLFAGVVLVFTLFTFFKVPETKGKSFEEIAAEFRKKSGSAPPRKAAVQMEFLASSESV

SEQ ID NO: 517 - DNA, 2355 bp, Canis familiaris
  CDS (201)..(1688)
ctaaatagaaagctatttatttcctatagaaaaacacaagaaaggaagggaggaggagatgtgctgcggagctggggaccagtagaaaaacttgctgccaagaaggacattttggaggttttgttcactggaaggcggtgtctctgggatcccaactcccagatctttattgaagattggaatagaattaaattagggccatggggacacagaaggtcacggtgtctctgatctttgccctctccattgctacaataggctctttccagtttggctataataccggagtcatcaatgctcctgaaacgataataaaggactttctcaattacaccttggaagagaaatcggaaaaccttcccactgaagtgttactcacttccctctggtccttgtctgtggccatcttctctgttggtggtatgattggctccttctctgttggactctttgtcaaccgctttggcaggcgcaattcaatgcttatggtcaacctcttggctgtcgctggtggctgccttatggggttctgcaaaatagcgcagtcggttgaaatgctgatcctgggccgattgattattggcctcttctgcggcctctgcacaggttttgtgcccatgtacattggagagatctctcccactgccctacggggcgcgttcggcactcttaaccagctgggcatcgtcatcgggatcctggtagctcagatcttcggtctgaaagtcatcatgggaactgaagagctttggcccctgctcttgggcttcaccatcattccagctgtcctgcaaagcgccgcccttccattttgccccgagagccctagatttttgctcattaacagaaaggaagaggagaatgctaaggagatcctccaacgattgtggggcacccaggatgtgagtcaggacatccaggagatgaaagatgagagtgctaggatggcacaagaaaagcaagtcactgtgctggagctcttcagatcgcgcagctaccggcaacccattatcatttccatcatgctccaactctcccagcagctctctggaatcaatgctgtgttctattactcaacaggaatcttcaaagatgcaggtgttgaggagccaatctatgccaccattggtgcaggggtggtcaatactatcttcactgttgtctctctgtttctggtggaaagggcagggaggagaactctacatatgattggccttggagggatggctgtttgttccatccttatgaccatctcgttgttattaaaggataactataattggatgagctttgtttgtattggggctatcttggtcttcgtagccttctttgaaattggcccaggccccatcccctggtttattgtggccgaactcttcagccagggaccccgcccagctgcaatggcagtggctggttgttccaactggacctccaattttctggttgggctgctctttccttctgctgcattctacttaggagcctatgtatttatcattttcactggcttcctcatcgtcttcttggtcttcaccttcttcaaagtccctgagacccgtggcaggacttttgaggaaatcacccgagccttcgaagggcaggggcaggatgccaacagagcggagaagggccccattgtggagatgaacagcatgcagccggtgaaggagaccgccactgtctaagccatgcctccttcccgcctccctcccaacatggaaaaaccacctctcccggatgagggagaaatcgaatcaggttgtaaccaggactgtttactgaatagctagctacttgattcctttctcttccccacacactccatgagcactcagaagaacccaatgctggagttagttgtatcttcaatgagtttgaacgttcattctggacattctcttctgtttagaagagaccaagtgaacctaccttcatttcaggaggaactggccacttgccatatgacaacattgtcagctcttcctacctggggttctggtaggtcctcaccgggccaataggggaataagagtgaggtgcagcaccccccccacacacacacacacacacacacacaccagacctcccaggaagcatatctacataagtgtggagggctgagagggattaaatagaagcacccctcctcgcttccatacagctctgcagagcaaattaacttgagtttattatcttatcttctggttttattgcataaatatttatttttttaagtgtaaagtaattttaccaaataatgcaaacataaggaaattgaggttagagttagagggaggtgcttaaagagaggtttatagggtagaagatttgatacgggagaggtcaaggtgc

SEQ ID NO: 518 - protein, 495 aa, Canis familiaris
MGTQKVTVSLIFALSIATIGSFQFGYNTGVINAPETIIKDFLNYTLEEKSENLPTEVLLTSLWSLSVAIFSVGGMIGSFSVGLFVNRFGRRNSMLMVNLLAVAGGCLMGFCKIAQSVEMLILGRLIIGLFCGLCTGFVPMYIGEISPTALRGAFGTLNQLGIVIGILVAQIFGLKVIMGTEELWPLLLGFTIIPAVLQSAALPFCPESPRFLLINRKEEENAKEILQRLWGTQDVSQDIQEMKDESARMAQEKQVTVLELFRSRSYRQPIIISIMLQLSQQLSGINAVFYYSTGIFKDAGVEEPIYATIGAGVVNTIFTVVSLFLVERAGRRTLHMIGLGGMAVCSILMTISLLLKDNYNWMSFVCIGAILVFVAFFEIGPGPIPWFIVAELFSQGPRPAAMAVAGCSNWTSNFLVGLLFPSAAFYLGAYVFIIFTGFLIVFLVFTFFKVPETRGRTFEEITRAFEGQGQDANRAEKGPIVEMNSMQPVKETATV

SEQ ID NO: 519 - DNA, 1485 bp, Ovis aries
  CDS (1)..(1485)
atggggaccacgaaggtcaccacacctctgatcttcgccatctcgattgctaccataggctctttccagtttggctacaacactggagtcatcaatgctcctgaggcgatcataaaagactttctcaattacactttggaagaacggtcagaaacacccccgtccagcgtgctcctcacatccctgtggtccttgtctgtggccatcttctccgtgggtggtatgattggttccttctccgtcggactctttgtcaaccgatttggcaggcgcaactcaatgcttattgtcaacctgttggccatagctggcggctgccttatgggattctgcaaaatagcagagtcagttgaaatgctgattttgggccgactgattatcggcctcttctgcggactctgcacaggattcgtgcctatgtacattggagagatctcccctactgccctgcggggtgcctttggtactctcaaccagctgggcatcgttatcggaattctggtggcccagatctttggtctaaaagtcatcttggggactgaagatctgtggcctctactgctgggcttcaccatcttaccagccatcatccagtgcgctgcccttccattttgccctgaaagtcctagattcttgctcattaacagaaaggaggaggagaaggcaaaggagatccttcagagactctggggcaccgaggacgtggctcaggacatccaggagatgaaggacgagagtatgcggatgtcgcaggagaagcaagtcacagtgctggagctcttccgtgcccccaactaccggcagcccatcatcatctccatcatgctccagctctcccagcagctctctgggatcaacgcggtgttctactactcgacaggaatcttcaaagatgcgggtgtccaggagccggtctacgccactatcggtgcaggtgtggtcaacaccatcttcactgtggtgtctgtgttcttggtggaaagggctgggaggaggactctacacctgattggccttggagggatggctttttgttccatcctcatgacaatttctttgttactaaaggataattacagctggatgagctttatctgtattggggccatcctggtctttgtggccttctttgaaattggcccaggccccattccctggtttattgtggctgaactctttggccagggaccccgcccagcagccatggcagtggccggttgttccaactggacctccaactttttggttggactgctcttcccctcagccacgttctacttaggtgcctacgttttcatcgtcttcactgtcttcctcgttatcttctgggtcttcaccttcttcaaagttcctgagacccgtggcaggacttttgaggaaattacacgagcctttgaagggcaggtgcagacaggaacccgcggtgaaaaaggccccatcatggaaatgaacagcatccagcccacgaaggacaccaatgcctaa

SEQ ID NO: 520 - protein, 494 aa, Ovis aries
MGTTKVTTPLIFAISIATIGSFQFGYNTGVINAPEAIIKDFLNYTLEERSETPPSSVLLTSLWSLSVAIFSVGGMIGSFSVGLFVNRFGRRNSMLIVNLLAIAGGCLMGFCKIAESVEMLILGRLIIGLFCGLCTGFVPMYIGEISPTALRGAFGTLNQLGIVIGILVAQIFGLKVILGTEDLWPLLLGFTILPAIIQCAALPFCPESPRFLLINRKEEEKAKEILQRLWGTEDVAQDIQEMKDESMRMSQEKQVTVLELFRAPNYRQPIIISIMLQLSQQLSGINAVFYYSTGIFKDAGVQEPVYATIGAGVVNTIFTVVSVFLVERAGRRTLHLIGLGGMAFCSILMTISLLLKDNYSWMSFICIGAILVFVAFFEIGPGPIPWFIVAELFGQGPRPAAMAVAGCSNWTSNFLVGLLFPSATFYLGAYVFIVFTVFLVIFWVFTFFKVPETRGRTFEEITRAFEGQVQTGTRGEKGPIMEMNSIQPTKDTNA

SEQ ID NO: 521 - DNA, 1638 bp, Candida albicans
  CDS (1)..(1638)
atgtcgtccaagatcgaaagaatcttttctggacctgctttaaaaatcaatacttatttggacaagcttccaaaaatttacaatgttttcttcatcgctagtatatccaccattgctggtatgatgtttggttttgatatttcttcaatgtctgcctttattggtgctgaacattatatgaggtatttcaattccccaggatcggatatccaagggttcattacttcatccatggctttgggttctttctttggttctattgcctcctcatttgtttctgaaccctttggtagaagattatcattattgacttgtgctttcttctggatggtcggtgctgctattcaatcatcagttcaaaatcgtgctcaattgattattggtagaatcatttctggtattggtgttggtttcggttctgctgttgctccagtttatggtgctgaattggctccaagaaaaattagaggtcttatcggtggtatgttccaattctttgtcaccttgggtatcatgatcatgttttacttatccttcggattgggccacattaatggtgttgcttcattcagaattgcttggggacttcaaattgtccctggtctttgtttgttcttgggttgtttctttattccagaatctcctcgttggttggctaaacaaggtcaatgggaagctgctgaagaaattgttgccaagatccaagctcatggtgatcgtgaaaatcctgatgttttgattgaaatttctgaaatcaaagatcaattattattggaggagtccagtaaacaaattggatatgctactttattcaccaaaaaatacattcaaagaaccttcactgctattttcgctcaaatttggcaacaattgactggtatgaacgttatgatgtactatatcgtttatattttccaaatggctggttattctggtaacagtaacttggttgcttcatccattcaatatgttatcaacacttgtgtcaccgtgcctgcattatattttattgataaagtaggtagaagaccattattgattggtggtgccactatgatgatggctttccaattcggtcttgctggtattttgggtcaatactcaattccttggccagatagtggtaacgactcagtcaacattagaattccagaagacaataagtctgcctccaaaggtgccattgcttgttgctacttgttcgttgcttcctttgcctttacttggggggtcggtatttgggtctactgtgctgaaatatggggtgataacagagttgctcaacgtggtaatgccatctccacttctgccaattggattttgaatttcgctattgccatgtataccccaactggtttcaagaatattagctggaaaacatatatcatttatggtgtcttctgtttcgctatggctacccatgtctactttggattcccagaaaccaagggtaaaagattggaagaaattggtcaaatgtgggaagaacgtgttcctgcttggagatcaagatcttggcaaccaaccgttcctattgcttccgatgccgaattggcaagaaagatggaagttgaacacgaagaagataaattgatgaatgaagactctaactccgaatccagagaaaatcaagcctaa

SEQ ID NO: 522 - protein, 545 aa, Candida albicans
MSSKIERIFSGPALKINTYLDKLPKIYNVFFIASISTIAGMMFGFDISSMSAFIGAEHYMRYFNSPGSDIQGFITSSMALGSFFGSIASSFVSEPFGRRLSLLTCAFFWMVGAAIQSSVQNRAQLIIGRIISGIGVGFGSAVAPVYGAELAPRKIRGLIGGMFQFFVTLGIMIMFYLSFGLGHINGVASFRIAWGLQIVPGLCLFLGCFFIPESPRWLAKQGQWEAAEEIVAKIQAHGDRENPDVLIEISEIKDQLLLEESSKQIGYATLFTKKYIQRTFTAIFAQIWQQLTGMNVMMYYIVYIFQMAGYSGNSNLVASSIQYVINTCVTVPALYFIDKVGRRPLLIGGATMMMAFQFGLAGILGQYSIPWPDSGNDSVNIRIPEDNKSASKGAIACCYLFVASFAFTWGVGIWVYCAEIWGDNRVAQRGNAISTSANWILNFAIAMYTPTGFKNISWKTYIIYGVFCFAMATHVYFGFPETKGKRLEEIGQMWEERVPAWRSRSWQPTVPIASDAELARKMEVEHEEDKLMNEDSNSESRENQA

SEQ ID NO: 523 - DNA, 2425 bp, Kluyveromyces lactis
  CDS (539)..(2194)
gaattccgagcagtgagtgagaacggtaatgttgaggattgtagtgtttttcttttattgatagaagatgctcatcgcatcgtcgtgttccgtgaaagctctccatgttagaaagtccaccgttgccagttggcaggctgtatcctccccgctcttccttggtgccggattttctttagctccttacacaatgacgctttgggacaatgtttcgttattccatcgacgatgttgccccagactaattaatcaacgggctaagaaattagcgtaactgatgtagaatgatcagagggtttttttttctttcttagttctatttacactattttccagcttgaatggtttaagatttaatccgttgtttctgatataaaagccaggtaataaaccttctaacttgcctcttcttggtgtcgattcgaaaacacttttcggttgtttgtttctgtttttttccctttcgattcaataacccaattaaaaaacgtattataacaaactataacaaacatcaactttagctaataacaacaaaatgtcattgaaaaattggcttttgctacgtgatatccaatacgagggaacgttttataaaaagttcccccatgtctacaacatttacgtcatcggtttcatagcatgtatctccggtcttatgttcggttttgatatcgcatcgatgtcttctatgattggtaccgatgtttacaaggactatttcagtaatcctgactctttgacttacggtggtattactgcttctatggcaggtggttcattcttgggttctttgatctctccaaacttttctgatgcttttggtagaaaagtctctttgcatatatgtgctgctctatggattattggtgccattctacaatgtgctgctcaagaccaagccatgttgatcgtgggtcgtgttatttctggtatgggtattggtttcggttcctctgctgcccctgtgtactgttctgaaatctccccaccaaagattagaggtaccatttctggtcttttccaattctctgttaccgttggtatcatggtcctattctacatcggttacggttgtcacttcattgatggcgctgctgcctttagaatcacttgggggttgcaaatggttccaggtttgatcttaatggtcggtgtattctttatcccggaatccccacgttggttggctaaccatgatcgttgggaagaaacttctctcatcgttgctaacatcgttgctaacggtgacgttaacaacgaacaagttcgtttccaattggaagaaattaaggaacaagtcatcatcgattctgctgccaagaacttcggttacaaagatttattcagaaagaagactttaccaaaaacaatcgttggtgtttctgctcaaatgtggcaacaactatgtggtatgaatgttatgatgtactacattgtctacattttcaacatggctggttacactggtaacactaacttggttgcctcgtccattcaatatgtgctaaatgttgttatgactatcccagcattgttcttgattgataaatttggtagaagacctgtgttgatcattggtggtatcttcatgttcacttggttgttctctgtcgctggtatcttggctacttactccgttccagccccaggcggtgtcaacggtgatgatactgttactattcaaattccaagtgaaaacacttccgctgctaacggtgtcattgcatcctcatacttgttcgtctgtttcttcgctccaacttggggtattggtatctggatttactgttctgaaattttcaacaacatggaaagagctaagggttctgccctttctgcagcaactaactgggccttcaactttgccttggctatgttcgttccatctgccttcaaaaacatttcctggaagacctacatcatctttggtgtcttctctgttgctttgactattcaaactttcttcatgttcccagaaactaaggggaaaactttagaagaaatcgaccaaatgtgggttgataatattccagcatggaggactgctaattacattccacaactacctatcgttaaagatgaagaaggtaacaagttgggcttgttgggtaacccacaacatttggaagatgttcattctaatgaaaagggtctacttgaccgttccgactcagcaagcaactccaattaaacagtgaccagctatgacaaataaataaatttttcgaactaattactagcgcatctttctctaatgacttaagaaatgaaatgaattatttcaaacaaatataacaatatcaatccataacatggttttatgctcttactatcttctgtcttttttttctttgtgtggcagacgacaaactcagtggctctacatgactataaatatagcacgaggctcacgtcaaagctt

SEQ ID NO: 524 - protein, 551 aa, Kluyveromyces lactis
MSLKNWLLLRDIQYEGTFYKKFPHVYNIYVIGFIACISGLMFGFDIASMSSMIGTDVYKDYFSNPDSLTYGGITASMAGGSFLGSLISPNFSDAFGRKVSLHICAALWIIGAILQCAAQDQAMLIVGRVISGMGIGFGSSAAPVYCSEISPPKIRGTISGLFQFSVTVGIMVLFYIGYGCHFIDGAAAFRITWGLQMVPGLILMVGVFFIPESPRWLANHDRWEETSLIVANIVANGDVNNEQVRFQLEEIKEQVIIDSAAKNFGYKDLFRKKTLPKTIVGVSAQMWQQLCGMNVMMYYIVYIFNMAGYTGNTNLVASSIQYVLNVVMTIPALFLIDKFGRRPVLIIGGIFMFTWLFSVAGILATYSVPAPGGVNGDDTVTIQIPSENTSAANGVIASSYLFVCFFAPTWGIGIWIYCSEIFNNMERAKGSALSAATNWAFNFALAMFVPSAFKNISWKTYIIFGVFSVALTIQTFFMFPETKGKTLEEIDQMWVDNIPAWRTANYIPQLPIVKDEEGNKLGLLGNPQHLEDVHSNEKGLLDRSDSASNSN

SEQ ID NO: 525 - DNA, 2099 bp, Saccharomyces cerevisiae
  CDS (180)..(1910)
agcttcaacactggggaatgaataatatgtcatctagaaaaaatttatataatactcagtgtttatcatatctcggatcatcactcatctctcatgagtaatagaaaccataaagaaaagatatatcaagcctcttatcaaggttggttttgaacactttacaataaaatctgccaaaaatgtctgaagaagctgcctatcaagaggatacagcagtccaaaatactccagctgatgctttgtcgccagttgaatccgattctaattccgctttgtctactccatccaacaaagctgaaagagatgacatgaaagatttcgacgagaatcacgaagaatctaataactacgttgaaattccaaagaagcccgcctccgcctacgttacagtttccatctgttgtttaatggttgctttcggtggttttgttttcggttgggatactggtaccatttctggttttgttgctcaaactgattttatcagaagatttggtatgaagcaccacgatggtacttattatttgtctaaggttagaactggtttaattgtctccattttcaacattggttgtgccattggtggtattattttagcaaaattaggtgatatgtatggtcgtaaaatgggtttgattgtcgttgttgtcatctacattatcggtatcattatccaaattgcctcaatcaacaagtggtaccaatatttcattggtagaattatctctggtttaggtgtcggtggtattgccgttttatctcctatgttgatttctgaagtctctccaaagcatattagaggtactttggtttcatgttaccaacttatgattactttgggtattttcttgggttactgtacaaactacggtaccaagacctacaccaattctgtccaatggagagttccattaggtctaggtttcgcttgggctttgtttatgattggtggtatgacattcgttccagaatctccacgttatttagttgaagtcggtaaaattgaagaagctaagcgttctattgctctttcaaataaggtcagcgcagacgatccagctgttatggctgaagtcgaagttgttcaagctacagttgaagctgaaaaattagctggtaatgcctcctggggtgaaatatttagcactaagactaaggttttccaacgtttgatcatgggtgctatgattcaatcattgcaacaattgacaggtgataactatttcttctattacggtactaccgttttcactgctgtcggtttggaagattcttttgaaacttctattgtcttgggtattgtcaactttgcttccacctttgttggtattttcttagtcgaaagatatggtcgtcgtagatgtttattatggggtgctgcttccatgacagcttgtatggttgttttcgcttctgttggtgttacaagattgtggccaaatggtaagaagaacgggtcttctaagggtgctggtaactgtatgattgtcttcacatgtttctacttattctgttttgccactacctgggctccaattccatttgttgttaactctgaaactttcccattgagagttaagtccaagtgtatggctattgctcaagcttgtaactggatctggggtttcttgattggtttctttactccatttatttcaggtgctattgatttctactacggttatgttttcatgggctgtttggtcttttcttacttctacgtcttcttcttcgttccagaaactaaaggtttgactttagaagaagttaacaccttatgggaagaaggtgttttgccatggaaatcaccttcttgggttccaccaaacaagagaggtactgactacaacgctgatgatctaatgcatgatgatcaaccattttacaagaagatgttcggaaaaaagtaggtcagttaattaaataatatagacttccttcaaggaataaaaataatatttgatccttccaatttttaacgctttatgaaatatatatttatgatttaatagtttatagataatactttatcaaactacaattttgaattatgttttttgtttcatagttgtggaagaggttaggaataggccgaattc

SEQ ID NO: 526 - protein, 576 aa, Saccharomyces cerevisiae
MSEEAAYQEDTAVQNTPADALSPVESDSNSALSTPSNKAERDDMKDFDENHEESNNYVEIPKKPASAYVTVSICCLMVAFGGFVFGWDTGTISGFVAQTDFIRRFGMKHHDGTYYLSKVRTGLIVSIFNIGCAIGGIILAKLGDMYGRKMGLIVVVVIYIIGIIIQIASINKWYQYFIGRIISGLGVGGIAVLSPMLISEVSPKHIRGTLVSCYQLMITLGIFLGYCTNYGTKTYTNSVQWRVPLGLGFAWALFMIGGMTFVPESPRYLVEVGKIEEAKRSIALSNKVSADDPAVMAEVEVVQATVEAEKLAGNASWGEIFSTKTKVFQRLIMGAMIQSLQQLTGDNYFFYYGTTVFTAVGLEDSFETSIVLGIVNFASTFVGIFLVERYGRRRCLLWGAASMTACMVVFASVGVTRLWPNGKKNGSSKGAGNCMIVFTCFYLFCFATTWAPIPFVVNSETFPLRVKSKCMAIAQACNWIWGFLIGFFTPFISGAIDFYYGYVFMGCLVFSYFYVFFFVPETKGLTLEEVNTLWEEGVLPWKSPSWVPPNKRGTDYNADDLMHDDQPFYKKMFGKK

SEQ ID NO: 527 - DNA, 1785 bp, Neurospora crassa
  CDS (1)..(1785)
atggcgatcttcgccatgggctggcagaagcccgacaatgtcgctggctcatctgccccagcgattatggtcggcctgtttgtcgccacaggcggcttactccttggctatgacactggaaccatcaacggcattcttgccatgaaatcgttcaaagaccacttttcaaccggctacatcgacggcaacggacagcctggcatatacccaaaggagagtgcgttaatcgttgccatgctcagcgccggaaccgccatcggagccttactcgctgcgcctctcggagatcactatggacgtcgccggtcccttattggcgccatcggaattttcgtaataggcgccatcctgcaggtttgtgcatataacatcgatctgttggtggcaggaaggacggttgccggtgttggtatcggcattgtctcagtgcttgtccccttatatcagtctgagatggcacccaagtggattcgaggaacactggtgtgcacctaccaactctccatcaccatggggcttcttgccgctgccgtggtcaacatcctcacatacaaattgaagacagctgctgcctaccgggtaccaataggacttcagctaacctgggcctgcgtcttggccctgggcttgaccgtgttacccgaaactcctcgttacctcatcaaacgtggagacaagaacgccgctgcgctttctctcagtcggctgcgtcgactggacattactcaccctgccttggtcgaggagcttgccgaaatcgaagcaaaccatcaatacgagatggcactgggtcccgactcttacaaggacattctctttggcgaacctcaccttggccgtcgcacgtttacaggttgctgtctgcagatgctacaacagcttaccggcgtgaactttatcatgtactatggaaccaccttttttaataacgctggcgttggaaaccccttgaagatctctctcatcatgcaagtcatcaacacagcatcgaccatacccggattgttcgtagtcgaatcatggggccggcgtcggctcttgatggtgggcgccataggcatggccatctgtcagctgctgatcgctgccttcgcgacggccagcggctccaacaacctatcagcacataacaaggtcctcattacctttgttgcgatatacatcttcttctttgctgcatcatggggcccagttgtatgggtcgtcacctccgagatttatccgctcaaggttagagccaaatccatgtcgataactacggcttcaaattggttcctcaattttggcatcgcctacggcaccccgtatatgcaaacgaacagtgcagcgagcgacgaaagctcgatagatctcggctctaaagtgtttttcgtatggggcgcgttttgcatagtagcggtcggctttgtatggtgtatggtttacgagactagcaagatcagtctcgaacaaattgatgagatgtacgagagagttgaccatgcgtggcacagcaggcgcttcgaacctagttggagtttccaggagatgcgagaccttggcttctccgatggcggcataccgccaacgcagcagctgcagcagcagccgcagcagccgcagcagcaacaacaacaacaccaccaacaacaacaacaccaactacaagttgacctacagcaatcgcagtcacgcactagcaactccagcacgtctcaaaccgacacgggcgggagcaataacaccggggcgtcacaagacgataaacttgtggcatccttgggcaacatcgatctcagctattga

SEQ ID NO: 528 - protein, 594 aa, Neurospora crassa
MAIFAMGWQKPDNVAGSSAPAIMVGLFVATGGLLLGYDTGTINGILAMKSFKDHFSTGYIDGNGQPGIYPKESALIVAMLSAGTAIGALLAAPLGDHYGRRRSLIGAIGIFVIGAILQVCAYNIDLLVAGRTVAGVGIGIVSVLVPLYQSEMAPKWIRGTLVCTYQLSITMGLLAAAVVNILTYKLKTAAAYRVPIGLQLTWACVLALGLTVLPETPRYLIKRGDKNAAALSLSRLRRLDITHPALVEELAEIEANHQYEMALGPDSYKDILFGEPHLGRRTFTGCCLQMLQQLTGVNFIMYYGTTFFNNAGVGNPLKISLIMQVINTASTIPGLFVVESWGRRRLLMVGAIGMAICQLLIAAFATASGSNNLSAHNKVLITFVAIYIFFFAASWGPVVWVVTSEIYPLKVRAKSMSITTASNWFLNFGIAYGTPYMQTNSAASDESSIDLGSKVFFVWGAFCIVAVGFVWCMVYETSKISLEQIDEMYERVDHAWHSRRFEPSWSFQEMRDLGFSDGGIPPTQQLQQQPQQPQQQQQQHHQQQQHQLQVDLQQSQSRTSNSSTSQTDTGGSNNTGASQDDKLVASLGNIDLSY

SEQ ID NO: 529 - DNA, 27 bp, artificial sequence
  Primer
atgaaaaatatcatttcattggtaagc

SEQ ID NO: 530 - DNA, 27 bp, artificial sequence
  Primer
ttaacatttatcagctgcatttaattc

SEQ ID NO: 531 - DNA, 1390 bp, Saccharomyces cerevisiae
  CDS (303)..(1118)
cgttacttaaagagagagcacacacgttataaactacccaccgccaaattgctatccaatgttaaggatagacaaatgcaaaaatatataaaggaaaccaaaatctgcttatataaagcgtaaatcttacatttttcactgcttactcactcttattgttttttttctgttcaaccacgcgatgagttttttttttccattattatttataggacaaaaatgaaaaaatattagctcagataagcacattttgttcatagctaagtggatagggaaacacctacacttaattgcaagcaacaatgccttcgctaacccccagatgtatcattgtcagacacggtcaaactgaatggtccaagtcaggccagtatactggtttgacagatctaccgttaacgccctacggtgagggccaaatgttgaggaccggtgagagtgttttccgcaataatcagtttttgaatccagacaacatcacttatatcttcacctctccacgtttgcgtgccaggcaaactgtggatttggttttgaaaccattaagcgacgagcaaagagctaagatccgtgtggtggtagacgacgacttgcgagagtgggagtacggtgactacgagggaatgctgactcgagaaatcattgaattgagaaagtcacgcggtttggacaaggagaggccatggaatatctggagagatgggtgtgagaacggtgagactactcagcaaattgggttgagactttcccgcgctattgccagaatccagaacttgcaccgcaagcaccagagtgagggcagagcatcagacatcatggtctttgcgcacggacatgcattgcgttattttgctgctatttggtttggactgggtgtgcaaaagaagtgtgagacgattgaagaaattcaaaatgtcaaatcttatgatgacgacacagttccatatgtgaaattggaatcttacagacatttggtagacaatccatgtttcttactggacgccggtgggattggtgttttgtcatacgctcaccacaacattgacgaacctgcattggaattagcaggtccatttgtctcaccaccagaggaggaatcccagcatggcgatgtgtaagcaatcattcgaaatgcaaaaaaagatatgcagttatagaaagtgataaaaacattttttttcttgactttttatgttatataatatgctatatatgataatatctagtggtatcttaaaaaagaaaaaataatgaaataaaagggatagtacaaaggactgtgtttttttgtattgtggaaaaacgaactaattgaaaaataaaccataaaatgaacggagtaaaaaaagtactagcaaaagcttatttgcaatattcaaggaaaaaaggc

SEQ ID NO: 532 - protein, 271 aa, Saccharomyces cerevisiae
MPSLTPRCIIVRHGQTEWSKSGQYTGLTDLPLTPYGEGQMLRTGESVFRNNQFLNPDNITYIFTSPRLRARQTVDLVLKPLSDEQRAKIRVVVDDDLREWEYGDYEGMLTREIIELRKSRGLDKERPWNIWRDGCENGETTQQIGLRLSRAIARIQNLHRKHQSEGRASDIMVFAHGHALRYFAAIWFGLGVQKKCETIEEIQNVKSYDDDTVPYVKLESYRHLVDNPCFLLDAGGIGVLSYAHHNIDEPALELAGPFVSPPEEESQHGDV

SEQ ID NO: 533 - DNA, 714 bp, Deinococcus radiodurans
  CDS (1)..(714)
atgatcaagcgccttgctcccaccggtttttcggcccccgaccgcgcgaccgccaccgagttctgggtcgtgcgccacggcgagagcacctggaacgccggggggcgctaccagggccagacggacgtgccgctgtccgccgtcggcctgttgcaggcagcctgcctcgccgagcgcctgaccgggcaggtcttcgacgcggtgtactccagcgacctgacccgcgcccgccagaccgccggggcggtggccgagcgccttgccggggcgccgccggtgcaactgagccccgaactgcgcgaaatcgacgtgggcgagctgaccgggctggtcgtcactgagatccgcgagcgctatcccgactacctcgcggcgctgcaggccgacccctggacgacccagcgcccgggcggcgagagcatggccgaccttttcgggcgctgcggcgaggcctttcacgcgctgcgggccgcgcatcccggggggcgggtgctggtctttacccacggcggcgtggtacgggtggcagtgggactcgcgctcggtggcgttcccggccacgcctggtcgcgcctgagtgtcaccaacacgtcgattacccgcgtgctgctcggcgaacacagcggcaccctgctcggcttcaacgacgaggcgcacctcgaagccctgctcgaagcgaccgaggcggacgacgtgctggggcaagcgccgtag

SEQ ID NO: 534 - protein, 237 aa, Deinococcus radiodurans
MIKRLAPTGFSAPDRATATEFWVVRHGESTWNAGGRYQGQTDVPLSAVGLLQAACLAERLTGQVFDAVYSSDLTRARQTAGAVAERLAGAPPVQLSPELREIDVGELTGLVVTEIRERYPDYLAALQADPWTTQRPGGESMADLFGRCGEAFHALRAAHPGGRVLVFTHGGVVRVAVGLALGGVPGHAWSRLSVTNTSITRVLLGEHSGTLLGFNDEAHLEALLEATEADDVLGQAP

SEQ ID NO: 535 - DNA, 1350 bp, Nostoc sp. PCC 7120
  CDS (1)..(1350)
atgactcgtgtcattattgtgcgtcacggccaaagtacttataacatcgaacggcgcatccaaggacgtgctgacgtatcaacattaacggagcgaggtcgtagtgacgctagtaaggtaggcaaggccctcactaacatttcctttaaggcaatttacactagcccactccagcgagcaaaacaaacagcagagattattcatagtgagctggcaaatgaggcagttcagtctgctgatgtgcagatttctgaattgttaagagaaatagacttgcctttgtgggaaaaactgctgacatccgaggtcaaggaaaagtttcccgaagattaccgcatttggcacgaaaaaccccaggaactacaaatgttagtgaacgacaatggggtgacaagagaacattttccagttctatctttatacgaacaggcgcggcagttttggcaaaacattttgcccaatcatcgcggtgaaagcattctcatcgttggacacaacggcattaatcgcgccctcatcagcacagccttgggtgttcaccccagtcgttaccatgccatacagcaatctaactgtggaatcagtgtattaaattttgctggaggactgggtgaaccagtgcaactagagtcgatgaatcaaacccaacacacaggcgagactctaccttccttgcgtcctggtcatcagggagtgagattgttattggtgcgtcacggtgaaactgaatggaatcgccaaactaggtttcagggacaaattgacgttcccctcaacgataacggtagacaacaagcacaaaaagccggggtgtttctgcaaaatgtagcaattgactttgctgtaagtagttctatgctgcgtcccaaagaaacagccgagattatcttgcgccaccatccaagtatcaatttggagttgcaagacggtttaagagaaatcagtcacggactttgggaaggaaaactagaagccgaaatagaagaggaatttcctggtgaattagagcgttggcggactataccaggccaggtacaaatgccggaaggtgagaatttacagcaagtgtgggaacgtagcacggaagcctggcaaaatattgtgcaaacagccttagataatcaacgccaaacagggttaatcgtggctcacgatgccacaaataaaaccttactgtgtcatattctcggtttacccacagacaatttctggaattttcgccaaggtaatggtgctgttagtgtcattgattacccctctggattaaatggtgtaccagtactgcaagccatgaatattactactcatttgggtggtgtattagataaaaccgcagctggagcattatag

SEQ ID NO: 536 - protein, 449 aa, Nostoc sp. PCC 7120
MTRVIIVRHGQSTYNIERRIQGRADVSTLTERGRSDASKVGKALTNISFKAIYTSPLQRAKQTAEIIHSELANEAVQSADVQISELLREIDLPLWEKLLTSEVKEKFPEDYRIWHEKPQELQMLVNDNGVTREHFPVLSLYEQARQFWQNILPNHRGESILIVGHNGINRALISTALGVHPSRYHAIQQSNCGISVLNFAGGLGEPVQLESMNQTQHTGETLPSLRPGHQGVRLLLVRHGETEWNRQTRFQGQIDVPLNDNGRQQAQKAGVFLQNVAIDFAVSSSMLRPKETAEIILRHHPSINLELQDGLREISHGLWEGKLEAEIEEEFPGELERWRTIPGQVQMPEGENLQQVWERSTEAWQNIVQTALDNQRQTGLIVAHDATNKTLLCHILGLPTDNFWNFRQGNGAVSVIDYPSGLNGVPVLQAMNITTHLGGVLDKTAAGAL

SEQ ID NO: 537 - DNA, 636 bp, Listeria monocytogenes
  CDS (1)..(636)
atggcagaaggtttacgtacaatttattttgtaagacatggtaagacagagtggaatatgactggacaaatgcagggatggggcgattcgccgctagttgcagaaggtattgacggggcaaaagcagtcggcgaagtattaaaagacatgcagattgatgccgtttatacgagtactagtaaacgcacgcaagataccgcggcttatattctcggtgaccgcgaaatcgaaattcaacctctggaagaactaaaagaaatgggttttggaacatgggaaggcattagagtaacggaaattgacgaaaaacacccagaagaacgcgcaaagattctccatagtccagaaacctacaaagcagaagtaaatggtggcgaaacctattatgagcttgcagaacgactactagaaggcgtcgaaaaaattattgcagacaatccaaatggtaatattctcgtcgtttctcacggcatgtcgctcacgttattattatacttgctgcaaggcggaactattgaagatcaccgcaaagaagcaccaagaattttgaacacaagtattagcatcgtagaataccaaaacggcgaattttctcttaaaaaaatcaatgaaatcggtcatttagacttaaaataa

SEQ ID NO: 538 - protein, 211 aa, Listeria monocytogenes
MAEGLRTIYFVRHGKTEWNMTGQMQGWGDSPLVAEGIDGAKAVGEVLKDMQIDAVYTSTSKRTQDTAAYILGDREIEIQPLEELKEMGFGTWEGIRVTEIDEKHPEERAKILHSPETYKAEVNGGETYYELAERLLEGVEKIIADNPNGNILVVSHGMSLTLLLYLLQGGTIEDHRKEAPRILNTSISIVEYQNGEFSLKKINEIGHLDLK

SEQ ID NO: 539 - DNA, 636 bp, Listeria innocua
  CDS (1)..(636)
atggcagagggtttacgaacgatttattttgtaagacatggtaaaacagagtggaatatgactggacaaatgcaaggctggggcgattctccgctagttgcagaaggtattgacggggcaaaagcagttggcgaagtgttgaaagatacaccaattgatgccgtttatacaagtacaagtaaacgcacgcaagataccgcggcttacattcttggcgaccgcgaaatcgaaattcaacctctggaagaactaaaagaaatgagctttggaacgtgggaaggcattagagtaactgaaattgacgaacaacaccctgaagaacgcgcgaaaattctccatagcccagaaacctacaaagcagaagtgaacggtggcgagacttattatgagcttgcagaacgactgttagaaggcgttgaaaaaatcattgcagaaaatccaagtggcaacattctcgtcgtttctcacggcatgtcacttacgttattattatacttgctacaaggcgggaccattgaagatcaccgcaaagaagcaccaagaattttgaacacaagtattagcatcgtagaataccaaaacggcgaattttctcttaaaaaattaaatgaagttggtcatttagacttaaaataa

SEQ ID NO: 540 - protein, 211 aa, Listeria innocua
MAEGLRTIYFVRHGKTEWNMTGQMQGWGDSPLVAEGIDGAKAVGEVLKDTPIDAVYTSTSKRTQDTAAYILGDREIEIQPLEELKEMSFGTWEGIRVTEIDEQHPEERAKILHSPETYKAEVNGGETYYELAERLLEGVEKIIAENPSGNILVVSHGMSLTLLLYLLQGGTIEDHRKEAPRILNTSISIVEYQNGEFSLKKLNEVGHLDLK

SEQ ID NO: 541 - DNA, 654 bp, Brucella melitensis
  CDS (1)..(654)
atgactgattcttcccaccaacggagtactgcgatgtctcgtaccctcgtcctggtccgccatggccaaagcgaatggaacctcaagaacctctttaccggctggcgtgatccgggcctcaccgagcagggccatgcggaagccaaggccgcaggccaacgcctcaaggcagccggcctgaagttcgacattgcctacacctccgccctttcccgcgcgcaagttacctgccagcacattctcgacgagcttggccagccgggccttgaaaccatccgcgaccaggccctgaacgagcgcgactatggcgatctctccggtctcaacaaggatgacgcccgcgcaaagtggggtgaggaacaggttcacatctggcgccgttcctatgacgtcccgcctccgggcggcgaaagcctgaaggacaccggcgcgcgcgtctggccctattaccttcacaccatccagccacatgtgctgcgcgaggagaccgttctggtcgccgcccatggcaattcgctgcgcgcactcatcatggcgctcgagggcctgacaccagaacagattctcaagcaggaactcaacaccggcgttccgatcatctaccggctcaatgccgattcgacggtcgcctcgaaggaaatcctcagcgcctga

SEQ ID NO: 542 - protein, 217 aa, Brucella melitensis
MTDSSHQRSTAMSRTLVLVRHGQSEWNLKNLFTGWRDPGLTEQGHAEAKAAGQRLKAAGLKFDIAYTSALSRAQVTCQHILDELGQPGLETIRDQALNERDYGDLSGLNKDDARAKWGEEQVHIWRRSYDVPPPGGESLKDTGARVWPYYLHTIQPHVLREETVLVAAHGNSLRALIMALEGLTPEQILKQELNTGVPIIYRLNADSTVASKEILSA

SEQ ID NO: 543 - DNA, 813 bp, Nostoc sp. PCC 7120
  CDS (1)..(813)
atggttactacgccactttatatcaaatacaaggcattgtcgaaccagaaggagatatctatgcagttgaggcttgaagaatctgtaggaactcgcgtgattttgttacgccacggagagagtacgtttaatgctttgggattatatcaaggtagtagtgatgagtcagtattaacagaagttgggcgtagggatgcgcgaattacaggggaatttctccagggaatatgttttgatgctgtttatgttagttcactcaagcgggcgcaggaaaccgctaaggaaattttagaggtaattaattttccccaaaatgcagtttttatcgatgaaaaattaagagaaaatgatatgcctgcttgggaaggattagcatttcaatatgtgcgggaaatattccctgaagcatatcaactttggaaacagcgcccgcatgaattttggatgcagatagataataaaacacggttttatccggcgctgaatttatatcaacgggtacaacaattttggcgagaagtactaccaaacaacgtaggtaaaactgtgttggtagttgcacatggggggacaaatcgggctttgattgggactgctttggggataagtcctgagttttatcattctcttcaacagtcaaattgtgggattagtattcttaattttcctgatggttatttggcttcggggcagttagaggtgatgaatttgaattatcatttggattttttgagaaatgagaagaaaggcaaaatttttaaacgcaaagtatcgcggaggtttacgcggagtgacgcggaggttttactatga

SEQ ID NO: 544 - protein, 270 aa, Nostoc sp. PCC 7120
MVTTPLYIKYKALSNQKEISMQLRLEESVGTRVILLRHGESTFNALGLYQGSSDESVLTEVGRRDARITGEFLQGICFDAVYVSSLKRAQETAKEILEVINFPQNAVFIDEKLRENDMPAWEGLAFQYVREIFPEAYQLWKQRPHEFWMQIDNKTRFYPALNLYQRVQQFWREVLPNNVGKTVLVVAHGGTNRALIGTALGISPEFYHSLQQSNCGISILNFPDGYLASGQLEVMNLNYHLDFLRNEKKGKIFKRKVSRRFTRSDAEVLL

SEQ ID NO: 545 - DNA, 615 bp, Deinococcus radiodurans
  CDS (1)..(615)
atggcggggccggaccttaccctgctgctcgtgcggcacggcgcaaccgcgtggaacgagggagggcagtggcagggctggaccgacaacccgctgggcgacgcgggccgggcgcaggccagagcgctgcgcgaggaactggcggggcagactttcgacgccgtttattcgagcgacctcacgcgggcgcggcagaccgccgaactcgcgctgccgggccgggcgctgcggctggacgcccgactgcgcgagctgaatctgggcgactacgagggccacacgctggcgcagatgcaggcgcacggcggctacgcgggctggcaggccgacccctgggcgcaggcggtgccgggcggagagagcctgcaagacgtggcggcgcggatgcgtgggtggctaacggacgtgcaggccgagtttcccggcgggcgcgtcatcgctttctcgcactccatcgcccttcgcacgctggcccgtgacctgctggggctgccgctggagccgcaggtgaattacccgattccctatgccgagcgcatcaagaacgggcgctgcatggtgctggagtgccggggcgggacgtggcggcgggccggggcaaacgccgcaagctga

SEQ ID NO: 546 - protein, 204 aa, Deinococcus radiodurans
MAGPDLTLLLVRHGATAWNEGGQWQGWTDNPLGDAGRAQARALREELAGQTFDAVYSSDLTRARQTAELALPGRALRLDARLRELNLGDYEGHTLAQMQAHGGYAGWQADPWAQAVPGGESLQDVAARMRGWLTDVQAEFPGGRVIAFSHSIALRTLARDLLGLPLEPQVNYPIPYAERIKNGRCMVLECRGGTWRRAGANAAS

SEQ ID NO: 547 - DNA, 714 bp, Caulobacter crescentus
  CDS (1)..(714)
atgccgacgctcgtcctgctgcgccatggccaaagccagtggaacctggaaaaccgcttcaccggttgggttgatgtggacctcaccgctgagggcgaagctcaggcccggaagggcggcgagctgatcgctgcggccggcatcgagatcgaccgcttgttcacctcggttcagacccgcgccatccgcacaggcaatctggcgctggacgccgccaagcagagcttcgtccccgtgaccaaggactggcgcctgaacgagcgccactatggcgggctgaccggcctgaacaaggctgagaccgccgaaaagcacggcgtcgagcaggtgaccatctggcgccgttcgtacgatatcccgccgccggagctggcgccgggcggcgagtacgacttcagcaaggatcgccgctacaagggcgcaagcctgcccagcacggaaagcctggcgacgacgctggttcgcgttctgccctactgggaaagcgacatcgctccgcatctcaaggcgggtgagactgtgctgatcgccgcccacggcaactcgctgcgcgccatcgtcaagcatctgttcaacgtgccggacgaccagatcgtcggtgtggagattccgaccggcaatccgctggtgatcgacctggatgctgcgttgaagccgaccggcgcgcgctacctggacgacagtcgggctgaggcgcttcccaaagttggttaa

SEQ ID NO: 548 - protein, 237 aa, Caulobacter crescentus
MPTLVLLRHGQSQWNLENRFTGWVDVDLTAEGEAQARKGGELIAAAGIEIDRLFTSVQTRAIRTGNLALDAAKQSFVPVTKDWRLNERHYGGLTGLNKAETAEKHGVEQVTIWRRSYDIPPPELAPGGEYDFSKDRRYKGASLPSTESLATTLVRVLPYWESDIAPHLKAGETVLIAAHGNSLRAIVKHLFNVPDDQIVGVEIPTGNPLVIDLDAALKPTGARYLDDSRAEALPKVG

SEQ ID NO: 549 - DNA, 756 bp, Treponema pallidum subsp. pallidum (syphilis spirochete)
  CDS (1)..(756)
atgaagcttgtgttgatccgtcatggagaaagtgaatggaacaggctgaacctgttcactggttggacagatgttccgcttaccccacgtggggagtcggaagcccaggaaggaggccgcgtactgcaagaagcggggtttgattttgacctatgctacacttctttcttgaaacgtgccattcgtacgctcaattttgtactccaggcactggaccgtgagtggttgccggttcacaaaagctggaaattgaacgagcggcattatggggatctacaaggtttaaataagacagagacggcgcagaagtatggtgagcagcaggttagggtgtggcgtcgctcctttgatgtggctcctcctccgcttactgtaggggacgcacgttgtccgcatactcaagcctcctaccggggggtatgcgcgtctggtcggacgccagtacttccgtttacggaaagtttgaaagataccgttgcgcgtgtggtgccgtattttgaagaggaaatcaaaccgcagatgatttccggacagcgtgtgcttattgtggcgcatggtaactcgttgcgcgcactgatgaagcacatagagtctttggatgagactcagataatggaagtaaatttgcctaccggtgtaccgcttgtctatgagttcgaggcggattttaccctgtgtgggaagcgttttttaggtaatgaggcggatgttgcagcgagggcgcaggctgtggctgatcagggtaagagtaactaa

SEQ ID NO: 550 - protein, 251 aa, Treponema pallidum subsp. pallidum (syphilis spirochete)
MKLVLIRHGESEWNRLNLFTGWTDVPLTPRGESEAQEGGRVLQEAGFDFDLCYTSFLKRAIRTLNFVLQALDREWLPVHKSWKLNERHYGDLQGLNKTETAQKYGEQQVRVWRRSFDVAPPPLTVGDARCPHTQASYRGVCASGRTPVLPFTESLKDTVARVVPYFEEEIKPQMISGQRVLIVAHGNSLRALMKHIESLDETQIMEVNLPTGVPLVYEFEADFTLCGKRFLGNEADVAARAQAVADQGKSN

SEQ ID NO: 551 - DNA, 645 bp, Xylella fastidiosa
  CDS (1)..(645)
atgcgtattttgcttgctcgtcatggagagacactttggaatgctgaaggtcgctatcaaggccaaattgatattcctctttcttctgttggtgaggctcaggcgcgtgcccttggtgagcgcctacgggatgtagtcattgctcgtgccgtggcatctcccttggtacgggcccaatacactgcgcaactggccttgggtgaaagccgcgcagcacagttattgattgaggcggatctgaaagaaatttcccacggtgactgggagggtcttttagatactgagattcatgcaatggatcccacacggctgcacgcttggcgtaaagcacctgagacagtcatcatgcctaacggtgaatcactgcaccaagttctagaacgcagctggcgtggtttaacaaccgccgctgttggattagggattgacgatatcttattagtcgttgcgcatgatgcagtcaaccgagtgatcctgtgtcgagtgctgggattgccattggctcatttatggcgcttccatcaagcaccgactacgctgaacctcttggaaggaaagaatattgaccaactacaagtagtacgcttaaacgattgcagtcatcacaccccgttctttggtgaagctaaacatcgcgctttataa

SEQ ID NO: 552 - protein, 214 aa, Xylella fastidiosa
MRILLARHGETLWNAEGRYQGQIDIPLSSVGEAQARALGERLRDVVIARAVASPLVRAQYTAQLALGESRAAQLLIEADLKEISHGDWEGLLDTEIHAMDPTRLHAWRKAPETVIMPNGESLHQVLERSWRGLTTAAVGLGIDDILLVVAHDAVNRVILCRVLGLPLAHLWRFHQAPTTLNLLEGKNIDQLQVVRLNDCSHHTPFFGEAKHRAL

SEQ ID NO: 553 - DNA, 2034 bp, Arabidopsis thaliana (mouse-ear cress)
  CDS (1)..(2034)
atgattccactctcgtttgcagcattaggagacatagttgataagaagcttgatgaggattatgtaaaggaagaagttgaaatgatgatacaagtatctctgctatccacacaagcagcaccgggagaacgaccaacgatgtcggaagttgaaatttttagaaactcctgcttgtgctacataaactggttttgcaacatcatctccataatatattctaacagtttgcttttgaggattgattcaggatcatcatctatatctgttgtcttcttagtttttactctgtctcggatggagcaacgacggatgttaacggcggctagaccacgtttgtcctcgacgatccgtacgattacgtctcacgtggcgttctcagcaagccgtctcttgaaaccttatgttgcatatcggcttggattggaggacgcgaatcagaggaaaacagagaacgaatccaccggtggagataaagaaatcgccaattcgctcctccactgtcttaaatttcactatcttcttcttcattttccttccttctcacttcaaatccataatcgctctacttctctctctctctctagattcgaaaaaatggcgaaactggtgatgttgttggttctctgtatcttaccggcgatagccatggcggcaaggaggggaaatattggaaagaatacaatggtggttcaaggtagcacctactgtgacatttgcaaattcggcttcgagactcctgaatcctcctacttcatccccggtgcaacggtgaagctatcatgcaaagacaggaagacaatggaagaggtttacacagacaaagctgtatcagacaaagaaggaaagtataagttcattgtccacgacgatcacagagaccagatgtgcgatgttttgcttgtgaaaagctcggataaaacctgctctaaaatctccgttggacgtgagaagtctcgtgtgatcttgaaccattacagtggcattgcctcgcagatcagacatgctaacaacatgggatttgagaaagaagtgagaatggctacttctacgactatgtctcatcaagcgattgggtctgttgtctctcaaagaccattcaaagcttctcagtttctaaaggagcctttgaataatgtaccaatgaaattcagacaaaaaagattcaagattgaagcaactgcttctcagatatctgtcgttgacaacactttcttgtctccgtctccttccaagaacaaaccacatgaatctaagaagaaatcaaatgaagcagctttgatattgattaggcatggagaatcgttatggaatgagaagaatttgttcacgggttgtgttgatgtgccattgactcagaaaggtgttggagaagctattgaagctgggaagaagattagtaacattcctgtagatttgattttcacttcttctttaatccgtgctcagatgactgcaatgcttgccatgactcagcatcgtcgcaagaaggttccaatcatcttgcacaacgagagtgtaaaggcgaaaacttggagtcatgttttcagcgaagaaactagaaaacaatctatcccggttatagcggcttggcaactgaatgagagaatgtatggagagttgcagggtttgaacaagaaagaaacagcggaaagatacgggacacaacaagttcacgaatggcgcaggagttacgaaattcctcctccgaaaggcgagagcttggagatgtgtgctgagagagcagtggcttattttgaagacaatatcaaaccagagcttgcatctggaaacaatgtaatgattgctgctcacgggaactcattgagatctatcattatgtatcttgacgatttaacttctcaggaggttacaactctagacctgtccacaggtgtaccattgctctacatcttcaaagaaggcaagttcatgaaacgaggaagccccgtcggttctactgaagctggtgtctatgcttatacaaagagattggcacaatacagagagaagcttgatgcggcggcgaccatttaa

SEQ ID NO: 554 - protein, 677 aa, Arabidopsis thaliana (mouse-ear cress)
MIPLSFAALGDIVDKKLDEDYVKEEVEMMIQVSLLSTQAAPGERPTMSEVEIFRNSCLCYINWFCNIISIIYSNSLLLRIDSGSSSISVVFLVFTLSRMEQRRMLTAARPRLSSTIRTITSHVAFSASRLLKPYVAYRLGLEDANQRKTENESTGGDKEIANSLLHCLKFHYLLLHFPSFSLQIHNRSTSLSLSRFEKMAKLVMLLVLCILPAIAMAARRGNIGKNTMVVQGSTYCDICKFGFETPESSYFIPGATVKLSCKDRKTMEEVYTDKAVSDKEGKYKFIVHDDHRDQMCDVLLVKSSDKTCSKISVGREKSRVILNHYSGIASQIRHANNMGFEKEVRMATSTTMSHQAIGSVVSQRPFKASQFLKEPLNNVPMKFRQKRFKIEATASQISVVDNTFLSPSPSKNKPHESKKKSNEAALILIRHGESLWNEKNLFTGCVDVPLTQKGVGEAIEAGKKISNIPVDLIFTSSLIRAQMTAMLAMTQHRRKKVPIILHNESVKAKTWSHVFSEETRKQSIPVIAAWQLNERMYGELQGLNKKETAERYGTQQVHEWRRSYEIPPPKGESLEMCAERAVAYFEDNIKPELASGNNVMIAAHGNSLRSIIMYLDDLTSQEVTTLDLSTGVPLLYIFKEGKFMKRGSPVGSTEAGVYAYTKRLAQYREKLDAAATI

SEQ ID NO: 555 - DNA, 582 bp, Bacillus subtilis
  CDS (1)..(582)
atgacagccgtttgtttagtaagacatggagaaaccgattggaacctgcagcaaaaatgccaaggcaaaaccgatatcccgctaaacgcaacaggtgaacgccaagcaagagaaaccggagaatatgtaaaggacttttcttgggatattattgtgacgagcccgctgaaaagagcgaaaagaaccgcggaaattattaatgaatatctgcatcttccgatagtcgagatggatgattttaaggaacgcgattacggcgacgcggagggcatgccgctggaggaacggacaaagcgctatccagataacatctatccgaatatggaaaccttagaagaactcactgacaggctgatgggcggtttggcaaaagtgaatcaggcgtatccaaacaagaaggtgctgatcgtggcgcacggtgcggcaattcacgccctgctgacagaaatatccggcggtgacccggagcttcaaagcacccgtctcgtcaacgcctgcctcagcaacattgaatttgcagaagaaaaatggcggataaaagactataatatcaacagccacttatccggctttatcaaataa

SEQ ID NO: 556 - protein, 193 aa, Bacillus subtilis
MTAVCLVRHGETDWNLQQKCQGKTDIPLNATGERQARETGEYVKDFSWDIIVTSPLKRAKRTAEIINEYLHLPIVEMDDFKERDYGDAEGMPLEERTKRYPDNIYPNMETLEELTDRLMGGLAKVNQAYPNKKVLIVAHGAAIHALLTEISGGDPELQSTRLVNACLSNIEFAEEKWRIKDYNINSHLSGFIK

SEQ ID NO: 557 - DNA, 606 bp, Thermotoga maritima
  CDS (1)..(606)
atgaaactctatctcataagacacggcgaaaccatctggaacgaaaagggtctgtggcagggagtcacagatgttcctctcaacgaaagaggaagagaacaggcaagaaagctggcaaacagcctgaaaagagtcgatgccatttactcgagtcccctcaaaagaagcctcgagacagcagaagagatcgccaggcgctttgaaaaagaaatcatcgtcgaagaagatctgagagaatgtgaaatatcactctggaacggtctcacagtggaagaggctatcagggagtatcctgtggagttcaagaagtggtcatcggatccaaattttggaatggaaggtttagaatccatgagaaatgtacagaatcgcgtagtgaaggcgatcatgaagatcgtctcacaggagaagttgaacggttcagagaacgtggtcatcgtatcacactctctgtctttgagagctttcatctgctggatcctcgggcttcctctttaccttcacagaaatttcaagctggacaacgcgtccctcagtgtggtggaaatagagagcaaaccgaggcttgttttgttgaacgatacgtgtcaccttaaggaatcttga

SEQ ID NO: 558 - protein, 201 aa, Thermotoga maritima
MKLYLIRHGETIWNEKGLWQGVTDVPLNERGREQARKLANSLKRVDAIYSSPLKRSLETAEEIARRFEKEIIVEEDLRECEISLWNGLTVEEAIREYPVEFKKWSSDPNFGMEGLESMRNVQNRVVKAIMKIVSQEKLNGSENVVIVSHSLSLRAFICWILGLPLYLHRNFKLDNASLSVVEIESKPRLVLLNDTCHLKES

SEQ ID NO: 559 - DNA, 660 bp, Clostridium acetobutylicum
  CDS (1)..(660)
atgaaaacaacggttttgctggttagacatggagagactgaatggaatgttcagggaaggtttcagggatgccatgatataaaccttacagataacggaattgaacaagctaagagagttgcaaagcgattagaaggaagttttgattgtgtttatgcaagtccattgaagagagcctttaatactgctaaattaattgcttcgactaaagggattagtccaataatagaagacgacttaagagaaataaattttggactttgggaaggtttaaccattaaggaaatgaaaagtaagtttccgaaggaatttgacatttggagaaatgatactgaggatggacctttgtgtggaggagatttaagtataaaaagagcttcaataagagttgaacatgctgtattaaaaattgtaaatgacaataaaggtaaaaacattgtagtagttgctcatggagggataataaaagcagcgcttatagctctttttaactggaatatggcaatgtatcatagaattttattaggcaatacatctatatgcaaaatagaatttaatgaaaataatatacctaaaatagtaacaattaatgatgtcagccatcttccggaagaatatgcagaaaaggacccgatgcatgataagaaagaaatagtatag

SEQ ID NO: 560 - protein, 219 aa, Clostridium acetobutylicum
MKTTVLLVRHGETEWNVQGRFQGCHDINLTDNGIEQAKRVAKRLEGSFDCVYASPLKRAFNTAKLIASTKGISPIIEDDLREINFGLWEGLTIKEMKSKFPKEFDIWRNDTEDGPLCGGDLSIKRASIRVEHAVLKIVNDNKGKNIVVVAHGGIIKAALIALFNWNMAMYHRILLGNTSICKIEFNENNIPKIVTINDVSHLPEEYAEKDPMHDKKEIV

SEQ ID NO: 561 - DNA, 744 bp, Saccharomyces cerevisiae
  CDS (1)..(744)
atgccaaagttagttttagttagacacggtcaatccgaatggaacgaaaagaacttattcaccggttgggttgatgttaaattgtctgccaagggtcaacaagaagccgctagagccggtgaattgttgaaggaaaagaaggtctacccagacgtcttgtacacttccaagttgtccagagctatccaaactgctaacattgctttggaaaaggctgacagattatggattccagtcaacagatcctggagattgaacgaaagacattacggtgacttacaaggtaaggacaaggctgaaactttgaagaagttcggtgaagaaaaattcaacacctacagaagatccttcgatgttccacctccaccaatcgacgcttcttctccattctctcaaaagggtgatgaaagatacaagtacgttgacccaaatgtcttgccagaaactgaatctttggctttggtcattgacagattgttgccatactggcaagatgtcattgccaaggacttgttgagtggtaagaccgtcatgatcgccgctcacggtaactccttgagaggtttggttaagcacttggaaggtatctctgatgctgacattgctaagttgaacatcccaactggtattccattggtcttcgaattggacgaaaacttgaagccatctaagccatcttactacttggacccagaagctgccgctgctggtgccgctgctgttgccaaccaaggtaagaaataa

SEQ ID NO: 562 - protein, 247 aa, Saccharomyces cerevisiae
MPKLVLVRHGQSEWNEKNLFTGWVDVKLSAKGQQEAARAGELLKEKKVYPDVLYTSKLSRAIQTANIALEKADRLWIPVNRSWRLNERHYGDLQGKDKAETLKKFGEEKFNTYRRSFDVPPPPIDASSPFSQKGDERYKYVDPNVLPETESLALVIDRLLPYWQDVIAKDLLSGKTVMIAAHGNSLRGLVKHLEGISDADIAKLNIPTGIPLVFELDENLKPSKPSYYLDPEAAAAGAAAVANQGKK

SEQ ID NO: 563 - DNA, 1050 bp, Synechocystis sp
  CDS (1)..(1050)
atgaccaaagacgatgtggcccaccaatatcccgaacaatatcgtctctggcacgaagcaccggatcaattggccatgaccgtagatggagcggaatattaccccgttgcggctctctatgcccaggcccaaagattttggcaggatgtgttaaccgatgcggcgggacaaaccctgctgattgtggcccacaatggcatcaatcgttgcctgttaatgagcgccattggtatgcccgcttcccattaccaacgcctgcaacagtccaactgcaatattaatgtgttgaattttagtggtggctggggcgatccggtgcaactggaatccttgaatcaaaccgcccatatgggggtacctctgccacctccccgcaaggataataatcgtctgcggttactgcttatccgccatggggaaacccaatggaatcgggaaggacggttccaaggtattcgggatattcccctcaatgacaatggccgccatcaagcccaaaaagcggcggaattcctcaaagatgtgcccattaacctaggcattagcagtcccatggctcggcccaaggaaacggcggagattattctgcaatatcacccaagcatagagttggatttacagccggaattggcggaaatttgccatggcctgtgggaaggcaagctagaaacggaaattgaagcggaatatcccggattattgcaacagtggaaagatgcccccgccacagtgcagatgccggaaggggaaaatttacaacaggtctgggaccgggcgatcgcctgttggcaggaccgggtcaaattctatagccagggggatggttccacagtgggcattgtggtggcccatgatgccatcaacaaggtgattttggcttatttgttgggtcttactcccgctcacttttggcaagttaaacagggtaatggcggggtgagcgtcattgactatccccagggtctagataagcccccagttattcaagccattaatttgatgggccatttgggcacagtgttggataaaaccgccgccggagccctatag

SEQ ID NO: 564 - protein, 349 aa, Synechocystis sp
MTKDDVAHQYPEQYRLWHEAPDQLAMTVDGAEYYPVAALYAQAQRFWQDVLTDAAGQTLLIVAHNGINRCLLMSAIGMPASHYQRLQQSNCNINVLNFSGGWGDPVQLESLNQTAHMGVPLPPPRKDNNRLRLLLIRHGETQWNREGRFQGIRDIPLNDNGRHQAQKAAEFLKDVPINLGISSPMARPKETAEIILQYHPSIELDLQPELAEICHGLWEGKLETEIEAEYPGLLQQWKDAPATVQMPEGENLQQVWDRAIACWQDRVKFYSQGDGSTVGIVVAHDAINKVILAYLLGLTPAHFWQVKQGNGGVSVIDYPQGLDKPPVIQAINLMGHLGTVLDKTAAGAL

SEQ ID NO: 565 - DNA, 875 bp, Arabidopsis thaliana (mouse-ear cress)
  CDS (30)..(722)
aaagcaattgtcagatttcagcatctcccatggaggaatcaagattcgattctgaagatgttgattatgctgagattgttgttgttcgtcatggtgaaacatcttggaatgccgagagaaaaatccagggtcatttggatgttgagttaaatgatgcaggaagacaacaagcacaaagagttgcagagcggttatcgaaggagcagaagatatctcatgtatactcttctgacttgaagagagcctttgagactgctcagatcattgctgctaaatgcggcaagcttgaggtgcttaccgatcgtgatttgcgggaaagacatttaggagatatgcaagggcttgtgtatcaagaagcttcgaaaattcgcccggaagcttacaaggctttttcatctaaccgcacagacgttgatattccaggtggaggagaaagtcttgacaaactttacgatagatgtacaactgcattacagagaatcggcgacaaacataaaggtgaaaggatagtagtagtgactcatggaggtgtgatccgatctctctacgaaagagctcgtccaagtgcaagaaaagttgaaaagatactcaatacatcggtcaatgtgttccgtttattcgacggagacaaatggaccatccaagtttggggtgatgtgagtcatctggaggaaaccggcttcttacaatcaggttttggtggtgatagaacctctggttagagagattctatactcttagtcttcttccccttggaagagcatttatgtaatttaagtttcactccataacttttcaatttttaacatttgaccccattactttgataaagtgatttgggaggattgataaagtaaattgctataaatttctac

SEQ ID NO: 566 - protein, 230 aa, Arabidopsis thaliana (mouse-ear cress)
MEESRFDSEDVDYAEIVVVRHGETSWNAERKIQGHLDVELNDAGRQQAQRVAERLSKEQKISHVYSSDLKRAFETAQIIAAKCGKLEVLTDRDLRERHLGDMQGLVYQEASKIRPEAYKAFSSNRTDVDIPGGGESLDKLYDRCTTALQRIGDKHKGERIVVVTHGGVIRSLYERARPSARKVEKILNTSVNVFRLFDGDKWTIQVWGDVSHLEETGFLQSGFGGDRTSG

SEQ ID NO: 567 - DNA, 741 bp, Debaryomyces hansenii
  CDS (1)..(741)
atgagcccatctaaagcaccaactccaagagttatatttattcgccacggccaaaccgaatggtcaaaatctggccaatatacgtccattactgatttaccattaacagatttcggagtcaaacagatgcggaatactggtaaacacttaattgggcctagtccattccaattgatcaaaccggaaaacttgaagaatgtctttacatctccaagattgcgtgccaagcaaacggttgagttgttgctcgaagggttgaacgatatggcaaaggccaagttgcttaccaccgaggaagataacttaagagagtgggaatacggtgattacgaaggattattgacgtcccagattattgaattaagaaacaagagaggtttggataaggatttacctaaaggtgaagaatggaacatttggagggacgggtgtgaaaacggtgaaacgcacgagcaagtttccgcaagattggacaaggttatcacgaacatcagagctatccacgaaaaggcgattcaagataatgttccttgcgatgtcatagttgttggacatggtcatatcttgagatgttttgctgctagatgggtgggtaaagacattaatgtcaatccgcaagtcgtgttggatgctggtggagttggagttttgagctatcaacaccataatattcacgagcctgctttatgcttagctggagcatttgttgtcccagttgaagaggaagggtctgatatataa

SEQ ID NO: 568 - protein, 246 aa, Debaryomyces hansenii
MSPSKAPTPRVIFIRHGQTEWSKSGQYTSITDLPLTDFGVKQMRNTGKHLIGPSPFQLIKPENLKNVFTSPRLRAKQTVELLLEGLNDMAKAKLLTTEEDNLREWEYGDYEGLLTSQIIELRNKRGLDKDLPKGEEWNIWRDGCENGETHEQVSARLDKVITNIRAIHEKAIQDNVPCDVIVVGHGHILRCFAARWVGKDINVNPQVVLDAGGVGVLSYQHHNIHEPALCLAGAFVVPVEEEGSDI

SEQ ID NO: 569 - DNA, 741 bp, Yarrowia lipolytica
  CDS (1)..(741)
atggcccctcgagttatctttgtacgacacggcgagaccgaatggtcaaagtccggccaacacacgtcggtgactgatctgccattgactgagaacggagtcaagcgagtgcgagcgacgggacgggcgctggtgggccgaaaccggctggtgaacccggcgtacgtggagcacatttttgtttcgccccgatctcgtgcccagcagacgctcaagctcttttttgaggacgagcccgaggctctcgccaagatcccccagaccgtgaccgaagacattcgagagtgggactacggcaagtacgagggccgaaagtcagccgaaatccgggccgaccgaaccgcgcgaggcatcgacaaggacggccacaagtggaacatttggtccgacggctgcgaggacggagagtcgccccaacaggtgcagaagcgagtggacgagctcatcaaggagatccgggtgatccacaagaaggcgctcgacgagggcaaggagcattgcgacgtcatggtgttcgcacacggccacatcctgcgagtctttgctctgcgatgggtcaacggagacatcaccatcaacccggctctgattctcgaggcaggaggagtcggtgtgctgtcttacgagcataacaacattgaggagccagccatttacctgggaggagccttctttgtgcccgacgaggatgtggagaagaacagcggagtcattgcgctggctgggggagagcagaactag

SEQ ID NO: 570 - protein, 246 aa, Yarrowia lipolytica
MAPRVIFVRHGETEWSKSGQHTSVTDLPLTENGVKRVRATGRALVGRNRLVNPAYVEHIFVSPRSRAQQTLKLFFEDEPEALAKIPQTVTEDIREWDYGKYEGRKSAEIRADRTARGIDKDGHKWNIWSDGCEDGESPQQVQKRVDELIKEIRVIHKKALDEGKEHCDVMVFAHGHILRVFALRWVNGDITINPALILEAGGVGVLSYEHNNIEEPAIYLGGAFFVPDEDVEKNSGVIALAGGEQN

SEQ ID NO: 571 - DNA, 816 bp, Kluyveromyces lactis
  CDS (1)..(816)
atgtctaaagttactccccgttgtattatcgtccgtcatggacaaactgaatggtcaaaatccggtcaatataccggattaactgatattccgttgactccatatggtgttgaacagatgagaagaactggtaaatgcgtctttggtaacaagttcattgacccaaaccatatcacatacattttcacttctcctcgtcaacgtgctagaaagactgttgatttaattttggaatcccttactgaagaacaacgttcaaagatcagaatcgtagtcgataacgatctaagagaatgggaatatggtgattacgagggtctgttgacccatgaaattgtcaaattgagaaaatcccgtggtttggatcaagaaaggccttggaacatctggcgtgatggttgtgaaaacggtgaaagcaccaagcaaatcggttgtagactttcccgtgtcatttccagaattcaaaacctacatcgccaacaacagaaagacggagtaccaagtgatatcttggtgtttgcacatggccatgcattacgttatttcgcatccttgtggatcaaacatggattagaagaaaaatatgaaccatcattcgatccaccaaaacctacttataacgatgagactgttcctaatgtaacaatggaaaagtacagatacttggttgataatccaaacttcttgttggatgctggtggtatgggagttctttcttatgcacaccataatattgacgaacctgctctagcgttggccggaacatttattgccccaccagaggaagaatctcaacatgaaccggtagttgaataa

SEQ ID NO: 572 - protein, 271 aa, Kluyveromyces lactis
MSKVTPRCIIVRHGQTEWSKSGQYTGLTDIPLTPYGVEQMRRTGKCVFGNKFIDPNHITYIFTSPRQRARKTVDLILESLTEEQRSKIRIVVDNDLREWEYGDYEGLLTHEIVKLRKSRGLDQERPWNIWRDGCENGESTKQIGCRLSRVISRIQNLHRQQQKDGVPSDILVFAHGHALRYFASLWIKHGLEEKYEPSFDPPKPTYNDETVPNVTMEKYRYLVDNPNFLLDAGGMGVLSYAHHNIDEPALALAGTFIAPPEEESQHEPVVE

SEQ ID NO: 573 - DNA, 687 bp, Kluyveromyces lactis
  CDS (1)..(687)
atgaccgctgatataccgtactatgagtcaaataacgataaaaacgtgctacgtctgtttgtcattagacatggtcaaactgaagaaaatttgaagaagatattgcaaggtcatatggacaccgagctgaacgaaacaggacaggatcaagcatccaaactgggggaatatttggctaatgatagacatttgaaatttgataaaatatacagtagtgatttgaaacgttgccaacaaaccatcaacacagctcttgaacatttcaacaccccaactaaattggttactactgataaacttagagaaagatgcatgggggttatagaaggaatgtacctcaaggacgctgaagaatatgctgattcgatgggaaaaccaacttttagagacttcggtgaaccagcggaggagttccagcaaaggttatctaatgtattagaaaacattgtaagtgaaaataaatcgagcaaaaatattggtatagtcagtcatggtggcagcattagacaactattaaagctactcgattataaggagctcaatgtccataaaatcattgttttcaatacctccgtcacgattattgactacatcaagaatgaaaaagcatatgtggtaagacgagtcggtaatacccagcatttgggatccggagagtttatcgtcagcgacttacagctaagataa

SEQ ID NO: 574 - protein, 228 aa, Kluyveromyces lactis
MTADIPYYESNNDKNVLRLFVIRHGQTEENLKKILQGHMDTELNETGQDQASKLGEYLANDRHLKFDKIYSSDLKRCQQTINTALEHFNTPTKLVTTDKLRERCMGVIEGMYLKDAEEYADSMGKPTFRDFGEPAEEFQQRLSNVLENIVSENKSSKNIGIVSHGGSIRQLLKLLDYKELNVHKIIVFNTSVTIIDYIKNEKAYVVRRVGNTQHLGSGEFIVSDLQLR

SEQ ID NO: 575 - DNA, 651 bp, Erwinia carotovora subsp
  CDS (1)..(651)
atgttacaggtatatcttgttcgccacggcgaaacagaatggaatgtggctcgacgtattcaaggccaatctgatagtgcgctgacgccaagaggtgagcaacaggcacaacaggttgctgaacgaatcgggacgttagggattacgcatatttttaccagcgatctcggcagaacgcgccagacgacagaaatcatcgctaaatattgtggtgattgccagataatcctggagcccggcttacgcgaattgaacatgggcgtattggaagctcgcgatctggattcgttgaccgccgaggaagaagggtggcgtaaacggctggtggatggcacacctaatgggcgaatcccggaaggggaatcgatggtggatgtcgcatcacgtatgcacggtgtcttagaacattgtctggcattgcctgctgggagccgcccgttgctggttagtcacggcatggcgctggggtgtttactcagtacggttttggggctaccagcatcggctgagcggcgtctgcgactacgcaactgttccttatcgcgcatcgatcatcagcaaagcccgtggctggcatcgggttgggtggtggaaacggccggagatatttctcatttggatatcccggcactggatgagttacagcgctga

SEQ ID NO: 576 - protein, 216 aa, Erwinia carotovora subsp
MLQVYLVRHGETEWNVARRIQGQSDSALTPRGEQQAQQVAERIGTLGITHIFTSDLGRTRQTTEIIAKYCGDCQIILEPGLRELNMGVLEARDLDSLTAEEEGWRKRLVDGTPNGRIPEGESMVDVASRMHGVLEHCLALPAGSRPLLVSHGMALGCLLSTVLGLPASAERRLRLRNCSLSRIDHQQSPWLASGWVVETAGDISHLDIPALDELQR

SEQ ID NO: 577 - DNA, 840 bp, Candida glabrata
  CDS (1)..(840)
atgggtcacagtccaactcctagatgtattattgtcagacatggccagaccgagtggtctaagtccggtcagtacaccggtttgactgacttgccattgactgactatggtgttggccaaatgctgaggaccggtgagtctatcttctccaacaaccgtttcatcaaccctgaccacatcacatatatcttcacttctccaagaaccagggccaagcagaccattgagttggttttgaagccattgagcgaggagcaaaggtctaagatcaaggttattgttgacaatgacttgagagaatgggagtacggtgactatgaagggctattgaccaaggagattgtcgagctgcgtaagtcccgtggtttggacaaagctcgcccatggaatatctggagagatggctgtgagaacggtgaaactactgaagaagtcggtttgagattgtctagagtcatcgcacgtatccaaaacctgcacaagaagcaccaggaacaaggcataccatctgatatcatggtgtttgctcatggacatgctttgcgttactttgcggccatctggctacgtctaggtgaagagaaagagtgtatcactgctttctctaagcagaaggttaagtcctatgaggaggatgagtctgtggtcccatacgttgagattaccaagttcagacacttggtggacaacccattcttcttacttgacgctggtggtatcggtgtattgtcttatgcccaccacagcattgatgaacccgccttggacctagctggtgcgttcatttccccaccagaggaagagtcccaacacgctccagttccaaacaagaattactga

SEQ ID NO: 578 - protein, 279 aa, Candida glabrata
MGHSPTPRCIIVRHGQTEWSKSGQYTGLTDLPLTDYGVGQMLRTGESIFSNNRFINPDHITYIFTSPRTRAKQTIELVLKPLSEEQRSKIKVIVDNDLREWEYGDYEGLLTKEIVELRKSRGLDKARPWNIWRDGCENGETTEEVGLRLSRVIARIQNLHKKHQEQGIPSDIMVFAHGHALRYFAAIWLRLGEEKECITAFSKQKVKSYEEDESVVPYVEITKFRHLVDNPFFLLDAGGIGVLSYAHHSIDEPALDLAGAFISPPEEESQHAPVPNKNY

SEQ ID NO: 579 - DNA, 744 bp, Candida glabrata
  CDS (1)..(744)
atgccaaagttagttctagttagacacggtcaatccgaatggaatgaaaagaacttgtttaccggttgggtcgacgttagattgtccgccaagggtgaacaagaagccgctagagccggtgaattgttgaaggagaagaacgtccacccagacatcttgtacacttccaagctatccagagctatccaaaccgctaacattgctttgtccaaggctgacagattgtggatcccagtcaagagatcctggagattgaacgaaagacactacggtgctttgcaaggtaaggacaaggctgaaaccttggaaacttacggtgaagagaagttcaacacctggagaagatccttcgatgtcccacctccagtcatcgaagctgactccccatactctcaaaagaacgatgaaagatacagagacgtcgacccaaatgtcttgccacaaactgaatctttggctttggtcattgacagattgttgccatactgggaagatgttatcgccaaggacttgttggctggtaagaccgttatgatcgccgctcacggtaactccttgagaggtttggtcaagcacttggaaggtatctccgatgctgacattgccaagttgaacatcccaactggtattccattggtcttcgaattggacgaaaacttgaagccatccaagccatcttactacttggacccagaagctgctgctgctggtgccgctgccgtcgctgctcaaggtaagaaataa

SEQ ID NO: 580 - protein, 247 aa, Candida glabrata
MPKLVLVRHGQSEWNEKNLFTGWVDVRLSAKGEQEAARAGELLKEKNVHPDILYTSKLSRAIQTANIALSKADRLWIPVKRSWRLNERHYGALQGKDKAETLETYGEEKFNTWRRSFDVPPPVIEADSPYSQKNDERYRDVDPNVLPQTESLALVIDRLLPYWEDVIAKDLLAGKTVMIAAHGNSLRGLVKHLEGISDADIAKLNIPTGIPLVFELDENLKPSKPSYYLDPEAAAAGAAAVAAQGKK

SEQ ID NO: 581 - DNA, 621 bp, Bartonella quintana
  CDS (1)..(621)
atgggacgcacacttgtattaatccgtcatggacaaagtgaatggaatatcaaaaatctttttaccggttggaaagaccccggtttgacagaaaaaggccatgcagaagcaataacagcaggaaaaaatctcaaagcagctggtttaaaatttgatattgcttatacatctgccttacagcgtgcacaaaaaacggctcagcacattttagaacaaatgggacaatcagatttgccattgataaaaaactcggcattgaatgaacgtgattatggtgatctctctgggctaaataaagatgaagtacgtcaacaatggggagaacaacaagtgcaaatatggcgtcgctcctatgctgttgcgccccctaatggagaaagcctacgcgatactggtgcacgtgtttggccctactatctttaccatattcaacctcatattttgcgttctcaaactgttttgattgcagcacatggtaattctcttcgtgctcttattatggcacttgaaggtctaaatagtgaagaaattatatctcaagaattaacaactggcattcctcttatttatacatttaattccgactcaacaatttcatcaaagaccattatcacaccctaa

SEQ ID NO: 582 - protein, 206 aa, Bartonella quintana
MGRTLVLIRHGQSEWNIKNLFTGWKDPGLTEKGHAEAITAGKNLKAAGLKFDIAYTSALQRAQKTAQHILEQMGQSDLPLIKNSALNERDYGDLSGLNKDEVRQQWGEQQVQIWRRSYAVAPPNGESLRDTGARVWPYYLYHIQPHILRSQTVLIAAHGNSLRALIMALEGLNSEEIISQELTTGIPLIYTFNSDSTISSKTIITP

SEQ ID NO: 583 - DNA, 648 bp, Parachlamydia sp
  CDS (1)..(648)
atggtagataaaaatttattttgcgatatttatttaatccggcatggagagacagattggaacatgttaggaaaattacaagggcatattgatatttctcttaacagctcaggtaagattcaagctcggaaccttcaaaagcaactgaatcacattaattttgcagcagctttttcctctgatcttagccgagcgcgtcaaacggcagaaattgttctcgaatcaaaagacattaagatagaggaaacagctgttttaagagagcgacagctaggcgaatgggaaggtcaatcaatagatgacctaaaaaattggttgcaaaagaacagtcaaattgattctttcactcaagaagattttttagcctacaagtgggattcaatatctgaaaactatgcagaagtattcaaccgtttgtctaggcttgttttaaagatctctccattgtacttaggctctacaattttgctgtcttcccacggaggattattacgctcagttctttatcagttggattttaaaagtgaactcagatggcatgtagataattgtggatttattaaaatacgtgccaataatagaggtggaatgactattgcggaatgtcatgggattaagacctcaagagcctcctcttcaacattttga

SEQ ID NO: 584 - protein, 215 aa, Parachlamydia sp
MVDKNLFCDIYLIRHGETDWNMLGKLQGHIDISLNSSGKIQARNLQKQLNHINFAAAFSSDLSRARQTAEIVLESKDIKIEETAVLRERQLGEWEGQSIDDLKNWLQKNSQIDSFTQEDFLAYKWDSISENYAEVFNRLSRLVLKISPLYLGSTILLSSHGGLLRSVLYQLDFKSELRWHVDNCGFIKIRANNRGGMTIAECHGIKTSRASSSTF

SEQ ID NO: 585 - DNA, 636 bp, Listeria monocytogenes
  CDS (1)..(636)
atggcagaaggtttacgtacaatttattttgtaagacatggtaagacggaatggaatatgactggacaaatgcagggatggggcgattcgccgctagttgcagaaggtattgacggggcaaaagcagttggcgaagtgttgaaagatacaccaattgatgcggtttatacaagtacaagtaaacgcacgcaagataccgcggcttacattcttggcgaccgcgaaatcgaaattcaacctctggaagaactaaaagaaatgggatttggaacgtgggaaggcattagagtaactgaaattgacgaacaacaccctgaagaacgcgcaaaaattctccatagcccagaaacctacaaagcagaagtgaacggcggcgagacttattatgaacttgcagaacgactgttagaaggcgtcgaaaaaatcattgcagaaaatctaagcggcaacattctcgtcgtttctcacggcatgtcgctcacgttattattatacttgctgcaaggcggaacggttgaagatcaccgcaaagaagcgccaagaatcttgaacacaagtattagcatcgtagaataccaaaacggcgaattttctcttaaaaaaatcaatgaaatcggtcatttagacttaaaataa

SEQ ID NO: 586 - protein, 211 aa, Listeria monocytogenes
MAEGLRTIYFVRHGKTEWNMTGQMQGWGDSPLVAEGIDGAKAVGEVLKDTPIDAVYTSTSKRTQDTAAYILGDREIEIQPLEELKEMGFGTWEGIRVTEIDEQHPEERAKILHSPETYKAEVNGGETYYELAERLLEGVEKIIAENLSGNILVVSHGMSLTLLLYLLQGGTVEDHRKEAPRILNTSISIVEYQNGEFSLKKINEIGHLDLK

SEQ ID NO: 587 - DNA, 633 bp, Thermus thermophilus
  CDS (1)..(633)
atgaaggagatctggtacgtccgccacggggagacggagtggaacgcccagcggcgcttccaggggcacctggacgtccccctctcccccgtgggtatcgggcaggccttccgcctcgccgagcgcctcagccgcagccgcataagctttgaccgcctctacgcctcggatctgcggcgggcccgccagaccgccgagcccctcgcccaggtcctcggcctccccatcgccaccacgccccttctccgggagatccacgtgggcgagctcgccggcctgacccgggccgaggccgaggcccggtttcccagcttcttggcggaagcggccaaggacccctggaacgcccgcaggcccggtggagagagcatggccgacctggcccgaaggcttcaggcctttctggaagaggtgccgcccggccgccacctcgtggtcacccacggcggcgtcatccgcgccgccctcaagctcgccctagacctcgccggggacacctggcgccgcttccacatccaaaacacctccatcacccggatcctctacccggaaaacgccgtgctcaccgtggcggacgccgcccacctggaagtgtgggccgactggctcagcgacgaggatctaaaaggataa

SEQ ID NO: 588 - protein, 210 aa, Thermus thermophilus
MKEIWYVRHGETEWNAQRRFQGHLDVPLSPVGIGQAFRLAERLSRSRISFDRLYASDLRRARQTAEPLAQVLGLPIATTPLLREIHVGELAGLTRAEAEARFPSFLAEAAKDPWNARRPGGESMADLARRLQAFLEEVPPGRHLVVTHGGVIRAALKLALDLAGDTWRRFHIQNTSITRILYPENAVLTVADAAHLEVWADWLSDEDLKG

SEQ ID NO: 589 - DNA, 654 bp, Mycobacterium paratuberculosis
  CDS (1)..(654)
atggcatgttcgcccgccagacgcttgggcccagcggccccagcatgtcgtccggcagaatcactgcacatgggcttgcacaaccaccgtctggtgctgctgcgccacggcgagaccgagtggtcgaaaacgggtcggcacaccggccgcaccgaggtggagctgaccgaggccggccggacgcaggccgagcgcgccggccgggcgctgagcgagctgaaactcgttgagccactggtgatcagcagcccgcggcaacgctcgctggccaccgcggagctggccgggctgaacgtcgacgaggtgtccgagcagctcgcggaatgggattacggctcctacgagggcctgaccactgagcagatccgccagtcggtgcccgactggctggtgtggacgcacggctgtcctggcggcgagagcgtcgcgcaggtcagcggtcgcgccgacgcggccgtcaccgcggcgctgcggcagatggagtcgcgcgacgtggtcttcgtcagccacggccacttctgcagggcggtgatgacacgctgggtggaattgccgctcgccgaaggcagccgcttcgccatgatcaccgcgtcgatcgcggtctgcggattcgagcacggggtgcggcaactgcgggcgctcgggttgacgtga

SEQ ID NO: 590 - protein, 217 aa, Mycobacterium paratuberculosis
MACSPARRLGPAAPACRPAESLHMGLHNHRLVLLRHGETEWSKTGRHTGRTEVELTEAGRTQAERAGRALSELKLVEPLVISSPRQRSLATAELAGLNVDEVSEQLAEWDYGSYEGLTTEQIRQSVPDWLVWTHGCPGGESVAQVSGRADAAVTAALRQMESRDVVFVSHGHFCRAVMTRWVELPLAEGSRFAMITASIAVCGFEHGVRQLRALGLT

SEQ ID NO: 591 - DNA, 1134 bp, Mycobacterium paratuberculosis
  CDS (1)..(1134)
atgaaggtcgtcatcgaagccgacgggggatcgcgcggcaaccccggcccggccgggtacggcgccgtggtgtggacaccggaccgcggcaccgtgctggccgagaacaagcaggccatcgggcgggccaccaacaacgtcgccgaatatcgcggcctgctagccggtttgggcgacgcgctgaagctgggcgccaccgaggccgaggtctacctggattccaaactgttggtggagcagatgtcggggcggtggaaggtcaaacaccccgacctgatcgagctgcacgcccaggcccgaagcctggccgcgcgattcgacaggatcagctacacgtggatcccccgcgagcgcaactcgcacgccgaccggctggccaacgaggcgatggacgcggccgccgcggccaccggcacggcggaaaagcccgggccggccgaacaatccgatccgaccgccgccgacgccgggaaaaccgccgcggcgccgtcacccgcggcgcccgggtggaccggcgcgcgcggcaccccgacccggctgctgttgctgcgacacgggcagaccgaattgtcggtgcagcggcgctattccgggcgcggcaaccccgcactcaccgagacgggacggcggcaggccgacgcggcggcacgctatctggccgcgcgcggcgggatttcggcggtgttcgcctccccgctgcaacgggcctacgacaccgcggcggtcgtcgccaaggcgctgggcctggacgtgaccgtcgacgacgacctgatcgaaaccgatttcggggcctgggaggggttgacgttcggcgaggccgccgagcgcgaccccggactgcaccggcgctggctgcgtgacaccagcaccgccccgcccggcggggagagcttcgactcggcggccgagcgggtgtcgcgggttcgccagaagatcatcgccgcacagcagggcagcaccgtgctggtggtgtcgcacgtgacgccgatcaagatgctgctgcgggaggcgctggacgccgggccgggcatcctgtaccggttgcatctcgacctcgcctcgctgagcatcgccgagttctattccgacggagccgcttcggtgcggctggtcaaccagaccggatacctgtag

SEQ ID NO: 592 - protein, 377 aa, Mycobacterium paratuberculosis
MKVVIEADGGSRGNPGPAGYGAVVWTPDRGTVLAENKQAIGRATNNVAEYRGLLAGLGDALKLGATEAEVYLDSKLLVEQMSGRWKVKHPDLIELHAQARSLAARFDRISYTWIPRERNSHADRLANEAMDAAAAATGTAEKPGPAEQSDPTAADAGKTAAAPSPAAPGWTGARGTPTRLLLLRHGQTELSVQRRYSGRGNPALTETGRRQADAAARYLAARGGISAVFASPLQRAYDTAAVVAKALGLDVTVDDDLIETDFGAWEGLTFGEAAERDPGLHRRWLRDTSTAPPGGESFDSAAERVSRVRQKIIAAQQGSTVLVVSHVTPIKMLLREALDAGPGILYRLHLDLASLSIAEFYSDGAASVRLVNQTGYL

SEQ ID NO: 593 - DNA, 627 bp, Lactobacillus johnsonii
  CDS (1)..(627)
atggatctgttattagtaagacatggggttagtgaacataatacttcagatgtgatctccggcggtactagtaaccctaacttaagccaagcgggtgttaaacaagtagaagaagtaagtaagttaattgacaatagtaaacttgatcgagtatatgcaagcccattaattagagctaaaagaacagcacaaattttaactgattttcaaaaagagattattactgatgatcgacttagagaaatgaattttggctcttgggacggccaacatgccgaagagctgaagataaaatatcctgatgccttcgatgatttaggaactattaatagtaaatatgcagaatacgctgaaaatggtgaaacttttagtcaagtagcagatcgagttgaagaatttttatctgagattcaacccgatgctaatgacaagacaattatgattgtttgtcacggatttgtgattaggagtttaatagctcggtggtttaaactaaaaattgaagatgtaatgacagtaagaaatgttagttttactgagcttcattttgaaaaaaatgatattgagcgaccaagattaatgacctttaatcggacggaacccttgtattacggaattaagaggtga

SEQ ID NO: 594 - protein, 208 aa, Lactobacillus johnsonii
MDLLLVRHGVSEHNTSDVISGGTSNPNLSQAGVKQVEEVSKLIDNSKLDRVYASPLIRAKRTAQILTDFQKEIITDDRLREMNFGSWDGQHAEELKIKYPDAFDDLGTINSKYAEYAENGETFSQVADRVEEFLSEIQPDANDKTIMIVCHGFVIRSLIARWFKLKIEDVMTVRNVSFTELHFEKNDIERPRLMTFNRTEPLYYGIKR

SEQ ID NO: 595 - DNA, 807 bp, Ashbya gossypii
  CDS (1)..(807)
atggcgaagacgcataccccccgttgcattgtgatccgtcacggacagactgaatggtcaaaatcaggtcaatacacaggcttgacagaccttccgctgaccgaatatggtgtcggccagatgcggcgcactggtgctgcgatatttagcgcaaaatacattgatcctgcgcacataacatacgtatttacttctccacgccaacgcgcgcggaagactgtggacctggttttggaaagcctcagtgaagatgaacgtgcacgcatccaggtggtggtcgacgaggacctacgggagtgggagtacggtgactacgaaggtctgctgacaagccagattatcgaattgcgtcgtagccgtggcttggactgcaagcgcccatggaatatatggcgcgacggctgcgagaacggcgagagcacccagcaggtgggcctgaggctatcacgagtgattgcccggatccaggcattacaccggcagcaccaagctgagggacggccgagcgatattctggtgtttgcgcatggccatgctctccgttatttttctgcgctctggatgaagatgggcgtcgaagcgccgacgccagactgcgccatgccctcgagtaaccggaatgacgattccgtgcccttggtgcggctggagcaattccggtacctgcaggacaaccccaacttcttgctagacgcaggtggcatcggtgtgttgtcgtacgcacaccacaatattgacgagccagctctagctctcgctggcgctttcgtttgccccccacaggaggaatcacagcacgacgggtaa

SEQ ID NO: 596 - protein, 268 aa, Ashbya gossypii
MAKTHTPRCIVIRHGQTEWSKSGQYTGLTDLPLTEYGVGQMRRTGAAIFSAKYIDPAHITYVFTSPRQRARKTVDLVLESLSEDERARIQVVVDEDLREWEYGDYEGLLTSQIIELRRSRGLDCKRPWNIWRDGCENGESTQQVGLRLSRVIARIQALHRQHQAEGRPSDILVFAHGHALRYFSALWMKMGVEAPTPDCAMPSSNRNDDSVPLVRLEQFRYLQDNPNFLLDAGGIGVLSYAHHNIDEPALALAGAFVCPPQEESQHDG

SEQ ID NO: 597 - DNA, 687 bp, Mycobacterium tuberculosis
  CDS (1)..(687)
atgtcatcctggcatgctgctcgcacagtggttcgggcgacaggcctaggatgtcgtcgggcacaatctgtcggtatgggcgtgcgcaaccaccgattgctactgctccgccacggcgagaccgcttggtcgacgctgggccggcacaccggcggtaccgaggtcgagctgaccgataccgggcgaacgcaggcagagctggctggtcagctgctgggtgaactcgaacttgacgacccgattgtcatctgtagcccgcgtcgacggacgttggatactgccaagttggccggcctgacggtgaatgaggtaactgggctgctcgccgaatgggattacggttcctatgagggccttacgacgccgcagatccgggaatccgaacccgattggctggtgtggacgcacggctgcccagctggagaaagcgtcgcacaggtaaacgatcgcgctgacagcgccgtcgcgctggccctggagcacatgtcctcacgcgacgtgttgtttgtcagccatggccacttctcccgcgcggtgatcacgcgctgggtccagctaccgctcgccgaaggcagccgtttcgcgatgcccaccgcctcgatcgggatctgcgggttcgagcacggcgtgcgtcagctcgccgtgctcgggttgaccggtcatccgcagccgatcgcagccgggtga

SEQ ID NO: 598 - protein, 228 aa, Mycobacterium tuberculosis
MSSWHAARTVVRATGLGCRRAQSVGMGVRNHRLLLLRHGETAWSTLGRHTGGTEVELTDTGRTQAELAGQLLGELELDDPIVICSPRRRTLDTAKLAGLTVNEVTGLLAEWDYGSYEGLTTPQIRESEPDWLVWTHGCPAGESVAQVNDRADSAVALALEHMSSRDVLFVSHGHFSRAVITRWVQLPLAEGSRFAMPTASIGICGFEHGVRQLAVLGLTGHPQPIAAG

SEQ ID NO: 599 - DNA, 618 bp, Photorhabdus luminescens
  CDS (1)..(618)
atgcgactatttttggttcggcacggtcagacggaagcgaatctgagtggtgttttctgtggtatgacggatgtggagctgactgaaacggggataaatcaggctcggcaagttgcccgttatctatcggcagtaacattttcgcaagcgataagcagcgcgttacggcgggcgcgtcatactgcggagattattctggccggtcattcgttatcagctaatattgatacacaactcaatgagatgcatttcggcgcatgggaaatgcgccatcaccgtgatttgcaacatgaagacgcagaagcttgggctgcttggttagccgattggcaacaggcatccccgactggcggtgaaactttctcagcatttgcggccaggatagagaacgtggttcagcaactgttgacaccagaaagtcaggataatctgttgctggttgctcatcagggagtattgggcttgttactggcgcgtctgttggctataccgcctgctgctatgtggcactttcattttgaacaaggaacatacagtgtcgtggaaatccaacatggatttactaccttgcgaacatttaataaccggactgactggcagcttgagacacggaaataa

SEQ ID NO: 600 - protein, 205 aa, Photorhabdus luminescens
MRLFLVRHGQTEANLSGVFCGMTDVELTETGINQARQVARYLSAVTFSQAISSALRRARHTAEIILAGHSLSANIDTQLNEMHFGAWEMRHHRDLQHEDAEAWAAWLADWQQASPTGGETFSAFAARIENVVQQLLTPESQDNLLLVAHQGVLGLLLARLLAIPPAAMWHFHFEQGTYSVVEIQHGFTTLRTFNNRTDWQLETRK

SEQ ID NO: 601 - DNA, 588 bp, Anopheles gambiae str
  CDS (1)..(588)
atgtcccgtaccctctatctgctgcgccacggccagacccgttacaacgccgaactgcggctgcaggggcgctgcaactccgaactgaccgccaagggcgaagcccaggccctcgccatgggggcccgtctggtcaagctgctggcggagcccgctgactggaccctttacgccagccccctcggccgggcgcgccagaccgcggagcgggtatgccagcaacttggcatggaccaagagcgtatcgtctgggacgagcggctggtggagctggggatgggggagtgggagagtcgccgggtgcccgagctgctggcggcccaccccgagctcgatctggagcagccagactggtatctgcaagcccccgagggggagagttttcagagcattcaaggccgggcgctgagctggctgcaggatgagcgtatcgccgagcgtgccatcgtggtctctcacggtctgttcggcgccatgctgcgcggcgcctatgcggatctggactacaccaccacctggctgcaggagttgccgcaggatgccttcttcaaactgagcggcggccgtatcgagcggatcccctgctga

SEQ ID NO: 602 - protein, 195 aa, Anopheles gambiae str
MSRTLYLLRHGQTRYNAELRLQGRCNSELTAKGEAQALAMGARLVKLLAEPADWTLYASPLGRARQTAERVCQQLGMDQERIVWDERLVELGMGEWESRRVPELLAAHPELDLEQPDWYLQAPEGESFQSIQGRALSWLQDERIAERAIVVSHGLFGAMLRGAYADLDYTTTWLQELPQDAFFKLSGGRIERIPC

SEQ ID NO: 603 - DNA, 3762 bp, Neurospora crassa
  CDS (1)..(3762)
atgtcagctaccgctcccaagatcatcacgatagggtatgcccacgaagccctggacagaaacatcaatcttcgcaaagacatcgggtcggtaaacttggcggtgggcgggaacctagaagccgtgtttgtacagctcaatggtaaacaggctacagcggaatgtgacgtgtgcaagaagagtctaggaccatttgtcggttgtgttcaacacccgagtgttggcgatggttcatgtgcaaattgcctgtataggcgtcagggactcaaatgtacacatcgtgtttcgatggacatcgacagtgacgacctcccgctcattcaaagtcgcaagacgcaggaccccaatgtacacccgccaccttgcaccaagaagaatgtcaaaaagcaaagaaggaccatcgaaactgagacggctagtcatactgaggcagagccgccaattcatggccccggcacagcgcttggttcggctgcagaccactggctaaaaagtctagccttcagcaagtacgcttccccagctcccactcaaggagaaaaagcgaacaacgactatgcgcctaacccgggacacttcgaaaacgggaactatacgtctagctctggactcctcgagaacaacaactacactctgagccaagcacctgcggtcatgggaggcaacgactacgcccccagcccgatgccgttcaaaggaaccatgaatgacattctcgaccacgatgccagcaagccgatgcttgcgtacctgcccaaaaatgtttcccccgaggtgttgcgctccatagctcaataccaccaggaccttgcggacgacctccgcatggaagccaagaggcttgagaaggagatgcgacaagagcgcgagcgtgagcgtgagcaccgtgtgagagagcatttggtttcagtgcgcggcactcctcctcttcctctaaaagtccccaaacctttccagcttagcaattctgccactaagcatacccatctccaacaccccacaagctttatgccatacaaatggcatatgttaatggcttcagacgatgaaaatttcgtggacgctactatttggaatagtggcttgaatgtcccgcgcatagaaattttggcagacgaaatcgctggatttgtgtcagcccgccggcccgctaagaggaagcgtgacaaaatggatatccaagacaatctccaggatccctcacagacctccacgaaagaaaaccacgatgataacgccaagttttcaagggactggaagccaccacaggggatcatcacagacaaggacctcgaagagatttatgcaagccttggttcaagcaatacgaagattaaggaactgagaaaacgcaaggcagtgcgcgagatcgctttacggaaaagcgttgacacaatagaccttaccgaaaagcaccagctccgagcagcttatcttcagcttacgggtcaacaagctcagaatccctgtaaggaatgcaaagctggcaaagggcgcttcgaggtttgcgtctacggtgatggcaacagatgtggcaactgctgtcaccgcggcagcggcaacgctcgctgctcttttcagataaccgggaaagaaaatactgaagctaccaatgaatccccacatcacgcagacgtagatgcgccggtaccgaataccaaatcagtgccggacttgctctctgaacctggaatcgggacagggcttgaacatcatccagagccggagccggaaccccagaagggcggacgagaactaagaccacggccgccacagccaccacggccgccacggcgcaatagaaaactgccacaaagagatcaggatactagagtgacagaaactgccacagttggccgaaatcaagaacctgacacacccctcggccctccacccgcaacaacagagacaacaacgacagcagcagcagcagcagcagcagcagcagcagcagcagcagcagcaacaccaaggcaagaactaccatcagatgttcacgaagcacaactccctgctgccgtaggatcagtgggtaacgtacaaacttcccgcgaacgatgcgaatgcaggccgagagacacccgccccgaaagacaggaggaaaccgatgacaccacgggcctacagggtaccaaaacccaagacaggtcggcgatggcattgtggcaaggtgaagagcgacaggacactggcaaggacaaagatacaagagcgtttggcagggctgccgttagtgaagatgatgcgggcccttcttccattctcgcatgtctcggagattctcctatggagacgctgcggcgcctaggactgcattatcaggttcaggcggatgagttgaggctggagtgcatgaggattgatcgggaggagagaacgaggagacaaaaggagcgcgagagggagtgggagcgggaaagaggaggaagagaagatggcggctggactgacaagatgggtgatcatgtgtcttactcagaatacagaactaatacacaacccaacattggactgtattgtaaaattcaagatctctcaaagtatccgtgcagccccatgcttgaccgagacatagccgagaacagttttacgtgctccgtacgcgacggtgtgcgtagcgaagacccgtgtattgttacattttacccatccatgcacgctgcgtattgtaacgaatatcctacactgggaaaacttacgtaccgagcgctgaaaagttctggtgcgcactggcgtagtgctgctcgggatgattcccattcgtcgaattacctggctattgagaaatcgtcagatcggcaaagataccgagggtgcaatgtcattgtgaaaactccctttaccccggctgttccggcagtttcattgttgagcaacgtttcactacctctatcaattgtttacttcacccttccgccactcctcacgttattcccatcaaggccaagcaacccaggtcaaattcaagttccaccttcgacaactcagcgctcggaagtagcaaggatgtcaacaccccgggtattcattatcagacatggcgagaccgcatggtctattgatggccgtcacactggctcgaccgacattccgttgacagcgaatggcgagaagcgcgtcaaggcgacgggaaaagcgctcataggtgatgaccgcctgattgttcccaagaagctggcccatatatacgtatctccccgaaaaagagcccagcgtacctttgagcttctaaacctcggtatcaaaggtccgctgccatggcaacgtcatggcgagtgcgaatccaagccagttccatgcgatgccgaggttgaagtcaccgaggacatccgcgagtgggattatggtgaatacgaaggtatcactagtccgcaaattagggagaagaggaagcaacaaggtcttgatcccaactgggatatttggagggatggatgccctggaggagagaaaaatctcgtctgcaggagtcccgcagatgtcaacgagcgctgcgatcgtctcatcaaagatattcgggagaggtttcacgctcccgcgctcaataagccaaagggagatcctgatgcggaacgcgccgatgtgttgattgttgcccatggacacatccttcgtgcgtttgcacagcgatggactgggctgtctctgcacgagggaccttcgtttttgctggaagctggcggtgttggtaccttaagtgctttccatgttgatcttgaggatctagatgatgcgaagttggataagctggagaagatgtaa

SEQ ID NO: 604 - protein, 1253 aa, Neurospora crassa
MSATAPKIITIGYAHEALDRNINLRKDIGSVNLAVGGNLEAVFVQLNGKQATAECDVCKKSLGPFVGCVQHPSVGDGSCANCLYRRQGLKCTHRVSMDIDSDDLPLIQSRKTQDPNVHPPPCTKKNVKKQRRTIETETASHTEAEPPIHGPGTALGSAADHWLKSLAFSKYASPAPTQGEKANNDYAPNPGHFENGNYTSSSGLLENNNYTLSQAPAVMGGNDYAPSPMPFKGTMNDILDHDASKPMLAYLPKNVSPEVLRSIAQYHQDLADDLRMEAKRLEKEMRQEREREREHRVREHLVSVRGTPPLPLKVPKPFQLSNSATKHTHLQHPTSFMPYKWHMLMASDDENFVDATIWNSGLNVPRIEILADEIAGFVSARRPAKRKRDKMDIQDNLQDPSQTSTKENHDDNAKFSRDWKPPQGIITDKDLEEIYASLGSSNTKIKELRKRKAVREIALRKSVDTIDLTEKHQLRAAYLQLTGQQAQNPCKECKAGKGRFEVCVYGDGNRCGNCCHRGSGNARCSFQITGKENTEATNESPHHADVDAPVPNTKSVPDLLSEPGIGTGLEHHPEPEPEPQKGGRELRPRPPQPPRPPRRNRKLPQRDQDTRVTETATVGRNQEPDTPLGPPPATTETTTTAAAAAAAAAAAAAAATPRQELPSDVHEAQLPAAVGSVGNVQTSRERCECRPRDTRPERQEETDDTTGLQGTKTQDRSAMALWQGEERQDTGKDKDTRAFGRAAVSEDDAGPSSILACLGDSPMETLRRLGLHYQVQADELRLECMRIDREERTRRQKEREREWERERGGREDGGWTDKMGDHVSYSEYRTNTQPNIGLYCKIQDLSKYPCSPMLDRDIAENSFTCSVRDGVRSEDPCIVTFYPSMHAAYCNEYPTLGKLTYRALKSSGAHWRSAARDDSHSSNYLAIEKSSDRQRYRGCNVIVKTPFTPAVPAVSLLSNVSLPLSIVYFTLPPLLTLFPSRPSNPGQIQVPPSTTQRSEVARMSTPRVFIIRHGETAWSIDGRHTGSTDIPLTANGEKRVKATGKALIGDDRLIVPKKLAHIYVSPRKRAQRTFELLNLGIKGPLPWQRHGECESKPVPCDAEVEVTEDIREWDYGEYEGITSPQIREKRKQQGLDPNWDIWRDGCPGGEKNLVCRSPADVNERCDRLIKDIRERFHAPALNKPKGDPDAERADVLIVAHGHILRAFAQRWTGLSLHEGPSFLLEAGGVGTLSAFHVDLEDLDDAKLDKLEKM

SEQ ID NO: 605 - DNA, 567 bp, Synechococcus sp
  CDS (1)..(567)
atgcgccatggggcaacggaatgggctctcaatgggcggcacaccggcagcacagacctgccgctgcagcccgagggtgaagcggaagcctgcgccctcagcccggtcctcagccagcagacatttgcagtggtgttcagctctcccctccaacgggcacaacgcacctgcgagctggccgggctcggcgatcagatgcagatctacgacgacatcatcgagtggaactacggcgactacgaagggatcacaactgccaagatccgtgaaaccgtcccggactggacggtctggagccacggttgccccaagggtgagaacgctcagcaagttgaagttcgctgcgcaaacgcgatcagcacagcgctggccgtcccaggggacggggatgttgccctgtttgcccatggccacatcctccgggcactggctggaacatggctgggactgggtgccactggcggacaactgctaaggctgggcacagcctccgtcagcatcctgggctgggaacgggaaacccgggccattcagcgttggaataccccatccacagggaacttctag

SEQ ID NO: 606 - protein, 188 aa, Synechococcus sp
MRHGATEWALNGRHTGSTDLPLQPEGEAEACALSPVLSQQTFAVVFSSPLQRAQRTCELAGLGDQMQIYDDIIEWNYGDYEGITTAKIRETVPDWTVWSHGCPKGENAQQVEVRCANAISTALAVPGDGDVALFAHGHILRALAGTWLGLGATGGQLLRLGTASVSILGWERETRAIQRWNTPSTGNF

SEQ ID NO: 607 - DNA, 612 bp, Rhodopirellula baltica
  CDS (1)..(612)
atggagcgccaggtcatgagcgatcagttccctcaaatttatcttgctcgtcatggcgaaacgccgtggacgatcacggggcagcacaccggatcgacagacatgccgctgacacccaaaggcgaacgcaacgccactcaactacaaggtcgactcgaaggcatccgtttcaacgaagtctggaccagtcctttgcagcgagccaaacgaacctgtgaactggcaggttacggcgagcgggcacgcgtcgtcaccgagctggccgaatgggactgcggtgcatacgaagggctcacgagaaatgaaattcaccaaaagcatccagactggaatctttttcgcgatggttgccccaacggcgaatcattgacggacgtggcgacgcgtgtcgatcgagtgatccagcgaatccgtcagcgaaacgacacttgcttgctgttcgctcacaagcactttttgcaagtcttcgccgcctgctgggtggggcttcctccggagactggtcaacgtctgtttctcggtacggcggcgttgagcatcgttggctatcaccacgaccaaagtgattcagtcatccggttgtggaacgaccgaagctatctgactgactaa

SEQ ID NO: 608 - protein, 203 aa, Rhodopirellula baltica
MERQVMSDQFPQIYLARHGETPWTITGQHTGSTDMPLTPKGERNATQLQGRLEGIRFNEVWTSPLQRAKRTCELAGYGERARVVTELAEWDCGAYEGLTRNEIHQKHPDWNLFRDGCPNGESLTDVATRVDRVIQRIRQRNDTCLLFAHKHFLQVFAACWVGLPPETGQRLFLGTAALSIVGYHHDQSDSVIRLWNDRSYLTD

SEQ ID NO: 609 - DNA, 1329 bp, Prochlorococcus marinus subsp
  CDS (1)..(1329)
atgagcattagattaattttagttaggcatgggcttagcagttttaatgaaaaaggcttagttcaaggtaggacagatgattcatatttaaccgataaaggctacgaacaggcacttaaatctggagaggcattatcagggattaattttgacaagatatattcttccccacttgtaagagcagcagagactgcaaagacaattcagaaaaacttaaaaggagaaaataatattatttacgataaaaatttattagaggttgatcttggttcatggtctggtttaactattaatgaaataagaaaaaagtatccagaagactatcttctttggaaaaatgatcctgaaaatttgactttagagagtattcataattcaacgtatcaaccaattaaagaattatatgagcaggcaaatgaatttattaaaagtatttttaaaatctatttagaaaaacaagaagcaaatattttaataattggtcataatgcaatcctaagatgtttaattttattattaattggaaaacctaaaaaaggttttagaaaaataaagttagataatgcctctttttccatccttaatattgtgaagcaaagacattcatataaaacacaaattgaatgtttaaaccaaacttctcatctagataaaagaattcctgatcagattggagactcaagaatatttttaattaggcatggtgaaaccaactggaataaagagggtcgatttcaaggacaaataaatattcctttaaataataatgggaaagatcaggcgggaaaggcctctaaatatttagaagaaattaacttcaacaaagctttttcaagttcaatggatagaccatatgaaacagcacaaataattcttcaaaacaagtcagatttagaaataaaaaagattgaaaatttagtagaaataagccatggattatgggaaggcaaattagaaaatgaaattaagcaacaatggccagaattacttaaaaattggcatgaaaaacctgaagaagtgctaatgcccgagggtgagagtattaaagaagtatctgaaagatcagttaaggcttgggaagaaatatgtttagctcaaaagaataaagatttgaccttgttagtcgcacatgatgcagtaaataaaacccttatttgtaatttattaggaattgatttttctaatatctggatgataaagcaaggtaatggaggtataactgttattgatctttttaaggatcctcaaaaagataatgtaattagtgctttgaatattactacacatcttggtgggatactggactcaacagcatccggggctctttaa

SEQ ID NO: 610 - protein, 442 aa, Prochlorococcus marinus subsp
MSIRLILVRHGLSSFNEKGLVQGRTDDSYLTDKGYEQALKSGEALSGINFDKIYSSPLVRAAETAKTIQKNLKGENNIIYDKNLLEVDLGSWSGLTINEIRKKYPEDYLLWKNDPENLTLESIHNSTYQPIKELYEQANEFIKSIFKIYLEKQEANILIIGHNAILRCLILLLIGKPKKGFRKIKLDNASFSILNIVKQRHSYKTQIECLNQTSHLDKRIPDQIGDSRIFLIRHGETNWNKEGRFQGQINIPLNNNGKDQAGKASKYLEEINFNKAFSSSMDRPYETAQIILQNKSDLEIKKIENLVEISHGLWEGKLENEIKQQWPELLKNWHEKPEEVLMPEGESIKEVSERSVKAWEEICLAQKNKDLTLLVAHDAVNKTLICNLLGIDFSNIWMIKQGNGGITVIDLFKDPQKDNVISALNITTHLGGILDSTASGAL

SEQ ID NO: 611 - DNA, 1332 bp, Prochlorococcus marinus
  CDS (1)..(1332)
atgcccctgcgtcttctcctcgtccgtcatgggctgagcagcttcaaccgcgagcgacggattcagggtcgcagtgatctttccacgctcacctcgcaaggccaagaacaggcccgtcaaactggacaagccctaaaagaaatccaaatcaatgctgtttacagctcccctctgaagcgtgccgcatccacaacaacaaacctactagcaagcaaaggcagtgatctcagaccttgcttcgatgatgggttactggaaatcgacctggctccatggagtggtctctgcagcgatgaggtaaagagcatgttcccagatgcctatcgcacctggaagcaacaaccacaggaattggttctcaagcgagaagacggcaatccctataaacccattggcgagctgatggaacaggctcgtgaattcctacggaaactcattcaacgtcacccaatggagggtgacgaaacagttctggttgtttcgcacaattgcatcctgcgctgcttaatccttgttctccttggtgagccagaccaaggcttgcgacgactgcgcctcgataacgcctcactctcggtgttcaacctgatacccctctcagagcaatcccatcaagcacaagtcgaatgcctcaacagcaccgttcacttgcatcagcaactacccagcaaagggaaggggccgagactgatccttgtgcgccatggtgaaaccgactggaaccaacaaggccggttccaaggccaaatcgacatcccgctgaataaaaatggcttcgcgcaagccgccgcagccggtgcattcctaagcgatgtgttgatcgatcaggcctacagcagttcgatgacccgaccaagacaaacggcggaagccatcctcaagcaccatccagatgtccaactcgaagtcacccaggggctggtggaaattggccatggcctttgggaagggaagctggaatcagacattgaagccggctggcctgaactgctagatgcctggaaaaaagctccgcagacggtgcagatgcccgaaggcgaaaccatccaggatgtatggaagcgttcagtggcctgctggaacaagatcgccaacagcctggctccagaagcaacagcgctcgtggtggctcatgacgctgtcaacaaaacgattctctgccatctactcggaatgaccccggctgatatctgggcagtcaaacaagggaatggaggtgtcacggtggtcgacatcgctacagatcccggccaacctgcagtggtgacctctctcaacctcacctctcaccttggtggtgtgctcgatcgcacagctgctggggcgctctaa

SEQ ID NO: 612 - protein, 443 aa, Prochlorococcus marinus
MPLRLLLVRHGLSSFNRERRIQGRSDLSTLTSQGQEQARQTGQALKEIQINAVYSSPLKRAASTTTNLLASKGSDLRPCFDDGLLEIDLAPWSGLCSDEVKSMFPDAYRTWKQQPQELVLKREDGNPYKPIGELMEQAREFLRKLIQRHPMEGDETVLVVSHNCILRCLILVLLGEPDQGLRRLRLDNASLSVFNLIPLSEQSHQAQVECLNSTVHLHQQLPSKGKGPRLILVRHGETDWNQQGRFQGQIDIPLNKNGFAQAAAAGAFLSDVLIDQAYSSSMTRPRQTAEAILKHHPDVQLEVTQGLVEIGHGLWEGKLESDIEAGWPELLDAWKKAPQTVQMPEGETIQDVWKRSVACWNKIANSLAPEATALVVAHDAVNKTILCHLLGMTPADIWAVKQGNGGVTVVDIATDPGQPAVVTSLNLTSHLGGVLDRTAAGAL

SEQ ID NO: 613 - DNA, 591 bp, Prochlorococcus marinus
  CDS (1)..(591)
atgacatctcgtcaactttggatcatccgccatggggctaccgaatgggcactccaaggccgtcataccggcagcaccgacctccccttgctaccccagggggaagaagaggcgaaggctcttgctcctgtgctcaaaggcgtgacatttgccgctgtgttgtcatctcccctgcaacgagccatacgcacctgtgcgctggctgagcttgaaatacctgctgaaatcatgccggagctgatcgaatggaactacggaaactatgaaggcatcaccacagcagagatccgtcaaaccgttcctgcgtggaccatttgggaccaaggttgtcctggtggcgagcacgctactgccgtgcaagagcgttgtgaacgaattattgaacatgccctcggcatctcaaacaacggtgacatcgttctcttcgcccatggacatatcttgcgagccctgactggcacctggctaggtctcggtgccgcagcaggccgactgttcagactagataccggcagcatttgcattcttggtttcgaaagagagcagcgcgtgatcacacgctggaatgccctctgcactggcacgttctaa

SEQ ID NO: 614 - protein, 196 aa, Prochlorococcus marinus
MTSRQLWIIRHGATEWALQGRHTGSTDLPLLPQGEEEAKALAPVLKGVTFAAVLSSPLQRAIRTCALAELEIPAEIMPELIEWNYGNYEGITTAEIRQTVPAWTIWDQGCPGGEHATAVQERCERIIEHALGISNNGDIVLFAHGHILRALTGTWLGLGAAAGRLFRLDTGSICILGFEREQRVITRWNALCTGTF

SEQ ID NO: 615 - DNA, 618 bp, Streptomyces avermitilis
  CDS (1)..(618)
atggcaccgcgcatcctgctggcccggcatggacagacggaatggtccctgctcgggaagcacaccggcaggacggacattccgctcctcgaagagggccggcgcggcgccaagctgctgggcgaacggctgcaccgggcgcccttcgacgggctcttcgacgccgagatccgtacgagtccgctggcacgcgcgcgtgagacatgcgaactggccggtttcggtgaccgcgccacctcctgggacccgctcatggagtgggactacggggcgtacgagggcatgacgccggccgagatccagaaggtgcggccgggctggttcatctggcgcgacggcgtccccgagggcgagaccctcgcgcaggtctccgcgcgcgcggacgaggtcgtcgcctgggcgcgtgccgaggaccgcgacgtcctggtgttcgcccacgggcacatcctgcgctcgatcggcgcgcggtggctcggcctgccgatcgatttcgccgcgcgtatcaggctcagtccgacgtccctctcggtgctgggatgggcctacggggagcccgcgatcgagagctggaacgatctggggcatctggtgcaccagggcgagcagcggatcgcctga

SEQ ID NO: 616 - protein, 205 aa, Streptomyces avermitilis
MAPRILLARHGQTEWSLLGKHTGRTDIPLLEEGRRGAKLLGERLHRAPFDGLFDAEIRTSPLARARETCELAGFGDRATSWDPLMEWDYGAYEGMTPAEIQKVRPGWFIWRDGVPEGETLAQVSARADEVVAWARAEDRDVLVFAHGHILRSIGARWLGLPIDFAARIRLSPTSLSVLGWAYGEPAIESWNDLGHLVHQGEQRIA

SEQ ID NO: 617 - DNA, 600 bp, Streptomyces avermitilis
  CDS (1)..(600)
atgggtgaccttctcctcgtacggcacggtgagaccgagtggtcggtgtccgggcggcacacggggtcgaccgacattccgctcaccgagaacggacgggagcaggcgcgcaggctggctccgctgatcgcctcgcaccacgtcggggccgcgttcgtcagcccgatgcggcgggcgcgggagacggcgcggctggcggggctcgacggggcgcgcgtcgacgcggacctgagcgagtgggactacggcgggtacgagggggtcacgaccgtcgagatccaccggacccggcccgactggttcctgttcacggacggggtcgagcccggcccgccggagcaccccggggagagtccggaggaggtcggggcgcgcgcggagcgcatgctggccaaggtcgacgcggcgctcgccgacacggagggcagtgtcgtcgtggtctcccacggtcacttcctccgcgtgctggccgcgcggcggctggggctgcccgcctcgggcggcgccctgttccagctcgcgaccggaacggtgagccggctgagcacggagcaccgccgccatgtggtggccagctggaatgtcagaccctcctcgtag

SEQ ID NO: 618 - protein, 199 aa, Streptomyces avermitilis
MGDLLLVRHGETEWSVSGRHTGSTDIPLTENGREQARRLAPLIASHHVGAAFVSPMRRARETARLAGLDGARVDADLSEWDYGGYEGVTTVEIHRTRPDWFLFTDGVEPGPPEHPGESPEEVGARAERMLAKVDAALADTEGSVVVVSHGHFLRVLAARRLGLPASGGALFQLATGTVSRLSTEHRRHVVASWNVRPSS

SEQ ID NO: 619 - DNA, 612 bp, Streptomyces avermitilis
  CDS (1)..(612)
atgggcgacctcatactggtccgccacggcgagaccgagtggagcctgtcgggccggcacaccagccggaccgacctgcccctcacccaccacggtgaggagcaggccaagtccctggcgcccttcttcgccgggcgctcgttcgcccgcgtcctcaccagccccctcgaccgcgcggtgcgcacggcggagctggccgggctgaccggggccgtgaccgaccccgacctgcacgagtgggactacggcgggtacgagggcatcacgaccgtcgagatccaccgcacccggcccgactgggacctgtggaccgacggcgtgccgtcggcctcggacgggtcccgcggtgagtcgccgcaggaggtgggagagcgcgccgaccgtgtgctgtcccgggtggacgcggcgctccggggtgacggagaagacgtggtcctggtggcccacgcccacttcctgcgggtcgtgaccgcgcgccgcctgggcctgcctcccgagcaagggcggctcttccggctcgccaccggcacggtcagccggctgtccaccgaacacggacgtccggtgatcgcgacgtggaacgagtcgggaacttcccacgggcaccactag

SEQ ID NO: 620 - protein, 203 aa, Streptomyces avermitilis
MGDLILVRHGETEWSLSGRHTSRTDLPLTHHGEEQAKSLAPFFAGRSFARVLTSPLDRAVRTAELAGLTGAVTDPDLHEWDYGGYEGITTVEIHRTRPDWDLWTDGVPSASDGSRGESPQEVGERADRVLSRVDAALRGDGEDVVLVAHAHFLRVVTARRLGLPPEQGRLFRLATGTVSRLSTEHGRPVIATWNESGTSHGHH

SEQ ID NO: 621 - DNA, 645 bp, Enterococcus faecalis
  CDS (1)..(645)
atgaaattatattttacacgacatggaaaaactgaatggaatcaacagaaacgatttcaaggaatgacaggagattcgccgttattaccaactagttatgacgaaattaaacaattaggccaatatttacaagatattccgtttgaaaaaatttattctagtccgctattacgtgccaaaaatactgcgcggggaattcaacaagaattgactcatccagttgaaattgtttatacagataccttaaaagaattaggtttaggtcgtctagaaggacaatatattgaagaaatgcgtaatttttatggagaagaattagatcatttacggcatcgtttagatttgtatgatccaacaatttttgatggtgaaccaatcgagcaagcgattcaacggatttcagaaacagttgctgaagcggcgaaacagcacgaaggtccagttctatttgtcggacacggagcagcgctgacggcggcaatccaagcgatggctggtaaaccattatcagaattacggacaatgggcgggctgttaaacaatagcctctcaatccttgaaaccaaagaggcatcaaggaacatgccgtacgacttaacgttatggaatgatacgtcttttttagctaaagaaaaagcacaataa

SEQ ID NO: 622 - protein, 214 aa, Enterococcus faecalis
MKLYFTRHGKTEWNQQKRFQGMTGDSPLLPTSYDEIKQLGQYLQDIPFEKIYSSPLLRAKNTARGIQQELTHPVEIVYTDTLKELGLGRLEGQYIEEMRNFYGEELDHLRHRLDLYDPTIFDGEPIEQAIQRISETVAEAAKQHEGPVLFVGHGAALTAAIQAMAGKPLSELRTMGGLLNNSLSILETKEASRNMPYDLTLWNDTSFLAKEKAQ

SEQ ID NO: 623 - DNA, 666 bp, Lactobacillus plantarum
  CDS (1)..(666)
atgacaaaactattatttgttcgccatgggaaaacagagtggaatcttgaggggcgctatcaaggctctcagggagattcaccattattaccgactagttatcaagaaattcatgaattggcagcggcgctccaggatattcggtttagtcatatctatgtcagtccgttaaaacgggcgcgtgatacagcgatgacactacgtaatgatttgacacaatcagagttacccataacggtactgagtcgtttacgggagttcaatctcggtaagatggaaggaatggccttcacggatgttgaagctacgtatccggccgaattcgacgcgtttcgaaatcatccggatcagtatgacccgacagcgattcagggggagagctttcaacaactgctgaagcggatgactcccgctattaagcaaattgttcaagcaaatccacgtcgcgatgacaatgttttgatcgttagtcatggtgcggccttgaatgccttggtcaactcattactgggagcgacactggcgacgttacggcaacggggtggcttgtcgaatacgtcaacaacaattttagagacgcgtgaccgtggtcaacattttaagctattagattggaatgacacctcatacctatcacggcggcccgatgcaactgatacgatttaa

SEQ ID NO: 624 - protein, 221 aa, Lactobacillus plantarum
MTKLLFVRHGKTEWNLEGRYQGSQGDSPLLPTSYQEIHELAAALQDIRFSHIYVSPLKRARDTAMTLRNDLTQSELPITVLSRLREFNLGKMEGMAFTDVEATYPAEFDAFRNHPDQYDPTAIQGESFQQLLKRMTPAIKQIVQANPRRDDNVLIVSHGAALNALVNSLLGATLATLRQRGGLSNTSTTILETRDRGQHFKLLDWNDTSYLSRRPDATDTI

SEQ ID NO: 625 - DNA, 642 bp, Clostridium tetani
  CDS (1)..(642)
atggaaatgggtataacattatatataactaggcatggacaaactgagtggaacacagaaagaagaatgcaaggatggaatgattcacctttaacaaaattagggatggagcaggcaaagagattaggaaagcgattagataataataatatagatataatttattctagtccattaggaagggctattaaaacagcaaaaatagttagaggagaaagggatatacctattgtatgtgataatagattaaaagagattaaattaggaaaatgggaaggtatgaatcatgaccttatagacaattattataaagaagagatagacaacttttggaataatcctaaactatacaaatctataggaggagagacatttttacagcttagaaacagagttaaagattttttggaggagattctaaaaaagcataaagatgaaactattcttatagtaactcatgctataacattaaaaggtatcatgaactatatagaagatttaactatagataatttttggggagaaccacatataaatcctacaagtctgacaaaggtagagatagaagattcaaatagaagaatattattgaatgcagatatatcccatttagatgaagtgaaagaaataaagatagtatag

SEQ ID NO: 626 - protein, 213 aa, Clostridium tetani
MEMGITLYITRHGQTEWNTERRMQGWNDSPLTKLGMEQAKRLGKRLDNNNIDIIYSSPLGRAIKTAKIVRGERDIPIVCDNRLKEIKLGKWEGMNHDLIDNYYKEEIDNFWNNPKLYKSIGGETFLQLRNRVKDFLEEILKKHKDETILIVTHAITLKGIMNYIEDLTIDNFWGEPHINPTSLTKVEIEDSNRRILLNADISHLDEVKEIKIV

SEQ ID NO: 627 - DNA, 600 bp, Bradyrhizobium japonicum
  CDS (1)..(600)
atgcccgtgcccacgatctactatcttcgccatggcgagaccgagtggaatgcgctcgggcggctccagggcaccagggacgttccgctgaacgcgcgcggccgcagccaggccgtgcaggccggcggcattctcgccgatctgttcaagcgcgacggccgcgacaaggcggcgctgccctatgtgtcgagtccgctcggccgcgcgcgcatgaccatggaacttgcgcgcggcatgctcgaattgcccgtggccgactattcgctcgacgatcgcctgcgcgagatcggctacggcgtctgggaagggctgacgctggccgagagcgaggcgaccgatcccgaaatctatgccaggcgccttgccgacaaatggacggtgggccccgtaggcggggagacctacgccgatgtacaggtccgcgtgcgggcctggtacgatcagctccggaccgacaccgtcgcggtcgcccatggcgggacctgccgggccctgatggtttcgcttggcctggagacgccggccagcgccgccgagctctatatcgagcagggcgccgtctacgtgttccgggacgggcggctggagaagtttagttaa

SEQ ID NO: 628 - protein, 199 aa, Bradyrhizobium japonicum
MPVPTIYYLRHGETEWNALGRLQGTRDVPLNARGRSQAVQAGGILADLFKRDGRDKAALPYVSSPLGRARMTMELARGMLELPVADYSLDDRLREIGYGVWEGLTLAESEATDPEIYARRLADKWTVGPVGGETYADVQVRVRAWYDQLRTDTVAVAHGGTCRALMVSLGLETPASAAELYIEQGAVYVFRDGRLEKFS

SEQ ID NO: 629 - DNA, 1407 bp, Synechococcus elongatus
  CDS (1)..(1407)
atggcacagtgggatggccaagtttgttgtctgtcaatcgctaaggagaaacctctgagtacccgagtcattattgtccgccacggtgaaagcacgtttaatgtccaagagcgggtgcaaggtcacagtgatgcctcgttgctcacggagcggggtcgttggatggcagcccaggtgggtctagcgctgcggggtattcctattcgcaaaatttacaccagtcccctgaaacgggcacaggaaaccgcagaggttatccatgctcagctccaaaaccccgaactcaagccaccccatgcccttgatctcctcaaagagattgccctgccagcttgggaagatctcccctttgccgaagtgaaggcacagttcccagaggactatcgccgctggcaggaagccccagaaaccttgatgatgaaaatcaccacagaaagtggccaaacgaaggagtttttcccgctactggatctctacgatcgcgcgggcatggtcttggaaacgctgctagcggctcacgccaatgaaacgattgtcattgtgggtcacagtggcatgaaccgtgccctgatctgcacgggcctcggcttgggggtcaagggttacctgcggctccagcaggccaatggtggcattagtgtcttaaatttcagcaatggcctgcggcaacctgctcaactggaagcgctcaatctcactagccatcttaatgatccttttccacagccccgcttcaaggaacaaacgctgcgggtctttcttgtccgccacggtgaaacggactggaaccgcgaaggacgcttccaagggcaaattgatgtgcccctcaatgaaaatggccgtgcccaagcagcggcggtggctgagtttctcaaggatgtccccttccaccatgccgtgagcagtcccctgctgcgtcccaaggatacggccttggcgattttgcagtatcacccccatgtgcagctggagttagagccagcccttgcagagattagccatggggactgggagggcaagtttgaacctgaggtggaggcggcctaccccggtgaactggaacgttggcggacaacaccagccctagtgcaaatgcccaatggcgaaaacctcgagcaggtgcgcgatcgcgtggtcaaagcctgggaactctggctgaagcgctggaaaactaatgctcccactccccacaatgtcttggttgtggcccacgatgccaccaataaggtgttgctctgccacattgttggtcttggcattgaaaacttctggctctttaagcagggcaatggcagtgtcacggtgattgactatcccctcaaggggggtctgccgcgcttgcaggcagtgaatatcaccacccatttgggaggggtactggatcggacggcggcgggagcgctatag

SEQ ID NO: 630 - protein, 468 aa, Synechococcus elongatus
MAQWDGQVCCLSIAKEKPLSTRVIIVRHGESTFNVQERVQGHSDASLLTERGRWMAAQVGLALRGIPIRKIYTSPLKRAQETAEVIHAQLQNPELKPPHALDLLKEIALPAWEDLPFAEVKAQFPEDYRRWQEAPETLMMKITTESGQTKEFFPLLDLYDRAGMVLETLLAAHANETIVIVGHSGMNRALICTGLGLGVKGYLRLQQANGGISVLNFSNGLRQPAQLEALNLTSHLNDPFPQPRFKEQTLRVFLVRHGETDWNREGRFQGQIDVPLNENGRAQAAAVAEFLKDVPFHHAVSSPLLRPKDTALAILQYHPHVQLELEPALAEISHGDWEGKFEPEVEAAYPGELERWRTTPALVQMPNGENLEQVRDRVVKAWELWLKRWKTNAPTPHNVLVVAHDATNKVLLCHIVGLGIENFWLFKQGNGSVTVIDYPLKGGLPRLQAVNITTHLGGVLDRTAAGAL

SEQ ID NO: 631 - DNA, 582 bp, Oceanobacillus iheyensis
  CDS (1)..(582)
atgacagaaatatacttagttaggcacggggaaacaaattggaataaggaaggaagagtacaaggcaggacggatattcctttaaatgaaacaggtagaatgcaagcaaaactttgttttaacggagtaaaggaatttgagccaacgattctgattgcaagccctttacaacgagccaaagtaactgctgaaattctaaatgaacaatggggtttacctattattgagatggaagaatttaaggaacgatcctatggtgatgcggaaggaatgacgctggaagatagagaacgattcttccctgataaagacattccgaatatggaaatattggaagatgtaaagcgacgaggaattgaaggaatacaaaaagtgtgccaacggttttctgatgaaaaaatcgtaattgtagctcacggggcgctaatcaatgcgattttatcggtgatctctaagggagaaattggatcaggtaaaacacatttaaataatacttgtattaataagctgacgtttgctgataaggtatttgaaattaaagattataataacacggatcatttaatagcggtgaatgattaa

SEQ ID NO: 632 - protein, 193 aa, Oceanobacillus iheyensis
MTEIYLVRHGETNWNKEGRVQGRTDIPLNETGRMQAKLCFNGVKEFEPTILIASPLQRAKVTAEILNEQWGLPIIEMEEFKERSYGDAEGMTLEDRERFFPDKDIPNMEILEDVKRRGIEGIQKVCQRFSDEKIVIVAHGALINAILSVISKGEIGSGKTHLNNTCINKLTFADKVFEIKDYNNTDHLIAVND

SEQ ID NO: 633 - DNA, 648 bp, Bifidobacterium longum
  CDS (1)..(648)
atgttgctgcgccacggccagaccgtgtggagcgaatccgggcagcataccgggcgcacgaacatcccgttgaccgcggtcggcgagcagcaggcagcggatgccggaaggcgcctgcgcgaagctttccccgaaggattcagccagggctgtgtgttttccagtccgctgaagcgggcgtgccaaaccgctgaactggccggttttgcggaccacggtgtgttggacggcatcgctgaatgggattacggccgagccgaggggcgtacgcgccagcaggtgagtgaggccagcggttttgaatgggatgtgtggcgtgacgggccgcgctcgctgacgcccacgctggagggcgattgggtcgagaccttaccttcgggcgagcaggtgccggtccatgccgggcctggcgagacgctggaagaagcagcggtacgcgccaagagcgccatcgatgagattacgccgctgctgaaagacggccataatgtgctgttggtggctcatgcgcacatcctgcgcatcctcacctcgcaatggctgggcgtggacccgcatttcgcgcggttgctgcgtttggatacggcgcactactcggtgcttagcgtctataagggagataacgtcatcgaacggtggaacgcctag

SEQ ID NO: 634 - protein, 215 aa, Bifidobacterium longum
MLLRHGQTVWSESGQHTGRTNIPLTAVGEQQAADAGRRLREAFPEGFSQGCVFSSPLKRACQTAELAGFADHGVLDGIAEWDYGRAEGRTRQQVSEASGFEWDVWRDGPRSLTPTLEGDWVETLPSGEQVPVHAGPGETLEEAAVRAKSAIDEITPLLKDGHNVLLVAHAHILRILTSQWLGVDPHFARLLRLDTAHYSVLSVYKGDNVIERWNA

SEQ ID NO: 635 - DNA, 1005 bp, Arabidopsis thaliana
  CDS (1)..(1005)
atggctactgctacgtctcaccaatcagtcgtttcatttgcttctctccggtcttctccttcttctacaatctctcaatgtggattcaagatcgattcttcactgagctttacatcgaaaaagacaaacttttgcaagattaaagcaatggcatcatcagtttcttttaacaacactctcttgtctccttccaagacaatccctgacaattctcaaaagaaatcaaatgaagcagctttgatattgattaggcatggagaatctttatggaacgagaagaatctttttactggttgtgttgatgtgccattgactgagaaaggtgttgaagaggctattgaagcagggaagaggattagtaacattcctgttgatgttatctttacatcttctttgattcgtgctcagatgactgcaatgcttgctatgattcaacaccgtcgtaagaaggtaccgatcatcttgcacgatgaaagcgaacaggcgaaaacttggagtcaagtttttagtgatgagactaaaaaccaatccattcctgtcatacctgcttggcagctcaatgaaagaatgtatggagaattacaaggtcttaacaagcaagaaacagccgagagatatgggaaagagcaagttcacgaatggcgtaggagttatgatattcctcctcccaaaggagagagtttggagatgtgtgctgagagagcagtagcttattttcaggacaatatcgaaccgaagcttgcagctggaaagaacgtaatgatagctgctcacgggaactcgctgcggtctatcattatgtatcttgacaaattgacttgccaggaggtgataagtctagagctatcgacaggtatacctcttctctacatattcaaagaaggcaaattcatgaagcggggaagcccggttggtccaacagaagctggtgtttatgcttataccaagagattggctcaatacagacagaagctagaggacgatagtgaagtactctgtgcctga

SEQ ID NO: 636 - protein, 334 aa, Arabidopsis thaliana
MATATSHQSVVSFASLRSSPSSTISQCGFKIDSSLSFTSKKTNFCKIKAMASSVSFNNTLLSPSKTIPDNSQKKSNEAALILIRHGESLWNEKNLFTGCVDVPLTEKGVEEAIEAGKRISNIPVDVIFTSSLIRAQMTAMLAMIQHRRKKVPIILHDESEQAKTWSQVFSDETKNQSIPVIPAWQLNERMYGELQGLNKQETAERYGKEQVHEWRRSYDIPPPKGESLEMCAERAVAYFQDNIEPKLAAGKNVMIAAHGNSLRSIIMYLDKLTCQEVISLELSTGIPLLYIFKEGKFMKRGSPVGPTEAGVYAYTKRLAQYRQKLEDDSEVLCA

SEQ ID NO: 637 - DNA, 645 bp, Xanthomonas campestris
  CDS (1)..(645)
atgcgcatcctgcttgcccgtcacggcgagacgccgtggaacgccgaaggccgttaccagggccagatcgatatcccgctgtcaccggtcggcgaagggcagggcgccgcgttgggcgcgcgtctgcaggccttgcagatcacccgcgcagtggcatcgccactctcgcgtgcccaggccaccgcaacgttggcgcttggcagtgcacgcgcaggcctgctgcagaccgatgcggacctgcaggaaatcgcccatggcgaatgggaagggttgcttgcaagcgaaatcaatgacaaggatccggcacgcctgcgcgcatggcgcgaagaacccgacaccgtactgatgcccggcggcgagtcgctgcgtcaggtgctcgatcgcagctggcgcggtctggcgcgcgccgccgacggcctgggtgcagacgacaccttgcttgtggtcgcgcacgatgcggtcaaccgcgtgatcctgtgcaagatcctcggcctgccgctgtccaagttgtggacattccgccaggcccccaccacgctcaacctgctcgaaggcgacgacgtcgatcacctggaagtggtccgcctcaacgattgcgcgcaccacacgccgttctttggtgaagccaagcatcgggcgttataa

SEQ ID NO: 638 - protein, 214 aa, Xanthomonas campestris
MRILLARHGETPWNAEGRYQGQIDIPLSPVGEGQGAALGARLQALQITRAVASPLSRAQATATLALGSARAGLLQTDADLQEIAHGEWEGLLASEINDKDPARLRAWREEPDTVLMPGGESLRQVLDRSWRGLARAADGLGADDTLLVVAHDAVNRVILCKILGLPLSKLWTFRQAPTTLNLLEGDDVDHLEVVRLNDCAHHTPFFGEAKHRAL

SEQ ID NO: 639 - DNA, 645 bp, Xanthomonas axonopodis
  CDS (1)..(645)
atgcgcatcctgcttgctcgtcacggcgagacgccgtggaacgccgaaggccgttaccagggccagatcgatattccgctctcgccggtcggcgaaggccaggcgcgcgcattgggcgaacggctgcactcgctgcagatcgaccgcgcggtggcatcgccgttgtcgcgcgcgcaggctactgccaaggccgcgttgggcgcttcgcgtcaagcgctgctgcagaccgatgccgacctgcaggaaattgcgcacggcgaatgggagggcctgctggccagcgagatcaacgacaaggatcccgcacgtctgcgcgcctggcgcgaagagcccgataccgtgttgatgccgggtggcgaatcgctgcgtcaggtgctcgatcgcagctggcgcggcctgatgcgcgccgccgatgggctgggcgcccacgacaccttgctggtggttgcgcacgatgcggtcaatcgcgtgatcctgtgcaagatcctgggcctgccgttgtccaggctatggagcttccgccaggccccgaccacgctgaacctgctcgaaggcgatgacgtcgagcatctcgaagtggtgcgcctcaacgactgtgcgcaccacacaccgttctttggtgaggcaaagcatcgggcgctttaa

SEQ ID NO: 640 - protein, 214 aa, Xanthomonas axonopodis
MRILLARHGETPWNAEGRYQGQIDIPLSPVGEGQARALGERLHSLQIDRAVASPLSRAQATAKAALGASRQALLQTDADLQEIAHGEWEGLLASEINDKDPARLRAWREEPDTVLMPGGESLRQVLDRSWRGLMRAADGLGAHDTLLVVAHDAVNRVILCKILGLPLSRLWSFRQAPTTLNLLEGDDVEHLEVVRLNDCAHHTPFFGEAKHRAL

SEQ ID NO: 641 - DNA, 621 bp, Thermoanaerobacter tengcongensis
  CDS (1)..(621)
atggttacaagactttatatagcaaggcacggccagtcaaagtggaatttagagagcagaatgcagggtatgaaagatattgaactgacccaattagggttggaacaggctgaattgcttgcaaaaagactgaaaggtgaaaacatagattgtatatattctagtgacttaaaaagagcttataccaccgcagaaataatttcaaaagaaataaatgcccccatagtaaaaatagaggaatttagggaaatgtcctttggagtttgggaagggcttactgcgaaggagatagaagaaaactatcaagaactttatgacctctggaaaacagaccctagacatgtccttatagaaaatgcggaaacattaaaagaggtccaaaagagaatgctcacaaagacaaaagagattgtagaagagaattggggaaaaaatattctaattgtatctcatggcacttctattaaagctctaattttaggattgctggaaatcgatttgagcttttaccctagctttagaatggataatgcttctcttagcataatagatataaaagaaaacaaaaaagcagttctagttttgtataacgatacctgccatttaggagagaggaagtag

SEQ ID NO: 642 - protein, 206 aa, Thermoanaerobacter tengcongensis
MVTRLYIARHGQSKWNLESRMQGMKDIELTQLGLEQAELLAKRLKGENIDCIYSSDLKRAYTTAEIISKEINAPIVKIEEFREMSFGVWEGLTAKEIEENYQELYDLWKTDPRHVLIENAETLKEVQKRMLTKTKEIVEENWGKNILIVSHGTSIKALILGLLEIDLSFYPSFRMDNASLSIIDIKENKKAVLVLYNDTCHLGERK

SEQ ID NO: 643 - DNA, 582 bp, Rhizobium loti
  CDS (1)..(582)
atgagcagcgtgctaccgcaaatccatctggtccggcatggcgagacggcgtggagcctttcggggcagcataccggccgcaccgacatgccgctgacgccggcgggcgaggccgcggcgcggggcgtggcggagcggctcaagggcctgtcgttctcggcggtgtggtcgagcccctcgcagcgcgcctacaacactagcgtgctggccggctttggcgcgacaagcgtcagaaacgacgatctgcaggaatgggactacggcgcctatgaggggcgcaccaccaaggacatcctggccgagcggccaggctggaacgtgtttcgcgacggctgcccgcaaggcgagatggctgccgatgtcggtgcccgcgccgacaggatcatcagacagcttcgcgaagccggcggctcgatcctgatcttttccagcgcgcatttcctgcgcgtgctcgccgcccgctggctcggcctgccgccggaaggcggcgcgctgttcgtgctcgatacggccagcatcagcgtgctcggctacgagcatgatctcagcgagccggtcgtgcgcaaatggaaccagaagtag

SEQ ID NO: 644 - protein, 193 aa, Rhizobium loti
MSSVLPQIHLVRHGETAWSLSGQHTGRTDMPLTPAGEAAARGVAERLKGLSFSAVWSSPSQRAYNTSVLAGFGATSVRNDDLQEWDYGAYEGRTTKDILAERPGWNVFRDGCPQGEMAADVGARADRIIRQLREAGGSILIFSSAHFLRVLAARWLGLPPEGGALFVLDTASISVLGYEHDLSEPVVRKWNQK

SEQ ID NO: 645 - DNA, 651 bp, Pasteurella multocida
  CDS (1)..(651)
atgaaaacattaacattctatttgatacgtcatggtaaaacggagtggaacgaaaaaaggttattacaaggaaatggggactcccctttgacacaagaaggcattgaaggtgctaagcgcacagcaaaagcgttatctaacattgatttcactgccgcctatagtagcgtattgccccgtgcaatttccactgcaaacatgattttagcgcacaaaaccaccccattaatttgtcatgccggcttaaatgaattgtgttttggctcatgggaagggcaagccattgaggaattaagttgcttaccggaataccgtcaaatgcgcgatcaacctgcgcagtatttggggttaaccaatggcggggaaacttatcagcaattagcaacacgcgcgatcggcgtcattgaacagattattcaacgttatgacactggaaatattctcattgtctctcatggtcatactttacgtatgcttttggcgttgtttcatggtgccacttggcaaacccatcgagaaaaaagtaccagcttagcgaacacgtccattagcgttgtacactatttacaaactgagaatgaaacaggacgctttgtgcttgaaaaggtcaatgatatacagcatttaaccgattcattcgatgaggaataa

SEQ ID NO: 646 - protein, 216 aa, Pasteurella multocida
MKTLTFYLIRHGKTEWNEKRLLQGNGDSPLTQEGIEGAKRTAKALSNIDFTAAYSSVLPRAISTANMILAHKTTPLICHAGLNELCFGSWEGQAIEELSCLPEYRQMRDQPAQYLGLTNGGETYQQLATRAIGVIEQIIQRYDTGNILIVSHGHTLRMLLALFHGATWQTHREKSTSLANTSISVVHYLQTENETGRFVLEKVNDIQHLTDSFDEE

SEQ ID NO: 647 - DNA, 597 bp, Streptomyces coelicolor
  CDS (1)..(597)
atggcaccgcgcattctgctggcccggcacggacagacggagtggtcgctgtccggcagacacaccggcaggaccgacgtgccgctcctggaggagggccggcgcggcgcgaagctgctcggcgagcggctgcaccgggcgccgtgggacgggctggacggcgtggaggtgcggaccagtccgctggtgcgcgcgagcgagacctgcgagctggcgggtttcggggagcgcgcacgcgcgtgggacacgctgatggagtgggactacggggcgtacgagggcatgacgccggagcagatccaggccgtgcggcccggctggctgatctggcgggacggggccccggagggggagggcgtggcggacgtcacggcgcgcgcggacgaggtggtggcgtgggcgcgagaggcggagcgggacgtgctcgtcttcgcccacgggcacgttctgcgggcgatcggggcgcggtggctggggctgccggtgtccttcggcgcgcggatacggctcagtccgacgtcgctgtcggtgctggggtgggcgtacggggagccggcggtggagagctggaacgatctggggcacttggtcggctga

SEQ ID NO: 648 - protein, 198 aa, Streptomyces coelicolor
MAPRILLARHGQTEWSLSGRHTGRTDVPLLEEGRRGAKLLGERLHRAPWDGLDGVEVRTSPLVRASETCELAGFGERARAWDTLMEWDYGAYEGMTPEQIQAVRPGWLIWRDGAPEGEGVADVTARADEVVAWAREAERDVLVFAHGHVLRAIGARWLGLPVSFGARIRLSPTSLSVLGWAYGEPAVESWNDLGHLVG

SEQ ID NO: 649 - DNA, 600 bp, Streptomyces coelicolor
  CDS (1)..(600)
atgggtgatctgtttctggtccggcacggtgagaccgagtggtcgcgttcgggccggcacaccgggctgacggacgtcccgctgaccgagaaggggcgggaacaggcgcggagtctggtgccgttgatccggtcccaccggatcggggcggcgttcgtcagccccttccagcgggcgcgggagacggccgagctgatcgggctgcacgatgtgcgcatcgaaccggacctgcacgagtgggactacggcggctacgaggggatcaccaccgtcgagatccaccggagccggccggactggttcctgttcacggacggggtgacgcccggaccgccggaccaccccggggagacgcccgagcaggtgggtgagcgggccgaccgggtgctggccacggtggatgccgcgttcgccaacaccgaggggtgcgtggtgctggtggcgcacgggcacttcctgcgcgtgctgaccgcccggcacctgggccttccgccctcgcacggggcgctgttccagctgggcacgggcacgctgtgccggctgggcacggagcacggacggccggtgatcgccgcctggaatgtcagacccccgtcgtag

SEQ ID NO: 650 - protein, 199 aa, Streptomyces coelicolor
MGDLFLVRHGETEWSRSGRHTGLTDVPLTEKGREQARSLVPLIRSHRIGAAFVSPFQRARETAELIGLHDVRIEPDLHEWDYGGYEGITTVEIHRSRPDWFLFTDGVTPGPPDHPGETPEQVGERADRVLATVDAAFANTEGCVVLVAHGHFLRVLTARHLGLPPSHGALFQLGTGTLCRLGTEHGRPVIAAWNVRPPS

SEQ ID NO: 651 - DNA, 660 bp, Gloeobacter violaceus
  CDS (1)..(660)
atggcactactggtcatggtccgccacggtcaatcgatctggaacctcgaaaaccgcttcaccggctggactgacgttcccctgaccgaaaaaggccgcgcggaagcccgcgcctgcggcgagttgatttattgcgtccccttcgccgtcgcctttacttccaaactgacgcgcgcccaagacaccttgcgcctcattctcgaagccgccgaccaaccggacgtgccggtgatcgaggatcaggccctcaatgagcgccactacggcgagctgcaggggctcaacaaagccgaaactgccgcgaagtacggtgaggaaacggtccggcagtggcggcgcagcctggaggggcgtccccccggcggcgagagcctcaaggacaccgccctgcgatcattgcgctatttctacgaaaaaattgttcccgagttggaggcgggtaagaacgtgctcgtcagtgcccacggcaacacgatccgggccattttgatggaactcgatcacctgagccccgagcaggtcgaaaaggtcgaaatcgaatactgcgtgccggtcgccttcgagcatcaggcggacggcaccttctcgcaggtgctcatgccccgatgcgacatcatccggccgccgcagccgccggcccgcagcatcgcccggctctag

SEQ ID NO: 652 - protein, 219 aa, Gloeobacter violaceus
MALLVMVRHGQSIWNLENRFTGWTDVPLTEKGRAEARACGELIYCVPFAVAFTSKLTRAQDTLRLILEAADQPDVPVIEDQALNERHYGELQGLNKAETAAKYGEETVRQWRRSLEGRPPGGESLKDTALRSLRYFYEKIVPELEAGKNVLVSAHGNTIRAILMELDHLSPEQVEKVEIEYCVPVAFEHQADGTFSQVLMPRCDIIRPPQPPARSIARL

SEQ ID NO: 653 - DNA, 621 bp, Bartonella henselae
  CDS (1)..(621)
atggaacgcacacttgtactcattcgtcatggacaaagtgaatggaatctcaaaaatctctttaccggttggaaggaccctggtttaacagaaaaaggccgtaccgaagcaatagcagcaggtaagaaacttaaagaaactggtttaaaatttgatatcgcttatacatctgctctacagcgtgcacaaaaaacagcccagaacatcttagaacaaatggaacaatcagatttagaactgataaaaacccccgcactgaatgaacgaaattatggtgatctctctggtttgaataaagatgaagtgcgtcaaaaatggggagaacagcaagtgcaaatatggcgccgctcctatactattgctccccctaatggagaaagccttcgcgatactggtgctcgtgtttggccttattatcttcaccatatccaacctcatattttgcgctctcaaactgttttgatcgcagcacacggtaactctcttcgtgctcttattatggcacttgaaggcttaaatagtgaggaaattatctctcaagaattagcaactggcattcctatagtttatacatttaattcggactcaacaatttcgtcaaagacaatcatcaccccttaa

SEQ ID NO: 654 - protein, 206 aa, Bartonella henselae
MERTLVLIRHGQSEWNLKNLFTGWKDPGLTEKGRTEAIAAGKKLKETGLKFDIAYTSALQRAQKTAQNILEQMEQSDLELIKTPALNERNYGDLSGLNKDEVRQKWGEQQVQIWRRSYTIAPPNGESLRDTGARVWPYYLHHIQPHILRSQTVLIAAHGNSLRALIMALEGLNSEEIISQELATGIPIVYTFNSDSTISSKTIITP

SEQ ID NO: 655 - DNA, 681 bp, Parachlamydia sp
  CDS (1)..(681)
atggttaaattaattttgatgcgtcacggccaatctcagtggaatttagcaaatttgtttactggttgggtagacattcccctgtcttttaaaggaattgaagaggctatagaggcaggaaaacaaatcaaaaattaccctattgatttaatttttacttcttccttaattcgtgctcaaatgacagcaatgttggcaatgtctgttcatacatctggtaaagtccctgtgattcttcacacaggtgaggggcgactagaagaatgggcaagtatttatagttccgaatctcaatctcagacaatacctgtcattcgtgcttgggaattgaatgagcggatgtatggagaattacaaggaataaataaagaagaaatggctaaaaaatatggagctgagcaggtgcatatttggcgacgaagttttgatgttccccctccaaatggagaaagtttacaaatgacagcagctcggaccataccttattttgaaaacaccattgtccctcatttgaaagagaagaaaaatatttttattgctgcacacggaaattccctgcgttcgattatcatgaaattagatgggctgacaacagatcaagtcgttaagttggaactggcaacaggggtgcctgtgatctatgatttcaatcacgatgaatatattaaacaacaaaagtag

SEQ ID NO: 656 - protein, 226 aa, Parachlamydia sp
MVKLILMRHGQSQWNLANLFTGWVDIPLSFKGIEEAIEAGKQIKNYPIDLIFTSSLIRAQMTAMLAMSVHTSGKVPVILHTGEGRLEEWASIYSSESQSQTIPVIRAWELNERMYGELQGINKEEMAKKYGAEQVHIWRRSFDVPPPNGESLQMTAARTIPYFENTIVPHLKEKKNIFIAAHGNSLRSIIMKLDGLTTDQVVKLELATGVPVIYDFNHDEYIKQQK

SEQ ID NO: 657 - DNA, 636 bp, Rhizobium meliloti
  CDS (1)..(636)
atgagcggcaccctcgtccttgtccggcacggccagagcgactggaacctgaagaacctcttcaccggctggcgcgatcccgacctcaccgaactcggcatcgaggaggcaaaggccggcggcaaggcgcttgccgattacggcatcaaattcgacatcgccttcacctccgtcctcatccgggcccagcgtacctgccagctcgtcctcgacgccgtcggccagtcgtcgctcgaaacgatccgcgatcaggccctgaacgagcgcgactacggcgacctctccggtctcaacaaggacgatgcgcgggcgaaatggggcgaagagcaggtccatatctggcgccgctcctacgacgtgccgccgcccggcggcgagagcctgcgcgacaccggcgcgcgcgtctggccctattacctgaccgacatcctgccgcgcgtgctttcgggcgagaaggtgctcgtcgccgcccatggcaactcgctgcgctccctcgtcatggtgctggacaagctgaccaaggagcagatcctcaagctcaacctcgcgaccggagtgccgatggtctacaagctgaacgcggattcgaccgtcgcttcgaaggaagtgctaggggatatgtccggggcgcattga

SEQ ID NO: 658 - protein, 211 aa, Rhizobium meliloti
MSGTLVLVRHGQSDWNLKNLFTGWRDPDLTELGIEEAKAGGKALADYGIKFDIAFTSVLIRAQRTCQLVLDAVGQSSLETIRDQALNERDYGDLSGLNKDDARAKWGEEQVHIWRRSYDVPPPGGESLRDTGARVWPYYLTDILPRVLSGEKVLVAAHGNSLRSLVMVLDKLTKEQILKLNLATGVPMVYKLNADSTVASKEVLGDMSGAH

SEQ ID NO: 659 - DNA, 648 bp, Escherichia coli O6
  CDS (1)..(648)
atgttacaggtatacctagtccgccacggtgaaacgcagtggaacgccgagcgacgtattcagggccagtctgacagcccgctgaccgccaaaggtgagcaacaggcgatgcaggtggcaacccgtgccaaagagcttggcattacgcatatcatcagtagcgatttaggacggacccggcgcacggcggaaatcatcgcccaggcctgcggctgtgacatcatctttgattctcgcctgcgtgaattaaatatgggtgtactggaaacaagaaatatcgattcactcaccgaagaagaagagaactggcgtcggcaactggtcaatggcaccgttgacgggcgtattcctgaaggcgagtcaatgcaggagctcagcgatcgcgttaatgcggcactggaatcttgccgggacttaccgcagggaagccgaccgctactggtgagccatggtattgcactgggatgcctggtgagtacgattctcggattaccagcatgggcagagcgccgcttacgtctgcgtaactgttctatttcgcgcgtggattatcaggaaagcttgtggctggcgtctggctgggtggttgaaaccgcaggggacatctcgcatctggacgcccctgcattagatgagctgcagcgttaa

SEQ ID NO: 660 - protein, 215 aa, Escherichia coli O6
MLQVYLVRHGETQWNAERRIQGQSDSPLTAKGEQQAMQVATRAKELGITHIISSDLGRTRRTAEIIAQACGCDIIFDSRLRELNMGVLETRNIDSLTEEEENWRRQLVNGTVDGRIPEGESMQELSDRVNAALESCRDLPQGSRPLLVSHGIALGCLVSTILGLPAWAERRLRLRNCSISRVDYQESLWLASGWVVETAGDISHLDAPALDELQR

SEQ ID NO: 661 - DNA, 648 bp, Photorhabdus luminescens
  CDS (1)..(648)
atgttacaggtatatcttgttcgtcatggggagtctgaatggaacgcagcacgtcgtattcagggacaatctgacagccctttgactgaaacaggcgaacatcaagccagattagtggcacaaagagtaaaatctgaaagtattacccatattattaccagtgaccttggacggacacgccgaacggcggaaatcattgctaaggtttgtggttgtgaaattattctggagccacgtttgcgtgaattgcacatgggggttcttgaacgcagaaatattgattcattaacatcggaagaagagaaatggcgtaagaaagtccttgatggcacacctgggggacgtatccccaaaggcgaatctatggatgaactggctgtgcgtatgagggctgcgctggagaactgtcgtaatctgcctgttggtagccgaccgctgttagtcagtcatggcatcgctttgggatgtttggttggcacaatactgggattgcccgcacatgctgaacgtcgtcttcgcttgcgaaattgctctctgtccagagtggattatcagcacagtccgtggctagcgtcgggctggattgtagaaacggcaggcgatatcacacatctggatacgcccgcactggatgaattacaacgttaa

SEQ ID NO: 662 - protein, 215 aa, Photorhabdus luminescens
MLQVYLVRHGESEWNAARRIQGQSDSPLTETGEHQARLVAQRVKSESITHIITSDLGRTRRTAEIIAKVCGCEIILEPRLRELHMGVLERRNIDSLTSEEEKWRKKVLDGTPGGRIPKGESMDELAVRMRAALENCRNLPVGSRPLLVSHGIALGCLVGTILGLPAHAERRLRLRNCSLSRVDYQHSPWLASGWIVETAGDITHLDTPALDELQR

SEQ ID NO: 663 - DNA, 648 bp, Salmonella typhimurium
  CDS (1)..(648)
atgttacaggtataccttgttcgccacggtgaaacgcagtggaacgccgagcgacgtattcagggccaatcggacagtcccctgacagcaaaaggcgagcagcaggccatgcaggtaggagaacgcgcccgtagcctcggcatcacccatatcatcagcagcgatttaggccgcacaaaacgcacggcggagattatcgcccaggcgtgcgggtgtgatatcacctttgactcccgcctgcgcgagctggatatgggcgtgctggaaaagcgccagatcgattcgctgacggaagaagaagagggctggcgtcgtcagctggtcaacggcacgcaggatggccgcattcccggcggggaatcgatgcaggagttgagcgatcgcgttcatgccgcgctggcgtcctgtctggagctaccgcagggcagccgacctttattggtcagtcacggtatcgcgttgggctgtctggtcagtactatactgggactacccgcctgggcggaacgccggttacgtttgcgcaactgctctatttcccgcatcgattaccaggaaagtcagtggctggcgtctggctgggtggtagaaaccgcaggggacgtttcgcatctggacgcccctgcattggatgagctacagcgttaa

SEQ ID NO: 664 - protein, 215 aa, Salmonella typhimurium
MLQVYLVRHGETQWNAERRIQGQSDSPLTAKGEQQAMQVGERARSLGITHIISSDLGRTKRTAEIIAQACGCDITFDSRLRELDMGVLEKRQIDSLTEEEEGWRRQLVNGTQDGRIPGGESMQELSDRVHAALASCLELPQGSRPLLVSHGIALGCLVSTILGLPAWAERRLRLRNCSISRIDYQESQWLASGWVVETAGDVSHLDAPALDELQR

SEQ ID NO: 665 - DNA, 22 bp, artificial sequence
  Primer
atgccttcgctaacccccagat

SEQ ID NO: 666 - DNA, 23 bp, artificial sequence
  Primer
ttacacatcgccatgctgggatt

SEQ ID NO: 667 - DNA, 3844 bp, Saccharomyces cerevisiae
  CDS (1218)..(3269)
agatctactcaaatatgaaaaaaagaagagaacgtcaacaattttaatcgttcgtatcatcaagaagttccggtcctatagtgtagtggttatcactttcggttttgatccggacaaccccggttcgaatccgggtaggaccttcttttttgcgaatgacgtatgctgctttttgtgcctacagttttttttttatttggctagcccattgctttgatcgatatttcctgtgagaagtttaaatccactaaggtttttcattgttgctgcagatgtgtttttccattcatcctgaaatatgcactgctattccgcattccattcccctagtcttttttagttctttccgttcgaccttcatcgaaaaatgacaaaacgcgttaggaacaacaaccaattgcaaacaagcagtgaaacaaaaccatcaaggcccgaaaatacaagtgtgtactaatacagtaagtaggtcaaatacgcaatgaccaaagatgccgtgaatctagatgcttacaccgtgagcttcatgcctttctataccgagtatcaaggaccaaccgaagagtttaaggattacaaattcgaagatactatttactttcgtggcaaggaactgaagagggaaaagtctgcgacgccttccagtagcgataacacaactagtaataccttcagtaatggcgccatcctctcgggaaacacaataactggcaagatagtttcagtgaataattacgaaagagagggcactgatcgcaacgaattggcgcgattgcaagaattgatctccctcatcgatgtcataaatcagtaaatataaacattaaatacattacacgtagccacccgctgtatagcataaaactaacttaaaattattcatatgcgtttcccggggccgaagcgttattgccgatattcggtagccgattccgctggctttttttttttgaacgaggcaaaaaagtttcgtgactgaacttcttcgtcactggttttgttgataatttttatcgttttttacttcgagattgaaaacagtgttctgaattttagcaacgatatcgcaccgcacgtttagcctgatcaaaccttatatatacctctaccttaaaatatatatatatatagtattcgaattccgaattgtgtgtctccgcggttagtgattgttatacacaaacagaatacaggaaagtaaatcaatacaataataaaatatgacaatcaaggaacataaagtagtttatgaagctcacaacgtaaaggctcttaaggctcctcaacatttttacaacagccaacccggcaagggttacgttactgatatgcaacattatcaagaaatgtatcaacaatctatcaatgagccagaaaaattctttgataagatggctaaggaatacttgcattgggatgctccatacaccaaagttcaatctggttcattgaacaatggtgatgttgcatggtttttgaacggtaaattgaatgcatcatacaattgtgttgacagacatgcctttgctaatcccgacaagccagctttgatctatgaagctgatgacgaatccgacaacaaaatcatcacatttggtgaattactcagaaaagtttcccaaatcgctggtgtcttaaaaagctggggcgttaagaaaggtgacacagtggctatctatttgccaatgattccagaagcggtcattgctatgttggctgtggctcgtattggtgctattcactctgttgtctttgctgggttctccgctggttcgttgaaagatcgtgtcgttgacgctaattctaaagtggtcatcacttgtgatgaaggtaaaagaggtggtaagaccatcaacactaaaaaaattgttgacgaaggtttgaacggagtcgatttggtttcccgtatcttggttttccaaagaactggtactgaaggtattccaatgaaggccggtagagattactggtggcatgaggaggccgctaagcagagaacttacctacctcctgtttcatgtgacgctgaagatcctctatttttattatacacttccggttccactggttctccaaagggtgtcgttcacactacaggtggttatttattaggtgccgctttaacaactagatacgtttttgatattcacccagaagatgttctcttcactgccggtgacgtcggctggatcacgggtcacacctatgctctatatggtccattaaccttgggtaccgcctcaataattttcgaatccactcctgcctacccagattatggtagatattggagaattatccaacgtcacaaggctacccatttctatgtggctccaactgctttaagattaatcaaacgtgtaggtgaagccgaaattgccaaatatgacacttcctcattacgtgtcttgggttccgtcggtgaaccaatctctccagacttatgggaatggtatcatgaaaaagtgggtaacaaaaactgtgtcatttgtgacactatgtggcaaacagagtctggttctcatttaattgctcctttggcaggtgctgtcccaacaaaacctggttctgctaccgtgccattctttggtattaacgcttgtatcattgaccctgttacaggtgtggaattagaaggtaatgatgtcgaaggtgtccttgccgttaaatcaccatggccatcaatggctagatctgtttggaaccaccacgaccgttacatggatacttacttgaaaccttatcctggtcactatttcacaggtgatggtgctggtagagatcatgatggttactactggatcaggggtagagttgacgacgttgtaaatgtttccggtcatagattatccacatcagaaattgaagcatctatctcaaatcacgaaaacgtctcggaagctgctgttgtcggtattccagatgaattgaccggtcaaaccgtcgttgcatatgtttccctaaaagatggttatctacaaaacaacgctactgaaggtgatgcagaacacatcacaccagataatttacgtagagaattgatcttacaagttaggggtgagattggtcctttcgcctcaccaaaaaccattattctagttagagatctaccaagaacaaggtcaggaaagattatgagaagagttctaagaaaggttgcttctaacgaagccgaacagctaggtgacctaactactttggccaacccagaagttgtacctgccatcatttctgctgtagagaaccaatttttctctcaaaaaaagaaataacttaaatgagaaaaatttcgtaatgagataaaatttcgctccttttctgttttctattttctattttcccaacttttgctctattcagttataaattactatttatccatcagttaaaaaacaagatcttttactggtcagctaggaaagcgaaaatacaaagactttatgcacttagtgatatatatgtatagatatatccatttttacgcacttatcatatatcttagttatctaaatacaatctagttattcgtacacaatcgcccctgttatccctatagtgggaataaagtaatgcactgtgacggggttcttcgcccgggatagggtaaaaggatattgccgtttcaagaaacttcggggataatcgaataagataccgagaaagctattgttcgttgtgcacgtaggatgtatattgaacaagcatgaccagaatctgatgcattacgagaaggttacgggatgatatcagacctccgaagtccatgttgcaaaaatgtgccgacttttccgcggcgctatttggcacaaatttcaggagaaacatcactgtcggtgttatagaattc

SEQ ID NO: 668 - protein, 683 aa, Saccharomyces cerevisiae
MTIKEHKVVYEAHNVKALKAPQHFYNSQPGKGYVTDMQHYQEMYQQSINEPEKFFDKMAKEYLHWDAPYTKVQSGSLNNGDVAWFLNGKLNASYNCVDRHAFANPDKPALIYEADDESDNKIITFGELLRKVSQIAGVLKSWGVKKGDTVAIYLPMIPEAVIAMLAVARIGAIHSVVFAGFSAGSLKDRVVDANSKVVITCDEGKRGGKTINTKKIVDEGLNGVDLVSRILVFQRTGTEGIPMKAGRDYWWHEEAAKQRTYLPPVSCDAEDPLFLLYTSGSTGSPKGVVHTTGGYLLGAALTTRYVFDIHPEDVLFTAGDVGWITGHTYALYGPLTLGTASIIFESTPAYPDYGRYWRIIQRHKATHFYVAPTALRLIKRVGEAEIAKYDTSSLRVLGSVGEPISPDLWEWYHEKVGNKNCVICDTMWQTESGSHLIAPLAGAVPTKPGSATVPFFGINACIIDPVTGVELEGNDVEGVLAVKSPWPSMARSVWNHHDRYMDTYLKPYPGHYFTGDGAGRDHDGYYWIRGRVDDVVNVSGHRLSTSEIEASISNHENVSEAAVVGIPDELTGQTVVAYVSLKDGYLQNNATEGDAEHITPDNLRRELILQVRGEIGPFASPKTIILVRDLPRTRSGKIMRRVLRKVASNEAEQLGDLTTLANPEVVPAIISAVENQFFSQKKK

SEQ ID NO: 669 - DNA, 1713 bp, Glycine max
  CDS (1)..(1713)
atgacaacggtagctgcttctcttgatgccaaagaggtgtctacctccaaaactgaccaaaaccaagtgtgtgactgtgatccccaaactagccatgtcttcaaatcaaaattaccagatatcccaatctccaaccacctccctctccacgcttactgctttcagaaactatcccaattctccgaccgcccatgcctcatcgtcggacccgccgccaaaacctacacctactccgagacacacctcatttcacgcaagattgccgccggattgtccaacctcggaatccgcaagggcgacgtggtcatgatccttctccagaactccgccgagttcgtcttctccttcctcgctgcctccatgatcggcgccgtcgccaccacagccaatccgttctacaccgccgcggagatcttcaagcagtttaccgtctccaagacgaagctgatcataacgcaggcaatgtacgtggacaagcttcgcaaccacgacgacggcgcgaagctcggcgaggacttcaaggttgtgaccgtcgacgacccgccggaaaattgcctccacttctcggtgctctcggaggcgaacgagagcgacgcgccggaggttgatatccaacccgacgacgcggtggcgatgccgttctcttccggcacgacgggtttacctaaaggagtggttctcacgcacaagagtttaacaaccagtgtggcgcaacaagttgacggagagaaccctaacctctacctcaccaccgaggacgtgctcctatgcgtgcttccgttgtttcacatattctccctcaacagtgtgcttttgtgcgcgcttagggccgggagtgcggttttgttgatgcagaagttcgagattgggacgctgttggagctcatacagcggcaccgcgtgtcggtggcgatggtggtgccgccgctggtgctggcgttggcgaagaatccgatggtggcggattttgacctgagttcaatacggttagtgctgtcgggagctgctcccttggggaaggagctcgtggaagctctccggaacagggtgcctcaagccgttttgggacaggggtacgggatgacagaagcaggaccagtgctgtccatgtgcttgggctttgcaaagcaacctttcccaacaaaatcaggctcttgtggtaccgtagtcagaaatgcagaactcagggttgttgaccctgaaactggtcgttctcttggctacaatcaacccggtgaaatttgcatcagagggcaacagatcatgaaaggatatctgaacgatgagaaagcgacagcattgaccatagattcagagggttggcttcacaccggtgatgttggctatgtagatgaagatgatgaaattttcattgttgacagggtgaaagaactcatcaaatataaaggcttccaggtgccccctgcagaacttgaagggcttcttgtaagccatccctccattgcagacgcagctgtagtcccacaaaaggatgttgctgctggtgaagttcctgttgccttcgttgtgagatcaaacggctttgatctaactgaagaggctgtaaaagagtttatagctaaacaggtagtgttttacaaaagactgcacaaagtttattttgtacatgctattcccaagtctccatcaggaaagatattaaggaaagacctcagagcaaagctagaaaccgccgccactcagacgccttaa

SEQ ID NO: 670 - protein, 570 aa, Glycine max
MTTVAASLDAKEVSTSKTDQNQVCDCDPQTSHVFKSKLPDIPISNHLPLHAYCFQKLSQFSDRPCLIVGPAAKTYTYSETHLISRKIAAGLSNLGIRKGDVVMILLQNSAEFVFSFLAASMIGAVATTANPFYTAAEIFKQFTVSKTKLIITQAMYVDKLRNHDDGAKLGEDFKVVTVDDPPENCLHFSVLSEANESDAPEVDIQPDDAVAMPFSSGTTGLPKGVVLTHKSLTTSVAQQVDGENPNLYLTTEDVLLCVLPLFHIFSLNSVLLCALRAGSAVLLMQKFEIGTLLELIQRHRVSVAMVVPPLVLALAKNPMVADFDLSSIRLVLSGAAPLGKELVEALRNRVPQAVLGQGYGMTEAGPVLSMCLGFAKQPFPTKSGSCGTVVRNAELRVVDPETGRSLGYNQPGEICIRGQQIMKGYLNDEKATALTIDSEGWLHTGDVGYVDEDDEIFIVDRVKELIKYKGFQVPPAELEGLLVSHPSIADAAVVPQKDVAAGEVPVAFVVRSNGFDLTEEAVKEFIAKQVVFYKRLHKVYFVHAIPKSPSGKILRKDLRAKLETAATQTP

SEQ ID NO: 671 - DNA, 1644 bp, Glycine max
  CDS (1)..(1644)
atggctgatgatggaagcaggagggaattgatattcaggtcgaagcttccggatatctacatccccaaacatatgcccctccactcttactgcttcgagaatttgagagagtgtggttcacgcccctgcctgatcaatgcccccacgggagacgtctacagctaccacgaggtggacagcaccgccagaaaggtggcgagggggctgaagaaagagggcgtggaacagggccaggtcatcatgatcctcctccccaattgccccgaattcgtcttctcgtttcttggcgcatcccaccgcggtgccatggccactgccgccaaccctttcttcacccccgccgagattgcaaagcaagcccatgcctccaatgccaagctcctcatcacccaggcctcttactacgacaaagtcaaggacctccgcgacatcaagctcgtattcgtcgactcttgtcccccccatacagaggagaagcagcatctccatttctcacatctgtgtgaggataacggtgacgctgatgttgatgttgatgttgatatcaagcccgatgacgtggttgcattgccttattcttcgggaacaactggtcttcccaagggagtgatgctgagccacaaggggctggtgaccagcattgctcagcaggttgacggtgataatcccaacctctattaccactgccacgacaccatcctctgcgtgcttcccctctttcacatttactctctcaactccgttcttctctgtggcttgcgtgccaaggctaccattctcctcatgcccaagttcgatattaactccttgcttgctctcattcacaagcacaaagtcactattgcccctgtcgtccctcccattgttctcgccatttccaaatcacccgatctccacaagtacgacctgtcttccatcagagtcttgaagtccgggggagcccctctgggtaaggaactcgaagacactctcagagctaaattccccaacgccaaacttggccagggatacggaatgactgaggcagggcctgtgctaacaatgtctttagcttttgctaaagaaccgatagacgtgaaaccaggtgcatgtggaaccgttgtaagaaatgcagagatgaagattgtcgatcctgaaaccggtcattctttacccagaaaccaatccggtgaaatttgcataagaggcgaccagattatgaaaggttatctaaatgatggagaggctacagagagaaccatagacaaagatggttggttgcacacaggtgacatcggttacatcgacgatgacgatgagttattcatcgttgacaggctcaaggaattgatcaaatacaaaggatttcaagtggctccagctgaacttgaagcccttcttctcactcatcctaagatctctgatgctgctgttgttccaatgaaggatgaagccgcgggagaggtacctgttgcatttgtggtcatatcaaatggttataccgacacaaccgaggatgaaattaagcagtttatctccaaacaggtggtgttttacaaaagaataaaccgagtattcttcattgatgcaattcccaagtcaccgtcaggcaaaatcttgcgcaaggatctaagagcaaagatagcggcaagtgttccaaaatga

SEQ ID NO: 672 - protein, 547 aa, Glycine max
MADDGSRRELIFRSKLPDIYIPKHMPLHSYCFENLRECGSRPCLINAPTGDVYSYHEVDSTARKVARGLKKEGVEQGQVIMILLPNCPEFVFSFLGASHRGAMATAANPFFTPAEIAKQAHASNAKLLITQASYYDKVKDLRDIKLVFVDSCPPHTEEKQHLHFSHLCEDNGDADVDVDVDIKPDDVVALPYSSGTTGLPKGVMLSHKGLVTSIAQQVDGDNPNLYYHCHDTILCVLPLFHIYSLNSVLLCGLRAKATILLMPKFDINSLLALIHKHKVTIAPVVPPIVLAISKSPDLHKYDLSSIRVLKSGGAPLGKELEDTLRAKFPNAKLGQGYGMTEAGPVLTMSLAFAKEPIDVKPGACGTVVRNAEMKIVDPETGHSLPRNQSGEICIRGDQIMKGYLNDGEATERTIDKDGWLHTGDIGYIDDDDELFIVDRLKELIKYKGFQVAPAELEALLLTHPKISDAAVVPMKDEAAGEVPVAFVVISNGYTDTTEDEIKQFISKQVVFYKRINRVFFIDAIPKSPSGKILRKDLRAKIAASVPK

SEQ ID NO: 673 - DNA, 1641 bp, Glycine max
  CDS (1)..(1641)
atggcaccttctccacaagaaatcatcttccgatccccactccccgatattccgatccccacacatctcccattgtactcttactgcttccaaaacttgtcacagttccatgaccgtccatgcctcatcgacggcgacaccggcgagaccctcacctacgccgacgtcgacctcgctgctcgccgcatcgcctccggcctccacaaaatcggcatccgccagggtgacgtcatcatgctcgtcctacgcaactgcccgcagttcgccctcgccttcctcggcgccacccaccgtggcgccgtcgtcaccacagccaaccccttctacacgccggcggagcttgcgaagcaagcgacggccacgaaaaccaggctcgtcataacgcaatccgcgtacgtagagaaaatcaagagtttcgcggacagcagcagcgatgtcatggtgatgtgcattgatgatgatttttcttatgaaaacgacggcgttttgcatttctcaacgctcagtaacgccgacgaaacggaagcccctgccgttaagattaaccctgacgagctcgttgcgcttccgttttcttctggcacgtctgggctccccaagggcgttatgttatcgcataaaaacttggtcaccacgatagcgcagttagttgacggcgaaaacccgcaccaatacactcacagcgaggatgtgctactctgtgtgttgcctatgtttcatatctatgcgctcaattccattttgctctgcgggattcgttccggtgcggccgtgcttattttgcagaagtttgagatcactactctgttggagctcatcgagaagtacaaggtgacggttgcgtcgtttgtgccgcccatcgttttggcgttggttaagagcggagagactcatcgctacgacctgtcgtctattcgcgctgtggtcaccggcgcggcacccttaggaggggaacttcaagaagccgttaaggctaggctaccacacgctacttttggacagggatatgggatgacagaagcaggaccacttgccattagcatggcatttgcaaaagtaccctctaagattaaaccaggtgcatgcggaaccgttgtgagaaacgccgagatgaaaatcgtggatacagaaacgggtgattcacttccaagaaacaaacacggtgaaatttgcataataggcacaaaggtcatgaaaggatatctaaatgacccagaggctacagagagaactgtagacaaagaaggatggttacacacaggagatattggtttcattgatgatgatgatgaactcttcattgttgatcggttaaaggaattgatcaaatacaaaggattccaagtggctcctgctgagcttgaagcattgttgattgcccacccaaacatttctgatgctgccgttgtaggcatgaaagatgaagctgcaggggaaattccagttgcatttgttgtaaggtcaaatggttctgagatagccgaggatgaaatcaagaaatacatttcacaacaggtggttttttacaagagaatatgtagagttttcttcacggactctattcctaaagcaccctcaggcaaaattctgcgaaaggtattaactgcaagacttaacgaaggtttggtggtggccaattag

SEQ ID NO: 674 - protein, 546 aa, Glycine max
MAPSPQEIIFRSPLPDIPIPTHLPLYSYCFQNLSQFHDRPCLIDGDTGETLTYADVDLAARRIASGLHKIGIRQGDVIMLVLRNCPQFALAFLGATHRGAVVTTANPFYTPAELAKQATATKTRLVITQSAYVEKIKSFADSSSDVMVMCIDDDFSYENDGVLHFSTLSNADETEAPAVKINPDELVALPFSSGTSGLPKGVMLSHKNLVTTIAQLVDGENPHQYTHSEDVLLCVLPMFHIYALNSILLCGIRSGAAVLILQKFEITTLLELIEKYKVTVASFVPPIVLALVKSGETHRYDLSSIRAVVTGAAPLGGELQEAVKARLPHATFGQGYGMTEAGPLAISMAFAKVPSKIKPGACGTVVRNAEMKIVDTETGDSLPRNKHGEICIIGTKVMKGYLNDPEATERTVDKEGWLHTGDIGFIDDDDELFIVDRLKELIKYKGFQVAPAELEALLIAHPNISDAAVVGMKDEAAGEIPVAFVVRSNGSEIAEDEIKKYISQQVVFYKRICRVFFTDSIPKAPSGKILRKVLTARLNEGLVVAN

SEQ ID NO: 675 - DNA, 1668 bp, Zea mays
  CDS (1)..(1668): n means a or g or c or t/u
atgggttccgtagacgcggcgatcgcggtgccggtgccggcggcggaggagaaggcggtggaggagaaggcgatggtgttccggtccaagcttcccgacatcgagatcgacagcagcatggcgctgcacacctactgcttcgggaagatgggcgaggtggcggagcgggcgtgcctgatcgacgggctgacgggcgcgtcgtacacgtacgcggaggtggagtccctgtcccggcgcgccgcgtcggggctgcgcgccatgggggtgggcaagggcgacgtggtgatgagcctgctccgcaactgccccgagttcgccttcaccttcctgggcgccgcccgcctgggcgccgccaccaccacggccaacccgttctacaccccgcacgaggtgcaccgccaggcggaggcggccggcgcccggctcatcgtgaccgaggcctgcgccgtggagaaggtgcgggagttcgcggcggagcggggcatccccgtggtcaccgtcgacgggcgcttcgacggctgcgtggagttcgccgagctgatcgcggccgaggagctggaggctgacgccgacatccaccccgacgacgtcgtcgcgctgccntactcctccggcaccaccgggctgcccaagggcgtcatgctcacccaccgcagcctcatcaccagcgtcgcgcagcaggttgatggcgagaacccgaacctgtacttccgcaaggacgacgtggtgctgtgcctgctgccgctgttccacatctactcgctgaactcggtgctgctggccggcctgcgcgcgggctccaccatcgtgatcatgcgcaagttcgacctgggcgcgctggttgacctggtgcgcaggtacgtgatcaccatcgcgcccttcgtgccgcccatcgtggtggagatcgccaagagcccccgcgtgaccgccggcgacctcgcgtccatccgcatggtcatgtccggcgccgcgcccatgggcaaggagctccaggacgccttcatggccaagatccccaatgccgtgctcgggcaggggtacgggatgacggaggcaggccccgtgctggcgatgtgcctggccttcgccaaggagccgtacccggtcaagtccgggtcgtgcggcaccgtggtgcggaacgcggagctgaagatcgtcgaccccgacaccggcgccgccctcggccggaaccagcccggcgagatctgcatccgcggggagcagatcatgaaaggttacctgaacgaccccgagtcgacgaagaacaccatcgaccaggacggctggctgcacaccggcgacatcggctacgtggacgacgacgacgagatcttcatcgtcgacaggctcaaggagatcatcaagtacaagggcttccaggtgccgccggcggagctggaggcgctcctcatcacgcacccggagatcaaggacgccgccgtcgtctcaatgaacgacgaccttgctggtgaaatcccggtcgccttcatcgtgcggaccgaaggttctcaagtcaccgaggatgagatcaagcaattcgtcgccaaggaggtggttttctacaagaagatccacaaggtcttcttcaccgaatccatccccaagaacccgtcgggcaagatcctgaggaaggacttgagagccaggctcgccgccggtgttcactga

SEQ ID NO: 676 - protein, 555 aa, Zea mays
MGSVDAAIAVPVPAAEEKAVEEKAMVFRSKLPDIEIDSSMALHTYCFGKMGEVAERACLIDGLTGASYTYAEVESLSRRAASGLRAMGVGKGDVVMSLLRNCPEFAFTFLGAARLGAATTTANPFYTPHEVHRQAEAAGARLIVTEACAVEKVREFAAERGIPVVTVDGRFDGCVEFAELIAAEELEADADIHPDDVVALPYSSGTTGLPKGVMLTHRSLITSVAQQVDGENPNLYFRKDDVVLCLLPLFHIYSLNSVLLAGLRAGSTIVIMRKFDLGALVDLVRRYVITIAPFVPPIVVEIAKSPRVTAGDLASIRMVMSGAAPMGKELQDAFMAKIPNAVLGQGYGMTEAGPVLAMCLAFAKEPYPVKSGSCGTVVRNAELKIVDPDTGAALGRNQPGEICIRGEQIMKGYLNDPESTKNTIDQDGWLHTGDIGYVDDDDEIFIVDRLKEIIKYKGFQVPPAELEALLITHPEIKDAAVVSMNDDLAGEIPVAFIVRTEGSQVTEDEIKQFVAKEVVFYKKIHKVFFTESIPKNPSGKILRKDLRARLAAGVH

SEQ ID NO: 677 - DNA, 1659 bp, Brassica napus
  CDS (1)..(1659)
atggaacttttgctcccacacccttcaaactcatctcctctgactgttctcggttttttggaccgagccgccgccgtttacggcgactctccttccctcctccacgataccaccacccatacttggtctgaaacccactctcgatgtctccgagtcgcttcgactctatcttcctcctccctcggaatcaaccgtggccaagttgtctccgttattggtcccaacgttccttctgtctacgagcttcagttcgcggttccaatgtctggagcagtcctcaataacatcaaccctcgtttagacgctcatgcactctctgttgttctacgtcacagtgaatccaagctcgttttcgtcgaccatcactcgagttctttagtcctcgaagctctctcgttcttgcccaagaatgagaagcctcgtctcgtcctcctccaagatgacagcaacatatccggcttaaccaatatgtcggcctcttcgtctgctgacgtggattttctcgacacttacgaaggtgttatggagagaggagacccgaggttcaagtgggtccgtcctaacaacgagtggaacccaatggtgcttaactacacttccggaacgacgtcgtctcctaaaggtgtggtacttagtcacagagcagttttcatgagtaccgttaactctttgctctactggtctatgcctaaccgaccagtctacctatggaccctaccgatgttccacgccaacggttggggctacacatgggccacagctgctgtgggggccacaaacatttgtgtccgaagagtagacgctccgaccattttcgagttgatcgacaagcatcaagtgactcacatgtgcgccgcgccgatggttctcaacatgttgactaactatccatctaggaaacagcttaaacggccggtccagattatgacagctggagctccacctccggccacggtcatttcaagcgccgagagtctaggttttgatgtggctcacggttacgggctgacagaaactggtggtctagttgtcacatgtgcgtggaagccggagtgggacgggctaggacaagacgagagagcgagactgaagtcaaggcaaggaatcagaaccgcggtattcgcggaagctgacgtgttggacacgctaacgggaaagagcgtgaagcacgacggagtaactgtgggagagattgtcttcagaggtggttgtgtcatgttgggttactacaatgacccggaagggaccgccgcgagtatgagagaagacggatggttctacactggagacattggtgtgatgcacccggacggttacttggaagtcaaggataggtcaaaagatgtgatcatatgtggaggagagaacataagcagcacggaagttgagacggttttgtacacgaacccggcggttaaggaagcagctgtggtggctaaaccggataagatgtggggagagactccttgtgcgtttgtgagcttgaagtgtagtgatcgtgggtcagttactgagagagaggtaagggagttttgtaagaagaagctaccaaagtatatggttccaaggaatgtggttttcatggaggagcttccaaagacttctactggaaagattcagaagttcctgctcagacaaatggccaagtctttgccttga

SEQ ID NO: 678 - protein, 552 aa, Brassica napus
MELLLPHPSNSSPLTVLGFLDRAAAVYGDSPSLLHDTTTHTWSETHSRCLRVASTLSSSSLGINRGQVVSVIGPNVPSVYELQFAVPMSGAVLNNINPRLDAHALSVVLRHSESKLVFVDHHSSSLVLEALSFLPKNEKPRLVLLQDDSNISGLTNMSASSSADVDFLDTYEGVMERGDPRFKWVRPNNEWNPMVLNYTSGTTSSPKGVVLSHRAVFMSTVNSLLYWSMPNRPVYLWTLPMFHANGWGYTWATAAVGATNICVRRVDAPTIFELIDKHQVTHMCAAPMVLNMLTNYPSRKQLKRPVQIMTAGAPPPATVISSAESLGFDVAHGYGLTETGGLVVTCAWKPEWDGLGQDERARLKSRQGIRTAVFAEADVLDTLTGKSVKHDGVTVGEIVFRGGCVMLGYYNDPEGTAASMREDGWFYTGDIGVMHPDGYLEVKDRSKDVIICGGENISSTEVETVLYTNPAVKEAAVVAKPDKMWGETPCAFVSLKCSDRGSVTEREVREFCKKKLPKYMVPRNVVFMEELPKTSTGKIQKFLLRQMAKSLP

SEQ ID NO: 679 - DNA, 1689 bp, Glycine max
  CDS (1)..(1689)
atgataactctagctccttctcttgatactccaaaaactgatcaaaaccaagtttctgatccccaaactagccatgtcttcaaatcaaaattaccagatatcccaatctccaaccacctccctctccactcctactgcttccagaacctctcccaatttgcccaccgcccttgcctcatcgtcggacccgcctccaaaaccttcacctacgccgacacccacctcatttccagcaagatcgccgccggattgtccaacctcggaatcctcaagggcgacgtcgtcatgatcctcctccagaactccgccgatttcgtcttctccttcctcgccatctccatgattggcgccgtcgccaccaccgccaacccgttctacaccgccccggagatcttcaagcagttcaccgtctccaaggcgaagttgatcataacacaggcaatgtacgtggacaagctccgcaaccacgacggcgcgaagctcggcgaggacttcaaggtcgtaaccgtcgacgatccgccggagaattgcctccacttctctgtcctctcggaggcgaacgagagcgacgtgccagaggtggagatccacccggacgacgcggtggcgatgccgttctcctccggcacgacgggtttacctaaaggagtgattctcacgcacaagagtttaaccacgagtgtggcgcagcaagttgacggagagaaccctaacctctacctcaccaccgaggacgtgctcctctgcgtgcttccgctctttcacatattctcgctcaacagtgtgctattgtgcgccctcagggcggggagtgcagttttgttgatgcagaagttcgagatcgggacactgctggagctgatacagcggcaccgagtgtcggtggcgatggtggtgcccccgctggtgttggcgttggcaaagaatccgatggtggcggattttgacctgagttcaatacggttagtgctgtccggagctgctcccttggggaaggagctcgaggaggctctccggaacaggatgcctcaagctgttttgggacagggttacgggatgacagaagcagggccagtgctgtccatgtgcttgggctttgcaaagcaacctttccaaacaaaatcaggctcttgtggtaccgtagtcagaaatgcagaactcaaggttgttgaccctgaaactggtcgttctcttggctacaatcaacccggtgaaatttgcatccgagggcaacagatcatgaaaggatatctgaacgatgaggcagcgacagcatcgaccatagattcagagggttggcttcacaccggtgatgttggctacgtagatgatgatgacgaaattttcattgttgacagggtgaaggaactcatcaaatataaaggcttccaggtgccccctgcagaacttgaagggcttcttgtaagccatccctccattgcagatgcagctgttgtcccacaaaaggatgttgctgctggtgaagttcctgttgccttcgttgtgagatcaaacggctttgatctaactgaagaggctgtaaaagagtttatagctaaacaggtagtgttttacaaaagactgcacaaagtttattttgttcatgctattcccaagtctccatcaggaaagatattaaggaaagacctcagagcaaagctagaaaccgccgccactcagacgccttaa

SEQ ID NO: 680 - protein, 562 aa, Glycine max
MITLAPSLDTPKTDQNQVSDPQTSHVFKSKLPDIPISNHLPLHSYCFQNLSQFAHRPCLIVGPASKTFTYADTHLISSKIAAGLSNLGILKGDVVMILLQNSADFVFSFLAISMIGAVATTANPFYTAPEIFKQFTVSKAKLIITQAMYVDKLRNHDGAKLGEDFKVVTVDDPPENCLHFSVLSEANESDVPEVEIHPDDAVAMPFSSGTTGLPKGVILTHKSLTTSVAQQVDGENPNLYLTTEDVLLCVLPLFHIFSLNSVLLCALRAGSAVLLMQKFEIGTLLELIQRHRVSVAMVVPPLVLALAKNPMVADFDLSSIRLVLSGAAPLGKELEEALRNRMPQAVLGQGYGMTEAGPVLSMCLGFAKQPFQTKSGSCGTVVRNAELKVVDPETGRSLGYNQPGEICIRGQQIMKGYLNDEAATASTIDSEGWLHTGDVGYVDDDDEIFIVDRVKELIKYKGFQVPPAELEGLLVSHPSIADAAVVPQKDVAAGEVPVAFVVRSNGFDLTEEAVKEFIAKQVVFYKRLHKVYFVHAIPKSPSGKILRKDLRAKLETAATQTP

SEQ ID NO: 681 - DNA, 3359 bp, Methanothrix soehngenii
  CDS (310)..(2328)
gtcgacctgcaggtcaacggatctgtgagcctgaataagttggaattaacagtattcttccagcggccgggcacggctgcttttaggctcttcgagattcgaccatctcttcaagccatagggtctataatctttattatttataattattaacaagcaaaaaccttatttatctgaaagacaaatcggaaatgtgcaaaactgctgttctctatgacgaattagagtggacagcgggcatgttcttcgcgtcaagttttccctgggataggagaaaagtgcgcgaaatattaggctttgatttaggagatgttgaaattggctggcaaagaagacaagaagttgaagacgacagtatttcaggacgagaccagaatctttaatccgccaaaagagttggtagaaaagtcaatcgtgatgcagtggatgaagaagaaagggttcaagactgagaaggagatgcgtgcttggtgctcctctgatgagcattacctcgagttctgggacgagatggcaaagacgtacgttgactggcacaagccctatactaaggtgatggacgactcggagatgccctacttccactggttcactggaggtgagatcaacatcacatacaacgccgtggacaggcacgccaagggcgcaaagaaggacaaagttgcatacatatggataccagagcctacagaccagccagtccagaagatcacctacggcgacctctataaggaggtcaataagttcgcaaacggcctcaagagcctcggcttgaagaagggggatcgggtcagcatctacatgcccatgataccccagcttcccatcgccatgctcgcctgcgccaagctcggcgtcagccacatcgtggttttctccggattcagctccaaaggcctgatggacagggctgctcactgcggttccagagccatcatcaccgtggatggattctacaggcgcggaaagccggtgcctctgaagccgaacgccgacgaggcagctggcggcgctccgtcagttgagaagattatcgtctacaagcgtgcgggcgttgacgtttccatgaaagagggcagggacgtctggtggcatgatctggtcaagggccagtccgaagagtgtgagccggtatgggttgacccggagcacaggctgtatatcctctacacctccggcacaaccggcaagcccaagggtatcgagcacgcaacgggcggaaacgccgtcggaccggctcagacgcttcactgggtcttcgacttgaaggacgacgatgtctggtggtgtaccgccgatattggatgggtcaccggtcactcctacatcgtctacgctccgctcattctgggcatgaccagcctcatgtacgagggcgctgcagactatccagacttcggtaggtggtggaagaacatccaggaccacaaggtcaccgtcctttacactgcccccacggcggtaaggatgttcatgaagcagggcgcagaatggcctgataagtacgacctctcaagcctgaggctactgggatctgtgggcgagccgatcaatccggaggcctggatgtggtatcgtgagcacattggacgaggcgagctccagatcatggacacctggtggcagaccgagaccggaaccttcctcaactctccgctgcccatcacgccactgaagcccggatcgtgcacattcccgctccccggatatgacatatccatcctggatgaggaagggaatgaggttcctctgggatccggaggcaacatagtggcattgaagccctatccttcgatgctcagggcgttctggggcgacaaagagaggttcatgaaggagtactggcagttctactgggatgttcccggccgccgcggcgtctatctcgctggagacaaggcgcagagggacaaggacggctacttcttcatccagggcagaatcgatgatgttctcagcgtcgcaggccacaggatagccaacgccgaggtcgagtctgccctggtggctcaccccaagatagccgaggcggcagtagttggaaagcccgacgaggttaagggcgagtcgatcgtcgccttcgtcattctgagggtcggaaatgaaccgtcccctgagctggcaaaggatgcgatcgctttcgtcaggaagacccttgggccggtggctgcgcccacggaggtccacttcgtcaacgacctcccgaagacgaggagcggcaagataatgcgccgtgtcgtcaaggcgagggcccttggaaacccggttggggacatatcgaccctgatgaatccagaagcagtggatgggatccccaagatcgtctgatggggatcctatttttttatcagattagcggagctaaagtcttctttttccatcaagtcttgatgatgctttaacgttctcatccatacaatatggcaatttctaaaagcctagtgttttgttaatcacgttaaataatgataattatcaatcataacgttaagtcacctcgatagatttataaatgaaaaaacaggttaattatcgatcgctacaatattcccaatggctcctgctggctgggattttggccctattgcgataataaaaggaatgccagatggctgcgttgggctggctgcctggcatcaggatagatcaggcggagagttgggaagacgtggggattataaaggaggctgtaaatttggctgaggaaaaagcaactgcaaagacatcagttttactggaagagacaaggatattcgaggcacccaaggatctggcagagaactccaacgtaatgaagtggatgaaagagaaaggcttcaagacagagcgcgagatgcgcctctggtgctctgccaactacatccagttctggggagagatggccaagacctacgcagattggtttgagccctggtcctcaaccctagaatggaagccaccatatgccaaatggttcgtgggcggcaagtgcaatgtgacccacaactgcgtggataggcatgcccagggggccaagaagataaggtggccatatattcgtgcctgaacctacagatcagcccactcaaaagatcacttatgcacagctggaaaaggaggtcaataagttcgccaacggcctgaagagcctgggcgtggtaaagggagacagagtcatgttatacatgcccatgatccctcaactgcccatcgccatgctggccatagccaagattggcgccattcactgcattgtattctctggattttcctctggcggcctaaacagcagaatcatggacgccgaggccaaagtggttattactgtggatggtttctaccggcgcggcaagccgctgcccctcaagccaaatgtcgac

SEQ ID NO: 682 - protein, 672 aa, Methanothrix soehngenii [sequence omitted]

SEQ ID NO: 683 - DNA, 3802 bp, Alcaligenes eutrophus
  CDS (722)..(2704)
cccgggcgatattcagcacggcgatgccggtcatcgccagcagcaccgatgccaccgtgcgccgcgacagccgttcgcgcagcagcagccacgacaggatcgccaccgtggccgggatggtgctggtgatcacgccggccgccatggcgctggtcagccgcacgcccattgagcatcagcagcgtaaacaggaaggtgccgaagaacgcctgcaggaacaggttcagccattccccgcgcgagacccggcgcatgcgcgcgggccggtaccagggcgccaggcagacgatggcaatgacaaaacgcagcagcgcgaacagcagcaccggcacatgcgcgatgatcgatttgccgaggcccacgttgctgccgaccagtgccatcgaggcaaccaggaagagggcgtagaccggggagaatgctgaagggttggcgggcacgggtacggccttggtcttccggcgggcgccgcggcgggtgctgagccggcaggagcggcaagggtaagcgccgcgatcaggtatggaactcgcggcattatagctgtgcatgcctaatggagaaggctgcactttcgcggcacgtgcgtggatttttcccgctgcattgcaacaagttgcaggcacgccccggcccaccgtcaggtcttaccgtcaggtttaagtaagccgtcgggcgtaacgtggcagccaaagccagtccaaaatcaggagacaaacctatgtccgccatcgaatcggtgatgcaagagcatcgcgtgttcaacccgcccgaaggcttcgccagccaggccgcgatccccagcatggaggcctaccaggcgctgtgcgacgaagccgagcgtgactatgaaggtttctgggcgcgccacgcgcgcgagctgctgcactggaccaagcccttcaccaaggtgctggaccaaagcaacgcaccgttctacaagtggttcgaagacggcgagctcaacgcctcttacaactgcctggaccgcaatctgcagaacggcaatgcggacaaggtcgcgatcgtgttcgaggccgacgacggcagcgtgacgcgcgtcacctaccgcgagctgcatggcaaggtgtgccgcttcgccaacggcctgaaggcgctcggcatcaggaagggcgaccgcgtggtgatctacatgccgatgtcggtcgaaggcgtggtcgcgatgcaggcctgcgcacgcctgggcgccacgcactcggtggtgttcggcggcttctcggccaagtcgctgcaggagcggctggtggacgtgggcgcggtggcgctgatcaccgccgacgagcagatgcgcggcggcaaggcgctgccgctcaaggccatcgccgatgacgcgctggcgctgggcggctgcgaggccgtcaggaacgtgatcgtctaccgccgcaccggcggcaaggttgcctggaccgaaggccgcgaccgctggatggaagatgtcagcgccggccagccggatacctgcgaagccgagccggtgagcgccgagcacccgctgttcgtgctctacacctccggctccaccggcaagcccaagggcgtgcagcacagcaccggcggctacctgctgtgggcgctgatgacaatgaagtggaccttcgacatcaagcccgacgacctgttctggtgtaccgcggacatcggctgggtcaccggccacacctatattgcctacggcccgctggccgcgggcgccacccaggtggtgttcgaaggcgtgccgacctaccccaacgccggccgcttctgggacatgatcgcgcgccacaaggtcagcatcttctacaccgcgccgaccgcgatccgctcgctgatcaaggccgccgaggccgacgagaagatccacccgaaacagtacgacctgtccagcctgcgcctgctcggcaccgtgggcgagccgatcaaccccgaagcctggatgtggtactacaagaacatcggcaacgagcgctgcccgatcgtcgacaccttctggcagaccgagaccggcggccacatgatcacgccgctgccgggcgcgacgccgctggtgccgggttcgtgcacgctgccgctgccgggcatcatggccgccatcgtcgacgagaccggccatgacgtgcccaacggcaacggcggcatcctggtggtcaagcgtccgtggccggccatgatccgcaccatctggggcgatccggagcgcttcaggaagagctacttccccgaagagctcggcggcaagctctacctggccggcgacggctcgatccgcgacaaggacaccggctacttcaccatcatgggccgcatcgacgacgtgctgaacgtgtcgggccaccgcatggggacgatggagatcgagtccgcgctggtgtccaacccgctggtggctgaagccgccgtggtgggccgccccgacgacatgaccggcgaggccatctgcgccttcgtcgtgctcaagcgttcgcgtccgactggcgaagaggccgtcaagatcgcgacggagctgcgcaactgggtcggcaaggagatcggcccgatcgccaagcccaaggacatccgctttggcgacaacctgcccaagacgcgctcgggcaagatcatgcggcgcctgctgcggtcgctggccaagggggaggagatcacgcaggacacctcgacgctggagaatccggccatcctggagcagctcaagcaggcgcagtgatcgtctggcttcggcccgatcgagcccttgaacccgccgccgcgttcccgcgcgccggcgggtttgttacgatagccccccaccgaccacggaccgtccccaatgcctgaagcccagtcgcgctttcgccgacggttgctgctgtactacggcctgttcacgctagggttgttcggcttcgtcggcatgatggggctgcttgaaaagtccaatgccgatgcgctgtggctcggctacgtcttcctcttcatcaccatcgcgatctatgcctgcatcggcctgatctgccgcacctctgacctgaacgagtactacgttgcctcgcggcgcgtgccggcgctgttcaacggcatggcgattgccgccgactggatgagcgcggcgtccttcatcggcctggccggcatcctgtttgcctcgggctacgaagggctggcctatgtgatgggctggaccggcggctactgcctggtggccttcctgctggcgccgtacctacgcaagtacggcggctacaccattcccgatttcctcgcggcgcgctacggcaacggcaagcccggcggcaacctgccagtgcgcgcgatcgcggtgctggcggcctcgctctgctccttcgtctacctggttgcgcagatccagggcgtggggctggtggtgacgcgctttatcggcgtggagtttgccgtcggcatcttcttcgggctggccggcatcctggtgtgctcgttcctgggcggcatgcgcgcggtcacatggacgcaggtggcgcagtacatcatgatgatcgtcgccttcctggtcacggtatcgatgatcgcgtggaagcatcaccacgaagcgttgccgcagctcagctacggcacgctgctgtcgcaactcgacgcgcgcgagcagcagctggagcgcgagccggccgagcaggccgtgcgcgagtactaccggcagcaggccatcctgctgcaggagcgcatcgcccggctgcccgattcctttgcccaggagcgtgacgcgctcgacgcgcggctgcaggacctgcgcacgcgcaatgccccgctgcgcgacatcaagtcgctggagcgcgaacggctggaattc

SEQ ID NO: 684 - protein, 660 aa, Alcaligenes eutrophus [sequence omitted]

SEQ ID NO: 685 - DNA, 1845 bp, Phanerochaete chrysosporium
  CDS (1)..(1845)
atgcaccagcagacggtgggccatgagtccgacaagtggtgggccaagatggcgcgcgataccctgcacagggatcgccccttccacaccgttcgcgcaggcggcttcgagacaggcgacatcgtttggttcccagaaggcggcctgaacgcatcgttcaactgcgttgacagatgggcgttcaagcaccctgataagacggccatcatctacgaggccgacgagccgaacgagggctgcgagatcacgtatgcgcagctgccgcgaggtctgcagagagtcgcgaacgtgctcaagtcgctcggcgtcaagaagggcgacaccgtgtcggcgtacctgcccatgacatggcaggccgtcgccgcgttcctcgcatgcgcgcgcatcggcgtgcactctgtcgtcttcgcgggcttctctgccgagtccctgcgcgaccgtatgaacgactgcaagtcccgcgtgctcatcaccctcgacgaggcgcgcggcggcaagacgatcgcgaccaaggtcatcgccgacgccgcgatcaagcagtgccccggcgtcgagcacgtccttgtcctccgccgcaccggcaacgaggtgccctggaccgagggtcgcgacaagtggtggcacgaggagaccgccaaggtccccaactactgcccgccggaggtcatgtctgcagaggacccgctgttcatcctgtatacgtctggctcgactggcaagcccaagggtgtcgtccataccaccggtggatactcctttggcgctgcgctcaccgtcaagtacgtcttcgacgtgcaccccgacgacaagtttgcctgcatggctgacattggttggatcaccggccacacttacatcgtgtatggcccgctgtgcaacggtgtgtcgacgcctgtatacccgacgccctcgcgctactggcagaccgtcgagaagcacaagctcacgcagttttactctgcacccaccgcgatccggctgctccgccgcctcacggggacccacgtccaggaccacgacctcagctcgctccgcgtcctcggctctgtcggtgaaccgattaacccggaggcgtggcactggtacaacgaccacgtcggcaagccccagtgcgccatcgtcgacacgttctggcagaccgagaccggctcgatcgtcgtcactcccttccccggtgcgattgagaccaagcccggctccgcgaccgtcccgttctttggcattgagcctgccatccttgaccccgtctcaggcgaggagctcaagggtgataacgtcgagggtgtcctcgtcctcaagaccccatggccatcaatggcccgcacggtctaccaggaccacaaccggtacctggagacatacatgaagccctaccctggctacttctacactggtgacggccacgggcgcgacgagcacggctacatctggatcaagggccgtgttgatgacgttatcaacgtctccggcgacctgtcgacggcggagatcgagtcgtcgctcatccttcacaaggcggtcgcggagacggcggtcgtgggcacggcggacgagctcacgggccaggcggtgtcgttcgtgacgctcaagcccgagttcaagtgcaccccgcgggaggccgggctcgtgaaggagctcgtgctgcaggtgcgcaaggtcatcgggccgttcgcgccgaagaagatcttcatcgtgcccgacctgcccaagacgcgctcgggcaagatcatgcgtcgcatcatgcgcaagatcgtcgccggcgagggcgacagccttggcgacctcagcacgctcgccgagcccggcgtcgtcgacgtcatcaagactaaggtcgcgtcgtcctga

SEQ ID NO: 686 - protein, 614 aa, Phanerochaete chrysosporium
MHQQTVGHESDKWWAKMARDTLHRDRPFHTVRAGGFETGDIVWFPEGGLNASFNCVDRWAFKHPDKTAIIYEADEPNEGCEITYAQLPRGLQRVANVLKSLGVKKGDTVSAYLPMTWQAVAAFLACARIGVHSVVFAGFSAESLRDRMNDCKSRVLITLDEARGGKTIATKVIADAAIKQCPGVEHVLVLRRTGNEVPWTEGRDKWWHEETAKVPNYCPPEVMSAEDPLFILYTSGSTGKPKGVVHTTGGYSFGAALTVKYVFDVHPDDKFACMADIGWITGHTYIVYGPLCNGVSTPVYPTPSRYWQTVEKHKLTQFYSAPTAIRLLRRLTGTHVQDHDLSSLRVLGSVGEPINPEAWHWYNDHVGKPQCAIVDTFWQTETGSIVVTPFPGAIETKPGSATVPFFGIEPAILDPVSGEELKGDNVEGVLVLKTPWPSMARTVYQDHNRYLETYMKPYPGYFYTGDGHGRDEHGYIWIKGRVDDVINVSGDLSTAEIESSLILHKAVAETAVVGTADELTGQAVSFVTLKPEFKCTPREAGLVKELVLQVRKVIGPFAPKKIFIVPDLPKTRSGKIMRRIMRKIVAGEGDSLGDLSTLAEPGVVDVIKTKVASS

SEQ ID NO: 687 - DNA, 1938 bp, Pseudomonas aeruginosa
  CDS (1)..(1938)
atgttcgagatcagcgtccacccggtgccggacgccgtccgccagcgtgcctacctgaacgacgacgactaccagcgcctgtaccgccaatccgtcgagaaccccgacgagttctggggcgagcaggccaaggccttcctcgattggttcaagccctggcacagcgtccaccacggcgacctgaggaaaggccaggccacttggttcaagggcggccagttgaacgtcgcctacaactgcatcgatcgccacctggaacgccgcggcgaacagatcgcgatcgtctgggaaggcgacaaccccagcgaatccgcgcacatcacctaccgcaagctgcaccacaacgtctgccgcctggctaacgtgctgaagagccgcggcgtggaaaagggcgaccgggtctgcatctacatgccgatgattcccgaggccgcctacgccatgctcgcctgcgcccgtatcggggcggtgcactcggtggtgttcggcggcttctcgccggactcgctgcgcgaccgcatcctcgatgccgactgccgcaccgtgatcaccgccgacgagggcgtgcgcggcggcaagtacatcccgctgaagcagaatgtggaaaaggcactgaaggactgcccggacgtctctaccgtggtggtggtcgagcgcacccagggcgacataccctgggtcgaaggccgcgacatctggtaccacgaggcgctccacgcggcctcagccgactgcccggcggaagcgatggacgccgaggacccgctgttcatcctctatacctccggcagcaccggcaagccgaagggcgtgttgcacaccaccgggggctacctgctcggcgcggcgatgacccacaagtacgtgttcgactaccacgatggcgacgtctactggtgcaccgccgacgtcggctgggtcaccggacacagctatatcgtctacggcccgctggccaacggcgccaccaccctcatgttcgagggcgtgcccaactacccggacgcctcgcgcttctggcaggtgatcgacaagcaccaggtgaatatcttctacaccgcgccgaccgcgatccgcgcgctgatgcgcgaaggcgacgccccggtccgccagacctcgcgcagcagcctgcgcctgctcggctcggtgggcgagccgatcaacccggaggcttgggagtggtactaccaggtggtcggcgagaagcgctgccccatcctcgatacctggtggcagaccgagaccggcagcatcctgatcaccccgttgcccggcgccactgcgctaaagccaggctcggctacccgcccgttcttcggcgtgcaacccgtgctgctcgacgagaaaggcaaggaaatcgacggcgcgggcagcggcgtactggcgatcaaggccagttggccgagtcagatccgcagcgtctacggcgaccaccagcggatgatcgacacctacttcaagccctaccccgggtattacttcagcggcgacggcgcgcgccgcgacgaggacggctactactggatcaccggccgggtcgacgacgtgatcaatgtctccggacaccggatcggcaccgccgaggtcgagagcgcgctggtcctgcacgatgcggtggccgaggcggcagtggtcggctgcccgcatgacgtgaagggccaggccatctacgcgttcgtcaccctgatggccggcagtcagcccagcgaggcgctacaacaggaattgctggccctggtcggcaaggagatcggcagcttcgccaagccggatcacctgcaatgggcgcccagcctgccgaagacccgctccggcaagatcatgcggcgtatcctgcgcaagatcgcctgcaacgagctggacagtctcggcgatacctcgaccctggccgatccgggagtggtgcaggggttgatcgacaaccgcctcaaccgctga

SEQ ID NO: 688 - protein, 645 aa, Pseudomonas aeruginosa [sequence omitted]

SEQ ID NO: 689 - DNA, 1668 bp, Pseudomonas aeruginosa
  CDS (1)..(1668)
atgcgcgactacgccaccactgccgccgggttcgacttgcagcggaccgccgccgccacgctttccggtacgctccaggcgctcaacgcctgcgtcgaatgctgcgaccggcatgccctgccgggtcggatcgcgttgttctgggagggcaaggatggcagtcgcgccagctataccttcagcgagctgaaagcgctctccggacgtttcgccaatttcctccaggcccagggcgtacgcccgggcgactgcgtcgccggcctgttgccgcgcacgcccgagctgctggtcaccatcctcggcgcctggcgcctgggcgcggtgtaccagccgctgttcaccgccttcggcccgaaggccatcgaacaccgcgtggcgaccgccggcagcaaggtgctggtcaccgatgcggccaaccgcgacaagctcgacgaactcgccgatccgcctctggccgtcaccgtcggcggaccgaaggggcagggcatccgtcgcggcgatttcagcttctgggccgagctggagcgctatccggccgaattcgaaccggttccgcgcagcggcgaggatccgttcctgatgatgttcacctccggcaccaccggcctggccaaaccggtgccggtgccgctcaaggcgatcctcgccttcgtcggctacctgcgcgaggcggtggacctgcgccccgaggacgccttctggaacctcgccgatccgggctgggcctacggcctctactacgctgtcgccggtcccctcgccatgggccatccgaccaccttctacgaagggccgttcagcgtggaaagcacctgccggatcatccgtgactacggcatcaccaacctcgccggatcgcccaccgcctatcgcctgctgatggccgccggcgcggccgcggaaactgcgctgaaggggcgcctgcgcgcggtcagcagcgccggcgagccgttgacgccggaggtgatccgctggttcgccgacaggctcggcaccaccatccacgatcattacgggcagaccgagctgggcatggtgctgtgcaaccaccatgccctggcgcatccggtgcgggtcggcgccgccgggttcgcctgtcccgggcaccgggtagtagtgctggacgacgatctcaacgaactgccgcccggccagccaggcatcctcgccctcgaccggcggcgttcgccgctgatgtggtttcccggctaccagggcctggaaaccgcagccttcgtcggcgactactacctgagcggcgataccgtcgaactcaacgaagacggcagcatcagcttcgtcggccgcgccgacgacgtcattaccacctctggctaccgggtcggcccgttcgatgtggagagcgcgctgatcgaacacccggcagtgatggaggcggcggtgatcggcaagcccgacccggagcgcaccgaactggtcaaggccttcgtcgtgctctgcgccggccaccggccgacgccggaactggcggacgcattgcagcgatacgtgcgccagcgcctgtcggcgcacgcctacccgcgggagatcgagttcctcgaggaactgccgaagactcccagcggcaagatccagcgctttctcctgcgcaaccaggagatcgcccggcaacgcgaggcggccccacgggcggccgccgcgaactga

SEQ ID NO: 690 - protein, 555 aa, Pseudomonas aeruginosa
MRDYATTAAGFDLQRTAAATLSGTLQALNACVECCDRHALPGRIALFWEGKDGSRASYTFSELKALSGRFANFLQAQGVRPGDCVAGLLPRTPELLVTILGAWRLGAVYQPLFTAFGPKAIEHRVATAGSKVLVTDAANRDKLDELADPPLAVTVGGPKGQGIRRGDFSFWAELERYPAEFEPVPRSGEDPFLMMFTSGTTGLAKPVPVPLKAILAFVGYLREAVDLRPEDAFWNLADPGWAYGLYYAVAGPLAMGHPTTFYEGPFSVESTCRIIRDYGITNLAGSPTAYRLLMAAGAAAETALKGRLRAVSSAGEPLTPEVIRWFADRLGTTIHDHYGQTELGMVLCNHHALAHPVRVGAAGFACPGHRVVVLDDDLNELPPGQPGILALDRRRSPLMWFPGYQGLETAAFVGDYYLSGDTVELNEDGSISFVGRADDVITTSGYRVGPFDVESALIEHPAVMEAAVIGKPDPERTELVKAFVVLCAGHRPTPELADALQRYVRQRLSAHAYPREIEFLEELPKTPSGKIQRFLLRNQEIARQREAAPRAAAAN

SEQ ID NO: 691 - DNA, 1947 bp, Bacillus halodurans
  CDS (1)..(1947)
atgacagcgcctgtctggtttccatcggatgcttacaaagagcaaacgagattgtatcaatggatgaaaatgctcggctattcgtcctatgacgatttttatcaacgttcgatcgacgacattgcttggttttggcgggaagtggagcgggagctagacattccatggatgaagccttatgatcatgtccttgcaatggagaaagggcctgcctggcctgaatggtttatcggtggcaaattaaatgtgacggaagcagccgtggaaaaatgggcgaatgatccaaagaccgcaaataaaacggcgatcgtctgggaaggggaagaaggaaagacttccttgctatcgtttgcagcccttgatgaggcggtgaaacgtgcagcccatggcttaaaacagcatggagtcaaaaaaggagatgtgttcgccttatacatgccgatgattcctgagacggtgattgccatgctggctgttgccaagctcggagcaatcttcacgccgattttttctggttatggtgcagaggcgatcgctacgagactacgcgcttctggagcgaaatggctcataacagtagatggctgttaccggcgaggcaagctgattgatatgaggcaagaggcggagaaagcacttgctgacgcgccgaatgtccaatcaattgtcgttgtggagcgggtcggcacgttaacatcttatggtgccaacgatatacgctggactgagcttatgacctatgctccgctccaagaaacggcagcgatgaattcggcagatcccttaatgcttatttatacttccgggacaactggacggccaaaaggagcggttcatacgcatagtggcttcccaattaaagcggcgttcgatgcaggaattggcatggatttacgaaaagaggacacgcttttttggctgacagatatgggatggatgatgggcccgtttcttgtgtttgctggtttgatcaatggggcaaccatcgtcctttacgacggtgctcctgactatccgaatcatgaccgactttggcagcttgtcgaacaaaagcaagtaagtcatttaggtatttctccgacattaattcgcgccatgatgaagtacgggacggaacgaatggctgagcatgatttgtcttgcttaaaggtgattggctctacgggggagccgtggaaccctgagccatggcattggctgtttgaacacgtcggaaataaacaggtacctatctttaattactccggagggacggaaatatcaggtgggattttagggaatgtactcgttcgaccgattggtccgataacgtttaactcagcgattccagggatggcagctgctgtttataatgaaagtggtgaaaaagtaaccgcggaagtgggggagcttgtcctaacaaagccttgggtcgggatgactaacggcttttggcaggagcctgaacggtttctcgaaacgtactggtcacgttggagcaatacgtgggttcatggagattgggtcactcttgacgcggatggattttggacgataaccggtcgatcagatgatattttaaatgtagctggcaaacgacttggaccggcagaagttgagtctgtcctagtcggtcatcaggccgtcattgaggctggaaccattggggtaccagatgatgtgaagggtgaagtgccaatctgttttgttgtcattgccccaagtttttctgagagcgactcattaagacacgaattgatccagcttgtcgggacaaagcttggaaaagcattgaagccaaaggcagtgtattttgtttccgatttaccgaagacacgaaatgcaaaggtgatgcgccgtgcgatacgggcggcctttttgcaaaaggaggcaggagatttatcctcacttgaaaaccctcatgtattaaaagaaatcgaaaggttaggaacaaagcaatcctcatag

SEQ ID NO: 692 - protein, 648 aa, Bacillus halodurans
MTAPVWFPSDAYKEQTRLYQWMKMLGYSSYDDFYQRSIDDIAWFWREVERELDIPWMKPYDHVLAMEKGPAWPEWFIGGKLNVTEAAVEKWANDPKTANKTAIVWEGEEGKTSLLSFAALDEAVKRAAHGLKQHGVKKGDVFALYMPMIPETVIAMLAVAKLGAIFTPIFSGYGAEAIATRLRASGAKWLITVDGCYRRGKLIDMRQEAEKALADAPNVQSIVVVERVGTLTSYGANDIRWTELMTYAPLQETAAMNSADPLMLIYTSGTTGRPKGAVHTHSGFPIKAAFDAGIGMDLRKEDTLFWLTDMGWMMGPFLVFAGLINGATIVLYDGAPDYPNHDRLWQLVEQKQVSHLGISPTLIRAMMKYGTERMAEHDLSCLKVIGSTGEPWNPEPWHWLFEHVGNKQVPIFNYSGGTEISGGILGNVLVRPIGPITFNSAIPGMAAAVYNESGEKVTAEVGELVLTKPWVGMTNGFWQEPERFLETYWSRWSNTWVHGDWVTLDADGFWTITGRSDDILNVAGKRLGPAEVESVLVGHQAVIEAGTIGVPDDVKGEVPICFVVIAPSFSESDSLRHELIQLVGTKLGKALKPKAVYFVSDLPKTRNAKVMRRAIRAAFLQKEAGDLSSLENPHVLKEIERLGTKQSS

SEQ ID NO: 693 - DNA, 1707 bp, Staphylococcus aureus
  CDS (1)..(1707)
atgaaagtcgaagtttataaaggagcgcaaggtaaacataaccttaaagattatgaagaaacatataatacttttgattggaaagacgtagaacaagcattttcttggagtgaaactggaaaaatgaacatggcatatgaatgtatagatcgccatgtagatcaaggattaggggataaaatagcgttaaattacaaagatgagtacagaaaagaatcgtatacttataaagatatgcaacggttatctaataaagcagcgaatgttttgtctgaacatgcagaagttgacaaaggtgacagagtatttatatttatgtcgcgtacacctgaactatattttgcgttgttaggtgttttaaaaattggtgcaattgttgggccgttatttgaagcatttatggaaaaggcagttgcggatagattagagaacagtgaagctaaagtgttaattactaataaggcattgttacctcgagtacctgtagataaattaccgaacttgaaaaaaattgttgtcgtagatgaggatgtagaagacaattacatagacttcattagtttgatggaaactgctagcgatgaatttgacattgaatggttaaagtcggatgatggtttgattttacattatacatcaggttctactgggcaacctaaaggtgtattgcatgttcaacaagcaatgttagtgcactatatttctggaaaatatgtattagatttacaagaagatgatgtttattggtgtacagcagatccaggttgggttacaggaacatcttatggtatttttgcaccatggttaaatggcgctacaaattgtatagctggtggtcgcttttcaccagaacagtggtatagtatgattgaagattttaaagtgacgatttggtatacggcaccaacagctttaagaatgttaatgagtgctggtgacgatattgttgagaaatatgacttgtcatcgttacgttcgattctatcagtaggtgagcctttaaatcctgaagttataaaatgggcgaaaaaagtatacggtttaacggtgttagatacttggtggatgacagaaacaggtggacatatgattgttaactatccaacgatggacgtcaagcttggctcaatgggcaaaccattacctggtattcaagctgcaattatcgatgatgcaggtaatgaattaccaccaaatcgaatgggcaaccttgctataaaaaaaggctggccatcaatgatgtatcgtatctggaagaatccagaaaaatataaatcatattttattggagactggtatgtatctggtgattcggcatataaagatgaagatggttacttctggttccaaggacgtgttgatgatgtaattatgacagctggtgaacgagttggaccatttgaggttgagtctaaattggttgaacacgaagcagttgccgaagcaggaattattggtaaacctgatccggttcgcggtgaaataattaaggcgtttgttgcactgagaaaaggatatgaaccaacagacgaattaaaagaagaaattcgtttatttgttaaagaaggtttgtcggcacatgcagcaccacgtgaaatcgaatttaaagataaattacctaaaacacggtcaggtaaaattatgagacgtgtattaaaagcttgggaattaaatttagatgctggggatttaagtacaatggaataa

SEQ ID NO: 694 - protein, 568 aa, Staphylococcus aureus
MKVEVYKGAQGKHNLKDYEETYNTFDWKDVEQAFSWSETGKMNMAYECIDRHVDQGLGDKIALNYKDEYRKESYTYKDMQRLSNKAANVLSEHAEVDKGDRVFIFMSRTPELYFALLGVLKIGAIVGPLFEAFMEKAVADRLENSEAKVLITNKALLPRVPVDKLPNLKKIVVVDEDVEDNYIDFISLMETASDEFDIEWLKSDDGLILHYTSGSTGQPKGVLHVQQAMLVHYISGKYVLDLQEDDVYWCTADPGWVTGTSYGIFAPWLNGATNCIAGGRFSPEQWYSMIEDFKVTIWYTAPTALRMLMSAGDDIVEKYDLSSLRSILSVGEPLNPEVIKWAKKVYGLTVLDTWWMTETGGHMIVNYPTMDVKLGSMGKPLPGIQAAIIDDAGNELPPNRMGNLAIKKGWPSMMYRIWKNPEKYKSYFIGDWYVSGDSAYKDEDGYFWFQGRVDDVIMTAGERVGPFEVESKLVEHEAVAEAGIIGKPDPVRGEIIKAFVALRKGYEPTDELKEEIRLFVKEGLSAHAAPREIEFKDKLPKTRSGKIMRRVLKAWELNLDAGDLSTME

SEQ ID NO: 695 - DNA, 1887 bp, Salmonella enterica subsp. enterica serovar Typhi
  CDS (1)..(1887)
atgtcttttagcgaattttatcagcgttccattaacgaaccggaggcgttctgggccgagcaggcccggcgtatcgactggcgacagccgtttacgcagacgctggatcatagccgtccaccgtttgcccgctggttttgcggcggcaccactaacttatgtcataacgccgtcgaccgctggcgggataaacagccggaggcgctggcgctgattgccgtctcatcagagaccgatgaagagcgcacatttaccttcagccagttgcatgatgaagtcaacgctgtggccgctatgctgctgtcgctgggcgtgcagcgtggcgatcgcgtattggtctatatgccgatgattgccgaagcgcagataaccctgctggcctgtgcgcgcattggcgcgatccattcggtggtctttggcggttttgcctcgcacagcgtggcggcgcgcattgacgatgccagaccggcgctgattgtgtcggcggatgccggagcgcgtggcggtaaaattctgccgtataaaaagctgcttgatgacgctattgcgcaggcgcagcatcagccgaaacacgttctgctggtggacagagggctggcgaaaatgtcgtgggtggatgggcgcgatctggatttttccacgttgcgccagcagtatctcggcgcgagcgtgccggtggcgtggctggaatccaatgaaacctcgtgcattctttacacctccggcactaccggcaaaccgaaaggcgtccagcgcgacgtcggcggttatgcggtggcgctggcaacctcgatggacaccatttttggcggcaaggcgggcggcgtattcttttgcgcatcggatatcggctgggtcgtcggccactcctatatcgtttacgcgccgctgctggcaggcatggcgactattgtttacgaaggactgccgacgtacccggactgcggggtctggtggaaaattgtcgagaaataccaggttaaccggatgttttccgccccgaccgcgattcgcgtgctgaaaaaattcccgacggcgcaaatccgcaatcacgatctctcctcgctggaggcgctttatctggccggtgagccgctggacgagccgacggccagttgggtgacggagacgctgggcgtaccggtcatcgacaattattggcagacggagtccggctggccgatcatggcgctggcccgcgcgctggacgacaggccgtcgcgtctgggaagtcccggggtgccgatgtacggttataacgtccagctactcaatgaagtcaccggcgaaccctgcggcataaatgaaaaaggcatgctggtgatcgaagggccgctgccgccgggttgtattcagactatttggggcgacgatgcgcgttttgtgaagacttactggtcgctgtttaaccgtcaggtttatgccactttcgactggggaatccgcgacgccgaggggtattactttattctgggccgtaccgatgatgtgattaatattgcgggtcatcggctggggacgcgagaaatagaagaaagtatctccggttacccgaacgtagcggaagtggcggtggtggggataaaagacgctctgaaagggcaggtggcggtggcgtttgtcattccgaagcagagcgatacgctggcggatcgcgaggcggcgcgcgacgaggaaaaagcgattatggcgctggtggataaccagatcggtcactttggtcgtccggcgcatgtctggtttgtttcgcagctccccaaaacgcgttccggaaagatgcttcgccgcacgatccaggcgatctgcgaaggccgtgatccgggcgatctgacaaccattgacgatcccgcgtcgttgcagcaaattcgccaggcgatcgaggaatag

SEQ ID NO: 696 - protein, 628 aa, Salmonella enterica subsp. enterica serovar Typhi
MSFSEFYQRSINEPEAFWAEQARRIDWRQPFTQTLDHSRPPFARWFCGGTTNLCHNAVDRWRDKQPEALALIAVSSETDEERTFTFSQLHDEVNAVAAMLLSLGVQRGDRVLVYMPMIAEAQITLLACARIGAIHSVVFGGFASHSVAARIDDARPALIVSADAGARGGKILPYKKLLDDAIAQAQHQPKHVLLVDRGLAKMSWVDGRDLDFSTLRQQYLGASVPVAWLESNETSCILYTSGTTGKPKGVQRDVGGYAVALATSMDTIFGGKAGGVFFCASDIGWVVGHSYIVYAPLLAGMATIVYEGLPTYPDCGVWWKIVEKYQVNRMFSAPTAIRVLKKFPTAQIRNHDLSSLEALYLAGEPLDEPTASWVTETLGVPVIDNYWQTESGWPIMALARALDDRPSRLGSPGVPMYGYNVQLLNEVTGEPCGINEKGMLVIEGPLPPGCIQTIWGDDARFVKTYWSLFNRQVYATFDWGIRDAEGYYFILGRTDDVINIAGHRLGTREIEESISGYPNVAEVAVVGIKDALKGQVAVAFVIPKQSDTLADREAARDEEKAIMALVDNQIGHFGRPAHVWFVSQLPKTRSGKMLRRTIQAICEGRDPGDLTTIDDPASLQQIRQAIEE

SEQ ID NO: 697 - DNA, 1575 bp, Nostoc sp. PCC 7120
  CDS (1)..(1575)
atgtctcagccaactatagagtcaattctgcaagaaaaacgtttatttcctcccagtaccgagttttcccaaaatgcccagattaaaagtctagaagattaccaacgtctttatgacaaagccaaagctgatccgcaaaaattttgggcagaattagccgaaacagaattgcactggttccaaaaatgggacacagtactagattggcaagcaccttttgctaagtggttcgtgggtgggaagattaacatttcctacaactgtttagatagacatctcacaacctggcggaaaaataaagccgcgttgatttgggaaggggaaccaggagattcccgtactttaacttatgcccaattgcatcgggaagtttgccagttcgccaacgtcttgaaacaactgggagtgcagaaaggcgatcgcgtcggtatttatatgccgatgataccggaagccgcgatcgctatgttagcctgtgccagaattggcgcgcctcatagtgtggtatttggtgggtttagtgcggaagcattgcgcgatcgcttaattgatgcccaagccaaggtagtagttacagctgatggtggttggcgtaaagatgcgatcgttcccttgaaagaacaggtagacaaagccttggctgatgacgctgttcccagtgtggagaatgtcctggttgtcaagcgtaccggacaagatatttatatgcagttgggaggacgagatcattggtggcacgatttacaaaaaggtgcatcggcagattgtcccgccgaaccaatggacagcgaggatttactctttgtcctctacacttctggtagcacaggcaaacccaaaggtgttgtccacaccactggcggttataacctatatactcacatgaccaccaaatggattttcgacctacaagacacagatgtatattggtgtactgccgatgtaggctggattaccggacacagttacattgtttacggccccctctccaacggtgcaaccactctgatgtatgaaggtgcgcctcgtgcctctaatcctgggtgtttctgggatgtaattgaaaaatacggcgtgaatattttctacaccgcacccaccgcaattcgcgccttcattaaaatgggcgaacaccatcccaacgcccgtaatctttcttctttaagattattaggaaccgtcggcgaacccatcaacccagaagcttggatgtggtatcacaaagtaattggtggtgaacgctgccccatagttgatacttggtggcaaacggaaactggcggtatcatgattacgcctctaccaggggcaatttccactaaacccggttccgctacccttcccttccccggcatcctggccgacatcgttgatttagaaggtaacactgtaccggaaaacgaaggtggttacttagcagtgcgttatccctggcctgggatgatgcggactgtctacggcgatccggaacgcttccgccgcacctactgggaacacatccccccaaagatgggaattatacttactttgccggcgatggtgcaagaaaagatgaagacggctatttctgggtaa

SEQ ID NO: 698 - protein, 524 aa, Nostoc sp. PCC 7120
MSQPTIESILQEKRLFPPSTEFSQNAQIKSLEDYQRLYDKAKADPQKFWAELAETELHWFQKWDTVLDWQAPFAKWFVGGKINISYNCLDRHLTTWRKNKAALIWEGEPGDSRTLTYAQLHREVCQFANVLKQLGVQKGDRVGIYMPMIPEAAIAMLACARIGAPHSVVFGGFSAEALRDRLIDAQAKVVVTADGGWRKDAIVPLKEQVDKALADDAVPSVENVLVVKRTGQDIYMQLGGRDHWWHDLQKGASADCPAEPMDSEDLLFVLYTSGSTGKPKGVVHTTGGYNLYTHMTTKWIFDLQDTDVYWCTADVGWITGHSYIVYGPLSNGATTLMYEGAPRASNPGCFWDVIEKYGVNIFYTAPTAIRAFIKMGEHHPNARNLSSLRLLGTVGEPINPEAWMWYHKVIGGERCPIVDTWWQTETGGIMITPLPGAISTKPGSATLPFPGILADIVDLEGNTVPENEGGYLAVRYPWPGMMRTVYGDPERFRRTYWEHIPPKMGIILTLPAMVQEKMKTAISG

SEQ ID NO: 699 - DNA, 1992 bp, Brucella melitensis
  CDS (1)..(1992)
atgcgctttcaccctgagactaatcacgacgcggcactcctcatcgcagggcggcgcggtgcgtgtttctggaggaacagcatgacttcgaactatgccgaaacctatgccgcatggcagaacgatcctgaaggcttctgggcggatgctgcggcggcaatagactggttcaagccgtgggagcaggttttcgcaggcggcgaaggcacctatggccgctggtacaccggggctgagtgcaatacctgctacaacgcgcttgaccgccatgtcgccaatgggcgcggcgaccagctcgcgctcatctatgaaagccctattacgggcaagacgcgcaagatcacctatcacgaacttctggaagaagtggaggcgcttgccgccgtcatgctcgataatggcgtgcagaagggcgaccgcatcctcatctatatgccgaccgtgccggaagcggtggttgccatgcttgcctcggcccgtatcggagcgattcattccgtcgtattcggcggctttgctgccaatgaacttgccacccgcatcgatgacgccaagcccgtgatgattatcgccgcgtcatgcggcattgagccatcgcgcgtggtgccctatcaggccatgctggacaaggctatttcgcttgcccatcacaaggtcgatcattgcatcatattccagcgtgaacagcaccggcatttgccggtggaaggacgcgacatcgattatcgcgaagcggtcgatgccgctcgtgaacgccatgtgccttgcgtgccggtggccgcgaccgacccgctctacgtgctttacacctccggcacgaccggcgagccgaagggcgtcgtgcgcgacaatggcgggcatatggtggcgctcgtctggtcgatgaaacacgtcttcgacgtcaagccggggcaggtctggtgggcggcctccgatgtgggctgggttgtcggccattcctatatcgtctatgcgccgctgctcattggcgcaaccagcatcctctttgaaggcaagcctgtcggcacgccggatgcgggcgaatattggcgcatcatcgaagagcatggcgtggaagtaatgttcaccgcaccaaccgcgctgcgtgccatcaagaaggaagatgcagacgggcatttcgtgcgccgccatgatctttccggattccgtgcgctttatcttgcaggcgaacgcgccgacccggacacgatccattgggcggaaaacctgctcggctgcccggtcatcgaccattggtggcagaccgaaagcggctggccgatggtcgccaatccgctcggcctcggccttctggaaaccaaatacggctcgcctgccgtctgcctgccgggctatgacattcgcgtgctggatgatgagggccacgaggtcgaacccggcacgctgggcaatattctcatcaaggtgcctctgccgcccggttgcctgccaacattgtggaacgccgatgagcgtttccgcaaggcctatctcaacgagtttccgggctattacaaaaccgccgatgcgggctatatggatgaggacggctatctctacattatgagccgtaccgacgacatcatcaatgtcgcgggccatcgcctctcaacaggcgcgatggaggaggttctctccagccatcccgatgtggccgaatgcgccgtgcttggcatttccgatcccctgaaggggcaggttccctgcggctttctggtgctgaaatccaatatcgaccgcgatccgcaggaggtcgagaaggaatgtatcagcatgattcgcgacgccatcggcccggtcgccgccttccggctggcgcttgccgtcaagcgtctgccgaagacccgctccggcaaaatcctgcgctccaccatccagaagatggcggacggacaggaatggaagatgccagcaaccatcgatgatccggccattctggacgaaatcggcacggtcctgcgtgagcggcatatcggcctcgccttcgcctga

SEQ ID NO: 700 - protein, 663 aa, Brucella melitensis
MRFHPETNHDAALLIAGRRGACFWRNSMTSNYAETYAAWQNDPEGFWADAAAAIDWFKPWEQVFAGGEGTYGRWYTGAECNTCYNALDRHVANGRGDQLALIYESPITGKTRKITYHELLEEVEALAAVMLDNGVQKGDRILIYMPTVPEAVVAMLASARIGAIHSVVFGGFAANELATRIDDAKPVMIIAASCGIEPSRVVPYQAMLDKAISLAHHKVDHCIIFQREQHRHLPVEGRDIDYREAVDAARERHVPCVPVAATDPLYVLYTSGTTGEPKGVVRDNGGHMVALVWSMKHVFDVKPGQVWWAASDVGWVVGHSYIVYAPLLIGATSILFEGKPVGTPDAGEYWRIIEEHGVEVMFTAPTALRAIKKEDADGHFVRRHDLSGFRALYLAGERADPDTIHWAENLLGCPVIDHWWQTESGWPMVANPLGLGLLETKYGSPAVCLPGYDIRVLDDEGHEVEPGTLGNILIKVPLPPGCLPTLWNADERFRKAYLNEFPGYYKTADAGYMDEDGYLYIMSRTDDIINVAGHRLSTGAMEEVLSSHPDVAECAVLGISDPLKGQVPCGFLVLKSNIDRDPQEVEKECISMIRDAIGPVAAFRLALAVKRLPKTRSGKILRSTIQKMADGQEWKMPATIDDPAILDEIGTVLRERHIGLAFA

SEQ ID NO: 701 - DNA, 1707 bp, Brucella melitensis
  CDS (1)..(1707)
atgcccacgaggaggtgggctgcaagggaggaccaccgaatgactgaaagccctgcttcagcacggctcgaccgctacgatgatgccgttgcgcagttcgatattgcaaaagccattgcgcttcttgcaggaaatcctgatacgggtatcaatgcctgcattgaatgctgcgaccgatatacgggcgaaaatcgcgtggcgctgcacgccatttccatcgacaatacgttgactgaactcacctttgaagacctgcgcgatatgtccgcgcgggtcggcaatatgctggccgatgccgggatcagcgcaggcgatgtggttgccggtcttctcccccgcacgcctgaactcgtcgccaccattctcggcgcctggcgcatcggcgcaatctatcagccgcttttcaccgccttcggcccaaaagccatcgaacagcgtttcggcaccagtggcgccaaactcgtcgtcaccaacctggccaatcgttccaaattggccgaagtggaaaactgcccccgcgtcgcaaccattcttgcccccggtgaaagcctgccggaaggcgatatcgactttcgcgcagccgtggcggcagcatcgaccgaatgcgagcccgtcatgcgcaagggcagcgaccttttcatgatgatgtccacctccggcacggcgggcctgcccaaaggcgtcccggtgccgctgcgcgccctgatggctttcggcgcctatatgcgcgatgcgtgggctgcgcagcgacgatatttctggaatatcgccgatccgggctgggcttatgggctttactatgccgtgacgggtcccctgcttctgggtgtgccgacgatcctgaacgaaggcggtttcaccgccgaaaacacctatgacatcatcgaacgcctcggcgtgacgagccttgcgggctctccgactgccttccgcctgcttatggccgccgggccggaatctgctgcccgcgtcaagggccgcttgcgcgtggcatccagcgcgggcgagccgctgaacccggaagtcattcgctggttcgatgcctgtcttggcgcgccgatccacgatcattacggccagacggaactgggcatggtggtgaacaaccatcatggattggaacatccggtgcggcagggttccgcgggctatgccatgccgggctacagggttgcggttctggatgaagcgggcaaagaagtcggccccaatgaaccgggcgttctggccattgatatcgacaattcgccgcttctctggttcaccggctattataaaaaggatacgccctccatctccggcggatattatcgcaccggcgatacggtggaattcgagccgcatgggtctatcagcttcatcggccgcgccgatgacgtcatcacctcctccggctatcgcatcgggcctttcgatgtggaaagcgcgcttctggaacatcctgcggtcaacgaggctgcggtggtcggcgttcccgatccgcaacgcaccgaaatcgtgaaggcctttgtcatcctggcccccggcttcgagggtacgccggaactggcggaagaactggcgcttcacgtcaagaaacagctttccgcccatgcctatccgcggcagatcgactttgtggcggagcttcccaagacgccgagcggaaaaatacagcgcttcctcctgcgcaaggcggaagtcgaaaagcaacagcaacagaattag

SEQ ID NO: 702 - protein, 568 aa, Brucella melitensis
MPTRRWAAREDHRMTESPASARLDRYDDAVAQFDIAKAIALLAGNPDTGINACIECCDRYTGENRVALHAISIDNTLTELTFEDLRDMSARVGNMLADAGISAGDVVAGLLPRTPELVATILGAWRIGAIYQPLFTAFGPKAIEQRFGTSGAKLVVTNLANRSKLAEVENCPRVATILAPGESLPEGDIDFRAAVAAASTECEPVMRKGSDLFMMMSTSGTAGLPKGVPVPLRALMAFGAYMRDAWAAQRRYFWNIADPGWAYGLYYAVTGPLLLGVPTILNEGGFTAENTYDIIERLGVTSLAGSPTAFRLLMAAGPESAARVKGRLRVASSAGEPLNPEVIRWFDACLGAPIHDHYGQTELGMVVNNHHGLEHPVRQGSAGYAMPGYRVAVLDEAGKEVGPNEPGVLAIDIDNSPLLWFTGYYKKDTPSISGGYYRTGDTVEFEPHGSISFIGRADDVITSSGYRIGPFDVESALLEHPAVNEAAVVGVPDPQRTEIVKAFVILAPGFEGTPELAEELALHVKKQLSAHAYPRQIDFVAELPKTPSGKIQRFLLRKAEVEKQQQQN

SEQ ID NO: 703 - DNA, 1959 bp, Yersinia pestis
  CDS (1)..(1959)
atgagccaaatacataaacatcctattccagctgcaattgcagagcatgctctaattaccccagaaaaataccaacattattaccaacaatccgtgcagaaccctgatgaattctggggcgaacaaggcaaaatcattgattggattaaaccctataaaacggtaaaaaatacctcctttgaccccggtcatgtgagtatccgctggtttgaggacggtacattgaacctcgcggcgaattgccttgatcgccatttggcagagcgtggtgatcaaacagccatcatttgggaaggtgatgaccctaatcaatcaaaaaccgtcacttataagcaactgcaccatgatgtgtgccagtttgctaatgtcctaaaaagtttaggcgtcaaaaaaggcgatgtggttgccatctatatgccaatggtgcctgaagctgccgtggcgatgttggcttgcgcgcgcatcggcgctgttcattccgttatctttggtggattttctccagatgccgttgccgggcgtatcatcgattctcactctaaactggtgattactgccgatgaaggtatccgtgcaggccgtgctattccactgaaaaaaaatgtcgatgaagcactgaaaaaccccgctatcaccagtattaaaaatgttgtggtcttccaacgtactggtaacgccagctattgggaagatgggcgcgatgtatggtggcatgacctgataaaagaggcatccgctgactgcccgccagaagagatgaatgcagaagacccgctgttcatcctttatacctctggctctaccggtaaacctaaaggggttgtacatacgacgggcggttatctggtttatgctgcactgacattcaaatatgtctttgattatcaccctggcgatatctactggtgtactgcagacgttggctgggtaaccggacacagctatctgttatatggaccactggcttgtggggccatcactctaatgtttgaaggcgtgcctaactaccctggcgtcaatcgcttaagccaagttgttgataaacataaagtcaatattctatacaccgcgcctacagcgattcgggccttaatggccgaaggtgacaaagccatcgaaggaaccaaacgcgactcactgcgtattatgggatcggtcggcgagccgattaatccagaagcctgggaatggtattacaacaagatcggtaacagtaaatgcccgattgtcgatacttggtggcagactgaaaccggtggtttcatgataacccctctgccgggtgccaccgagttgaaagccggttccgcaacgcgtccattctttggggtacaacctgcgttggtagataacctgggcaatcctcaggaaggggtggcagaaggtaatctggtcataaccgactcatggccggggcaagccagaacattatttggcgatcatgaacgtttcgaacaaacctacttctcaacctttaaaggcatgtatttcagtggcgacggcgcacgtcgtgacgaagacggttactactggataaccggtcgagttgatgacgtactaaacgtttcaggccatcgcttaggaacggctgaaattgaatctgcattggttgcacacccgaaaattgccgaagcggctgttgtcggtgttccacataatattaaaggacaggctatttatgcctatatcacgctaaatcacggtgaagaaccaacgccagagttatataccgaagtacgcaactgggtacgtaaagagattggcccactcgcaacacccgatattttgcattggacggactcattacccaaaacccgttcaggcaagatcatgcgccgtattttacgcaaaattgcgacaggagataccagcaacttgggcgatacctcaacacttgccgatccaagcgtggtagaaaaattactagaagaaaaacaatcaatgcagacaccgtcgtaa

SEQ ID NO: 704 - protein, 652 aa, Yersinia pestis
MSQIHKHPIPAAIAEHALITPEKYQHYYQQSVQNPDEFWGEQGKIIDWIKPYKTVKNTSFDPGHVSIRWFEDGTLNLAANCLDRHLAERGDQTAIIWEGDDPNQSKTVTYKQLHHDVCQFANVLKSLGVKKGDVVAIYMPMVPEAAVAMLACARIGAVHSVIFGGFSPDAVAGRIIDSHSKLVITADEGIRAGRAIPLKKNVDEALKNPAITSIKNVVVFQRTGNASYWEDGRDVWWHDLIKEASADCPPEEMNAEDPLFILYTSGSTGKPKGVVHTTGGYLVYAALTFKYVFDYHPGDIYWCTADVGWVTGHSYLLYGPLACGAITLMFEGVPNYPGVNRLSQVVDKHKVNILYTAPTAIRALMAEGDKAIEGTKRDSLRIMGSVGEPINPEAWEWYYNKIGNSKCPIVDTWWQTETGGFMITPLPGATELKAGSATRPFFGVQPALVDNLGNPQEGVAEGNLVITDSWPGQARTLFGDHERFEQTYFSTFKGMYFSGDGARRDEDGYYWITGRVDDVLNVSGHRLGTAEIESALVAHPKIAEAAVVGVPHNIKGQAIYAYITLNHGEEPTPELYTEVRNWVRKEIGPLATPDILHWTDSLPKTRSGKIMRRILRKIATGDTSNLGDTSTLADPSVVEKLLEEKQSMQTPS

SEQ ID NO: 705 - DNA, 1716 bp, Bacillus halodurans
  CDS (1)..(1716)
atgaacttgcaagcgcttccagcaaaagaggggaaccataatctaaaagattacaatgaagctgtctctacctttgattggtcttctgttgaaaaacagttttcatggtatgagacagggaaagtgaatctcgcctatgaagccattgaccgtcatgcagaatcaaacagacaagataaagtggctctttattatagtgacgcaacaagggatgagcagtatacatttgctgatatgaagaagtatacagataaagctggcaacgttcttcgcgatgctggagtcagcaaaggggatcgggtctttattttcatgccacgctcacctgaactttattttgcattgcttggcgcagtgaaggttggtgcgatcgttggacctctttttgaagcctttatggaaggggcagtcagagatcgcttagaagatagtgaagcaaaagttctcatcacaactccagatctgttacaacgtgtaccagtcgaccaattgccacatttggaaacggtatttatcgtcggtgatcatgttgaagaagaagggccttatcgtgattttctctctaggttaactcaagcatcggacgacttagagattgaatgggtggaccgtgaagacggcttgattttacactatacttcaggatctactgggaagccaaaaggagtattgcacgtccacaatgcgatgattcaacactaccaaacaggaaaatgggtgttagatttaaaagaggatgatgtctattggtgtactgctgatcctggctgggtaacagggacgtcgtacgggatttttgccccgtggttatgtggagcgacaaatgtaattcgcggtggtcgctttagcccagcagattggtatgagacattgcaaaaatataaggcaaccgtatggtacagtgcaccaaccgctttccgaatgttaatgagcgccggggatgagctcgtgaaaaagtacgatctatcgtctttgcgccacatcttaagcgtgggtgaaccattaaatccagaagttgtccgctgggggatgaaagtgtttgatttgcgtattcatgatacgtggtggatgacagaaacaggagcgcaattaatttgtaactatccatcaatggacattcgcccaggctcaatgggaaaaccgttgccaggaattaaagcggccatcatcgatgatcaagggaatgagctaccaccgaatcggatggggaatttagcgatccgcaaaggctggccttcgatgatgcgtgccatatggaaaaatgaagaaaagtataacagctattttgaaattgatggctggtacgtttctggtgattcggcttatatggatgaagatggatatttctggttccaaggccgaattgatgatgtcattatgacctcaggggaacgagtcggtccatttgaggtagaaagcaagctagtagagcatcctgctgtagctgaagcgggagttatcggaaagcctgatccagttcgtggcgaaattatcaaggcatttgtctcccttcgcgatggatatgaactcaccgacgagttaaaagaagatatccgtacatttgtgaaggaaggtcttgctgcccatgccgctccaagagagatcgagtttaaggataagctaccaaaaacacgcagcggtaaaattatgcgtcgtgtgttaaaagcatgggagctagacttacctacgggagacctttcgacaatggaagattaa

SEQ ID NO: 706 - protein, 571 aa, Bacillus halodurans
MNLQALPAKEGNHNLKDYNEAVSTFDWSSVEKQFSWYETGKVNLAYEAIDRHAESNRQDKVALYYSDATRDEQYTFADMKKYTDKAGNVLRDAGVSKGDRVFIFMPRSPELYFALLGAVKVGAIVGPLFEAFMEGAVRDRLEDSEAKVLITTPDLLQRVPVDQLPHLETVFIVGDHVEEEGPYRDFLSRLTQASDDLEIEWVDREDGLILHYTSGSTGKPKGVLHVHNAMIQHYQTGKWVLDLKEDDVYWCTADPGWVTGTSYGIFAPWLCGATNVIRGGRFSPADWYETLQKYKATVWYSAPTAFRMLMSAGDELVKKYDLSSLRHILSVGEPLNPEVVRWGMKVFDLRIHDTWWMTETGAQLICNYPSMDIRPGSMGKPLPGIKAAIIDDQGNELPPNRMGNLAIRKGWPSMMRAIWKNEEKYNSYFEIDGWYVSGDSAYMDEDGYFWFQGRIDDVIMTSGERVGPFEVESKLVEHPAVAEAGVIGKPDPVRGEIIKAFVSLRDGYELTDELKEDIRTFVKEGLAAHAAPREIEFKDKLPKTRSGKIMRRVLKAWELDLPTGDLSTMED

SEQ ID NO: 707 - DNA, 2004 bp, Halobacterium sp. NRC-1
  CDS (1)..(2004)
atgagcaacgacaccgacaccccggagctggaggcgcgactcaccgaccaggacgagttcacgccgcccgagtcgttcgtcgagcaggcgaacgtctccgacccgggtatctacgacgagttcgatgcgacctggcccgaatgctggactgacgcggccgacctgctggactgggagacgccgtacgatcaggtcctcgacgattcgaacccgccgttctacgagtggttcccgggcggcggcctgaacgcgagcgcgaactgtctggaccgccacctcgacgagcgcggcgacgaggccgccatcgagtgggtgggcgagccggccgacgaagccaaccgcacgtacacgtacgcccagctccaccgggaggtcaacgagttcgccgccgggctgcgcgagatgggtgtcggcgaggacgacatcgtcacgctgtacatgccgatggtgcccgagttgccgatcgcgatgctggcctgcgcgcgcctcggcgcgccacactcggtggtgttcgcgggcttctccgcggacgcgctcagcacgcgaatgaacgccgccgactcggagtatctcgtcacctgcgacggctactaccggcgcggcgaccccctcgatcactacgcgaaaacgctcgacggcctggatggggtgtcacacgcggtcagtgacgtggtcgtcgtcgaccgcctcggcgcgaacggcgacggcttcgaccacgaccgcccggccgcacaccacgactacgacgccgtcgtcgccgcccacgacggtgcaagcgtctcgccggtcgagcgcgacgccaccgacatgctgttcctgatgtacacgtcgggcaccaccggccagcccaaaggcgtcactcactccacgggcggctacctctcgtgggccgcctggacctcgcaggcggtcctggacatcaagccgtctgacacctacttctgctcggcggacatcggctggatcaccggccactcctacatcgtctacgggcccctggcgcttggcaccacgacgatgctctacgagggcgctccggaccaccccgacaaggaccgcctgtgggagctcgtcgagtcctacgaggcaacccaactgtacaccgcgccgacggcgatccggtcgttcatgaaatggggggtggagtaccccgacgcccacgacctctccagcctgcggctgctcggaaccgtcggggagccgatcaacccacgggcctggacgtggtattacacccacatcggcgacgagtcgtgcccgatcgtggacacgtggtggcagaccgagaccggcggcatgatggtcacggggctgcccggcgtctccacgatgaaaccggggtcggcgggccgcccactgccgggcgtcgacgcgcgcgtcatcgacaccgacggcgacgacgtggcgggcgggcgggcgggccacctgaccatccagaagccgtggccggggatgctccaaaccctctacgagaacgacgagcggttcatcgacgagtactggcgggtatactccgacaccgacagcggcgactccgcggactgggtgtacttcccggaggacggtgcgaaagtcgacgacgacggctacatcacggtcctggggcgcgtcgacgacgtggtgaacgtctccgggcaccgcctgggcacgatggagatcgaatcggccatcgtcgacgtgccgggggttgcggaggcggcggtcgtcggcggcgaccacgacctgaaaggcgaagccgtgtacgcgtacgtgctcaccacggacgaccacgacgccagcgacgccctccgtgagcgcatcgtggccagcgtggaggacgccatcggccccatcgcgcgcccggaggcggtcgtgttcgcgccggaactcccgaagacgcggtcggggaagatcatgcgccggctcctggaggacatcgcaaacgacgccgacctcggggacacctcgacgctccggaaccccgacgtggtggagacgattcaggaccagctggccggcgactga

SEQ ID NO: 708 - protein, 667 aa, Halobacterium sp. NRC-1
MSNDTDTPELEARLTDQDEFTPPESFVEQANVSDPGIYDEFDATWPECWTDAADLLDWETPYDQVLDDSNPPFYEWFPGGGLNASANCLDRHLDERGDEAAIEWVGEPADEANRTYTYAQLHREVNEFAAGLREMGVGEDDIVTLYMPMVPELPIAMLACARLGAPHSVVFAGFSADALSTRMNAADSEYLVTCDGYYRRGDPLDHYAKTLDGLDGVSHAVSDVVVVDRLGANGDGFDHDRPAAHHDYDAVVAAHDGASVSPVERDATDMLFLMYTSGTTGQPKGVTHSTGGYLSWAAWTSQAVLDIKPSDTYFCSADIGWITGHSYIVYGPLALGTTTMLYEGAPDHPDKDRLWELVESYEATQLYTAPTAIRSFMKWGVEYPDAHDLSSLRLLGTVGEPINPRAWTWYYTHIGDESCPIVDTWWQTETGGMMVTGLPGVSTMKPGSAGRPLPGVDARVIDTDGDDVAGGRAGHLTIQKPWPGMLQTLYENDERFIDEYWRVYSDTDSGDSADWVYFPEDGAKVDDDGYITVLGRVDDVVNVSGHRLGTMEIESAIVDVPGVAEAAVVGGDHDLKGEAVYAYVLTTDDHDASDALRERIVASVEDAIGPIARPEAVVFAPELPKTRSGKIMRRLLEDIANDADLGDTSTLRNPDVVETIQDQLAGD

SEQ ID NO: 709 - DNA, 1944 bp, Caulobacter crescentus
  CDS (1)..(1944)
atggtgagcgacggacaggttttcccggttcctgcggatctggcgcgagacgcccatatcgatgcggccgcctatgacgcggcgctggctcgcgtcgaagccgaccccgaaggctattggcgcgacatcgccgcccggctcgactggatcacgccgcccaccaagatcaaggacgtctcctacgccaaggaagacttccgcatccgctggtacgaggacggcgttctcaacgtctcggccaactgcatcgatcgccacctgccggccaagaaagacgacgtggccctggtgttcgagggcgacgagcccgggacctccagcacgctgacctacggccagctgcacgaggaggtttgccgcatggccaacgtcctcaaggcgcagggcgtcaagaagggcgaccgggtcaccatctatctgccgatggtgccgctggcggccgtggccatgctggcctgcgcgcgcatcggagcggttcactcggtggtgttcggcggcttctcgcccgacagcatcgccggccgcatccaggactgcgcctcgcacttcgtgatcaccgccgacgagggccgccgcggcggccgccgcgtgccgctgaaggccaatatcgacgaagcgctgaagcactgcccatgggtcggcaaggtgctgatgatccgctggaccggcgccgatgtgccgctgaaggcgggccgcgacatcgtctggcaggacgtccgcgacaccgtctcggccgactgcccgcccgagcctatgaacgccgaggacccgctgttcatcctctacacctcgggctcgacggggaagcccaagggcgtgctgcacaccaccggcggctatctggcctgggcgtcgtggaccttctgggcggtgttcgactacaagccgggcgaggtgttctggtgcaccgccgacgtcggctgggtcaccggtcacagctatgtcgtctacggcccgctggccaatggcgggaccagcctgatcttcgagggtgtgcccaactatcccacccccagccgcttctgggaggtgatcgacaagcaccaggtgtcgatcttctacaccgcccccaccgctctgcgcgccctgatgcgcgaaggcgacgcgcatgtgaccaagaacgacctttcgtccctgcgcctgctgggcagcgtcggcgagccgatcaatccggaggcctggctctggtaccaccgcgtggtcggcaaggagaaactgccgatcgtcgacacctggtggcagaccgagaccggcggcatgctgatcaccccgctgcccggcgccaccgccctgaagccgggctcggcctccaagccgctgccgggcgtcaagccgcagctcgtggacgccgagggcaagtttctggacggcgccaccgagggaaatctggtcatcaccgacagctggccgggccagatgcggaccgtctatggcgaccaccagcggttcttcgagacctatttctcgacctatcccggcaagtacttcaccggcgacggctgccgccgcgacgccgatggctactactggatcaccggccgggtggacgatgtgatcaacgtctcgggccaccgcctgggcaccgccgagatcgagagcgccctcgtcgcgcacgagaccgtcgccgaggcggccgtggtcggctatccgcacgacatcaagggccagggcgtctatgcctatgtcactctgaaggcggggatcgaggctacggacgcgctgcgcaaggacctcgtcctgtgggtgcgccacgagatcggccctttcgccgcgccggacgtcatccagtgggccccgggcctgcccaagacccgctcgggcaagatcatgcgccgcatcctgcgcaagatcgccgagaacgagctcggcagcctgggcgacacctcgaccctggctgatccatcggtggtcgatgatctggtgaagaaccgcgcggggacctga

SEQ ID NO: 710 - protein, 647 aa, Caulobacter crescentus [sequence omitted]

SEQ ID NO: 711 - DNA, 1716 bp, Sulfolobus solfataricus
  CDS (1)..(1716)
atggactactacacactttacgacctttccttagaaaaaccagaaacctactgggaaacgtttgctaataggttatcattctttaagaaatgggaaaaagtcatagaaaaaaataaacaattacccatagctaaatggttcattaacggtactacaaatattgcatataacgcccttaatcacggtggtaaggcccttatattttaccaagagaataaacataaaggagatgaaattacattcgatgagttaaataatatgagttcaatgattgctggattattactagataaaggggtaagaagaggagatagaattgcgatttatatgcctaactcaatatgtacgatagctacgatactagctgcggctagactaggagcaatttatacgctcatttttgcaggattaggaataaatgctatagtaagtaggatttcaaatctggaacctaaattagtaatctccatagataagacattcagaaggggaaaggaaataaaactatatactaacttagccaatatagtatttccgagggactcctcgcaatttgactatacaagagaatataaagaatttgagaaaatagaaagtaatgaaccattgaaaataatgtatacttctggaacaacgggtaaacctaaaggtgtaatcttaccacatggagcttggatggtaggagattatacagtatttgacttaatgttttcattaaagagtgacgatatagttctaacaactgcagatgtgggatggataacgttctcaagaataatgtatggaactctaatgcatggctccacgttggcatttatggaaggagcgccagactatccatcggatagattgccaaaaattattgacgagttacagcctaaagtattatttacatcccctacactccttagaactttacaaaagttagatgtgaaacttccaagagtggagtttatagccacagcaggagagataatggatgaaactgcatggaaatacgcattaaggttttctgatagagttgcagatgtatatgggcaaactgagttaggttatgtaataggctatccttatgcgttagatggtgtagaaccaaaaataggatatgctggattgccatttccagctgcagttatagacacagtagacgaaaatgggaaaagtttaagaggacatattggtcatctagtcgcaagagaaccatttcctacccaatttattggaatttggaaagatgaagacaaatttttaagctattttgaaaaattcaacagccacgatactggggatctagccataattgatgagaaaggttatgttaaaatagttggtagagatgacgatatgataaagatagctggacatagaataactagtggagaagtagaaagtgtaataaattccttgcaaggaataattgaatcagctgctgtaggaataccggatgagataaagggtgaaaaattagtagtattttatgtgggaaacgtagacgaaagaatagtagcaacaaaggttagggaaatgttggggcctatatatgtcattgacaaaatatataaggttgaaagactaccgaagtctcgaagtggtaaaatagttagaagagttttgagagatttattattgggaaaagaaatagatgaaactatattggaagacccagaaatattaaaggagatcaaaaatgagattaagagatccgagagaatttag

SEQ ID NO: 712 - protein, 571 aa, Sulfolobus solfataricus
MDYYTLYDLSLEKPETYWETFANRLSFFKKWEKVIEKNKQLPIAKWFINGTTNIAYNALNHGGKALIFYQENKHKGDEITFDELNNMSSMIAGLLLDKGVRRGDRIAIYMPNSICTIATILAAARLGAIYTLIFAGLGINAIVSRISNLEPKLVISIDKTFRRGKEIKLYTNLANIVFPRDSSQFDYTREYKEFEKIESNEPLKIMYTSGTTGKPKGVILPHGAWMVGDYTVFDLMFSLKSDDIVLTTADVGWITFSRIMYGTLMHGSTLAFMEGAPDYPSDRLPKIIDELQPKVLFTSPTLLRTLQKLDVKLPRVEFIATAGEIMDETAWKYALRFSDRVADVYGQTELGYVIGYPYALDGVEPKIGYAGLPFPAAVIDTVDENGKSLRGHIGHLVAREPFPTQFIGIWKDEDKFLSYFEKFNSHDTGDLAIIDEKGYVKIVGRDDDMIKIAGHRITSGEVESVINSLQGIIESAAVGIPDEIKGEKLVVFYVGNVDERIVATKVREMLGPIYVIDKIYKVERLPKSRSGKIVRRVLRDLLLGKEIDETILEDPEILKEIKNEIKRSERI

SEQ ID NO: 713 - DNA, 2001 bp, Sulfolobus solfataricus
  CDS (1)..(2001)
atgtcagtaacgtgggctctaccttttgatcaaaagataaacccaaaactgaatttaaataggctagtaagtataactacgtataaagagattcacagccaaacggtaaaagattacaaacaattttgggcatctgtagcctcggaaattgactggttcaaaccatgggagaaaacactagacgatagtaatcctccattctataagtggttcgtaggtggagagcttaacgcctcttatctaactgtagataggcacgttaagagctggaggaagaataaggttgccataatatgggaaggagaaccagtggacgagaagggaaacccaaaggaggttaggaagttaacatattacgatctatatagggaagttaatagagtagcctatctcttgaaggagaaatacgggttaaagaaaggtgatgcaatagcgatttaccttccaatgataccggaattaccaatattcatgttagctgctgctaggatcggagtagtctttacggtggtgttctcaggatttagcgctgacgcattggcaagtaggattaatgacgccgaagccaagttactaattaccgcagatggtggatggagaaggggtaaagttgttgacttaaagggaattgtagataaggctttggagaagaccccaacaataaaggatgtaatagtagttagaaggataggtaataaggtcaacatggttgaaggtagggataagtactttgatgaagtaatcaaggacattccacaaaatgtttacgttgaaccagaaaggatgaaatctgaagacccgttatatatactctacacctctggaaccactggaaaacctaagggtatagtccacgatattggagggtatatgacattattacacgctacaatgaagtgggtattcgatataagggatgacgacatttactggtgtaccgcagatataggatgggttactggacactcttacattgtgtttggaccattaatggaaggagcaactgaaataatgtatgaaggagccttggattatccacaaccggataggtgggtatcgataattgaaaggtatgggatcacaatcctttatacctcacccactgcaattagaagcttcatgaaatatggtgataattgggttaaggctcacattacctccactgttaggctaatgcattctgtaggtgaaccaataaatccggaagcttgggagtggctatggaaattagtcggtagagaggaggtaccatttggaagcacttggtggatgactgagactggaggtattctaatatctcatttaccaggattgtatcttgtgccaatgaaacctgggacaaatggcccaccaatattgggaattgagccagatgtagttaatgaagatgggaaacaagttaaccttgaggaaagaggatatcttgttataaagaatccgtggcctggaatgccattaacaatttacaaggatcctgaaagatacgtgaaggtgtattggagtagattccctggaatgttctatgttggtgattacgctgttaaggacaaggatggatacttctggatattagggagggctgatgaagttatcaaggtagctgggcataggctaggtacatatgagttagaatcagctttaattgagcatcctgcagttgcggaagcagcggtaattggagtcccagacccagttaagggagaggtgccttatgcgtttgtaattttgaggcaaggttatacacctaatacgcagctttcacaagagatactgaagacggtaagagataaggtgggacctatagctactatagataagatattcttcgtgggtaagttgcctaaaacgagaagtggaaagataatgagaagagttgtaagggctgttgcaactagggcagaagtgggagatataactacattagaggatgaggcttctgtagaggagattaaaaaagctttagaggagtttaaggcagagtttgaaaagatcaacaaataa

SEQ ID NO: 714 - protein, 666 aa, Sulfolobus solfataricus
MSVTWALPFDQKINPKLNLNRLVSITTYKEIHSQTVKDYKQFWASVASEIDWFKPWEKTLDDSNPPFYKWFVGGELNASYLTVDRHVKSWRKNKVAIIWEGEPVDEKGNPKEVRKLTYYDLYREVNRVAYLLKEKYGLKKGDAIAIYLPMIPELPIFMLAAARIGVVFTVVFSGFSADALASRINDAEAKLLITADGGWRRGKVVDLKGIVDKALEKTPTIKDVIVVRRIGNKVNMVEGRDKYFDEVIKDIPQNVYVEPERMKSEDPLYILYTSGTTGKPKGIVHDIGGYMTLLHATMKWVFDIRDDDIYWCTADIGWVTGHSYIVFGPLMEGATEIMYEGALDYPQPDRWVSIIERYGITILYTSPTAIRSFMKYGDNWVKAHITSTVRLMHSVGEPINPEAWEWLWKLVGREEVPFGSTWWMTETGGILISHLPGLYLVPMKPGTNGPPILGIEPDVVNEDGKQVNLEERGYLVIKNPWPGMPLTIYKDPERYVKVYWSRFPGMFYVGDYAVKDKDGYFWILGRADEVIKVAGHRLGTYELESALIEHPAVAEAAVIGVPDPVKGEVPYAFVILRQGYTPNTQLSQEILKTVRDKVGPIATIDKIFFVGKLPKTRSGKIMRRVVRAVATRAEVGDITTLEDEASVEEIKKALEEFKAEFEKINK

SEQ ID NO: 715 - DNA, 1959 bp, Escherichia coli
  CDS (1)..(1959)
atgagccaaattcacaaacacaccattcctgccaacatcgcagaccgttgcctgataaaccctcagcagtacgaggcgatgtatcaacaatctattaacgtacctgataccttctggggcgaacagggaaaaattcttgactggatcaaaccttaccagaaggtgaaaaacacctcctttgcccccggtaatgtgtccattaaatggtacgaggacggcacgctgaatctggcggcaaactgccttgaccgccatctgcaagaaaacggcgatcgtaccgccatcatctgggaaggcgacgacgccagccagagcaaacatatcagctataaagagctgcaccgcgacgtctgccgcttcgccaataccctgctcgagctgggcattaaaaaaggtgatgtggtggcgatttatatgccgatggtgccggaagccgcggttgcgatgctggcctgcgcccgcattggcgcggtgcattcggtgattttcggcggcttctcgccggaagccgttgccgggcgcattattgattccaactcacgactggtgatcacttccgacgaaggtgtgcgtgccgggcgcagtattccgctgaagaaaaacgttgatgacgcgctgaaaaacccgaacgtcaccagcgtagagcatgtggtggtactgaagcgtactggcgggaaaattgactggcaggaagggcgcgacctgtggtggcacgacctggttgagcaagcgagcgatcagcaccaggcggaagagatgaacgccgaagatccgctgtttattctctacacctccggttctaccggtaagccaaaaggtgtgctgcatactaccggcggttatctggtgtacgcggcgctgacctttaaatatgtctttgattatcatccgggtgatatctactggtgcaccgccgatgtgggctgggtgaccggacacagttacttgctgtacggcccgctggcctgcggtgcgaccacgctgatgtttgaaggcgtacccaactggccgacgcctgcccgtatggcgcaggtggtggacaagcatcaggtcaatattctctataccgcacccacggcgatccgcgcgctgatggcggaaggcgataaagcgatcgaaggcaccgaccgttcgtcgctgcgcattctcggttccgtgggcgagccaattaacccggaagcgtgggagtggtactggaaaaaaatcggcaacgagaaatgtccggtggtcgatacctggtggcagaccgaaaccggcggtttcatgatcaccccgctgcctggcgctaccgagctgaaagccggttcggcaacacgtccgttcttcggcgtgcaaccggcgctggtcgataacgaaggtaacccgctggagggggccaccgaaggtagcctggtaatcaccgactcctggccgggtcaggcgcgtacgctgtttggcgatcacgaacgttttgaacagacctacttctccaccttcaaaaatatgtatttcagcggcgacggcgcgcgtcgcgatgaagatggctattactggataaccgggcgtgtggacgacgtgctgaacgtctccggtcaccgtctggggacggcagagattgagtcggcgctggtggcgcatccgaagattgccgaagccgccgtagtaggtattccgcacaatattaaaggtcaggcgatctacgcctacgtcacgcttaatcacggggaggaaccgtcaccagaactgtacgcagaagtccgcaactgggtgcgtaaagagattggcccgctggcgacgccagacgtgctgcactggaccgactccctgcctaaaacccgctccggcaaaattatgcgccgtattctgcgcaaaattgcggcgggcgataccagcaacctgggcgatacctcgacgcttgccgatcctggcgtagtcgagaagctgcttgaagagaagcaggctatcgcgatgccatcgtaa

SEQ ID NO: 716 - protein, 652 aa, Escherichia coli
MSQIHKHTIPANIADRCLINPQQYEAMYQQSINVPDTFWGEQGKILDWIKPYQKVKNTSFAPGNVSIKWYEDGTLNLAANCLDRHLQENGDRTAIIWEGDDASQSKHISYKELHRDVCRFANTLLELGIKKGDVVAIYMPMVPEAAVAMLACARIGAVHSVIFGGFSPEAVAGRIIDSNSRLVITSDEGVRAGRSIPLKKNVDDALKNPNVTSVEHVVVLKRTGGKIDWQEGRDLWWHDLVEQASDQHQAEEMNAEDPLFILYTSGSTGKPKGVLHTTGGYLVYAALTFKYVFDYHPGDIYWCTADVGWVTGHSYLLYGPLACGATTLMFEGVPNWPTPARMAQVVDKHQVNILYTAPTAIRALMAEGDKAIEGTDRSSLRILGSVGEPINPEAWEWYWKKIGNEKCPVVDTWWQTETGGFMITPLPGATELKAGSATRPFFGVQPALVDNEGNPLEGATEGSLVITDSWPGQARTLFGDHERFEQTYFSTFKNMYFSGDGARRDEDGYYWITGRVDDVLNVSGHRLGTAEIESALVAHPKIAEAAVVGIPHNIKGQAIYAYVTLNHGEEPSPELYAEVRNWVRKEIGPLATPDVLHWTDSLPKTRSGKIMRRILRKIAAGDTSNLGDTSTLADPGVVEKLLEEKQAIAMPS

SEQ ID NO: 717 - DNA, 1533 bp, Aquifex aeolicus
  CDS (1)..(1533)
atggcagaagaaaagtccgaagtacttttaaaaatccaagaaaagtattaccctcccaaagaaatagtggagagggcttggattaaagactacgaaaaggtttacgaggaaagcatcaaggatcgcgaaggcttctgggcaaaggtagccgaagaactccactggttcaagaagtgggacaaggttctcgagtggaacttcccatacgccaagtggttcgtaggggcaaagaccaacataacctacaactgcctcgacaggcacgtccagaacggaaagagaaacaaggttgcttacatctacgttgacgagaacgataacgaaaagaagataacctacggagaactcttagaactcgtaaacaggatagcaaacgggctcaaatccttgggagttaagaaaggagacagagtttccatatacatgccaacaaccatagaagcgatagctacgatgctcgcttgtgcgaggataggggctattcacagcgtagtatttgccggattctccgaaggagctctcagaacgaggattgaagacgcaaaggcaaaggtcgtggtcaccgcaagctacactcaaaggagaggaaagaaaatagaccttctcacaaccgttgagagggctatagacggactggacttcgttgagaaagtagtggtgtgggacagggacggagacgccctggaggaaaagggcggactctttgtagacttcaacgaaatggttaagaacgcttctcccgagtgcgaacccgaagttatggacgctgaagacccactctttatcctctacacttcaggaaccacaggaaagccgaagggagttctccacaccacgggtggttacatggttcagacctactacacttcaaagatagtctttgaccttcacgaagacgacatatactggtgtaccgcggacataggttggatcacgggacactcttacatagtctacggaatactcgcaaacggagttacgtccgtgataaccgagggagcacccgattatcccgatccgggaaggtggtggaggtacgtagaaaagtatagagtaaacgtcttctacaccgcacccacagcaataaggatgttcatgaggtacggtgaagagtggcctatgaagtacgatctctcttccctgagaattctcggttcagtaggagaacccataaaccccgaagcttggctctggtattacaaatatatcggaagggagaaatgcgtaatcgttgacacatggtggcaaacggaaacgggagctcacatgataacgacgataccctcttaccctgcaaagcccggaaaggcaggaaagcccttcttcacgatagaacccgaaatcgttgacaaggatggaaacaaggttccccccaataccgttggattcttggtaattaaatctccttggccctcaatgctcaggacgtgctggggtgagcccgagaggtacgaaaagtactggaacaccataaagggtgtgtggagacctagcctcttacgacgaagaagggtacataatgatcctcggtag

SEQ ID NO: 718 - protein, 510 aa, Aquifex aeolicus
MAEEKSEVLLKIQEKYYPPKEIVERAWIKDYEKVYEESIKDREGFWAKVAEELHWFKKWDKVLEWNFPYAKWFVGAKTNITYNCLDRHVQNGKRNKVAYIYVDENDNEKKITYGELLELVNRIANGLKSLGVKKGDRVSIYMPTTIEAIATMLACARIGAIHSVVFAGFSEGALRTRIEDAKAKVVVTASYTQRRGKKIDLLTTVERAIDGLDFVEKVVVWDRDGDALEEKGGLFVDFNEMVKNASPECEPEVMDAEDPLFILYTSGTTGKPKGVLHTTGGYMVQTYYTSKIVFDLHEDDIYWCTADIGWITGHSYIVYGILANGVTSVITEGAPDYPDPGRWWRYVEKYRVNVFYTAPTAIRMFMRYGEEWPMKYDLSSLRILGSVGEPINPEAWLWYYKYIGREKCVIVDTWWQTETGAHMITTIPSYPAKPGKAGKPFFTIEPEIVDKDGNKVPPNTVGFLVIKSPWPSMLRTCWGEPERYEKYWNTIKGVWRPSLLRRRRVHNDPR

SEQ ID NO: 719 - DNA, 1950 bp, Deinococcus radiodurans
  CDS (1)..(1950)
atgacccatcccaacgaccacattgacgcgatgctgcacgaaacgcgcgtcatccaccccagcgccgaatttcaggccgggacgcgggtcagccgcgcagagtacgagcgccgctaccgccagagcctcgaccagcccgacgacttctggtcagaggtggcccatgacctccactggatgaaggactgggaccgggtgctcgactggcaggagccgcacgcgcagtggttcgtgggggggcagacgaacatcgcctacaacgcgctcgaccgcaacgtgcagcgcggcctcggcgacaagcgggccatcatctgggaaggcgaggacggcgaggtgcggacctacacctacgccgaactgctgcgcgaggtttgcaaggcggcgaacgccctggaagaactcggcgtggtggccggcgaccgagtgaccctctacatgcccctgattcccgaggccgccatcgccatgctcgcctgcgcccgcatcggcgcggtgcattccatcgtgttcggcggcttctcggtctcggcgctggccgaccgcatcaacaacgcgcagagcaagctgctcatcaccgccgacgccggctatcgccggggcaagccggtcacgctcaaaatcaacgccgacgaggcggccaagctcgccccctgcctggaacacgtcctggtggtcaagcgcgccggcattccgctggagtggtggaccgaaggccgcgacctgtggtggcacgacgtagtggaccgccagagcgatcagcacgaggccaccgcgctcgacagcgagcacccactgttcatcctctacacctccggcagcaccggcgcccccaaaggcgtgcagcacacgaccggcggctacatggtgggcacttacctcaccacccagacggtcttcgacctgcgtgacgacgacatttactggtgcaccgccgacatcggctggattaccggccacagctacagcgtgtacggcccgctgctcaacggcgcgacggtggtgatgtatgagggcgctcccaaccagcccgactggggccgcttctgggacatcgtgcaaaagcaccgggtcaccatcctgtacaccgcgccgaccgccattcgctcctttatgcagcacggcgacgagattccgggccgctacgacctcgccagtttgcgcctgctggggtcggtgggcgaacccatcaaccccgaggcgtggatgtggtactaccgcgtcatcggcggcgagcgctgcccggtcgtggacacctggtggcagaccgaaaccggctccatcatgctgaccacactgccgggcgcctttcccagcaagccgggcagcgcggggctgccgatgttcggcgtggagcccgcgctgatgacccgtgacggcgaagagatcggcgacgacgacggcggcctgctcgtcatcaagcggccctggccctccatgctccgcacggtctacggcgacgacgaacgctaccgcaagagctactggggcgagattccgcacgtgtacttcgctggcgacggcgcccgccgcgaccacgacgggtactacacgattgtcgggcgggtcgatgacgtgctcaacgtctccggacaccgactgggcaccatggaaatcgaatcggcgctggtggcgcaccctgacgtgtccgaagccgcagttgtcggcagacccgacccagtgaagggggagagtgtggtggcctacgtgctgctgcaagacgggcacaccgccgaccccgccgccctacgcgcccacgtcagcagcgaaatcggcgccctggcccggcccgacgccatctacattgccgacgccctccccaagacccgcagcggcaaaatcatgcgccgcttcctgaggcaacttgccgccggacagccggtgcagggcgacaccagcaccctggaagaccccaccgttctggaacgactgcaagcctcccctgccctttga

SEQ ID NO: 720 - protein, 649 aa, Deinococcus radiodurans [sequence omitted]

SEQ ID NO: 721 - DNA, 1929 bp, Deinococcus radiodurans
  CDS (1)..(1929)
atggaccccgcactcttgacgactcccctcgtttcacccaccgacgccctgaaaaagaccgcccccgtcacgcccgagcgggcgcagcagctccgcgacatgcccgcgggcgactactggctgagcgtcgccagcgaactcacctgggacgtgccgccgaccaccgccctcgaaggcaccttcggggacttccagtatttccccggcgcgaagggcaacgtcagcgtcaactgcctcgaccgtcaccccaaaaaccgcgtcgcgctgtactacgagcgcgaagatggcctcaaggaaacgtggagctacggcgacctgaccgacgccaccgcccggttcgcggcggcattgcaagacctcggcgtggacaagggcgaccgggtggcgatttatctgtccaacgtgcccgaagcgtttatcgccattcatgcctgctaccgcatcggggcgatctactcggtcatcttcgcgggcttttcggcgtcggcggtgcgcgaccggctcaccgacgcgcagcccaaagtcgtggtttgcaccgacggcacgctgcggcgcgggcgcaacattccgctcaaggcgacgctcgacgaggcgcttgaagggttggagaagcccaccgtcatcgtcgcccgtcgcctggaccccttcctgccgctgggcgagaacgaactcgatttcgccgagctgctggagaaaacgacccgccgcgccgcgcccgtttcgctcgacgccaacgaccccggcttcatcatctacacctcgggcaccacgagcaaacccaaggggctggttcacagcggcatcggctttctgacggggacgtatgccaacgtgaagtgggcgctcaacctgcaacccgacgacgtgtactggtgcaccgccgacgtgggctggctgaccttcccgatttttgcgctggtgggcgggctggcgcacggggcgacgcacgtgatttacgagggcagcatcgacacgccgacgcccgagcggccctaccagatcatcgagaggtaccgcgccgacaaggtgtttaccgcgcccaccgccctgcggatgctgcggcgctcgggcgacgaagcgctggcacggtacgacctgagcccgctgcaactcgtcgcgctggtgggcgagccgcttgaccccgaaacctggcactggacgcacgacgtgctcggcggcggcaggctcttcgtcaacaacacctacggtcagaccgaaaccggcaccgcgtgggcgagcagcatggtgggcctcaccgaaggccgccccggctcgtgcgggcacccgctgcccggctaccgcgccgccgtggtgcacgaggacggcacgccctgcggccccaacgaactcggctcgctgacgctgaccgagcctttcccctgcctggcccgcaccgtgtggggcgaccatgaccgctacgtggagacctacctgtccgaatttcccggcaagtacgccgccgccgacgccgccctgctcgacagcgacgggcaactgtgggtcacgggccgcctggacgacgtgatgaacgtggccgggcaccgcctcggcacgatggagatggaagccgcgctgctcacccaccccgccgtcagcgaagccgccgtggtggcgatgcccgacgacatcaagggcgcggtgccggtggccttcgtggtgccgcgcgcgggcattcgcctcgacaccgacctcacctggctagaaaacgaacttgccgacgcggtggtgtccggtgtgggcgccatcgcccgtccgggccgcgtcgtcgtgacccccaccgtcccgcgcacccgcagcggcaaaatcatgcgccggctcctgcgcgacctgctgctgaccggcgaagtgaagggcgacctgacgagcctggaaaaccccgacgccctcgaaacggtgcgcgagcggctgggcggggcggcagcgggctga

SEQ ID NO: 722 - protein, 642 aa, Deinococcus radiodurans
MDPALLTTPLVSPTDALKKTAPVTPERAQQLRDMPAGDYWLSVASELTWDVPPTTALEGTFGDFQYFPGAKGNVSVNCLDRHPKNRVALYYEREDGLKETWSYGDLTDATARFAAALQDLGVDKGDRVAIYLSNVPEAFIAIHACYRIGAIYSVIFAGFSASAVRDRLTDAQPKVVVCTDGTLRRGRNIPLKATLDEALEGLEKPTVIVARRLDPFLPLGENELDFAELLEKTTRRAAPVSLDANDPGFIIYTSGTTSKPKGLVHSGIGFLTGTYANVKWALNLQPDDVYWCTADVGWLTFPIFALVGGLAHGATHVIYEGSIDTPTPERPYQIIERYRADKVFTAPTALRMLRRSGDEALARYDLSPLQLVALVGEPLDPETWHWTHDVLGGGRLFVNNTYGQTETGTAWASSMVGLTEGRPGSCGHPLPGYRAAVVHEDGTPCGPNELGSLTLTEPFPCLARTVWGDHDRYVETYLSEFPGKYAAADAALLDSDGQLWVTGRLDDVMNVAGHRLGTMEMEAALLTHPAVSEAAVVAMPDDIKGAVPVAFVVPRAGIRLDTDLTWLENELADAVVSGVGAIARPGRVVVTPTVPRTRSGKIMRRLLRDLLLTGEVKGDLTSLENPDALETVRERLGGAAAG

SEQ ID NO: 723 - DNA, 1899 bp, Vibrio cholerae
  CDS (1)..(1899)
atgagagcaaggagtaatgcgatgtctgcctatcaagagcaatatcaatgggcgaaagagcagcccgaagccttctggcgtaaacaagcgcagcagatcgactggtttcaaccgccgcaaaccattttggccaatgacgaacatggtatcgaacgttggtttcccgatggtgtgctcaatacgtgttggttagcactcgattatcactgcgagcaaggccgtggcgatcacactgcgctgatttacgactcgcccgtgacgggcaaaaagcagcgctacagttactcggcactgcgtgacagtgtcgcgaaaattgcaggcatgctggctgcgcaaggggtgagcaaaggtgatcgtgtcatcatttacatgccgatgatcccagaagcggcgatggcgatgctggcttgtgcgcgtttgggcgcgattcactcggtggtgtttggcggctttgcaccgaatgagctggcggtacggattgaagatgcggagccgaaagtgatcatgaccgcctcgtgcggcgtggaaatcaataaggtgattccctacaagcccatggtcgataaagccattatggatagccgctggaaacctgaaaaagtcttggtttatcagcgtagcgaatgccgcgctgagctcactcatgcccgtgatttggaatggaacacggtcgtgcaatcggccacgccacacggttgtgtgcctgtgctcgctaccgatccgctgtatatcctttacacctcaggcaccacaggcaaaccgaaaggggtggtgcgcgataatggcggccacgcggttgcgctcaagtattcaatgcagatcatctacaacatgccgcaagatggagtgttttgggcggcttcggatgtgggctgggtagtcgggcactcctatattgtgtatgcgccgctcattcatggttgcaccaccattttgtatgaaggtaaaccggtacgcacacccgaccccggcgcgttttggcgagtgtgtcaggagtaccaagtcaccgcgcttttttctgcaccgaccgcgtttcgtgccatcaaaaaagaagatccgaatggcgattatttaaaaaagtacgatttgtcggcgttaaccaccatttttatggccggagagcggcttgacccgccgaccttggaatgggtacaaagcaaaacaggcaagccagtgattgatcactggtggcaaaccgaaacgggttgggcgattgctggaaacccaacgggtcttgaatctatgcccatcaaagcgggctcggcaaccaaacccatccccggttatcaggtggagattcttaatgagcttggcgaaaatatgcctgccaatcagcaaggttttgtcgcactaaaaaggcctctaccaccaagctgcctgccaaccgtatggcgtaaccatgaccgttttgagtcgggctatttggcgcaattccccggttattatgtatccggtgatggcggttatcttgatgacgacgggtatctcttcatcatgggacgcatcgatgatgtgatcaacgttgcggggcatcgactatcgacaggcgagatggaagagattgtcggcgcgcatccggctgtcgcggaatgtgcggtgattggcgtccacgacgagctgaaagggcagttgccacttgggttagtggtgctcaaagatggagtgaagattgatgcgcaaacgctggagcaagagctggtcgccagtgtgcgcaatcaaattggtgcggtggcttgctttaagcatgccatagtggtcgaacgcttaccgaaaacgcgatccggcaaaattttgcggcgtatcatccgccaaatcgccgatggtgagagttacaccattccatctacgattgacgatcccatgagcctcaatgagctggaaaacctgtttcagcactga

SEQ ID NO: 724 - protein, 632 aa, Vibrio cholerae
MRARSNAMSAYQEQYQWAKEQPEAFWRKQAQQIDWFQPPQTILANDEHGIERWFPDGVLNTCWLALDYHCEQGRGDHTALIYDSPVTGKKQRYSYSALRDSVAKIAGMLAAQGVSKGDRVIIYMPMIPEAAMAMLACARLGAIHSVVFGGFAPNELAVRIEDAEPKVIMTASCGVEINKVIPYKPMVDKAIMDSRWKPEKVLVYQRSECRAELTHARDLEWNTVVQSATPHGCVPVLATDPLYILYTSGTTGKPKGVVRDNGGHAVALKYSMQIIYNMPQDGVFWAASDVGWVVGHSYIVYAPLIHGCTTILYEGKPVRTPDPGAFWRVCQEYQVTALFSAPTAFRAIKKEDPNGDYLKKYDLSALTTIFMAGERLDPPTLEWVQSKTGKPVIDHWWQTETGWAIAGNPTGLESMPIKAGSATKPIPGYQVEILNELGENMPANQQGFVALKRPLPPSCLPTVWRNHDRFESGYLAQFPGYYVSGDGGYLDDDGYLFIMGRIDDVINVAGHRLSTGEMEEIVGAHPAVAECAVIGVHDELKGQLPLGLVVLKDGVKIDAQTLEQELVASVRNQIGAVACFKHAIVVERLPKTRSGKILRRIIRQIADGESYTIPSTIDDPMSLNELENLFQH

SEQ ID NO: 725 - DNA, 1956 bp, Pseudomonas aeruginosa
  CDS (1)..(1956)
atgtctgcggcatccctgtaccccgtgcacccggaagcggtggcacggaccttcaccgacgaagccacctacaagacgatgtaccagcagtccgtcgtcaaccccgacggcttctggcgcgagcaggcccagcggatcgactggatcaagccgttcgagaaggtcaagcagacctccttcgacgaccatcacgtggacatcaagtggttcgccgacggcaccctcaacgtgtcgcacaactgcctcgaccgtcacctcgccgaacgcggcgaccaggtggcgatcatctgggaaggcgacgatcccgccgaccaccaggaaatcacctaccgccagctccacgagcaggtctgcaagttcgccaacgccctgcgcgggcaggacgtgcaccgcggcgacgtagtgaccatctacatgccgatgatccccgaggccgtggtcgccatgctcgcctgcacccgcatcggcgcgatccactcggtggtcttcggcggcttctcccccgaggccctggcaggacgcatcatcgattgcaagtcgaaggtggtgatcaccgccgacgaaggcgtgcgcggcggcaagcgcactccgctgaaggccaatgtcgacgacgccctgaccaacccggaaacctccagcgtgcagaagatcatcgtctgcaagcgtaccggtgcggagatcaagtggaaccagcaccgcgacgtctggtacgacgacctgatgaaggttgccggcagcacttgcgcacccaaggaaatgggcgccgaggacccgctgttcatcctctacacctccggctccaccggcaagccgaagggcgtgctgcataccaccggcggctacctggtgtacgcctcgctgacccacgagcgggtcttcgactaccgtccgggcgaagtctactggtgcaccgccgacatcggctgggtcaccggccacacctacatcgtctatggcccgttggccaacggcgccaccaccattctgttcgagggcgtgccgaactaccccgacgtgacccgcgtggcgaaaatcatcgacaagcacaaggtcaacatcctctacaccgcgccgaccgcgatccgcgcgatgatggccgaaggcaaggcggcggtggccggtgccgacggttccagcctgcgtctgctcggttcggtgggcgagccgatcaacccggaagcctggcagtggtactacgagaccgtcggccagtcgcgctgcccgatcgtcgacacctggtggcagaccgagaccggcgcctgcctgatgaccccgctgccgggcgcccacgcgatgaagccgggctctgcagccaagccgttcttcggcgtggtaccggcgctggtggacaacctcggcaacctgatcgagggcgccgccgagggcaacctggtgatcctcgactcctggccgggccaggcgcggaccctgttcggcgaccatgaccgcttcgtcgacacctacttcaagaccttcaagggcatgtacttcaccggcgacggcgcgcgccgcgacgaggacggctactactggatcaccgggcgggtcgacgacgtgctcaacgtctccggccaccgcatgggcaccgccgaggtggaaagcgcgatggtcgcccacccgaaggtcgccgaggcggcggtggtcggcatgcagcacgacatcaaggggcagggcatctatgtctacgtcaccctcaactccggggtcgagccgagcgaggcgctgcgccaggagctgaagcaatgggttcgccgcgagatcggtccgatcgccacgccggatgtgatccagtgggcgccgggactgccgaagacccgttcgggcaagatcatgcggcgcatcctgcgcaagatcgccgcggccgagtacgacaccctcggcgacatctccacccttgccgacccgggcgtggtccagcacctgatcgagacccatcgctcgatgcaggccgcctga

SEQ ID NO: 726 - protein, 651 aa, Pseudomonas aeruginosa [sequence omitted]

SEQ ID NO: 727 - DNA, 1497 bp, Sulfolobus solfataricus
  CDS (1)..(1497)
atggctagttatgaagaagttaggagaagtttttcgtggagtgaggtaattagatatttagacgagaacccattagacgttttgacttctcatgacggtatagcagttaagagattcactaagaacgctatggaggagataagcttctcagatcttaaaagaaaggcattaagacttgccttatatctcaaggagtttcataacattaaaaagggtgatgtaatagcaatattagcttcaaagaagattcaacaaatcatagtatttttagcaactctctccctaggagcaatttatcaaccattatttactgcatttgggccagaggcaattaagatgaggactagagatgtaaaaccaaaaattatcttttgtcaagatgaccaaaaggataagataaatgatgcaatactcttctccaagtttgatgaattattaagttacggtgaattgaaagagattgaaaagataaattgggatgatgcaataattttactttacacttctggtactacgggaacacctaaaggggccctaatcgctaagaggctatttcttaacatttatgtctacatgaaatatggtataggtgttagggaaaatgacgtgttttggaaccccgcagatcctggatgggcttatgggctatattatggtataataggaccgctaatgtttgggaaaactataatctttcttgacgaaccatttaacccagaaaggacaatggagttcatggaggaaaataaggttactaattttgctttcgcacctacggcatatagaatgatagctggaacggttaagaagaagtatgatttagtattggaaagagcgagttctgcaggtgaaccacttaacccagaagttataagatggtttatggataagtacaatgttactatcaaggatcattatggacaaactgaagttggaatggtagtttataatggctggggatatgacgcaaaagtaaaaatagggagtatgggactacctgcacctggttatgaggtcgatataatagaggatattatagctgtcaagagagattctccaggtttccacttcttgggatatctaaacaatccagagaagaccaaggaatcatttcgaggcgattggtacttgactggtgataatgcgtataaagatgaggaaggatatttatggtttgttggaaggaaggacgatgtggttaaggtatctggttacaggataggtccatttgaagttgagagcgtacttctagaatttcccgcagtactagaatctgctgttgttgccgatgaagatccaatacgaggacatgtattacatgcttatattgtactcaaaagtggatatactccaagtgaggaactaaagaaggagattattgattttgtaaatactaaatattctaggcacgtacatctagaaagggttgactttgttgataaattgccaaagactgagagtggtaaaatacaaagatatctacttagaaagaaataa

SEQ ID NO: 728 - protein, 498 aa, Sulfolobus solfataricus
MASYEEVRRSFSWSEVIRYLDENPLDVLTSHDGIAVKRFTKNAMEEISFSDLKRKALRLALYLKEFHNIKKGDVIAILASKKIQQIIVFLATLSLGAIYQPLFTAFGPEAIKMRTRDVKPKIIFCQDDQKDKINDAILFSKFDELLSYGELKEIEKINWDDAIILLYTSGTTGTPKGALIAKRLFLNIYVYMKYGIGVRENDVFWNPADPGWAYGLYYGIIGPLMFGKTIIFLDEPFNPERTMEFMEENKVTNFAFAPTAYRMIAGTVKKKYDLVLERASSAGEPLNPEVIRWFMDKYNVTIKDHYGQTEVGMVVYNGWGYDAKVKIGSMGLPAPGYEVDIIEDIIAVKRDSPGFHFLGYLNNPEKTKESFRGDWYLTGDNAYKDEEGYLWFVGRKDDVVKVSGYRIGPFEVESVLLEFPAVLESAVVADEDPIRGHVLHAYIVLKSGYTPSEELKKEIIDFVNTKYSRHVHLERVDFVDKLPKTESGKIQRYLLRKK

SEQ ID NO: 729 - DNA, 1869 bp, Sulfolobus solfataricus
  CDS (1)..(1869)
atgagttggaaaatatattctctagatcagattaaagcactggcaaaattctccatggaaaatccagaagccttctggcgggataaggctaattacgtaagttggtttaggcaaccagagaaaatacttgagggagaaccaccatacgagaaatggttcgtcggaggaacacttaatatatcctataatgccatagataggcatttaccagataagaaagataaggtggcattttattggaccaatgagagattagatagttttaggtcaatatcctttcaagatctttatcaagaagtaaacaaggcagcctatgtcttaagtgaattgggcgtgaaaaaaggcgatacggtatccatgctaatgcctaatataccagaagctgtatacttctccttagcaacacacagactgggggcaattctaataatacattatgtaggtttgagcgaggaaacagtggcatataggtttaatgattgcggttcaaaagtattgattgttgcttcaaagacgtttaggaatggaaatgagataagaattaaggattttgtggataaagttttggaatctcatactacacccatacagaaagtcttgacagtgccgaggggatattcagattttaatgttaatgggaaaagggatgttgtgtatgatggtgtgaaacctaaagggaaagtttacgttaaaccagtggaagttgaggctaacgagccagcgacagtttattacacgtctggaactacgggaagacctaagggattataccatagtaatggagggtatgtgatagcactcaattgggcttttaaggcaatatttaacccaacagagaatgacgtttggtggactgtttcagaattaggttggccagtatggccaatggcaaatttatacacgataccagtaatgggaatacctggtgtgctttttgagggatatgttggttataaaagggatctattctcgagagtaattgagagatataatgtaagcctagtttggagttctaccacaactctttacactctcaagagtttaggagaggagtcagttaagagcggagatacatcaagcttaagaatgattcttaatacaggagaacctttaaacgttggagcgtggatgtggttaaatcagaatcttcctcaagttaagatagcagatgcgtactggatgacagagcatttatcgccagttggtgcaactccttacggaatcggcgaaattccctttaaggcaggttccgctggtatacaattcccaggaggaacatatttcttaattgttgacgatgagggaaaaccattacctcctaagcaaaagggatatatagtgttaaaaccgcttaacccagccttagctaaaatgtggaatgatcccaattacgagaagataaaggagaagtattggtctaggttcccaggatacttctacactggagattacggttatgttgatgaggatggatatctgttcgtgctgggaagagctgatgatgtaataagagctgaaggggagaggataggaacacttgaagttgaaagtgtaatagtaactcatcccaacgtggccgaagctgccgtaataggtcaaggcggtaacataatagcgtttgtagtcccaagacaaggggttgaggttggtgacgcactcagaaatgacattaagaactattgtaggaacgctggttacatagttgataaagtagtgtttgtgaagagactgcctaaaaccaaaagcgggaagataatgagaaggctactaaaggctatcctagctaacgagaatccaggtgatgtatcaacattggacgatataaggataatggaggaacttaaggaggcgttgaagagcctaagctaa

SEQ ID NO: 730 - protein, 622 aa, Sulfolobus solfataricus
MSWKIYSLDQIKALAKFSMENPEAFWRDKANYVSWFRQPEKILEGEPPYEKWFVGGTLNISYNAIDRHLPDKKDKVAFYWTNERLDSFRSISFQDLYQEVNKAAYVLSELGVKKGDTVSMLMPNIPEAVYFSLATHRLGAILIIHYVGLSEETVAYRFNDCGSKVLIVASKTFRNGNEIRIKDFVDKVLESHTTPIQKVLTVPRGYSDFNVNGKRDVVYDGVKPKGKVYVKPVEVEANEPATVYYTSGTTGRPKGLYHSNGGYVIALNWAFKAIFNPTENDVWWTVSELGWPVWPMANLYTIPVMGIPGVLFEGYVGYKRDLFSRVIERYNVSLVWSSTTTLYTLKSLGEESVKSGDTSSLRMILNTGEPLNVGAWMWLNQNLPQVKIADAYWMTEHLSPVGATPYGIGEIPFKAGSAGIQFPGGTYFLIVDDEGKPLPPKQKGYIVLKPLNPALAKMWNDPNYEKIKEKYWSRFPGYFYTGDYGYVDEDGYLFVLGRADDVIRAEGERIGTLEVESVIVTHPNVAEAAVIGQGGNIIAFVVPRQGVEVGDALRNDIKNYCRNAGYIVDKVVFVKRLPKTKSGKIMRRLLKAILANENPGDVSTLDDIRIMEELKEALKSLS

SEQ ID NO: 731 - DNA, 1989 bp, Helicobacter pylori
  CDS (1)..(1989)
atgcaattagacgaagatttagaattcgctaaaaaaatctttaaccctaacagagcgtttgccaagcaagccaggattaaaaacatgtgcgaatataaagatttagtgcatgaagccaatgaagattatgaacatttttggggcgatttagccaagcagaaactcacatggtttaaaccttttgataaggttttaaacagcgataacgccccttttttcaaatggtttgaaaacggcaaaatcaatgtttcttacaattgcatagacaggcatttaaaagacaaaaaaaataaagtggcgatcatttttgaaggggaaatgggggattataatgtcatcacttacagaaaactccactctgaagtcaataaaacagccaaccttttaaaaaacgaattcaatgtcaaaaaaggcgatagggtcattatctatatgcccatgattgtagaaagcgtttatatgatgctcgcatgcactaggattggagcgatccatagcatcgtttttgctgggtttagccctgaagccttaagggataggatcaacgacgctcaagctaaattagttatcacagcggatgggacttttagaaaaggcaaaccttacatgctcaagccagcccttgacaaggctctagaaaataacgcctgccctagcgtggaaaaagcgctcattgtgatacgaaacgccaaagagattgactatgtgagagggcgcgattttgtctataatgaaatggtcaattaccaatccgacaaatgcgaacctgaaatgatggactctgaagatcctttattcttgctctatacaagcggatcaaccggaaagcctaaaggcgttcaacacagcagtgcggggtatttgttatgggcgcaaatgacgatggagtgggtttttgatattagagataacgataatttttggtgcaccgccgatattggctggatcacagggcacacttatgtggtttatggacctttagcttgtggggcgacgactttgatactagaaggcacgatgtcttatccggattatgggagatggtggaggatgatagaagaataccgtgtggataaattctacacttcccctaccgctataagaatgttgcatgccaaaggtgaaaacgaaccctcaaagtataatttagagtcgctcaaagttttaggaacggtgggagagcccattaaccctacagcatggaaatggttttatgaaaaaatcggcaactcaaaatgcagcatcgtggatacttggtggcagacagaaacaggcgggcacatcatcagccctttaccgggagctacgcctataagggccagttgcgcgactttacctttgcctggaatccatgcggaagttttaaacgaagacggcactaaaacaaagcctggagagcaagggtttttatgcatcactaagccatggccttctatgataagaaacatttggggcgatgaaaaacgatacattgatagctatttttctcagatcaagttgaatggggaatatgtctacctctctggagatggcgctatcgtggatgaaaacggatacattactattattgggcgcacagatgatattgtgaatgtgagtgggcataggattggcacggctgaagtggagagcgctatttccaagcatgaaatggtggctgaatgcgcggtggtgggtatccctgatgcgattaaaggagagggcttgtttgcgtttgtggtgctgtgcgatggggctaaatgcaatcttggcgagagtttagaattgctaaaagaaatgaaccatatcttatccattgagattggaaagatcgcgaaattagacaatgtcatgtatgtgccaggtttgcctaaaaccaggagcgggaaaatcatgagaaggcttttgaaatccatcgccaaaaaagagcctatcactcaagatttaagcacgctagaagatgtgaatgtggttaaagaaataatgagcatcgctcaaatggaggagtaa

SEQ ID NO: 732 - protein, 662 aa, Helicobacter pylori [sequence omitted]

SEQ ID NO: 733 - DNA, 1989 bp, Archaeoglobus fulgidus
  CDS (1)..(1989)
atggagccgaaaattttgtgggagccggattcggagtttatcaaaaactccaatctggccgagtttgttgagtggctttcttcaaacaagggtctcgattttgtggtttcagagaatgcgagggagaacgttgagaactacaagaacctctggaagtggtctgtggagaaccttgaggacttctgggagagcgtgtgggagttctttgagattaagagctacagcgattacaagactgttctcgatgaaaggaagatgccgggagcaaagtggtttgagggggcaacgctgaactatgcggagcatgcctttttgaaggctggtgagggagaagcggttgtttacgttagagaggacggtttgaggagggctttaacatggagcgagctggagaggcagactgcagcctttgctgcttggcttaaagatatgggtgtaaagaagggagacagggttgttgcctactgcagtcaggttcctgaagcggttattgcattgctggcaacggcgagcattggtgcaatctgggcggccgttggtggtgaggttgcgccaagggctgttattgacaggttcaagcagcttgagccaaaggttctgatcgcatctgatggccacttctacaacgggaaggagttcaacaagctggaggacattaagaccgttgtcagcggcatcccgagccttgagagggttgtcttgattcccaacctctacgagtcccacgacctgaagcttagcatcccactccactattgggaagagacggttgatagaaaggagaagctcaccttcgagcctctgccctttgaccatccactatgggttctttacacctcaggaacaacaggaattccgaagcccattgttcacgggcatggggggataacggtcgagatcttcaagggctccttccacatggacttcaaggagggcgaccgcttcctgtggtactccccgccctcatggatgatgtggaacactgttgttagcggtctcctcgctggagctaccattgtcttctacgatggcagcccgctttacaacttcctccagccgctgtggcagatatgcgagaaggagaagctgaacatcttcggaacgagtgctcccttcctccacggctgcatgaaattcggcctgcagcccggctcgcagtacgatttgagcagcttgagaatggttggctccaccgccgccccgctatcgcctgagggctttgagtgggtttacaggaatgttaaggaggacgtatggctgaactctgcaagcggcgggacggatgtgatgacgggctttgttggaggctgcccaattctccccgtctggagtggagagcttcagtgcaggtggctggggacgaaagttgaggcttacaacattgaaggcaagcctgtaatcaatgaagtgggagagcttgtcatcgagctcccgatgccctcaatgcccctctacttctggaatgacaaggacttcagctggtataaagagagctacttcagcatgttccccaacgtctggtggcacggggactggctgatgattacagacagaggaacggcaataatcttcggccgctctgattcaacaatcaagagaaagggagttagaatgggaactctggacttctacaaggttgtcgagagtatgaacgaaattatcagcagcctcgttgttgaggtcaagggcaagattttcctcttcgtggttccagcacatggaattgaggtcaacgaggagcttaaggagaagataaacagagccttgaaagagaatctcggagcctacttcgttgcggactacattattccagtgcccgacattccaatgactttgaactacaagaagctggaggtgccgataaagaagattctgctcggctgggaagtggagaaggcagtgaaccttgacagcataatgaatcctgatgccgttttcaaggtcgttgaggctgcaaagccctacgtggagcagctggagggagaatga

SEQ ID NO: 734 - protein, 662 aa, Archaeoglobus fulgidus
MEPKILWEPDSEFIKNSNLAEFVEWLSSNKGLDFVVSENARENVENYKNLWKWSVENLEDFWESVWEFFEIKSYSDYKTVLDERKMPGAKWFEGATLNYAEHAFLKAGEGEAVVYVREDGLRRALTWSELERQTAAFAAWLKDMGVKKGDRVVAYCSQVPEAVIALLATASIGAIWAAVGGEVAPRAVIDRFKQLEPKVLIASDGHFYNGKEFNKLEDIKTVVSGIPSLERVVLIPNLYESHDLKLSIPLHYWEETVDRKEKLTFEPLPFDHPLWVLYTSGTTGIPKPIVHGHGGITVEIFKGSFHMDFKEGDRFLWYSPPSWMMWNTVVSGLLAGATIVFYDGSPLYNFLQPLWQICEKEKLNIFGTSAPFLHGCMKFGLQPGSQYDLSSLRMVGSTAAPLSPEGFEWVYRNVKEDVWLNSASGGTDVMTGFVGGCPILPVWSGELQCRWLGTKVEAYNIEGKPVINEVGELVIELPMPSMPLYFWNDKDFSWYKESYFSMFPNVWWHGDWLMITDRGTAIIFGRSDSTIKRKGVRMGTLDFYKVVESMNEIISSLVVEVKGKIFLFVVPAHGIEVNEELKEKINRALKENLGAYFVADYIIPVPDIPMTLNYKKLEVPIKKILLGWEVEKAVNLDSIMNPDAVFKVVEAAKPYVEQLEGE

SEQ ID NO: 735 - DNA, 1932 bp, Archaeoglobus fulgidus
  CDS (1)..(1932)
atggaagagtttagaaagttgtggcaggaagcgtatgaaaatcctgaaaagttctggaatgagagggctgaggaggccatggacgacataaactggtttgaaccttggaagaatgtttttaaatgggaatacccaaagttcagctggtttgaaggggggaagaccaacatctgctacaactgccttgactacaaggtgaagaggtacggttcaaagcctgcctacatctacgaaaaccccgaaatggacttgagctatgcaattacctacagacagctttacagcatggttaaaaagtatgccgcatctctgagaggagctggactgagcaagggggacagaattcttctttatcttccaaactcaatcgaagctgcggcaatgctgctcgcagcagcaagaattggcgttatttctgtgacagtctttgctggtttctcccccaaggccgttgccgacagaattgagctgaccacaccgaagctaatcttcacgcaggatttctccacaaggagagggaagctggtgaggctgaaggacaacatcgatgaggctctgagctacgtgcctgaaaacgtaagggaaaacgtcggaatggtggtcgtgaagagagcgatgccggaagaggaggtcgatttaaaggaggggcgggatttcaccctgaaggagtttcttgacctgaaaggaggagaaagcagtgattatgttgagatggatgcgatggacccaatcttcgtcatgcccacatcaggcacaacggccaagcccaagcctgtggttcacgttcagggaggttatcagatatggaactactatgctgctaagtgggtttacggcctgaagcctgacgatgtgatattcaacacctcggacataggctggattgtcgggcagagctacatggttttcggcccgcttctcgcaggctctacgtgcattctcttcgacggcactcctgattatcccgagccgggcacgtggtgggaggttgtggagagaaacggagcaacgctgatatggacatccccgactggtgcgaggatactgagaaagcttggagtggagaaggcaaaggagtacgacgtgagctcggtcgagagggtggtttgtgcgggggaggttctgaatccagaggtgtggtactggctctacagagatgtttttgaggaggaaattccaataattgaccacatgtggcagaccgaaaccaccggagcgctattcggctatccctacggtctctacggggatgaaattaaggagtacatcaagcccggctccgccggacttcccttacctggaataattcccgtcgttcttgacgagctgagtggagaggagctaccaccgagggaaaagggagtcatgtacctcaaaagacctttccccggcctaacaccaacgctctgggacagctttgacagatacgtgaggtcatattgggaggttggagcgggcagaggaatgtactgcaccggagatgctgcctacattgacgaggatggctacgtgtggttcacgggaagggctgatgaggtcataaagattgcaggtcacagaattgggacaatagaggttgagaatgccctgataagtcatccggcagtagctgaggcaggtgtaagcggcatacctgatgaaatcaggggagaggttgtggcagcattcgtcgttctcaagcccggctactctccgagcgaggagctgaagagggagataatagaccacgtgaggaaaactctcggcccgattgttgttttcaaggacatacagttcgtgaacatgcttccaaagacgaggagcggtaaaatcatgaggagggtcatgaagaggcttttcctcgggcaggagcttggtgacctgtcaacgatcgaggaggaggcatcggttgaggaaatcaaggaggcggttgagaagctcaagaaactttaa

SEQ ID NO: 736 - protein, 643 aa, Archaeoglobus fulgidus
MEEFRKLWQEAYENPEKFWNERAEEAMDDINWFEPWKNVFKWEYPKFSWFEGGKTNICYNCLDYKVKRYGSKPAYIYENPEMDLSYAITYRQLYSMVKKYAASLRGAGLSKGDRILLYLPNSIEAAAMLLAAARIGVISVTVFAGFSPKAVADRIELTTPKLIFTQDFSTRRGKLVRLKDNIDEALSYVPENVRENVGMVVVKRAMPEEEVDLKEGRDFTLKEFLDLKGGESSDYVEMDAMDPIFVMPTSGTTAKPKPVVHVQGGYQIWNYYAAKWVYGLKPDDVIFNTSDIGWIVGQSYMVFGPLLAGSTCILFDGTPDYPEPGTWWEVVERNGATLIWTSPTGARILRKLGVEKAKEYDVSSVERVVCAGEVLNPEVWYWLYRDVFEEEIPIIDHMWQTETTGALFGYPYGLYGDEIKEYIKPGSAGLPLPGIIPVVLDELSGEELPPREKGVMYLKRPFPGLTPTLWDSFDRYVRSYWEVGAGRGMYCTGDAAYIDEDGYVWFTGRADEVIKIAGHRIGTIEVENALISHPAVAEAGVSGIPDEIRGEVVAAFVVLKPGYSPSEELKREIIDHVRKTLGPIVVFKDIQFVNMLPKTRSGKIMRRVMKRLFLGQELGDLSTIEEEASVEEIKEAVEKLKKL

SEQ ID NO: 737 - DNA, 1542 bp, Aeropyrum pernix
  CDS (1)..(1542)
atgctagccgtgacaagaatcggggccatacacagcgtggtattctcggggttcagcagctgggccctcgccgacaggattgtcgacgccaaggcggatgtcctgataacggcggatggcttctataggagggggaggatagttgatctcaagaagaacgccgacgaggccgtgaagcttgccgccgacaatggtgtaaaggttaggaaggttatagtggtgaggagggctgggaacgaggttaggtggagcagcgagctgaacgtctggtaccacgacctcctgaaggaggtgcctgagaaggtctatgtaaagccggagccgaggaagtctgacgacgtgctcttcatactatacaccagcgggacgacgggaaagcctaagggtataatgcacagcgtaggcggttacatgacctacgtctacaacgtgttccgctggaactgggatccgaggcccgaggacgttttctggaccgccgcggatataggctggataacgggccacacctacatagtctacggcccgttgatgcacggcgagacccagatcatgtacgagggggctccagactatccgaaccctggtaggatctgggagatggtggagcgctacggagtaacggtcttctacactagccccacccttctcaggctgctcaggaagtatggggacgagtgggttgagggcagagacttctcccggctaaggctactgggtactgtgggggagccgattaaccccgaggtgtggaagtggtattacgagaagataggctggaagagggctcccatagtggatacgtggtggcagaccgagacgggggcggcaatgataagtcccgcgcccgggatagcgctggtccccctgaagccgggcagcgctacgctcccgctacctgggattgtggctgatgtcctgacaagtgacgggaggcaggcagggccgggtgagaagggctacctggttgtgagggagccgtggcccggcatgatgctgggtatatggggagatcctgataggtatgtgaggacctactggtccaggttcagcaagccggaggagggggtttggatctactatcccgcggactatgctgtgagggatcgcgacggctacttctggattctaggtagggctgacgaggtcctcaacgtggcgggacacaggattggaactatagagcttgaggacgccctcctcacacaccccgcggtgagcgaggcagccgtggtgggggcgcccgatcccgttaagggtgaggttcccgtggccttcgtcgtccttagggctggctacgagccgagcgataagctggagcgggagcttagggagacagtgagaaggctgataggccctatagcggagccgtcaaagatatacttcgtggagaagctcccgaagactaggagtggtaagataatgaggaggattatgataagcctgctacgaggccagcctgttggagacgtcaccacgcttgaggacccaagcgctgtagaggctgtaaggagagcccttgagagggagaaggctgggtag

SEQ ID NO: 738 - protein, 513 aa, Aeropyrum pernix
MLAVTRIGAIHSVVFSGFSSWALADRIVDAKADVLITADGFYRRGRIVDLKKNADEAVKLAADNGVKVRKVIVVRRAGNEVRWSSELNVWYHDLLKEVPEKVYVKPEPRKSDDVLFILYTSGTTGKPKGIMHSVGGYMTYVYNVFRWNWDPRPEDVFWTAADIGWITGHTYIVYGPLMHGETQIMYEGAPDYPNPGRIWEMVERYGVTVFYTSPTLLRLLRKYGDEWVEGRDFSRLRLLGTVGEPINPEVWKWYYEKIGWKRAPIVDTWWQTETGAAMISPAPGIALVPLKPGSATLPLPGIVADVLTSDGRQAGPGEKGYLVVREPWPGMMLGIWGDPDRYVRTYWSRFSKPEEGVWIYYPADYAVRDRDGYFWILGRADEVLNVAGHRIGTIELEDALLTHPAVSEAAVVGAPDPVKGEVPVAFVVLRAGYEPSDKLERELRETVRRLIGPIAEPSKIYFVEKLPKTRSGKIMRRIMISLLRGQPVGDVTTLEDPSAVEAVRRALEREKAG

SEQ ID NO: 739 - DNA, 1944 bp, Xylella fastidiosa
  CDS (1)..(1944)
atgtctgacctgtacaccattgatccgatgttggccaaagatgcgcacgtagaccgtgctcactacaaaacgctttaccacgaatccctcgaacaaccggaagcattctggagcaacatcgcacagcgcctggagtggttcaaaaccccaacaaaaatcaaagatgtcagctaccaactagaagacgttcacatccgctggttcgaagacggtgaactcaatgccagcgtcaactgcctagaccgccacctcaccttacgcggcgacaaaacagcactcctgtttgaacctgacgcccctgacgccccatcctcacgcatcacctaccgtgaactgtacgaacgtgtctgccaactcggtaacgcactgcgccacctcaacatcgaaaagggcgaccgcgtcaccatctatttaccaatgattccagatgcagtcgtcgccatcctcgcttgcgcacgcattggagcaatccactccgtcgtcttcggcggctttgcaccgaactccattgccgatcgaataaacgactgcggtagcaaactcatcatcaccgcagacgaaggcctgcgcggcggcagaaaaattccattgaaagccaatgttgatgccgcattaaagatccacggaacccaatccgtcgaaaccgtactcgtcgtgcgtcacaccggcggtacgatcaacatgcataccccgcgcgaccgctggttccatcacgtcgtcgacatccaagcgaccgaatgcgccccagaacgcatgaacgctgaagacccacttttcatcctctatacctccggctccacaggcaaacccaaaggagtgctgcacaccaccggcggctacctggtgtacaccagctacactcatgaaaccgtgtttgacctgcgcgaaaacgacatctactggtgcactgccgacatcggctggattactggtcacagctacatcgtttacggccccctggccaatggcgccaccgtgttgctgttcgaaggcgtcccccactacccaaccgtgtcgcgcttctgggaagtgatcgacaaacatcacgtcaccctgttctacaccgcgccgaccgcaatccgtgccttgatgcgcgaaggcgacacccctgtaaaaaaaacctcccgcaaaagcttgcggttgcttggcagcgtcggcgaacccatcaaccccgaagcctggcactggtactacaccatcgttggcaacggacgctgtcccattgtcgacacctggtggcaaaccgagacaggaggaatcctcatcaccccactgatcggtgcaaccgaccttaaaccaggctcagtcaccctccccttcttcggcatacgccccgccctagtcgataccaacggacaaatactggatggccccgcagcaggcaacctagtcctcctcgattcctggccgggtcaaatgcgtaccgtctacggtgaccaccaacgttttatagacacttactttcgcacctaccccaatacttacttcaccggcgacggctgccgccgcgatgccgacggctactactggatcactggacgtgtggatgacgtcatcaacatctccggccaccgcatcggcaccgccgaaatcgaaagcacactcgtcgctcaccccaaagtggctgaagccgcggtcgtcggcttccctcacccgatcaaaggccagggcatctacgcatacgtgacattaattaccggcgagacacccagcgaagcactgcaccaagaactgctcacctgggtacgtaaagaaatcggagcaatcgccacacccgatcacgtgcaatgggcacccaacctccccaaaacccgctccggaaagatcatgcgccgcatcctacgcaaaattgcagaaaacgcaccagaccaactcggtgacacctccacactggctgatccgtctatcgtcgacttattgctcaacgaacgactgacacactga

SEQ ID NO: 740 - protein, 647 aa, Xylella fastidiosa [sequence omitted]

SEQ ID NO: 741 - DNA, 1827 bp, Sulfolobus solfataricus
  CDS (1)..(1827)
atggtatttaatccagataaggaatggatagagaacagtaacgtatataagttcatgattaaaaggaaccttaatagattagaagacttcgtaaggtatacatatgagaatcctgaattttgggaccagtttgtaaagcttattggagtggaatttaaagaaccttatgccaaggttttggatctgagcagaggaaaacaatggccacaatggttcataggagggaagttaaacattggagatcaattacgtgatagttctgatgtgttcattaagtggatggatgaagacctcaacaccagaactgtaacttattctcaaatactaaatgagagcaagtctattgcaagttggttaaagaagataggtttgaagaagggagatagggtcgctatttacatgccaatgatcccggaaatagtatcagtaatgctgggagcaataagggtagggacgataatcgtacccttattttccggatttggtccagagcccataagggttagagtggaggatagtgaggcgaaagtaatcttcacagttgataagagcattagaagaggaaaagaagtcgacatgttaaaaaatctagaaggactaaacgataatataactaaagtagtattgaatagaggaggcactaagggtgatttttatgagtataaggatgtcataaaaactgctggagattatgtagaagataccagtactgaagacccaatgatgataatttacacttctggaactactggaaaacccaaaggatgcgttcatactcacgatgggtttccaataaaagcttcagctgacatttacttccaattcgatttgaaaaatggagagacgttaatgtgggttactgacatggggtggatgatgggaccctggatggtatttggatcactcttactaaacgctaaaatgggaatgattgaaggatatacaagtggggaagtcctacagaaattcgttgaagatatgaaagttgatgttttaggggtctcagctagtctagttagggcactgagaagtcaaggcgaagttaagctaaacgttaggttaactggaaacactggagaaccaattgattcggaaagctggtattggttattcaacgccagtggaaagaaccccataataaactactctggaggtactgaaatctctggaggtattttggggaattacgttataaagaagataaagccatcttcatttaatggaccttctccgggaattaacgcctcagtatttaatgaggaaggaaaagacgccccaccaaatgttgaaggagagttagtcgtattaagtgtttggccaggtatgactagaggattttggagaaacccggaaaggtatatagagacctactggtcagtgtggaaagatgtatgggttcatggagatttggcttatagagacgaagaagggtatttttacatcgtaggtaggagtgatgatacgataaaggttgctgggaagagagtaggtccggctgaaatcgaaagcgtattaaattcattcccaaacgtagtggaatcagcatgtataggaatacctgatccgatgaagggggagaaaatagtctgttttgtagtctctaaggttagtgggattgaaaatcaattaatagaatacacagaggataaactgggtaaggcatttgcaccatctgaaataaagattgttaaggagctacctaagactagaaatgctaaaataatgaggagattgataagagccatatatttaaataaacccttaggagatatatcctcactggaaaatccgtcagctttggaggaaattaagaaggccatcagttag

SEQ ID NO: 742 - protein, 608 aa, Sulfolobus solfataricus
MVFNPDKEWIENSNVYKFMIKRNLNRLEDFVRYTYENPEFWDQFVKLIGVEFKEPYAKVLDLSRGKQWPQWFIGGKLNIGDQLRDSSDVFIKWMDEDLNTRTVTYSQILNESKSIASWLKKIGLKKGDRVAIYMPMIPEIVSVMLGAIRVGTIIVPLFSGFGPEPIRVRVEDSEAKVIFTVDKSIRRGKEVDMLKNLEGLNDNITKVVLNRGGTKGDFYEYKDVIKTAGDYVEDTSTEDPMMIIYTSGTTGKPKGCVHTHDGFPIKASADIYFQFDLKNGETLMWVTDMGWMMGPWMVFGSLLLNAKMGMIEGYTSGEVLQKFVEDMKVDVLGVSASLVRALRSQGEVKLNVRLTGNTGEPIDSESWYWLFNASGKNPIINYSGGTEISGGILGNYVIKKIKPSSFNGPSPGINASVFNEEGKDAPPNVEGELVVLSVWPGMTRGFWRNPERYIETYWSVWKDVWVHGDLAYRDEEGYFYIVGRSDDTIKVAGKRVGPAEIESVLNSFPNVVESACIGIPDPMKGEKIVCFVVSKVSGIENQLIEYTEDKLGKAFAPSEIKIVKELPKTRNAKIMRRLIRAIYLNKPLGDISSLENPSALEEIKKAIS

SEQ ID NO: 743 - DNA, 1959 bp, Sulfolobus solfataricus
  CDS (1)..(1959)
atggtacaagaaattacagaaaatattaaagaaatagaggaaaaagttgattataatacaaggatttatagagaaatttatagggaaagcatagagaacccaggtaaattctggggtaaattaggtgaggatttaattgactggtttgaaccttggaaggagatctataagcaagaaactcttacaaagtggttcttaggaggaaaactaaacgcaagttataatgcaattgatagacatttgaacagtagtagaaagtttaaagccgcgataatttgggaatctgaaaaaggggagagaaaaatacttacctatcaagacttattttacgaagttaatagatgggctaatgcgttaaagcaattaggtgtaaaaaaaggtgacagggttacaatttacatgcctttaaccccagaaggagttacagcaatgttagcgtgtgccagaataggtgcaattcacagtgtggtatttgctggttttggttcccaagcgttagccgatagaattgccgatgcacaatcgaagattgtcattactgcagacggatattatagaaagggtagactcatagagcttaagaagaccgttgatgatgctttatcgaaattacaagataattccgtaaagaatattataatatttaggaggattgggatagaaattccatttaaagaaggaagagatgtgttttttgatgaaataggaaagtataaatatatcgaaccagaaccagtagaggccactcatccgttattcatcctttatacttctgggactaccggtaaacctaagggtatagtacactcaactggtggatatcttgtaggcacagctacaatgttgttatggagttatggattaagccaagaaaatgatgtattattcaatacttcagacattggctggattgtaggacactcatacataacatattcaccgctcgtgatgggtagaagtgtagtaatatatgagagtgcacctgattatccaactcccgataaatgggctgaactaattgagaagtataaggctacgacttttggaacttctgcaacattcttaaggtatctgatgaaatatggtgaagattacattaaagctcatgacttatcctcgcttagaataatagtaacaaatggagaaccgctaaattacgctccgtggaaatatgggttagaaattataggtaagggtagggtgtttatgtcacatcagtggtggcaaactgagactggagctccgaatttaggttacatgccgggatatccaatcttcttaaccatgaaatctggcccagcgtccggtttcccattaccgggtaataaaataaaagttgtcgacgaaaatggaaatccgaccaggcctagagagagaggttacctaataattgaaccaccatttccaccaatgatgatgataggtatgtggaacgacgatggaaatgagagggttattaagacttactttagtaaattccccaacttatattatactggagactttgccatgatagatgaagatggatacgtgtgggtatctggaagagcagatgagacattgaagatagctgggcatagaataggagcaggtgaagttgagtctgcaataacctcgcaccctgcagtagcagaggcagctgtaataggcattccagatccagtgaaaggagagatcgctcacgcattcgttgtgttaaaacaagggtatcatcaaaacaatgagttatctaaggaaatacaagaacatgtgaggaaaattatggggcccatagtattattagaggtacatttcgttaatgcgttacctaaaactaggtctggtaaagtaatgagaagagtaataaaagctgttatgacgggatctaatataggagatatttcgacgttagaagatgaggcatcaatggaagaaattaaaaaagctatagaggtattgagaagacagttaaacccatga

SEQ ID NO: 744 - protein, 652 aa, Sulfolobus solfataricus
MVQEITENIKEIEEKVDYNTRIYREIYRESIENPGKFWGKLGEDLIDWFEPWKEIYKQETLTKWFLGGKLNASYNAIDRHLNSSRKFKAAIIWESEKGERKILTYQDLFYEVNRWANALKQLGVKKGDRVTIYMPLTPEGVTAMLACARIGAIHSVVFAGFGSQALADRIADAQSKIVITADGYYRKGRLIELKKTVDDALSKLQDNSVKNIIIFRRIGIEIPFKEGRDVFFDEIGKYKYIEPEPVEATHPLFILYTSGTTGKPKGIVHSTGGYLVGTATMLLWSYGLSQENDVLFNTSDIGWIVGHSYITYSPLVMGRSVVIYESAPDYPTPDKWAELIEKYKATTFGTSATFLRYLMKYGEDYIKAHDLSSLRIIVTNGEPLNYAPWKYGLEIIGKGRVFMSHQWWQTETGAPNLGYMPGYPIFLTMKSGPASGFPLPGNKIKVVDENGNPTRPRERGYLIIEPPFPPMMMIGMWNDDGNERVIKTYFSKFPNLYYTGDFAMIDEDGYVWVSGRADETLKIAGHRIGAGEVESAITSHPAVAEAAVIGIPDPVKGEIAHAFVVLKQGYHQNNELSKEIQEHVRKIMGPIVLLEVHFVNALPKTRSGKVMRRVIKAVMTGSNIGDISTLEDEASMEEIKKAIEVLRRQLNP

SEQ ID NO: 745 - DNA, 2046 bp, Archaeoglobus fulgidus
  CDS (1)..(2046)
atggcagacccgatggaagctatgaaaaaagagtttgagaaccgcatcattccaccaagctggaaggacagggtttgggaaatagaagattacaggaagttccacgaggacaccatcaaggacaaggaatcgatagagaagtggtgggagaagtgggcaaacgagattttctggttcaggaagtgggacagggctcttgacgatagcaacccgcccttctacaggtggtttgttggcggagagacgaatctcgcttacctctgtaccgactggcagattgagcagggaaggaagaacaaggtggcgattatctgggaaggagagccggttaaggaaaatggagagccggttgaagtgagaaagctaacttactacgacctttacagggaatcgaacaggattgccgcgatgctgaaggacaagcttggagttaagaaggacgagatcctgaccttctacctgccaatgattcctgaactgccgcttttcatgcttggagtgcagagaataggggcgaagcacagcatagtgttcagcggattcagtgctcaggctctggcggttagaataatggatgctggtgcgaggtatgttgtcactgcagatggcgtttacaggagagggaaggtgctgaacctcaaagcgattgtagatgacgccgttaagatttgcgagcaggagggtcacaaggttgagaaggttatcgtggtcaagagagcaggaaatgaaatcccgtggaacgatagcagagatgtttggtttgaggacctgatggcagacattggaaagaacgtgaaggttgagtgcgagaaaatgggttctgaggacttcagcttcatcctatatacctcgggaaccacaggaaggccgaaaggagcgcagcactccgtcggaggctatgcggttcacctctacactacaatgaagctcattttcgatatcaaggatgacgacatattctggtgcactgccgacatcggctggattacgggacacagctacattgtttacggtccactgatgtgcggtgcgacgaccatgatgtatgaaggcgccccagacttccctgacgtgagcagatgggcagcgatgattgagcgctacggagtgacgatattctacaccgccccgacggcaataagaatgctcatgcgcttccctgaggagaactacaccaagtacgacatgtcaacgctgagaataatccacagcgttggagagccgattaaccccgaagcttggagatggtactacagggttttcggtagagaagatgttgtctgctcaagcacatggtggatgacggaaactgggggtatgctgacggaccacttcccaggattggggaagataattccacttaagccgggcacaaatggctatccaattcctggagttaggatggaggttcttgatgatgagggcaattctgtgaaaccgggagaaagaggctacctcgttatctccacaccatggcccggaatgctcatgacgctgttcaaagacccaaacaggttcattgacgtttacttcggcaagtacaagagcaagggttggtattactacacaggcgactttgccatgttcgatgaggacggctacgtctgggttcttggaagggctgatgatatactgaaggttgctgggcacagaattggaactgctgaaattgaatcggcaatggtctctcatccggatgttgctgaagcagcctgcgttggcaaatccgacccggtaaagggagagattccgataatctacgtggtgctgagagaaggtgttgaaccctcaccggatatggtgaacgagctcaagaagcacctcagagccactctcggccctgttgttgccagcgatgctgtgataaccttcgttaacactctacccaaaacaagaagcggtaaaatcatgaggaggctgcttagggctgttgcagagggcaaagagctcggtgacgtcacaacccttgagagcgaggttgcggttgaggaggcgaagaaggcctacgagatggttaaggcggcccttgaggggtccaaatcctaa

SEQ ID NO: 746 - protein, 681 aa, Archaeoglobus fulgidus
MADPMEAMKKEFENRIIPPSWKDRVWEIEDYRKFHEDTIKDKESIEKWWEKWANEIFWFRKWDRALDDSNPPFYRWFVGGETNLAYLCTDWQIEQGRKNKVAIIWEGEPVKENGEPVEVRKLTYYDLYRESNRIAAMLKDKLGVKKDEILTFYLPMIPELPLFMLGVQRIGAKHSIVFSGFSAQALAVRIMDAGARYVVTADGVYRRGKVLNLKAIVDDAVKICEQEGHKVEKVIVVKRAGNEIPWNDSRDVWFEDLMADIGKNVKVECEKMGSEDFSFILYTSGTTGRPKGAQHSVGGYAVHLYTTMKLIFDIKDDDIFWCTADIGWITGHSYIVYGPLMCGATTMMYEGAPDFPDVSRWAAMIERYGVTIFYTAPTAIRMLMRFPEENYTKYDMSTLRIIHSVGEPINPEAWRWYYRVFGREDVVCSSTWWMTETGGMLTDHFPGLGKIIPLKPGTNGYPIPGVRMEVLDDEGNSVKPGERGYLVISTPWPGMLMTLFKDPNRFIDVYFGKYKSKGWYYYTGDFAMFDEDGYVWVLGRADDILKVAGHRIGTAEIESAMVSHPDVAEAACVGKSDPVKGEIPIIYVVLREGVEPSPDMVNELKKHLRATLGPVVASDAVITFVNTLPKTRSGKIMRRLLRAVAEGKELGDVTTLESEVAVEEAKKAYEMVKAALEGSKS

SEQ ID NO: 747 - DNA, 1761 bp, Archaeoglobus fulgidus
  CDS (1)..(1761)
atgaagatggaggagatatatagggaatttatcgaattgacgaagttgccagacaatgagacgaaggaaaaggccatggaagagtttttcagaaagctgaacacgatgcagctgcctgagtacttcaactgggcggaagaaatctttgagggagttcacgtgaaggatagggggaatcagaaggccctgatatggtcgaacattgagacgggagaaaagaaggaatacacctacgagcagtttgctgctgaaggaaacaggattgttaacttcctgaggggacacggcgtggagaagggggacagcttctacatgatgattcccctcctgcccccaatatggttcgcaacctttgcaactgtcaagggagggttcataggagttcccaccgctacaacgatgacggtcagagaccttgaatacaggttcaaagtttacccgccggttgcaattatggccgacgaagcttcagccaaaacaattgatgaggctttaagcaacgttggtgcggagccaaaagtcaaaattgttatcggagacaggagcggatgggagagctacgattcccttagcaaggagtcgtcggaagctgaggctgcaaagacgaagtgggacgacataatcttcagcttcttcacctcgggaacgacgggattgccgaagagagttgcccacaccgctacatcctacccagtgggccacctcatgacagcatgcataatcaatgtgcaaccgggagatattcaccacaacctgagcgctccgggatgggcgaagtacgcgtggagctccttctttgcccctcttaacgtcggagccactgcgaccggtttctactacacgaggctgaacggtgacctttaccttcaggctgtgtccgagttcaaggtcaacaccttttgcgccccgccaacagcatggaggctgttcatgttcgcagacataggaaagtacgactactcggcattgagggatgtcgttagcgctggagaaccactcaaccccgaactctacgagcagtggaagaagtacaccgacacggaaatcagggacttctacggccagacggagagcaccgcaatgataggcaacccgccgtggttcaagggaggcaaaatcattcccggctctttcggcaggcccaccttcatgtacgacgttactctcgttgatgatgagggcaatgaaataacgaagcccaatgaggttggccacatcgtcgtcaggcttgatcgctggaggccgattgggctgttcaaggagtacatgggcgaccctgagaaaacggccaaagttttcgttggaaagtactactacacgggagataaggcgttcttcgacgagaaggggtactggtggtttgttggcagggctgatgatgtcataaaaacttctgattaccgtgtcggaccatttgaggttgagagcgcccttattgagcaccctgcagttgctgaggctgctgttgttggaagcccgcatcccataaggtatcagctcgtcaaggccttcgtcatacttgctccgggctacgagccatcaagggagcttgctcttgagctgttcatgcactgcaagaatattcttgcgaggtacaagatacccaggataatcgagtttgttcccgagctgcccaagaccatcagcggtaaaataaggagagttgagctgaggcagattgaggaggagaagaggaagaagggagagaagggggagcacgagtacttctacgacgacttccctgaactcaagtcttcctaa

SEQ ID NO: 748 - protein, 586 aa, Archaeoglobus fulgidus
MKMEEIYREFIELTKLPDNETKEKAMEEFFRKLNTMQLPEYFNWAEEIFEGVHVKDRGNQKALIWSNIETGEKKEYTYEQFAAEGNRIVNFLRGHGVEKGDSFYMMIPLLPPIWFATFATVKGGFIGVPTATTMTVRDLEYRFKVYPPVAIMADEASAKTIDEALSNVGAEPKVKIVIGDRSGWESYDSLSKESSEAEAAKTKWDDIIFSFFTSGTTGLPKRVAHTATSYPVGHLMTACIINVQPGDIHHNLSAPGWAKYAWSSFFAPLNVGATATGFYYTRLNGDLYLQAVSEFKVNTFCAPPTAWRLFMFADIGKYDYSALRDVVSAGEPLNPELYEQWKKYTDTEIRDFYGQTESTAMIGNPPWFKGGKIIPGSFGRPTFMYDVTLVDDEGNEITKPNEVGHIVVRLDRWRPIGLFKEYMGDPEKTAKVFVGKYYYTGDKAFFDEKGYWWFVGRADDVIKTSDYRVGPFEVESALIEHPAVAEAAVVGSPHPIRYQLVKAFVILAPGYEPSRELALELFMHCKNILARYKIPRIIEFVPELPKTISGKIRRVELRQIEEEKRKKGEKGEHEYFYDDFPELKSS

SEQ ID NO: 749 - DNA, 1983 bp, Aeropyrum pernix
  CDS (1)..(1983)
atgcaggagggtttggaaaagaagatatggtatccgccccgcgatatagtggaccagagtaatgtaaagcttttcatggataagcacggtttcaagagctatgaggagcttgtcaggaggagcagtgaggacctcaaatggttctggggtaacctgcctgaatggctcggggtagagtggttcagagagcctaaagccgtggtggacctgagcagaggtgtggagtgggcccagtggtaccggggaggcctcctcaacgcggcgtacaacgtcgtagaccgtatagtcaagatggggtacgggcatagggaggccttcacttgggtaggcgaggatggggaggttaggaggtacacgtacctacagctgaaggacgaggttgacaggatggccaagctcctctcccaggactatgggctgggagtcggcgatgtggttgcgatctacgcccccatgatgcctgagagcatagcggccatgcttgcggccatgaaggttggggctgtggcttcaccgatattctccggcttcgccccgccagccgttgctgagaggctcaagctgggggaggcgagggtgctcgttaccgtagacgggtatctgaggagggggaggaggatagccctaaaggagcaggccgaccaggccgtgaagcttgcgggcggggcggtcgagcacgtcattgtggtcaggaggctcgggatagacgtcccatgggttgagggcagggatgagtggtatgacagggccatagcgggtaaggctggctctgcggagcccgaggagctagacccggagcatccagccctcctcctcttcacaagcggcacaaccgggaggcccaagggcgctgtgataagccatgcaggcgccatactccagcccgggaaggagcactacttcaacctcgacatacacccagcctggaggggcggggaggacaggctatggtggataactgatataggctggatgatggggccatggcaggtcctcggctcccagctcctgggcgccagccaccttatggcggagggggccatagactatccttataagtcgagggtttggaggctaatacaggagcacagggtaacccacttcggctttgcggcaacagtggccaggatgctcagggcagtggcgagcgacacggtggaggattacgacctatcaagcattagggccttcggaaacacgggggagcctatagaccatgccacctggatgtgggtcatggagaagttgggaggctggaggaggcccctgataaatctcagcggcgggacagaggtgttcggctgcatactcctcccgagccccgttgtccccctcaagccgacgaccctctgggggcccgctctgggtgttgatgctgacgttttcgacgatgagggtaggcctgtgaggggcgagccgggatacttggttgttaagaagcccttccccagcatgaccagggggctgtggaaagaccctgagaggtatataaagacgtactggtcccgcttcccgggtgtatggtaccacggcgactacgccctagtcgacgaggacgggttctggtacatactggggagggcggacgacgtgataaaagtggcggggaagaggattggcagcgccgagcttgagagcgtgctcacacagctacccgaagtggcggaggcggcatgcataggggtgccccacccgataaagggcgaggtcatagcctgcttcctggtgcccaagggcggttatgacgcggaggagctggcctcgaaggccaggaaggccgtggtggataggttcggcaagcccttcgccccggagcacgtggttatagtgagcgagctcccaaagacgaggagcggcaagataactaggagggtgctcagggatctagcccgcggtgtggagccgaaggagctgagtgttctggagaatcctgaggccgtcgaaaagcttagggacattataaagaggataggagggggctag

SEQ ID NO: 750 - protein, 660 aa, Aeropyrum pernix
MQEGLEKKIWYPPRDIVDQSNVKLFMDKHGFKSYEELVRRSSEDLKWFWGNLPEWLGVEWFREPKAVVDLSRGVEWAQWYRGGLLNAAYNVVDRIVKMGYGHREAFTWVGEDGEVRRYTYLQLKDEVDRMAKLLSQDYGLGVGDVVAIYAPMMPESIAAMLAAMKVGAVASPIFSGFAPPAVAERLKLGEARVLVTVDGYLRRGRRIALKEQADQAVKLAGGAVEHVIVVRRLGIDVPWVEGRDEWYDRAIAGKAGSAEPEELDPEHPALLLFTSGTTGRPKGAVISHAGAILQPGKEHYFNLDIHPAWRGGEDRLWWITDIGWMMGPWQVLGSQLLGASHLMAEGAIDYPYKSRVWRLIQEHRVTHFGFAATVARMLRAVASDTVEDYDLSSIRAFGNTGEPIDHATWMWVMEKLGGWRRPLINLSGGTEVFGCILLPSPVVPLKPTTLWGPALGVDADVFDDEGRPVRGEPGYLVVKKPFPSMTRGLWKDPERYIKTYWSRFPGVWYHGDYALVDEDGFWYILGRADDVIKVAGKRIGSAELESVLTQLPEVAEAACIGVPHPIKGEVIACFLVPKGGYDAEELASKARKAVVDRFGKPFAPEHVVIVSELPKTRSGKITRRVLRDLARGVEPKELSVLENPEAVEKLRDIIKRIGGG

SEQ ID NO: 751 - DNA, 1677 bp, Methanobacterium thermoautotrophicum
  CDS (1)..(1677)
atgtcaaaggatacctcagttctcctggaagagaaaagggtcttcaaaccccactacaccgttgtggaggaggcccacataaaaaactgggaggccgagctcgaaaagggaaaggaccatgagaactactgggccgaaaaggctgaaagattcgaatggttcagaaaatgggacagggtccttgatgagagcaacagaccattctacaggtggttcgtcaacggtaagatcaacatgacctacaacgccgttgacaggtggcttgacacagacaagagaaaccaggtcgccattctatacgtgaacgagaggggggatgaaaggaagttaacctactatgaactgtaccgtgaggttaacaggaccgctaatgccctcaaaagtcttggaatcaaaaagggcgatgcagttgccctctaccttccaatgtgccccgaacttgtaatctcaatgcttgcctgtgcaaagataggtgctgtccacagtgtcatatactccggtctcagtgtgggggccctggtggaacgcctgaacgatgcaagggcaaagatcataataacagccgacggtacctacagaaggggcggggttataaagctcaaacccatagtggacgaggccatactccagtgccccaccatagaaaccacagtggttgtaaagcacacagacatcgacattgagatgtcggatataagtggacgtgaaatgctcttcgataagctcatagagggtgaaggggaccggtgcgatgcagaggagatggatgcagaggaccccctcttcatactctacacttcggggagcaccggaaaaccaaagggtgttctacacacaacaggaggatacatggtgggggttgcatcaaccctcgagatgacctttgacatccacaacggagacctctggtggtgcacagcagacatcgggtggataacaggtcacagctatgttgtctatggcccgctgctacttggaaccacaacactcctctatgagggggcacctgattaccctgaccccggtgtgtggtggagtatcgttgagaaatacggtgtcaccaagttctacacggcaccaaccgcaataaggcacctcatgaggttcggtgacaagcacccaaaacgctacaaccttgaatccctcaagatacttggtacggtcggtgaacccataaaccctgaggcatggatgtggtactacaggaacattggaagggagaagtgcccgataattgacacctggtggcagaccgagacagggatgcacctcatagcacccctacctgtgacaccccttaaaccgggttcagtgacaaagcccctcccgggcatagaggccgacgtggttgacgagaatggcgaccccgtgcccctgggtaagggtggttttcttgtgatcagaaagccatggccagccatgttcaggaccctcttcaacgacgagcagaggtacatcgatgtttactggaagcagatccccggcggagtgtacaccgcaggtgacatggccaggaaggacgaggacggatacttctggatccagggaagatccgatgacgtcctgaacatagcagggcacaggataggtactgcagaggttgaatcagtctttgtcgcacaccctgcagttgcagaagccgcggttataggcaaggcctaccccatcaaggggtag

SEQ ID NO: 752 - protein, 558 aa, Methanobacterium thermoautotrophicum
MSKDTSVLLEEKRVFKPHYTVVEEAHIKNWEAELEKGKDHENYWAEKAERFEWFRKWDRVLDESNRPFYRWFVNGKINMTYNAVDRWLDTDKRNQVAILYVNERGDERKLTYYELYREVNRTANALKSLGIKKGDAVALYLPMCPELVISMLACAKIGAVHSVIYSGLSVGALVERLNDARAKIIITADGTYRRGGVIKLKPIVDEAILQCPTIETTVVVKHTDIDIEMSDISGREMLFDKLIEGEGDRCDAEEMDAEDPLFILYTSGSTGKPKGVLHTTGGYMVGVASTLEMTFDIHNGDLWWCTADIGWITGHSYVVYGPLLLGTTTLLYEGAPDYPDPGVWWSIVEKYGVTKFYTAPTAIRHLMRFGDKHPKRYNLESLKILGTVGEPINPEAWMWYYRNIGREKCPIIDTWWQTETGMHLIAPLPVTPLKPGSVTKPLPGIEADVVDENGDPVPLGKGGFLVIRKPWPAMFRTLFNDEQRYIDVYWKQIPGGVYTAGDMARKDEDGYFWIQGRSDDVLNIAGHRIGTAEVESVFVAHPAVAEAAVIGKAYPIKG

SEQ ID NO: 753 - DNA, 1929 bp, Archaeoglobus fulgidus
  CDS (1)..(1929)
atgagaaaaatgggctttatctggcatccgccaaaagaattggttgaggagtccaacgtcaaggccttcatggatgctgagggcttttccgactacaagcagatggttgagaagtccactgacgacatagagtggtggtggagcaaggctgttgagtggctcaatgtggagtggttcaagccctacgagaaggtctacgacatgtcgaagggcatagagtggactgactggttcgtgaacggcagagtaaacgccgcttacaacgccttggacaggcacagaaagaagaggaacaagttagcgttcatctggcagggagaggatggagaagtgaggagatacacctacctcgagctttacagggaagtgaacaggctcgccaacgccctcaaggcctttggagttgggaagggggacgttgtggccctctacctcccaatgtttcctgaaactgtcgttactctctttgctgccatgaagattggcgccattgcgatgccgatattctcgggctatagctctgcagccattcagacgaggcttgctgattcagatgcgaaggttgttgttacagcagatgcaagctacagaagagggagggctgtgccactcaagcccgaactcgacaaggcccttgaggggacgaaggttgagaaggttgttgtggtgaacagggcggacaccgaagttgagatgaaggaggatagggacgtttactgggatgaggttaaggagagcagcaggtgtgagacggttgagatggaccccaacgatgctgctttgctgctctacacctcaggcacaaccggaaagccgaaaggggttgttttatcccatgcgggagtgattttgcagagcagcaaggagattttcttcaacatggatttgaagcctgaagacgtttttctttggatcaccgacattggctggatgatggggccttggcagattattggctgccagcatctcggcgggactcacgttctctttgagggagcccccgactatcccaacaccgacaggatatgggcgatgattgaggagtttgaaattacgcagcttggtggttcagcgacggtttacagattgctgaagagatacggagatgaggcggtaaagcagcacgacctgagcagtttaaaggctacgggcaacaccggagagccgatagaccacgacacgtggatgtggctgctgaaggtcgttggcgaggagaggtgcccgatcataaacctctcaggaggaaccgagatcttcggctgctttttgcttccctctcccgcaatgcccctcaagccgacaaccttgggctatcccggattggggatggacgtggatgtgtttgatgacgctggaaactctgtgaggcagcagattggatatctggtttgcaagaagccagccccatcaatgacaagaggcttctggaaagaccctgagaggtacatcaagacctactggagcaggtggaagggagtctggtaccacggagactgggcttatgttgacgaggatggtttctggttcctcttcggcagggccgatgacgtcataaaggttgcaggaaagagaatgggacctgcagagattgagaccatcgtgaactccattcctgctgtccaggagtccgcatgcattggagttccgcatgagcttaagggagaggttgtttgggtttttgtgactctaaagcccggctatgagccgagtgaggagctggagaaggaaatcgttgacaaaattgtgaaggagttcggaaagcccttcaagccggacagggttgtgtttgtccccgatctgccgagaacgaggagcgggaagattatgaggaggctgataaaggctgttgttgccaagcaggagcttggcgacacctcagctctggaaaatccggactcgctggagaagataaaggaggttttggggtga

SEQ ID NO: 754 - protein, 642 aa, Archaeoglobus fulgidus
MRKMGFIWHPPKELVEESNVKAFMDAEGFSDYKQMVEKSTDDIEWWWSKAVEWLNVEWFKPYEKVYDMSKGIEWTDWFVNGRVNAAYNALDRHRKKRNKLAFIWQGEDGEVRRYTYLELYREVNRLANALKAFGVGKGDVVALYLPMFPETVVTLFAAMKIGAIAMPIFSGYSSAAIQTRLADSDAKVVVTADASYRRGRAVPLKPELDKALEGTKVEKVVVVNRADTEVEMKEDRDVYWDEVKESSRCETVEMDPNDAALLLYTSGTTGKPKGVVLSHAGVILQSSKEIFFNMDLKPEDVFLWITDIGWMMGPWQIIGCQHLGGTHVLFEGAPDYPNTDRIWAMIEEFEITQLGGSATVYRLLKRYGDEAVKQHDLSSLKATGNTGEPIDHDTWMWLLKVVGEERCPIINLSGGTEIFGCFLLPSPAMPLKPTTLGYPGLGMDVDVFDDAGNSVRQQIGYLVCKKPAPSMTRGFWKDPERYIKTYWSRWKGVWYHGDWAYVDEDGFWFLFGRADDVIKVAGKRMGPAEIETIVNSIPAVQESACIGVPHELKGEVVWVFVTLKPGYEPSEELEKEIVDKIVKEFGKPFKPDRVVFVPDLPRTRSGKIMRRLIKAVVAKQELGDTSALENPDSLEKIKEVLG

SEQ ID NO: 755 - DNA, 1974 bp, Campylobacter jejuni
  CDS (1)..(1974)
atgcttaatcaaaataatcaagagctttttaagccaagtaaagaattttctcgtaatgctcgtataaaaaatttatgtgaatactatgatttatgcgatgaagccaaggaagattttgaaggtttttggaaaagacaagcatttgagaagattgagtggttttcgcctttttcaagagtgctaaatgaggataaagctccattttataaatggtttgaaggtggaactttaaatgtaagttatcaatgtcttgatcgtcatatgaaaacaagacgcaataaagctgctttgatttttgaaggtgaaatgggggattatgaagtttatacttatagaagattattgcatgaaacttgcaaggcggccaatttgcttaaaaaattcggagtaaaaaaaggcgatagggttgtaatttatatgcctatgattccagaaacagctatagtaatgttagcttgtgcaaggattggggctattcatagtgtagtatttggagggttttctcctgaagccttaagagatagaattatagatgcaggagctaaacttgtagtaacggctgatggtgcttttcgtcgtggcaaaccttatatgttaaaacctgcagtagataaggctttaagtgaagggtgtgaaagtgtagaaaaagtacttatagttatacgcaataatgagcctatagaatatattaaaggaagggactatgtttataacgaacttgtgaaaaatgagtcttataagtgtgaacccgaaattatggatagtgaggatttgttgtttttgctttacacttcaggatcaacgggcaagccaaaaggagttatgcatgcaagtgcaggatatatactttgggcacaaatgactatggaatgggtttttgatattaaagattatgataattattggtgtagtgctgatgtgggttggattacaggacatacttatgtagtttatgggcctttagcatgtggggcaacgactataatgcatgaaggaactcctacttatccaaattctgggcgttggtggagaatgatagaagagtatcaaataagcaaattctacacttcgccaactgccataagaatgcttcatgctgatgcacctaatgagccaagaaaatatgatttaagtacgcttgaagtgcttggaacggttggagagcctatcaatcctagtgcttggaagtggttttatgatgaaatagggggaactaaaagtcctatagtcgatacttggtggcaaacagaaacaggtgggcatatgatcacgcctttaccaggcgccactcctttaaaaccaggttgtgccaccttgcctttgccagggatttttgcggaagttattgatgaagaaggcaataaaaaagatgaaggtgaagatgggttgctttgtataactaaaccttggccttcgatgattcgtggaatttggggcaatgatgaacgctatatagaaagttatttttctcaagctaaaaaagatggaaaagctgtatattttagtggcgatggtgctttttatgataaaaatggttatattaccatcacaggaagaacagatgatgtggttaatgttgcaggacatcgtataggaacggctgaaattgaaagcgctattgctaaacatccaagtgtagcagaatcagctgtagtgagtattttggatacgattaagggcgagtcattgtttgcttttgtggttttaagtcctgcatccagttgtgatcttggcggagctatagaaactttaaaagaacttaatgacattttaagagtagaaataggacctatagctaaaatagaaaaaattctttatactccaggtttgccaaaaactagaagtggtaaaataatgagaagaattttaagaactatagcaagaggcgaagaaatcaaacaggatatttcaacacttgaagattctaaagtagtagaaaccattgttaaattagctaaggcagagtttgaataa

SEQ ID NO: 756 - protein, 657 aa, Campylobacter jejuni [sequence omitted]

SEQ ID NO: 757 - DNA, 1956 bp, Pseudomonas aeruginosa
  CDS (1)..(1956)
atgcccgcaccgctctggagcccttccgccgaacgcatcgccgccagtcgcatggaggccttccgacgcttcgtcaaccagcggcacgccctcggcctggtcgactacccggcgctgcatgcctggagcgtgcagcggcgcgaggcattctggcaggccatcgtcgacttcttcgaggtgcgcttccagcaaccgccgcgtgcggtcctcgaggaaggcgcgcagatgccctcggcgcgctggttccccggcgccacgctgaatttcgccgaacacctgctgcgccgccgcgatgatgccccggcgctgatcgcggtgagcgaagacggtcgccgcgaggtgctcagccacgccgaactggcccgtcacgtggcgggcctgcagaagcgcctcgccgccctgggcataggccccggcgaccgggtcgccgcgctgatgccgaacacctggcagaccgtggtcggcatgctcgccaccgccagcctcggcgcgacctggtcgagctgctcgccggacttcggtacccagggcgtgatcgaccgcttcggccagatcgaaccgcgcgtgctgatcgcctgtgccggctaccgctacgccggcaagtcgctggacctgaccgccaagctcaacgaggtgctcgccggcctgcccggcctggagcaactgctggtggtgccctacgaccgtccgcaggcgcagccgcaggactaccgctgccaggcgcaggtcgcgctgtgggacgggttctaccaggccgagggcgagccggtcttcaccccggtgcccttcgagcagccgctgtacatcctctattcgtcgggcaccaccggagtccccaagtgcatcgtccatgccaccggcggcgtgctcctgcaacatctcaaggagcacggcctgcacaccgacctgggcgacggcgaccggctgttctactacaccacctgcggctggatgatgtggaactggctggcctccggtctggcggtgggcgccagcctggtgctctacgacggctcgccgttccaccccggccccgagcgcctgctggacctcatcgacgccgaggacatcgccgtgttcggcgccagcgccaagtacctggcggcgctcgagaaggccggcatgcgcccgcgccacagccaccgcctggacagcctgaggacactgctctccaccggttcgccgctggcccacgaaagcttcgactacgtctaccgcgagctgaagagcgacctctgcctgtcgtcgatctccggcggcaccgacatcgtttcctgcttcgccatcggcaacccggtgctgccggtgtggcgcggcgaactgcaatgcaaggcgctgggcatggccgtggaaatctgggacgacgacggccgccgcctcgccagcggcaagggcgagctggtctgcacccggcatttcccgtcgatcccgctgggcttctggaacgacccggatggcaccaggttccacgacgcctacttcgccagctttcccggcgtctgggcccatggcgactacgccgaggaaaccgtccacggcgggctggtcatccacggccgctccgacgcggtgctcaatcccggcggcgtgcgcatcggcaccgcggaaatctaccgccaggtggaaaaggtcgaggaagtcctcgagtccatcgccatcggccaggactggcagggcgatgtgcgtgtgctgctgttcgtccgcctgcgcgacggcgtgcgactcgacgagccgctgcgcgaacgcatccgccagaccatccgcgccaacgccacgccgcgccacgtaccggcgaagatcatccaggtcgccgatatcccgcgcaccctgagcggcaagatcgtcgagcttgcggtgcgcaacgtgatccacggccgcccggtgaagaacaccgacgccctggccaacccgcaggcgctggagctttatcgcgacctcgccgaactgcgcgactga

SEQ ID NO: 758 - protein, 651 aa, Pseudomonas aeruginosa
MPAPLWSPSAERIAASRMEAFRRFVNQRHALGLVDYPALHAWSVQRREAFWQAIVDFFEVRFQQPPRAVLEEGAQMPSARWFPGATLNFAEHLLRRRDDAPALIAVSEDGRREVLSHAELARHVAGLQKRLAALGIGPGDRVAALMPNTWQTVVGMLATASLGATWSSCSPDFGTQGVIDRFGQIEPRVLIACAGYRYAGKSLDLTAKLNEVLAGLPGLEQLLVVPYDRPQAQPQDYRCQAQVALWDGFYQAEGEPVFTPVPFEQPLYILYSSGTTGVPKCIVHATGGVLLQHLKEHGLHTDLGDGDRLFYYTTCGWMMWNWLASGLAVGASLVLYDGSPFHPGPERLLDLIDAEDIAVFGASAKYLAALEKAGMRPRHSHRLDSLRTLLSTGSPLAHESFDYVYRELKSDLCLSSISGGTDIVSCFAIGNPVLPVWRGELQCKALGMAVEIWDDDGRRLASGKGELVCTRHFPSIPLGFWNDPDGTRFHDAYFASFPGVWAHGDYAEETVHGGLVIHGRSDAVLNPGGVRIGTAEIYRQVEKVEEVLESIAIGQDWQGDVRVLLFVRLRDGVRLDEPLRERIRQTIRANATPRHVPAKIIQVADIPRTLSGKIVELAVRNVIHGRPVKNTDALANPQALELYRDLAELRD

SEQ ID NO: 759 - DNA, 1887 bp, Pseudomonas aeruginosa
  CDS (1)..(1887)
atgacgtacctgcagcagcacgcccgctcgatcgccgagccggccgcgttctgggccgaacaggcccgttccctggcctggtaccaggcgcccgcgaacatcctcgaaagcctgcccgacggcacccatcgctggttcgccgatggccgtctgaacagcgcctacctggccctcgaccggcagatcgaggaggggcgcggcgaacagaccgcgctgatctacgactcgccggtgaccggcacccaggaccgctacagctacctgcggctgcgcgacgaagtggcgcgcctggccggtgccctgcgggccctcggggtcggcaagggcgaccgggtgatcatctacatgccgatggtgccgcaggcggccatggcgatgctcgcctgcgcgcgcctgggcgcggtgcattcggtggtgttcggtggcttcgctccctacgagctggccctgcgcatcgacgacgccacgccgaagctggtgctcaccgcttcctgcgggctggagttcgatcgggtgatcgaatacaagccgctggtggacaaggccctcgaactggcgatccaccagcctgcccacgtcatggtctggcaacgcccgcaggcgcccgcgcgcctgcacccgggccgcgacctggactggcaggactgcctcgccgccgccgagccggccgatccgctgccggtggccagcggcgatccgctgtacatcatgtacacctcgggcaccaccggtaagcccaagggtatcgtccgcgacaacggtggccacgcggtcgcggtgcgctacgcggtccgcactatctacggcatgcaggccggcgacgtctggtgggggatctccgacgtcggctgggtggtcggccactcgctgatcgtctacggcccgctgatgtgcggctgtaccacggtgttctacgaaggcaagccggtgcgcacgccggacgccggcgcctactggcgggtgatcgaagagcacagggtgaacagcctgttctgcgcgccgacggcgatccgcgcgatccgcaaggaagacccgcatggcgaacgggtgaagcgctacgacctgggttcgctgcgccacctgttcctggccggcgagaagctcgacagcagcacccagcactggctggaggagcacaccgggcggccggtccacgaccattggtggcagaccgagaccggctggccggtgaccgcgccctgcatcgggatcgccggccacgacctgcgggccggctcgaccaaccgcgcggtgcccggctaccacgtgcaggtgctggacgacgaaggccggccgctgggagcgaaccgccagggcgcgatcgtcatcgccctgccgttgccgccgggctgcgcgcagaccctctggggcgaccacccgcgctacctgcaggcctacctgggcaactatcccggctactaccacaccggcgacggcggttatctcgacgaggacggcttcgtctacatcatggggcgcaccgacgacgtgataaacgtttccgggcatcgcctctccaccggcgagatggaggaacgcgtggcgcagcaccaggcggttgccgagtgcgcggtgatcggcgtgcgggacgaactcaagggccacgtgccgctgggcctggtggtgctcaaggacgatgccgggatcgccgccgagcaactgcagcgcgagctggtggcgctggtccgcgaacagatcggcgcgctggcctgcttccagcgggtggtggtggtcaagcggctgccgaagacccgctccgggaagatcctccgcgcggtgctgcgcaagatcgccgatggcgaggactacgcggcgccatcgaccatcgacgacccgacgatccttggcgagatcgaggctgcgctgagggtgcgcaaggcgggatag

SEQ ID NO: 760 - protein, 628 aa, Pseudomonas aeruginosa [sequence omitted]

SEQ ID NO: 761 - DNA, 1971 bp, Halobacterium sp. NRC-1
  CDS (1)..(1971)
atggattcactcgacggagtcggcacggtcgtccacgaaccggaccctgcgctcgcgtcgtcgacgaacgtcgcccagttcatgaccgcccacgacatcgacgacgtggacgcgctccgcgagcgcagcaccactgatctcgactggttctggggggaactcccggagtatctcggcctggagttcttcgaagactacgacgccgtccgcgacgacgccgacgacccccagtccacggcgtggtatccgggcgccgaactgaacgtcgcgcacaacaccgtcgaccgccacgccagcgtcgacgccggcacccgcaaccacgtcgcctgcatctgggagggcgaggacggcacggtccgccaacagacctaccacgacctccaccagcaggccaaccgggtggccaacgcccttgctgagcgcggcatcggcgagggcgacacggtgggcctctacatgccgatggtcccggaagtccagagcatcctctacggcatcttcaagatcggcgcgatcgccgtccccatcttctccgggttcggcgtcgaggccaccgccacgcgcatcgccgacgccgagtgttcggtggtgttcacgggcgacggcttcctgcggcggggcgaccgcgtcacgctcatggacaccctcaacgacgccatcgagcgggccggccacgtcgaccacaccatcgtctacgaccgcctcggcatccccgcggactcgctgtcctggacgccccgcgacgagtggtgggacgacgccgtggccacccagtccccgacgttcgagacgcactcgatggccgccagcgatccgtgcatgctgttgtactcctcggggacgacgggaacaccgaaaggcatcgtccacacccacgccggcgcgctcgtccaacccgccaaggagatccacttcgggttcgaccagcggcccggcgaccggttctgctgggtgagcgacatcggctggatgatggggccgtggtcgctcatcgggaaccacgcgttcgccggcaccatcgtgatgtacgagggcgcccccgaccaccccgcccccgaccgcttctggcagctcatcgaggaccacggcatcacccagttcggcgtctccccgacggcgatccgtgcactgcgcgaccacggcgacgagcacgtcgccggccacgatctctcctcgctgcgcatcctggggtcgacgggcgagccctgggaccccgagtcctggcggtggttttacgaccacgtcggcggcggtgacaccccgatcatcaacatctccggcggcacggaagtgttcggctgcttcctcatgccgctgccgacggagtcgctgaaaccctgcacgctcggcggccccgggctcggcatggacatcgacatcgtcgacgacgacggcacctccgttcgggacgccaacgagcgcggctacctcgtcgcgcggtcgtccagcccgtcgatgacgcggcgcctctggagcggcgaggaccgctacctggaggcgtactggtcgcgcttcgaggacgtctggaaccacggcgactgggcgcagatggacgccgacggcgactggttcctccacgggcgcgccgacgacgccatcaacgtcgccggccgcaaagtcggcccggcggaggtcgagggcgcgctcatcgaccacgacgccgtcacacaggcggccgtcgtcggagtgcccgacgacaccaccggtgaggccgccatcgcgtacgtcatcctcgccgacgccgccaccccgagcgcggagctgcgcgcggaactgcgcgaccacgtcggcgacgcccacggcaaaccgttccggccccgggaggtggtgttcgtcgacgacctgccgaaaacccagtccgggaagctcgtgcgccgcgccgtcgccagcgcgtacaccggggcggacgtcacggaccgctccagcatcgagaaccctgcggtgctggacgcgctccgggacgcgacctag

SEQ ID NO: 762 - protein, 656 aa, Halobacterium sp. NRC-1
MDSLDGVGTVVHEPDPALASSTNVAQFMTAHDIDDVDALRERSTTDLDWFWGELPEYLGLEFFEDYDAVRDDADDPQSTAWYPGAELNVAHNTVDRHASVDAGTRNHVACIWEGEDGTVRQQTYHDLHQQANRVANALAERGIGEGDTVGLYMPMVPEVQSILYGIFKIGAIAVPIFSGFGVEATATRIADAECSVVFTGDGFLRRGDRVTLMDTLNDAIERAGHVDHTIVYDRLGIPADSLSWTPRDEWWDDAVATQSPTFETHSMAASDPCMLLYSSGTTGTPKGIVHTHAGALVQPAKEIHFGFDQRPGDRFCWVSDIGWMMGPWSLIGNHAFAGTIVMYEGAPDHPAPDRFWQLIEDHGITQFGVSPTAIRALRDHGDEHVAGHDLSSLRILGSTGEPWDPESWRWFYDHVGGGDTPIINISGGTEVFGCFLMPLPTESLKPCTLGGPGLGMDIDIVDDDGTSVRDANERGYLVARSSSPSMTRRLWSGEDRYLEAYWSRFEDVWNHGDWAQMDADGDWFLHGRADDAINVAGRKVGPAEVEGALIDHDAVTQAAVVGVPDDTTGEAAIAYVILADAATPSAELRAELRDHVGDAHGKPFRPREVVFVDDLPKTQSGKLVRRAVASAYTGADVTDRSSIENPAVLDALRDAT

SEQ ID NO: 763 - DNA, 1719 bp, Bacillus subtilis
  CDS (1)..(1719)
atgaacttgaaagcgttaccagcaatagagggggatcataacttaaaaaactatgaagaaacgtaccggcattttgattgggccgaggcagagaaacatttctcttggcatgagacagggaaactgaatgcggcgtatgaagcgattgaccgccatgccgaatcgtttcgaaaaaacaaagtagcgctttattataaagacgcaaaaagggatgaaaaatacacatttaaagaaatgaaggaagaatcaaacagagccgggaatgtgctgagacggtatggaaatgtggaaaaaggggaccgcgtttttatttttatgccgagatcacccgagctttattttattatgcttggcgcaatcaaaattggcgccatcgccgggccgctgttcgaagcatttatggagggagcggtgaaagaccggcttgaaaacagtgaggcaaaggttgttgtcacaacgcctgagctgctggagagaataccggtagacaaactgcctcacttgcagcatgtcttcgtagtcgggggagaggctgagagcggcacgaatatcatcaattatgatgaagcagcgaaacaggaaagcacaagattggatatcgaatggatggataaaaaagacggctttctgcttcactatacatcaggttccactggtacgccaaagggcgtgttgcatgtccatgaagcgatgattcagcaatatcaaacaggaaagtgggtccttgatttaaaggaagaagacatttattggtgcacggctgatccaggctgggtgacaggtacggtatacggcatttttgcaccgtggctgaacggagcgacaaatgtcatcgtcggcggacgtttcagcccggaaagctggtatggaacgattgaacagcttggcgtcaatgtctggtacagcgcgccgacagcttttcggatgctgatgggagcgggagatgaaatggctgcgaaatatgatctaacttcactccggcatgtgctcagtgtcggtgagccgctaaatccggaagtcatcagatggggacataaagtttttaacaaacgaatccatgatacctggtggatgaccgaaacgggcagtcagctcatctgcaactatccttgcatggatattaaaccgggttcaatgggtaagccgattccaggagtggaggcagcgatcgttgacaatcaaggcaacgagctaccgccgtaccgaatgggcaatctcgccatcaaaaagggctggccttccatgatgcataccatttggaataaccctgaaaagtatgaatcgtatttcatgccgggcggctggtatgtgtctggggattctgcttacatggatgaagagggatacttttggttccaaggcagagttgatgacgtcatcatgacctccggtgagcgcgtcggcccatttgaagtggaaagcaagcttgtcgaacatccggctattgcagaagcaggcgttatcggaaagcctgacccggtgcgtggagaaatcattaaagcctttattgcactcagggaaggatttgagccgtctgataaactgaaagaagagatccgcctatttgtaaagcagggtcttgcagcccatgcggctccgcgtgagatcgaatttaaagataagcttccgaaaaccagaagcggaaagatcatgaggcgcgtgctgaaggcatgggagcttaatctgccggctggagatctgtcaacaatggaggattaa

SEQ ID NO: 764 - protein, 572 aa, Bacillus subtilis
MNLKALPAIEGDHNLKNYEETYRHFDWAEAEKHFSWHETGKLNAAYEAIDRHAESFRKNKVALYYKDAKRDEKYTFKEMKEESNRAGNVLRRYGNVEKGDRVFIFMPRSPELYFIMLGAIKIGAIAGPLFEAFMEGAVKDRLENSEAKVVVTTPELLERIPVDKLPHLQHVFVVGGEAESGTNIINYDEAAKQESTRLDIEWMDKKDGFLLHYTSGSTGTPKGVLHVHEAMIQQYQTGKWVLDLKEEDIYWCTADPGWVTGTVYGIFAPWLNGATNVIVGGRFSPESWYGTIEQLGVNVWYSAPTAFRMLMGAGDEMAAKYDLTSLRHVLSVGEPLNPEVIRWGHKVFNKRIHDTWWMTETGSQLICNYPCMDIKPGSMGKPIPGVEAAIVDNQGNELPPYRMGNLAIKKGWPSMMHTIWNNPEKYESYFMPGGWYVSGDSAYMDEEGYFWFQGRVDDVIMTSGERVGPFEVESKLVEHPAIAEAGVIGKPDPVRGEIIKAFIALREGFEPSDKLKEEIRLFVKQGLAAHAAPREIEFKDKLPKTRSGKIMRRVLKAWELNLPAGDLSTMED

SEQ ID NO: 765 - DNA, 2019 bp, Phycomyces blakesleeanus
  CDS (1)..(2019)
atgctcgataaaaccaccattgacggacaggaggatattgtcacccacccagtccccaagcgcctcctcaactcagcagaatgccctacacctcatgtcaactctcttgaacagtacaagtcaatgtggaaagagagtgtcgaacaacccgagaagttctttggaaatcttggtcgtgagcttttgtcctggagcaagcctttcgagactgtccagtatggttcctttgaggctggagatgtagcctggttcttggagggtgaacttaacgcatcgtacaactgtgttgatcgtcacgctttcaagaaccccgataagattgccatcatccatgaaggcgatgaacccgatcaggtccgccgtatcacttatggtgagcttcttagagaggtctgtcgcatggccaacgtcctcaagggcctcggtgtacgcaagggtgatcccgttgctatctacatgcccatgattcccgagaccattgtcgccatcttggcatgtgcccgtattggtgctatccactctgttgtctttgctggtttttctgccgagatcctccgtgatcgtgttgtcgactgtgctacccgtgtcgtactgacttccgatgaaggcagacgtggtggaaagaacattgccaccaagtgcatcgttgacgaggctctccgtgactacgagaatcactctgtcgaacatgtcctcgtcttccgtcgcaccggatccccagttccctgggttcaaggacgcgatgtctggtggcatgaggagatggccaaggcacgtactttctgctctcctgagcccatgagtgctgaagatcctctctttttgctctacacttctggatccactggtacccccaagggtattttgcacaccactggtggctatcttttgggtgttgctgccacagtcaagtacatctttgattaccaggagaatgatatctacgcttgcatggctgatattggatgggttactggacattcttacattgtttatggtcctctcactcttggtgctaccacagttctattcgaatctaccccaacataccccaacccctctcgcttctggcaactgatcgagaagcataagattacccagttctacaccgcacctacagctattcgtgctctgcagcgtcttggagaccagtggctggataacattgatatgtcaagcctgcgtgtacttggctctgtaggtgaacctattaaccgtgaagcctgggattggtacaacgagaaggttggtaagggtagatgtgctgttgtagatacctactggcaaaccgagactggttccatcattgtcagtcctcttcccggagctactcccacaaagcctggatctgccactcttcccttctttggtattgaccccgtattgcttgatcctactaccggcaaggagttgactgccaccggccaaaccggtgttcttgccatccgcaagcctaggccctcaatggctcgctctgtctacaacaaccacagccgttttgttgagacttatctcaagccctaccccggttactatttcacaggtgatggtgctctccgtgatgatgatggttatatctggattcgtggacgtgttgatgatgttatcaatgtttctggtcaccgtctctccacctctgagatcgaatctgctctcgttaaccatgaggctgttgccgagtctgctgttgttggtgcccatgatgatttgaccggccaatgtatccatgctttcgtttctctgaagccccatattcagatcgctgatggactcgaaaaggttctgactttgcaagttcgcaagactattggtccctttgctgcccctcgtcgcatctacattgtcagtgaccaccccaagactcgttctggaaagatcatgcgccgtattcttagaaagatcgttaacggagagcacgaccaactcggtgatatctctaccctggctgatccttcgattgttgctgtattgatcaacaaggttcaacggttaaacacagaagcaaatatatatatataa

SEQ ID NO: 766 - protein, 672 aa, Phycomyces blakesleeanus [sequence omitted]

SEQ ID NO: 767 - DNA, 2674 bp, Drosophila melanogaster
  CDS (419)..(2164)
cgtccaagcttttcacctccttaataaataagtggtattgcactgctctgttccaagtcagacccacaagggaaaggcaaacaaagtaaaacaattacacaatgctaagtcatattacaatatgtacgcggtaggaacacaagcggcacacaaaaggggattggatttaaatgcatttttaaatattttgttggaaatcttaccgtagctctaaaatatctctttgaaattaggtgacaatttgagttcagaaaatcgaattaagtcgggtgggcaattaggaagcctcgcataaaagtaagtgatccaattatggtcggggtaattagcccaattgtggggcacccggtatgcggccacccatttgagaacgccatcggcgcgtgctcaatgtaatactatagaaggaatactaagtatgtgtttcctcacggtcgtgtttcttttttgccattgtttcagggagggcaaccaccccgacgattattcccggggtctcacctatcgcaagttgctggaggaggtgtgccgcttcgccaacgtgctgaaggatcatggcattcgaaagggcgatcgtgtatccatttacatgcccatgattctggagctgcctatcgcgatgctggcctgcgctcgcattggagccgtgcactcgatcgttttcgccggattctcaccggactcactggcggagcggatgttcgattgcaaggccaagctgctgattacggcggatggagcctggcgtggagagaaacccctgtacctgaaggctctgtgcgacacggccttggagaaagtcgaggagatggggcactccgtggagaagtcgatcgtggtgtcgcatttgaagcgagtgactccgtgccagccggatcatgtcgaggaggaaatcccatggaccgatgaccgcgattactggtggcacgaggagatggaggacaaggagccggcctgctatccggagtggatggacgccgaggatccattgttcatgctctacaccagtggctccactggcaagcccaagggagtgctccacacgactgccggatatctgctgtatgcggccacgaccttcaagatcgtatttgactataagccaggggatatctactggtgcaccgccgatgttggctggatcacgggacacacctacgtggtgtacggaccattggccaatggagccacttcagtgattttcgaaggcacaccattcttccctggaaacgatcggtactggagtgtcattgacaaatataaggtaactcagttctacacagctccaacggcgattcgtgccctcatgaagttcggcgagggtcccgttctaaagcacaacctgagcggactcaaagttttgggcagcgtgggtgagcccatcaacccggaggcctggctctggtattacaaatacattggaaaggagcagtgctccattgtggacaccttttggcaaacggaaaccggtggtcatgtcattacacctctgcctggagcgactcccatgaagccgggatctgcttcattccccttctttggagtgaagcccactttgctggatgagtgcggcattgaaattaagggggagggagagggctacttggtcttctcgcaaccttggccgggaatgatgcgcactttgtacaacaaccatgaacgcttcgaggacacttatttctccaagttcccaggctactactgcactggcgatggagcccgacgcgatgctgacggctatttgtggatcactggtcgtgtggacgacatgttaaacgtgtccgggcacctgatgtccacagccgaggtagagtcggttctcacagagcatcctcgcgtggctgagtccgccgtggtttcccgtccgcatcccgtcaagggcgagtgtctctactgcttcataacgccgaacgagaacgaggtattcgaccagaagctaatttcggacctgaagaagatggtgcgagaacgtatcggaccttttgccatgccggatgtcattcaaaacgctcccggactgcccaaaactcgttccggcaagattatgcgtcgtgtgctgcgcaagatcgcggttaacgatcgcaacgtgggcgacacatctaccttggccgatgagcaaattgtggagcaactgttcgccaaccggccagtggaggccaagtagatggtagctgttggaccaactggcagcagccaggatcccttaacccaaggctttctccggttgcactgaccactccactttgccatcgcatttccaccacttacgtatcgcgattacgtatcctgtaaatctccctctacttatatgaattacccactgcttaatgtttgttccgttccgggctacggcgtggttagcacctttcaaattctacttagcgcgtaagcctaagcgtgtgcgtaagtaagtgactggatggtttccgatcccagttatatatcgtctatatgattttgtgtacttgcctgttcatcgtagttgacatgctcaccacgcacacattttccagttcttttgtttcttcgttgtagtcgtagtttaagttctcgctaattcgttgtgatacaaatttaattatatcttacttatgtatgtatttttagctagaattgatatgagacaaaatatatacacgattccaattgtcgccacaatttacaaaaaaaaaaa

SEQ ID NO: 768 - protein, 581 aa, Drosophila melanogaster
MCFLTVVFLFCHCFREGNHPDDYSRGLTYRKLLEEVCRFANVLKDHGIRKGDRVSIYMPMILELPIAMLACARIGAVHSIVFAGFSPDSLAERMFDCKAKLLITADGAWRGEKPLYLKALCDTALEKVEEMGHSVEKSIVVSHLKRVTPCQPDHVEEEIPWTDDRDYWWHEEMEDKEPACYPEWMDAEDPLFMLYTSGSTGKPKGVLHTTAGYLLYAATTFKIVFDYKPGDIYWCTADVGWITGHTYVVYGPLANGATSVIFEGTPFFPGNDRYWSVIDKYKVTQFYTAPTAIRALMKFGEGPVLKHNLSGLKVLGSVGEPINPEAWLWYYKYIGKEQCSIVDTFWQTETGGHVITPLPGATPMKPGSASFPFFGVKPTLLDECGIEIKGEGEGYLVFSQPWPGMMRTLYNNHERFEDTYFSKFPGYYCTGDGARRDADGYLWITGRVDDMLNVSGHLMSTAEVESVLTEHPRVAESAVVSRPHPVKGECLYCFITPNENEVFDQKLISDLKKMVRERIGPFAMPDVIQNAPGLPKTRSGKIMRRVLRKIAVNDRNVGDTSTLADEQIVEQLFANRPVEAK

SEQ ID NO: 769 - DNA, 1962 bp, Synechocystis sp
  CDS (1)..(1962)
atgtcagataccattgaatccatcctgcaggaagagcgactgtttgatccccctacagaatttagtgagcgggcttacgtgcgtagtgggcgggagtatgagcaactgtacagccgggcggccagcaatccggagaagttttggggtgagctggcggagcaggaattacattggtttaaaaaatgggaccaggttttggattggcaacctccctttgcgaaatggtttgtggggggtcagttaaatatttcccataactgtttggatcggcacttaaccacctggcggcgcaataaggcggccattatttgggagggggaaccgggagattcccggataattacctatgcccaactccatcgggaagtgtgtcagtttgccaatgccctgaaaagtttaggcgtgcaaaaaggtgatcgggtagcaatttatctgcccatgattcccgaagcggcgatcaccatgttggcctgttcccgtatcggtgcgccccatagtgttgtgtttggtgggtttagtgcggaagccctgcgggatcgattagtggatgctgaagccaaattggtcataactgccgacggtggttttcgtaaagataaggcgatcgccctgaagcaggaagtggataaggccctggaacacggtgcccccagcgtggaaaacgtcatcgtcgtgcaaagaactaaagccgatgtgaccatgacggcgggacgggaccactggtggcacgaactccaacctcaacagtcggcccattgcccagcggaacccatagacagtgaagatatgctgtttattctctacacctctggcagtactggcaaaccaaaaggcgtggtccacaccaccgggggttacaacctttacacccacatgaccaccaaatggatctttgacctcaaagatacggacgtttattggtgtaccgctgatgtgggttggattacgggccacagctacattgtttacggccccctgtccaacggtgcaacaacggtaatgtatgaaggggtgccccgcccctccaaccccggttgtttttgggacgtaattgaaaggtatggggtgaatattttctacaccgcccccaccgccatccgagcctttattcgcatgggggaagccgtacccaacgccagggatttatcctctctccgtttactgggcactgtgggggaacccattaaccccgaagcttggatgtggtaccaccgggtcattggcggcggtaaatgccccattgtcgatacctggtggcaaacggaaaccggcggcattatgctcactcccctacctggagctatccctaccaaacccggttcttgtaccaaaccttttcccggcattgtggcggaaattgttgatttagatggcaatcccgtcgagtcagaccaagggggctttttagtgattaaacaaccttggcccagcatgattcgggatgtgtacggcgacaccgatcgcttccgccatacctattgggaacatattcaacccaaggagggacaatatctctactttgctggggacggggcccgccgggataaagacggttatttttgggtcatgggccgggtggatgatgtgattaatgtctctggtcaccgtttaggcactatggaaattgaatcggctttggtttcccatcccctcgtagcggaagcggcggtggtgggtcgccccgatgaattgactggggaagccattttcgcctttgtttctctggagggtaacgctgaacccagtgaagagttgaaaaaagatttggtcaagcacgtcactgaagaaattggggcgatcgccaggccagcggaaatccgtttcaccgatgtgttacccaaaacccgttccggcaaaattatgcgtcgtctgttgcggagtttagcctccgggcaggaaatttccggggacacttccaccctggaggaccggacagtgctggacaaattacgggagggctaa

SEQ ID NO: 770 - protein, 653 aa, Synechocystis sp [sequence omitted]

SEQ ID NO: 771 - DNA, 2013 bp, Emericella nidulans, Aspergillus nidulans
  CDS (1)..(2013)
atgagtgacggaccaattgcccctcccaagcccgccgtggttgctgaggcccacgaggtcgacactttccacgttcccaaggcgttcttcgacaagcacccttccggccctcacttgaaaaatctcgatgaatacaagaagctctatgaggagtcgattcgcagcccagacgttttctgggcccgcaaagcccgtgagctgctcacttttgacaaagatttccaaacgacccgtatcggctcattggagaacggtgacgttgcttggttccctgagggtcggctaaatgcttctttcaactgtgtcgatcgtcacgccatcaagaaccccaacaaggtcgctatcatctacgaagccgacgaacccaacgagggccggacaatcacatatggcgagctgctccgcgaagtttctcgggttgcctgggttttgaaacagcgcggcgttaagaagggcgacactgtggctatctaccttcccatgattcctgaggccatcatcgccttccttgcgtgctcgcgtattggtgccgttcactccgttgttttcgccggtttctcgtcagactccctccgtgaccgtgtccttgacgccggttccaaggttgtcatcacaaccgatgagggtaagcgtggcggtaaggtcatcgggaccaagcgcattgtcgatgagggtctcaagcagtgccccgacgtgtcgaccgtgcttgtttacaagcgcaccggcgccgaggtgccctggaccgagggccgtgacatttggtggcacgaggaggttgagaagtaccctgcgtacattgctcctgactctgtcaactccgaggatcctcttttccttctatacacttctggttccaccggtaagcccaagggtgttatgcacactactgccggttacctcctaggcgcggctatgaccggaaaatacgtttttgatatccatgatgatgaccgctacttctgcggtggtgatgtcggctggattaccggccacacctacgtggtgtacgctcctctcctcctgggagtctcaacggttgtctttgagagtaccccggcttaccccgacttctctcgctactgggacgtgattgagaagcacaaggtgacccaattctatgtggcacccactgccctgcgattgttgaagagggctggtgaccaccacatccaccacaagatggaacatctacgtgtcctgggatccgtcggcgagcccattgctgctgaggtctggaagtggtacttcgagaaggttggaaaggaagaggctcacatttgcgacacctactggcaaaccgaaactggctccaacgtcattacccccttggccggtgtcactcccacgaagcctggcagtgcttccctgcccttcttcggtattgagcctgccatcattgatccagtctctggagaggagatctccggcaacgatgtggagggtgtgcttgccttcaagcagccctggcccagcatggcccgcactgtgtggggtgcccacaagcgctacatggacacatatctgcaagtctacaagggttactacttcaccggagatggagccggtcgtgaccacgagggatactactggatccgtggtcgtgttgacgatgtcgtcaacgtttctggtcaccgtctgtcaaccgcggaaattgaggctgccctcattgagcaccctatggttgctgaagcagccgtggttggtattgccgatgagttgaccggtcaggccgtcaatgcctttgtttcgctcaaagagggtaacgagaccaacgaccaagtccgcaaagacctcattctgcaagtccgcaagtcgattggacccttcgctgctcccaaagccgtctttgttgtcgacgacctgcccaagacccgtagcggtaagatcatgcgccgcatcctgcggaagattcttagtggtgaggaggatagcctgggcagcatttcaacgctgtccgatccatccgtggttgagagaattatcgccacagtgcacgcttcccgaggcaaataa

SEQ ID NO: 772 - protein, 670 aa, Emericella nidulans, Aspergillus nidulans [sequence omitted]

SEQ ID NO: 773 - DNA, 1881 bp, Neurospora crassa
  CDS (1)..(1881)
atgcgccagactttgaggagtaccagaagctatacaagcagtccatcaccgagcccaacgatgttctgggctgagcgcgcccgcgagcttctgtcgtggagcaaggatttccagacggtccacagcggctccctcgccaacggtgacaacgcctggttcgtagagggcgagctcaacgcctcgtacaactgcgtcgacaaacgccacaaggaccccaacagagtcgccatcatctacgaggccgacgagccggtcagaaggaatgtcacctatggcgagctcctcagggaggtctccaagctcgccatgtcctcaccaacttgggtgattcgcaagggagacaccgtcgccatctaccttcccatgattcccgaggccatcgttgccatgcttgcttgcaccagaattggcgccatccactccgtcgtttttgccggcttctcctccgactccctccgcgaccgtgtcgtcgatgcccagtccaaggttgtcatcaccaccgatgagggcaagcgcggtggcaagctgattggcaccaagaagatcgtcgacgaggctctccagcagtgccccgatgttcgcaacgtgctcgtctacaagcgcaccgggccgatcatcagcatgacccccggccgtgatctctggtggcacgaggaggttgagaagtaccctgcttactacacccctgtggccatggcctcggaggatcctctcttccttctctacacttctggctccactggcaagcccaagggagttgcccactctaccggtggttacctgctgcgtgccatgaccggcaagtacgttttcgacatccatgacggcgacaggtatttctgcggtggtgacgtcggctggattaccggtccacactatgtcctctcagccccgctcttgctcggtgtctctaccgtcgttttcgagggtaccccgcctaccaattctccgtactgggacatcattgaggagcacaaggtcactcagttctcagttgctccaactgccctgcgcctgctgaagcgcgccggtgaccatcacgttcgcaacgagatgaagcacctccgtgttctcggctctgtcggtgagccatcggccgccgaggtctggaagtggtactatgatgttgtcggcaaggccgccgcccagatttgcgacacctactggcagaccgagactggctccaacgtcatcactcccctcgccggcgttacccccaccaagcccggttccgcttctttccccttcttcggtatcgagcccgcgcttgtcgaccccgttaccggcgaggagatccgcggcaacgacgttgagggtgtcttggccttcaagcagccctggcccagcatggctcgcaccgtctggggtgcccataagcgctacatggagacctacctccatgtgtacaagggctactacttcacgggcgacggtgctgcccgcgatcacgagggcttctactggatccgcggccgtgtcgaccgtgtcaacgttagtggccaccgtctcagcactgccgagattgaggctgctctgattgagcatcactcaattgccgaggctgctgttgttggtgttgccgacgagctcactggccaggccgtcaacgccttcgttgccgtcaaggagggtacccagatcaacgatgctctccgcaaggagtctccgtccctccaggtccgccgcagcatcgggcccttcgctgctcccaaggccatctacatcgttcctgatcttcccaagactctctctggcaagatcatgcgccgcattctgaggaagattgttgccggcgaggaagatcagcttggtgatatcactactctcagcgatcccagcgtcgttgccaagatcatcgatgtcgtccacgcgcaccagtaa

SEQ ID NO: 774 - protein, 626 aa, Neurospora crassa [sequence omitted]

SEQ ID NO: 775 - DNA, 1971 bp, Rhodobacter capsulatus
  CDS (1)..(1971)
atgggagttcaaggacaaccctcggtcgcaccggcgcttcgggaggttccggcggggtttgagactgcgcatgcgaatggcgcgaaatatctcgagatgtatcgggaatcgctcgagaatccggatgcgttctgggggcgcgagggcaagcggctcgactggatcacgccctataccaaggtgaagaataccgatttcaccttcggcaaggtctcgatcaaatggttcgaggatggggtgctgaacgcgtccgtgaactgcatcgaccggcatctgcgcgaccgcgcgctgcaaaccgcgatcatcttcgagcccgatgacccgaaggaaccggcccgccacatcacctacaaggagctctccgaaaaggtgaaccggatggcgaatgtgctgctgtcccagggcatcatgcgcggcgaccgggtggtgatctatctgccgatgatcccggaggcggcctatgcgatgctggcctgcgcccggatcggcgcgatccattccattgttttcgcgggcttttcgcccgatgcgctggcgaaccggatcaatgattgcggcgccaaactggtgatcaccgccgacaccgcgccgcgcggcgggcggcgcacgccgctgaaagcgaacaccgatgcggcgctcttgcactgctcggacaaggtgcgctgcctggtggtcaagcacaccggcgatcagatcagctgggtgcatggccgcgatgtcgaccttttgtacctgatggagcacgtcagcccggaatgcccgccccgcccgatgaatgcggaagatccgctcttcatcctctacacctcgggctcgaccggcaaacccaaaggcgtcgtgcatacgaccggcggctacctcgtctatgccgcgatgacgcaccaatacacgtttgattacaaggacggcgacgtgttctggtgcaccgccgatgtgggctgggtgacggggcacagctacatcatctacgggcccttggcgaatggcgcgacgaccttgatgttcgagggcgtgccgaccttccccgatgcggggcggttctgggcggtgtgcgaaaagcacaaggtcaatcagttctacaccgcgccgacggcgatccgcgcgctgatgggtcagggcccggaatgggttgagaaatatgacctttcctcgcttcgggtgctggggtctgtgggcgagccgatcaaccccgaggcctgggtctggtacgacaaatatgtcggaaaagggaaatgtccgatcgtcgacaccttctggcagaccgagaccggcgggcacatgatcacgcccttgcccggcgcgacaccgacgaaaccgggctcggcgacgaacccgttctttggcgtcaagccggtggtgctggacccgcagaccgcggtgcggatcggcgaggtcgaatgcgagggggtgctctgcatttccgacagctggcccgggcagatgcggacggtctggggcgatcacgaccgcttccaggagacctatttcggccagtatcgcggctattacttcaccggcgacggctgtcggcgcgacaaggacggctattactggatcaccggccgggtcgatgacgtgatcaacgtctcggggcaccggatgggcacggccgaggtggaatcggcgctcgtcgcgcatccgcaggtggccgaggcggcggtggtgggctatccgcatgacatcaagggccagggcatctacgcctatgtgaccctgatgaacgggatcgagcccagcgaggatctgcgcaaggatctggtcaagtgggtgcgcaccgagatcggtccgatcgcctcgcccgatctgatccaatgggcgccgggcctgccgaagacgcgctcgggcaagatcatgcgccggatcctgcgcaagatcgccgagaacgactatggcgcgcttggcgacatctcgacgctggccgatccgggcgtggtgcaggagctgatcgacaaccggatgaaccgggcctga

SEQ ID NO: 776 - protein, 656 aa, Rhodobacter capsulatus [sequence omitted]

SEQ ID NO: 777 - DNA, 2043 bp, Caenorhabditis elegans
  CDS (1)..(2043)
atgtcggacgttcgcgtcaagttcaacctagccaacgatggagaaggtctcgacgaggatattttcctccctccagccccactccttgccggtgctcactgtgctggccttcaatcttaccacgatttgtaccgttcctcgatcaacgatgctgacgagttctggcgtaccgtctcatctgaactccatttcgaacaaggaacctctaagggtctcgaatggaatttcgactcgaaagctggaaatgtcttcgtcaagtttatggatggagccaagactaacatctcgtacaactgtttggaaagaaacattaaacgtggatatggaaacaaaatcgcctacattttcgaaggaaacgagccaaccgacacctccacctggacatacaacgagctacacgcccaagtagtccaattctccgctgttctgagatctcatggcgtcaaacgaggcgatgtggttgctttatatcttccaatgattcccgaattagcagttgcaatgcttgcgtgtgcccgtatcggagcaatgcattctgttgttttcgctggtttctctgccgaatcacttgccgctcgtgttgtcgacgctcgctgcagagttttggttacggcggacggagtttttcgaggagctaaaccaattgggctcaagtcaattgcggatgcagctgccgttctcgcatcgcaggaagatgtcaaagtggaagctatcattatggtggaacacttaaaacgagtcacgaagcctgatggagtggaacttcccaaggtcgattacaccgatatcaccgtcatctacgattcggagatgctcaagtgtgcaggcgtggattccccggtagaatggatggattctgaagatccgctatttattctctacacatctggctcaaccggaaaaccgaaaggtattcaacacactacagctggatacatgacgtacgcctacgcaaccacaaaatacacttttgatgcacaagaagacgatgtttactggtgtactgccgattgtggatggatcaccggacactcgtaccttctttatggacctttgatgaatgggctcaagggaatttggtatgaaggtgtgccgacttatccgactccttctagaatgtgggatgtcactgataagtatggtgtgaccaagctgtatacctcaccaacagccgcaagagctcttatggctctcggaaatcagtggcttgaaagctcttctcgcaaaactctcaaggttatcggaacagttggagagcccatcaatcctgctgcatggatgtggttgtacaagcaagttggactttccaatgtatccattgtggatacttactggcaaactgaaactggaggacacatgatcacatgccttccaggagcaactccaatgaagccaggagcagctgcaatgccattcttcggagcatctccagttcttttggatgctgaaggtcgtgttattgaaggtccgggagaaggatcactatgctttgatcgtgcctggcctggaatgatgcgtggaatctatggagatgagcaacgctttgtcaagacctatttggctccattcaatggatactatttcactggagatggtgccagacgtgatgaagatggatacttgtggataactggacgtgttgatgatttgatgaatgtcagtggtcatcttctgtctactgctgaaattgaatcagctcttgtggctcatgagaaagttgctgaagctgccgttgttgctgctccacatgacatcaagggatccttcccatacgcattcgtcactttgaatgttggagagagaatcaatgaaaagcttgtggctgagctcaagaaactagttcgcgagaaaattggtgcattggctgttccagatgttatccaagaagctccaggacttccaaaaactcgttccggcaaggttaccagaagaatcttgagaaagattgctgaaggatccgaaagtggaatcggtgatactactactctagtcgacgaatctgtcatcaaacaactaatctctggacgttctgcacgtgcataa

SEQ ID NO: 778 - protein, 680 aa, Caenorhabditis elegans
MSDVRVKFNLANDGEGLDEDIFLPPAPLLAGAHCAGLQSYHDLYRSSINDADEFWRTVSSELHFEQGTSKGLEWNFDSKAGNVFVKFMDGAKTNISYNCLERNIKRGYGNKIAYIFEGNEPTDTSTWTYNELHAQVVQFSAVLRSHGVKRGDVVALYLPMIPELAVAMLACARIGAMHSVVFAGFSAESLAARVVDARCRVLVTADGVFRGAKPIGLKSIADAAAVLASQEDVKVEAIIMVEHLKRVTKPDGVELPKVDYTDITVIYDSEMLKCAGVDSPVEWMDSEDPLFILYTSGSTGKPKGIQHTTAGYMTYAYATTKYTFDAQEDDVYWCTADCGWITGHSYLLYGPLMNGLKGIWYEGVPTYPTPSRMWDVTDKYGVTKLYTSPTAARALMALGNQWLESSSRKTLKVIGTVGEPINPAAWMWLYKQVGLSNVSIVDTYWQTETGGHMITCLPGATPMKPGAAAMPFFGASPVLLDAEGRVIEGPGEGSLCFDRAWPGMMRGIYGDEQRFVKTYLAPFNGYYFTGDGARRDEDGYLWITGRVDDLMNVSGHLLSTAEIESALVAHEKVAEAAVVAAPHDIKGSFPYAFVTLNVGERINEKLVAELKKLVREKIGALAVPDVIQEAPGLPKTRSGKVTRRILRKIAEGSESGIGDTTTLVDESVIKQLISGRSARA

SEQ ID NO: 779 - DNA, 1956 bp, Streptomyces coelicolor
  CDS (1)..(1956)
atgagcaacgaatccttggccaacctgctcaaggaagaacgcaggttcgcaccccccgccgacctggccgcgaacgccaacgtcacggcggaggcgtacgaacaggccaaggctgacaggctcggcttctgggccgagcaggcccgccggctgacctgggcgaaggagccgaccgagacgctcgactggtcgaacccgccgttcgccaagtggttcaaggacggcacgctgaacgtcgcctacaactgcgtggaccgccacgtggaggccggcaacggcgaccgcgtcgccatccacttcgagggcgagtccggcgacagccgcgccctcacctacgcccagctcaaggacgaggtctccaaggccgccaacgccctgctggagctgggcgtgcagaagggcgaccgggtcgccatctacatgccgatgatccccgagaccgcgatcgcgatgctggcctgcgcccgcatcggcgccgcgcactcggtggtcttcggcggcttctcctcggacgcgctggccacccgcatccaggacgccgacgcccgcgtcgtcatcaccgccgacggcggctaccggcgcggcaagccgtccgcgctcaagccggccgtcgacgaggccgtcgagcgcgcggggatcgtcgagcacgtgctcgtcgtccgccgcaccggccaggacgtcgcctgggacgactcccgggacaagtggtggcacgagaccgtcgacgggcagtccgccgagcacacgcccgaggcgttcgacgccgagcacccgctgttcatcctgtacacgtccggcacgacggggaagcccaagggcatcctgcacacctccggcggctacctcacacagacggcgtacacccactgggcggtcttcgacctcaagccggagaccgacgtcttctggtgcaccgccgacgtcggctgggtcaccggacactcgtacatcgtctacggcccgctcgccaacggcgccacccaggtcatgtacgagggcaccccggacaccccgcaccagggccgcttctgggagatcgtgcagaagtacggcgtgacgatcctctacacggcgcccaccgcgatccggacgttcatgaagtggggcgacgacatccccgcgaagttcgacctgtcctccctgcgcgtcctcggctcggtcggcgagccgatcaaccccgaggcgtggatctggtaccgcaagaacatcggcgcggacgccaccccggtggtcgacacctggtggcagaccgagaccggcgcgatgatgatcaccccgctgccgggcgtcacccacgccaagccgggctccgcccagcgcccgctgcccggcatctccgccaccgtcgtcgacgacgaggccaacgaggtgccgaacggtggaggcggctacctggtgctcaccgagccgtggccgtcgatgctgcgcaccatctggggcgacgaccagcggttcatcgacacctactggtcgcgcttcgagggcaagtacttcgcgggcgacggcgccaagaaggacgacgacggcgacatctggctgctcggccgcgtcgacgacgtgatgctcgtctccggccacaacatctccaccaccgaggtggagtcggccctcgtctcccacccctcggtcgccgaggcggccgtggtcggcgcgacggacgagacgaccgggcaggccatcgtggccttcgtgatcctgcgcggcaccaccgcggagagcgaggacctggtcgccgagctgcgcaaccacgtcggtgccacgctcggcccgatcgccaagcccaagcggatcctgccggtctcggagctgccgaagacccgctccggcaagatcatgcggcgcctgctgcgagacgtcgcggagaaccggcaggtcggcgacgtcacgacgctggcggactcgacggtcatggacctcatccagacgaagctcccggccgcccccagcgaggactga

SEQ ID NO: 780 - protein, 651 aa, Streptomyces coelicolor
MSNESLANLLKEERRFAPPADLAANANVTAEAYEQAKADRLGFWAEQARRLTWAKEPTETLDWSNPPFAKWFKDGTLNVAYNCVDRHVEAGNGDRVAIHFEGESGDSRALTYAQLKDEVSKAANALLELGVQKGDRVAIYMPMIPETAIAMLACARIGAAHSVVFGGFSSDALATRIQDADARVVITADGGYRRGKPSALKPAVDEAVERAGIVEHVLVVRRTGQDVAWDDSRDKWWHETVDGQSAEHTPEAFDAEHPLFILYTSGTTGKPKGILHTSGGYLTQTAYTHWAVFDLKPETDVFWCTADVGWVTGHSYIVYGPLANGATQVMYEGTPDTPHQGRFWEIVQKYGVTILYTAPTAIRTFMKWGDDIPAKFDLSSLRVLGSVGEPINPEAWIWYRKNIGADATPVVDTWWQTETGAMMITPLPGVTHAKPGSAQRPLPGISATVVDDEANEVPNGGGGYLVLTEPWPSMLRTIWGDDQRFIDTYWSRFEGKYFAGDGAKKDDDGDIWLLGRVDDVMLVSGHNISTTEVESALVSHPSVAEAAVVGATDETTGQAIVAFVILRGTTAESEDLVAELRNHVGATLGPIAKPKRILPVSELPKTRSGKIMRRLLRDVAENRQVGDVTTLADSTVMDLIQTKLPAAPSED

SEQ ID NO: 781 - DNA, 1989 bp, Schizosaccharomyces pombe
  CDS (1)..(1989)
atgacgaaaaatcctgtcgatcacacactcattatagaacctccggttcgtcttcatggcgatcccaccgtccctaaacctaacattgctagtttggatgagtataaacgtatgtatgaagagtcaattaatgacccatccactttttggggtaacatggctcgcgacatgatgacttgggacaaacaattcagcactgtcgtccaaggttccatcgacaaggcagatagtgcttggttcgctgatggtgccatttccccttgttataatttagtcgatcgtcatgccattgctcgcccagacgccgttgccttgatttatgaagctgatgagcccaatcagggtcgctatatcacctatcgcgagcttttggcttccgtttctcaatgtgccggtgctctccagtccatgggcgttggtatgggagatcgtgttgccatctatatgcctatgattcctgaaacaatcattgccatgttggccattgttcgtttgggtgccattcattctgttatttttgctggtttttctgcagagtctgttgcagaccgtgtcaatgattctgagtgtaaagttatcattaccgctgatgaaagtcatcgtggtggtaaacgaatccctttaaagggtgtcgttaacaaagcccttaccgaatgtcctaccatcaagaaggtactcgtcttccaacgctctgctgagcctaccgccagtatggttgaaggtcgtgatgtctggtggcacgatattattccaaagttcccccggtattgccctcctgcagtcgttaatccagagcatcccttgttccttctctacacttctggaagtacaggaaaacccaagggtgtcgtacattgcactggtggttaccttcttggcgctgctgctacttgcaaatacgttttcgatttgcatcccacggatcgtatgggttgtgctggtgatgtcggttggattactggtcatacctatattgtatacggccccttaatgcttggtgctgctactcttgtttttgaaagcacaccagcttaccctgattactctcgttactggagtgtcgttgagcgtcacagactgactcaatggtatattgcaccaactgccattcgtcttcttcaacgtgccggtaatgaatttgtcaagcacgatcgctcttctcttcgtgtcttgggtagtgttggtgaacccatcgctccagagtcatttatgtggtactacgaagtagttggtgagaaaagatgtgctgttgccgatacttattggcagactgaaacaggttctcacattgttacttctttgggacctgtgacacccatgaagcctggttctgctacgttaccctttttcggtatcgatgcagtcatcattgatcccttgactggcaagatcattgaaggcaacgatgttgaaggtgttcttgctatccgcagtccctggcccagcgctgctagaactgtttggcgcggtcacgatcgttacatcgacacctacttgaagccatatcctgggttctacttcaccggtgatggtgctacccgcgataaagatggttacatttggattcgtggacgtgttgatgatgttgtcaacatttccggccatcgtctgagtacagctgaaatcgaggctgctttgttgtctcatgacgctgtcgcagaatccgctgttgttggtgttcatgatgagctaaccggtcaagccgtcaatgcctttattttattgaaacctggctatgaagctacagtcgaacttgaaaaggagttgatcatggcggttcgatcgacaattggcccctttgcatctccacgcaagttaattttcagtgatcttccaaaaactagaagtggtaaaattatgcgccgcattctccgtaagattttggctggtgaagtcgaccagattggagacttgagtaccttggctgaccctaaggttgttgagcacatcatccatgctgttcattatgcccatcagaagaagccctag

SEQ ID NO: 782 - protein, 662 aa, Schizosaccharomyces pombe [sequence omitted]

SEQ ID NO: 783 - DNA, 2013 bp, Pyrobaculum aerophilum
  CDS (1)..(2013)
atgtccttagaattaaaagaaaaggaaagcgaactgccctttgatgaacaaattataaacgataagtggaggagtaaatatacgcctatagacgcctactttaaattccacaggcagacagtcgagaacttagagagtttctgggaaagcgtagccaaggagttggagtggtttaagccgtgggacaaggtgttagacgcctctaatccgccgttttacaagtggtttgtaggagggaggcttaatctgtcatacctggcagtagacagacatgtaaagacgtggaggaagaacaaactcgccattgagtgggagggagagcccgtagatgaaaacggctaccccacagacaggaggaaactgacgtattacgacctataccgcgaggtaaaccgcgttgcatatatgttaaaacagaacttcggcgttaagaagggcgataaaataacgctgtatctacccatggtgcccgagctcccaataaccatgttagccgcgtggagaattggcgcaattaccagcgttgttttctccgggttctcggccgacgcgctggcagagcgtataaacgactcccagtcgcgtattgtcataaccgcagacggcttctggcgcagggggagggtggtcagacttaaagaagtggtagacgccgcgttggagaaggccacaggagttgagagtgtaatcgtcttgcctagactcggcttaaaagacgtcccaatgaccgaggggcgcgactactggtggaataagttaatgcaggggattccgcctaatgcctacatcgagcccgagcctgtggagagcgagcacccctcctttattctatacacctcgggcactacggggaagcccaagggcattgtgcacgacacaggcggctgggccgtgcacgtatatgctacaatgaagtgggtttttgacataagagacgacgacatattctggtgcactgcggatataggctgggtcaccggccactcctacgttgtgctagggcctttgttaatgggagccactgaggtgatctacgagggcgcccccgactacccgcagccagataggtggtggtctataattgagcgctacggcgtcactatattctacacgtcgcctaccgccatacgcatgttcatgcgctacggcgaggagtggccaagaaagcacgacctctccactttgcgcataatccactcagtgggcgagccgataaaccccgaggcctggaggtgggcatacagagtcctcggcaatgagaaagtcgcctttggctccacttggtggatgacggagactggaggcattgtgataagccatgccccaggcctctacttagtgcccatgaagcccggcactaacggcccgccgctgcctgggtttgaagttgacgtggtggacgaaaacggcaacccggccccgccaggcgtaaagggctatcttgtcattaaaaagccgtggcccggcatgctccacggcatttggggcgatcccgagcgttatataaagacctactggtccagattccccggcatgttctacgccggcgactacgctattaaggataaggacgggtacatatgggtgttgggacgcgccgacgaggtgatcaaggtggctgggcacaggctgggcacatacgagctggagtcagccctaatttcacacccagctgtcgccgagtcggcggtggtaggcgtgcccgacgccatcaaaggagaggttcccatagccttcgtggtgctgaaacaaggcgtggcgccaagcgacgagttgcgcaaagagttgagggagcatgtaaggagaactataggccccatagcagagccagcccagatatttttcgttacaaagttgcccaagacacgctccggcaagataatgcgccgcctgctgaaggccgtggccacgggggcgccgctgggagatgtaacgacgctagaggacgagacctccgtggaggaagctaagagggcatacgaggagataaaggctgagatggcgagaacatga

SEQ ID NO: 784 - protein, 670 aa, Pyrobaculum aerophilum [sequence omitted]

SEQ ID NO: 785 - DNA, 2010 bp, Penicillium chrysogenum
  CDS (1)..(2010)
atgtcggacggcccaattcagcctcccaagcccgcagtggtgcatgaggcacacgaggtcgacactttccacgtccccaaggcgttccacgataagcacccctccggcactcacatcaaggacattgaggagtacaagaagctttacgaagaatcaatcaagagccccgacaccttctgggcacgcatggcccgcgagctcctcacatttgacaaggactttgaaaccacacatcacggctcgtttgagaacggcgacaatgcctggttcgtcgagggtcggttgaacgcatcgttcaactgtgtcgatcgccatgccctcaagaacccagataaggtcgccattatttatgaggccgacgagcccaacgagggccgtaagatcacctacggagagctgatgcgcgaggtgtcccgggttgcctggactctgaaggagcgtggcgtcaagaagggcgacacggtcggtatctacctgcccatgattcccgaggccgtaatcgctttcctggcttgctcgcgtattggtgccgtgcactccgttgtcttcgctggtttctcttccgactccctccgggaccgtgtcctggacgcctcctccaaggtcatcattacctccgacgagggcaagcgcggtggcaagatcattggcactaagaagattgtggacgaggccatgaagcagtgccccgatgtcgacaccgtgctggtgtacaagcgcaccggtgccgaggtgccctggaccgctggccgtgacatttggtggcacgaggaggtcgagaagtaccccaactacctcgcccctgagtcggtcagctccgaggatcctctcttcctgttgtacacctccggttccaccggtaagcccaagggtgttatgcacaccactgccggttacctgctcggtgcggccatgactggaaagtacgtgtttgatatccacgacgatgatcgctacttctgcggtggtgatgtcggttggattacaggtcacacctatgtcgtgtacgcccctctattgcttggctgcgccaccgtcgtgttcgagagtacccccgcctaccctaacttctcgcgctactgggatgtcattgacaagcacgacgtcacacaattctacgttgcacccaccgctctgcgtctgctgaagcgcgctggagatgagcacattcaccacaagatgcacagtctgcgtattcttggctccgtcggagagcccattgccgcggaagtctggaagtggtacttcgagtgtgttggcaaggaggaagctcacatctgcgacacatactggcaaaccgagaccggctcacatgtcatcacccctctcggcggtatcacccccaccaagcccggcagtgcctccctacccttcttcggtatcgagcctgccattatcgaccccgtctccggagaggagattgtcggcaatgatgtcgagggtgttttggccttcaagcagccgtggcccagcatggcccgcaccgtgtggggtgcccacaagcgttacatggacacttacttgaacgtgtacaagggttactacttcaccggagatggtgctggccgtgaccacgacggctattactggatccgcggtcgtgttgacgatgtcgtcaacgtttctggacaccgtctgtccaccgctgagatcgaggccgctcttctcgagcacgcttccgttgccgaggctgctgtcgttggtattgccgacgagctgaccggtcaggctgtcaatgcctttgtctctctcaaggagggcaagcccacagaacagatcagcaaggaccttgcaatgcaagttcgcaagtccattggtcccttcgccgcccccaaggctgtcttcgtcgtggatgacctccccaagacccgcagtggcaagatcatgcgccgaatcctccggaagattctcagtggcgaggaggacagcctcggtgatacatcaacgctctccgaccccagtgtcgtggacaagatcatagaaaccgtccacagtgctcgccagaagtaa

SEQ ID NO: 786 - protein, 669 aa, Penicillium chrysogenum
MSDGPIQPPKPAVVHEAHEVDTFHVPKAFHDKHPSGTHIKDIEEYKKLYEESIKSPDTFWARMARELLTFDKDFETTHHGSFENGDNAWFVEGRLNASFNCVDRHALKNPDKVAIIYEADEPNEGRKITYGELMREVSRVAWTLKERGVKKGDTVGIYLPMIPEAVIAFLACSRIGAVHSVVFAGFSSDSLRDRVLDASSKVIITSDEGKRGGKIIGTKKIVDEAMKQCPDVDTVLVYKRTGAEVPWTAGRDIWWHEEVEKYPNYLAPESVSSEDPLFLLYTSGSTGKPKGVMHTTAGYLLGAAMTGKYVFDIHDDDRYFCGGDVGWITGHTYVVYAPLLLGCATVVFESTPAYPNFSRYWDVIDKHDVTQFYVAPTALRLLKRAGDEHIHHKMHSLRILGSVGEPIAAEVWKWYFECVGKEEAHICDTYWQTETGSHVITPLGGITPTKPGSASLPFFGIEPAIIDPVSGEEIVGNDVEGVLAFKQPWPSMARTVWGAHKRYMDTYLNVYKGYYFTGDGAGRDHDGYYWIRGRVDDVVNVSGHRLSTAEIEAALLEHASVAEAAVVGIADELTGQAVNAFVSLKEGKPTEQISKDLAMQVRKSIGPFAAPKAVFVVDDLPKTRSGKIMRRILRKILSGEEDSLGDTSTLSDPSVVDKIIETVHSARQK

SEQ ID NO: 787 - DNA, 2323 bp, Homo sapiens
  CDS (92)..(2152)
gcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctggggcaaagctgccgagcagatcagctggtacaagccctggaccaaaacgctggagaacaaacactcgccctctaccaggtggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtagaaattacttgcaaaatgaaatgtgaattgtaaaacttggcctaaacaaatctaatgaaaacaaaaaaaaaaaaaaaaaa

SEQ ID NO: 788 - protein, 686 aa, Homo sapiens
MKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRWFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDINATEEQVLEEIVKHVRQNIGPVAAFRNAVFVKQLPKTRSGKIPRSALSAIVNGKPYKITSTIEDPSIFGHVEEMLKQA

SEQ ID NO: 789 - DNA, 1950 bp, Pseudomonas putida
  CDS (1)..(1950)
atgagctattcgagtggattgatccgtccggacggagcaaagaaggaggatcgctatcttaatctctatcgtcattccgtggacgatcctgagagtttctgggccgaacaagcgcagcgcatccattggcacgttcagccgcagagaatccttgaggcgtcgaacccacccttccgacaatggtttgttggtggtcagaccaacctctgcttcaacgccctcgatcgccacttgccagagcgtgccgaacagttggcgttggtagctgtttcctcggaaacaggagttacccaggagatcacctatgcgcagctgtatcgggaagttaataccttcgccgcagtactcaagcgactcaacgtagaaaagggtgaccgagtcgtcatctacatgccgaacatggctgaggcagttttcgccatgcttgcttgtgcgaggatcggggcgatccactccgtagtctttggcggcttcgctgcgcgtaacttatcggcgcgcatcgacgactcgcagcctaagttgctgattactgccgatgcagggatgcgcggtggccgggtcattccgtacaaaccactggtggaccaagcctgtgcggagtcggagtcaccgccacccaaggtgctgatagtgtctcgtggtttgcagccagagctgacctgggtaccggggcgtgacgaagactacgcgactttgcgcgccgctgttggtgatgcgcaggtgtcagtggagtggctggagtcgaacgatcccagctacctgctttacacatcgggcactaccggaaaacccaagggggtacaacgcgatgtcggtggctatgcggttgccctggcgctgtcaatggagacggtttttgacgttgctcctgggcaggtgatgttctcgacctcggatgtcggttgggcggtcgggcattcttacaatgtctatgggccgctaatcgtcggtgcgacttcgttgttgtatgagggcttgcctacccatccggatgccggcatctggtggtcgctatgtgaaaggtatgccgtgcgtaccatgttttcctcaccgacggccgtccgtgtgttgaagaggttcaataccgacgccattgctcggcacgacttgaatgccttgcgctacctcttcctggccggggaacccctggacgagccgacagctaactggatcagtcgggcactcggcaagccagtcatcgacaactactggcagaccgagactggctggccggcgattacccttcatcctggcttggaaatgaaacctgtgaagttaggctcggccggcctgccgaatttgggctacaggatcaaggtgattgatgagctcagcggggcgcctgtcgcggcgcatcaaaaaggcatgcttgtcgttgagccgccgttaccaccgggcttcatgacgacgatctggcgtgatgatgatcgcttctgtagtagctactttgggcacttcaaggagcaggtctacagctcgcttgattgggcggtccaggatgaggacggttacacctacattcttgggcgtaccgatgatgtcatcaacgttgctgggcatcgtctggggactcgcgaaatcgaggagtccgctgcggaagcttcccgcgttgccgaggcggcagttatcggtgtccccgacgagatcaaggggcaggtaccagttgcctttgtcacgctccgtaagactgcttccgatgaactccagcgccgagaggctgcggcagagatacgccaggcggtagagagccgtctgggggcggtggcgcgacctgctcgggtgtatatcgtcaatctcctgccgaaaacgcgttcaggcaaattacttcgtcggtcattgcaagccctggcgctgcaggcggatccaggggacttgtccacccttgacgaccctagtgcactcgatgagattcgccatgccctgagacgtggaccggacgcggggaactga

SEQ ID NO: 790 - protein, 649 aa, Pseudomonas putida
MSYSSGLIRPDGAKKEDRYLNLYRHSVDDPESFWAEQAQRIHWHVQPQRILEASNPPFRQWFVGGQTNLCFNALDRHLPERAEQLALVAVSSETGVTQEITYAQLYREVNTFAAVLKRLNVEKGDRVVIYMPNMAEAVFAMLACARIGAIHSVVFGGFAARNLSARIDDSQPKLLITADAGMRGGRVIPYKPLVDQACAESESPPPKVLIVSRGLQPELTWVPGRDEDYATLRAAVGDAQVSVEWLESNDPSYLLYTSGTTGKPKGVQRDVGGYAVALALSMETVFDVAPGQVMFSTSDVGWAVGHSYNVYGPLIVGATSLLYEGLPTHPDAGIWWSLCERYAVRTMFSSPTAVRVLKRFNTDAIARHDLNALRYLFLAGEPLDEPTANWISRALGKPVIDNYWQTETGWPAITLHPGLEMKPVKLGSAGLPNLGYRIKVIDELSGAPVAAHQKGMLVVEPPLPPGFMTTIWRDDDRFCSSYFGHFKEQVYSSLDWAVQDEDGYTYILGRTDDVINVAGHRLGTREIEESAAEASRVAEAAVIGVPDEIKGQVPVAFVTLRKTASDELQRREAAAEIRQAVESRLGAVARPARVYIVNLLPKTRSGKLLRRSLQALALQADPGDLSTLDDPSALDEIRHALRRGPDAGN

SEQ ID NO: 791 - DNA, 2444 bp, Lysobacter
  CDS (337)..(2232)
cccgggcgaccgcatccgcgtgcgcgtggacgtgcgtcggactgacgcggcgaccgccgggccgaacgcagcgcccggccgaggcatcttcgcaaggcgcaaggaatcggcgcgggcgcgcaggaacggggcgccgcccgcccggtgggacgccggggccgcaaggctccggcgtctttcgttggtgcgggctcgtgttcgcgcgagctttcttgtgcgagccgtcatcgtgcgggcccgtccacggcgcgcgccgcgcctagaccaaggtcgtaacgccccgcgtgcgccgcatggtctagcctgcgcgcggatgtcccttcgaggccgcgccccatgcgttacgaggagttccaccgccgttcgatcgaacagcccgaggcgttctgggccgagcaggcccgggcgatccactggcgcacgccgccgcagcgcatcctcgactactccaacccgccgttccggcaatggttcgccggcggcgaaaccaatctttgctacaacgcgctcgaccgccacctcgacgagcgcggcgaccagctcgcgctggtgacgatctccagcgaaaccgggcagacccgcgagctgagctatcgccaggtgcaccgcgaggtcaacgtcttcgccagcgcgattcgcgcgctcggcgtgggccgcggcgaccgcgtggtgatctacatgccgaacatggccgaggcggtgttcgcgatgttggcctgcgcgcgcatcggcgcggtgcattcggtggtgttcggcggattcgccgcgcacaacctggccctgcgcatcgacgacgccacgcccaagctgctgatctgtgccgatgccggcatgcgcggcggcaaggtcattccctacaagccgttggtggacgcggcctgcgcagaggcgcaatcgccgccgccgcacgtgctggtggtcagccgcggactcgacccggacctgcgcctgatccccggtcgcgatgtcgactacgcggccttgcgcacgcagcacgaagacgcgcaggtcgaggtggaatggctcgaatccaacgagcccagctatctgctctacacctccggcaccaccggcaagcccaagggcgtgcagcgcgacgtcggcggctacgcggtcggcctggcgctgtcgatgtgggcgatctacgacatccgcgccggacaggtgatgttctccacttccgacgtgggctgggcggtcggccattcctacaacgtctacggcccgctgatcgccggcgcgacctcggtgttgtacgaaggcctgccgaccaatcccgacccgggcgtgtggtggagcatctgcgagcgctacggcgtgcgcaccatgttctcctcgccgaccggcatccgcgtgctcaagaaacaggacgcggcctggttgaagaagcacgacctgtccgcgctgcattggctgttcctggccggcgagccgctcgacgagccgaccgcgcactggatcaccgacggcatcggcaagaccgtcatcgacaactactggcagaccgaaaccggctggccggtgctggcgctgatgccggggctggacctcaagccggtcaagttcggctcgccgggcctgccgatgccgggctaccacctgcgggtgatcgacgaggccaccggccgcgatgtcggcccgaacgagaagggcgtgctgacgatcgtgccgccgctgccgccgggctgcctgagcacggtgtggaacgacgatgcgcgcttcctcaccagctatttcggccacttcaaggagctgttgtacagctcgctggattgggcgatccgcgacgaggacggctacaccttcattctcggccgcaccgacgatgtcatcaacgtcgccggccaccgcctgggcacgcgcgagatcgaggaatcggtggccagccacgccagcgtcgccgaggcggcggtgatcggcgtgcacgacgagctcaagggccaggtgccggtggtgttcgccacgctcaaggccggcgatgcgcacgacccgcacgcggtcgcgacgggcatgcaggactgcgtggtgcgccagctcggcgcggtggcgcggccggcgcgggtgtacgtggtcgccgcgctgcccaagacccgctcgggcaagctgctgcggcgctcgatccaggccctggccgaaagccgcgaccccggcgatctgtccacgctcgacgatcccggcgcgctggaggaagtgcggcgcgcgctcgaacgcggcgccgatgcgggcggctgaccggcgccggcgcagcgtgaacgcgagcgaaacgttcgcccgcgcaacaccggtgttgacgccatttttctgcgacagcgttagcatcgcggcaacgggcgggctgcggcccgccctcgatccagcgaggcacgcgcgcaatgcagtacaccagtccttccggcaccgacgccgaactcggcccggcgcaccacggcgatgcgcaccgcggc

SEQ ID NO: 792 - protein, 631 aa, Lysobacter
MRYEEFHRRSIEQPEAFWAEQARAIHWRTPPQRILDYSNPPFRQWFAGGETNLCYNALDRHLDERGDQLALVTISSETGQTRELSYRQVHREVNVFASAIRALGVGRGDRVVIYMPNMAEAVFAMLACARIGAVHSVVFGGFAAHNLALRIDDATPKLLICADAGMRGGKVIPYKPLVDAACAEAQSPPPHVLVVSRGLDPDLRLIPGRDVDYAALRTQHEDAQVEVEWLESNEPSYLLYTSGTTGKPKGVQRDVGGYAVGLALSMWAIYDIRAGQVMFSTSDVGWAVGHSYNVYGPLIAGATSVLYEGLPTNPDPGVWWSICERYGVRTMFSSPTGIRVLKKQDAAWLKKHDLSALHWLFLAGEPLDEPTAHWITDGIGKTVIDNYWQTETGWPVLALMPGLDLKPVKFGSPGLPMPGYHLRVIDEATGRDVGPNEKGVLTIVPPLPPGCLSTVWNDDARFLTSYFGHFKELLYSSLDWAIRDEDGYTFILGRTDDVINVAGHRLGTREIEESVASHASVAEAAVIGVHDELKGQVPVVFATLKAGDAHDPHAVATGMQDCVVRQLGAVARPARVYVVAALPKTRSGKLLRRSIQALAESRDPGDLSTLDDPGALEEVRRALERGADAGG

SEQ ID NO: 793 - DNA, 2016 bp, Debaryomyces hansenii
  CDS (1)..(2016)
atgacaccacactctacacacgtaacgttggaccatgagggtattatccaacccccagcggaatttaaggaaagatcgaagtccaaacccaacttggcagactttgagacctatagcaagatgtacaaggaatcgattgagaaccccagcaaattttttggcgaacaagcgttggaacacttgagttgggaccgtccttttgacgaagccagataccccgtgagtagcgagcaggactttgcagacggggacattgcgtcgtggtttgtgaacgggcaattgaacgcttcgtataacgcagttgacagatgggccatcaagaatcctaacaagccggcgataatctacgaggcagacgaggaaaacgaaggtcgtattatcacgtacggccagttgttgaaggacgtgtgtaagttggcacaatgcttgacgaaattgggcatcagaaagggagattctgtggcagtatacttgccaatgatccctgaggcgttagtgactttgttagcgattgtgagaattggggccgtccattcggttgtattcgccgggttttcatctagctcgttgaaggaccgtatcttggacgccagctcgaagattgttatcaccactgatgagtcgaagagaggtggtaagaccattgagaccaagaagattgtggatgatgcgttgaagaactgtcctgacgtgacaaacgtcttgcttttcaagagaaccggcaacgcccatattccgttcaccgaaggcagggacttgtggtggcacgaggaaatggccaagtacggaccatacttcccaccggtaccagtcaactcggaagacccattatttttattgtacacctcgggttcgacaggtaagccgaagggtatccagcactcgaccgcggggtacttgttgggggctgccatgacgtccaagtacacgttcgacgtgcacgaagacgacgtgttatttaccgcaggagatgtgggttggattactggacacacatatgtggtatacggtccgttattatgtggggccaccaccgtggtgtttgaaggtaccccagcccaccctaactactcgagatactgggaaattgtcgacaagtatcaggtcacccagttctacgttgctcctactgctttgagattattaaagagagccggcaccaagtatatagaaaactataagttggattccttgagagttttaggttctgttggtgaaccaattgcagccgaaatctggcactggtataacgacaacattggtagacgcaagtgtcacattgttgatacctactggcaaacagaatcggggtcacacatgttagcgccattagccggtattactccaactaaaccaggctctgcctcgttaccatgttttggtattgatgcgaaaatcttggacccagttagtggtaaggaattgaaggaaaatgatgtcgagggggtcctttgtgtcaaatcgtgctggccatcaattagtagaggtatttacaacgactatgccagatttattgaaacttacttgaagccatacccaaatcattatttctcaggtgatggggctgcaagagacgttgacggattctactggattttaggtagagtcgacgatgttgttaatgtctccggtcacaggttgtctacggcggaaattgaagctgccttgatcttacatgaatctgttgctgaatgtgcagttgttgggtacgcagacgagttgacgggtcaagcagttgccgcttatgtttcattgaaatctaacgtatctgaagacctagaagtgatcaagaaagaattgatcctaactgttcgtaaggaaatcggtccttttgcaactccaaagacaattttgttggtagatgatttacctaagactagatcaggtaagatcatgagaagaattttgagaaaagttttggctggtgaagaagaccaattgggtgatatttcaacattatcgaatcctggtgttgttgctcaaatcattgatgtagtcaaggctactcgtaagtaa

SEQ ID NO: 794 - protein, 671 aa, Debaryomyces hansenii
MTPHSTHVTLDHEGIIQPPAEFKERSKSKPNLADFETYSKMYKESIENPSKFFGEQALEHLSWDRPFDEARYPVSSEQDFADGDIASWFVNGQLNASYNAVDRWAIKNPNKPAIIYEADEENEGRIITYGQLLKDVCKLAQCLTKLGIRKGDSVAVYLPMIPEALVTLLAIVRIGAVHSVVFAGFSSSSLKDRILDASSKIVITTDESKRGGKTIETKKIVDDALKNCPDVTNVLLFKRTGNAHIPFTEGRDLWWHEEMAKYGPYFPPVPVNSEDPLFLLYTSGSTGKPKGIQHSTAGYLLGAAMTSKYTFDVHEDDVLFTAGDVGWITGHTYVVYGPLLCGATTVVFEGTPAHPNYSRYWEIVDKYQVTQFYVAPTALRLLKRAGTKYIENYKLDSLRVLGSVGEPIAAEIWHWYNDNIGRRKCHIVDTYWQTESGSHMLAPLAGITPTKPGSASLPCFGIDAKILDPVSGKELKENDVEGVLCVKSCWPSISRGIYNDYARFIETYLKPYPNHYFSGDGAARDVDGFYWILGRVDDVVNVSGHRLSTAEIEAALILHESVAECAVVGYADELTGQAVAAYVSLKSNVSEDLEVIKKELILTVRKEIGPFATPKTILLVDDLPKTRSGKIMRRILRKVLAGEEDQLGDISTLSNPGVVAQIIDVVKATRK

SEQ ID NO: 795 - DNA, 2040 bp, Debaryomyces hansenii
  CDS (1)..(2040)
atgaccagttctccaacacatcaagttgtgcacgaagccaacaacatcaagaaacaagaaactccaaaagaatttttcgaaagacagccacgccaagggcacattacttcgttagaacaataccaagaattatacgagaagtcaattaacgacccagaaaccttttttggtgagtttggtaaggaattgttgcactgggacagagacttcgaaagagtcaagtctggatctttgttgcatggcgatgcagcatggtttattggaggtcaattgaacgcatgttacaactgtgttgatagacatgcattcgctactccaaacaagccagctattatctacgaagctgatgaagaaaaggactctaagatcttgactttcgccgaattgttgagagaagtctgccaagttgcaggtgtcttacaaagctggggtattaagaaaggcgacactgttgccatttatatgccaatgaactcgcaagcgatcattgctatgttggctgttgctagattgggtgctatccactctgttattttcgctggtttttcttctggttccattaaggacagagttaacgatgcatcttgtaaggctttgatcacctgtgacgaaggtcgtcgtggtggaaagaccattaacatcaagaaattgtgtgacgaggctttattgaactgtccatccattgaaaaggttcttgtttacgaaagaaccggtaataaggaagttaccttaaaggaaggccgtgattactggtggtctgaagaaacccaaaagtttgcaggctacttacctccagttccagttaactccgaagatccattattcttgttatacacctcaggttctactggtactccaaagggtgttgttcactctactgctggttacttattaggagctgccttaactactaaatacgtatttgatatccacccagaagatgtcttattcactgctggtgatgttggttggattactggacacacctacgcgttatatggtccattatctcttggtgtgccaactgtcgtttttgaaggtaccccagctttcccagattacggtagattatggcaaattgttgaaaaacataaggccactcacttctatgttgctccaaccgccttaagattattaagaaagtctggtgaacaagaaattgagaaatacgatttatcttctttaagaactttgggatctgttggtgaacctatttctccagatatctgggaatggtacaacgaaaaagttggtaagggccaatgccatgtcactgatacttattggcaaacggaatctggatcgcacttcattgctccaattgcaggtgtcgttccaaacaaacctggttctgctgctgtaccattctttggtatccaaacctgtcttattgatccagtcagtggtatcgaaattcaagggaacgacgtcgaaggtgttttagccgtcaaagatacctggccatccatggccagatcggtctacaagaaccataccaaatatatggacacctacttgaacccatacccaggatattacttcacgggtgatggtgccgcaagggatcatgatggatactactggatccgtggtagagttgatgacgttgttaatgtttctggtcacaggttatcgactgctgagatcgaagctgctttaattgaacataatgcaatttctgaagctgccgttgtcggtatgaatgacgacttaacgggtcaaactgttgttgcttttgttgcattgaaggaacaccttatcgctaaccttaaagccgacgaatccccagaagaagccttgaaattgaagaaagaaatgatcttacaagtcagaactcaaattggtccatttgctgctccaaagtctgttattattgtagaggatttaccaaagactagatctggtaagatcatgagaagaatcttaagaaagatcgcagccggtgaagctgatcaattaggtgatattaccactttatctaacccgcaatctgttgctggtattattggctcttttgatagccaatttggtaagaagtag

SEQ ID NO: 796 - protein, 679 aa, Debaryomyces hansenii
MTSSPTHQVVHEANNIKKQETPKEFFERQPRQGHITSLEQYQELYEKSINDPETFFGEFGKELLHWDRDFERVKSGSLLHGDAAWFIGGQLNACYNCVDRHAFATPNKPAIIYEADEEKDSKILTFAELLREVCQVAGVLQSWGIKKGDTVAIYMPMNSQAIIAMLAVARLGAIHSVIFAGFSSGSIKDRVNDASCKALITCDEGRRGGKTINIKKLCDEALLNCPSIEKVLVYERTGNKEVTLKEGRDYWWSEETQKFAGYLPPVPVNSEDPLFLLYTSGSTGTPKGVVHSTAGYLLGAALTTKYVFDIHPEDVLFTAGDVGWITGHTYALYGPLSLGVPTVVFEGTPAFPDYGRLWQIVEKHKATHFYVAPTALRLLRKSGEQEIEKYDLSSLRTLGSVGEPISPDIWEWYNEKVGKGQCHVTDTYWQTESGSHFIAPIAGVVPNKPGSAAVPFFGIQTCLIDPVSGIEIQGNDVEGVLAVKDTWPSMARSVYKNHTKYMDTYLNPYPGYYFTGDGAARDHDGYYWIRGRVDDVVNVSGHRLSTAEIEAALIEHNAISEAAVVGMNDDLTGQTVVAFVALKEHLIANLKADESPEEALKLKKEMILQVRTQIGPFAAPKSVIIVEDLPKTRSGKIMRRILRKIAAGEADQLGDITTLSNPQSVAGIIGSFDSQFGKK

SEQ ID NO: 797 - DNA, 1974 bp, Yarrowia lipolytica
  CDS (1)..(1974)
atgtctgaagaccacccagccatccacccaccctccgagttcaaggacaaccacccccacttcggaggcccccacctcgactgtctgcaggactaccaccagctgcacaaggagtccattgaggaccccaaggccttctggaagaagatggccaacgagctcatctcctggtcaaccccctttgaaactgtgcgatctggcggcttcgagcacggcgacgtggcctggttccccgagggccagctcaacgcctcctacaactgtgtggatcgacacgcctttgccaaccccgacaagcccgccatcatttttgaggccgatgagccgggccagggccgaatcgtcacctacggcgaactgctgcgacaggtgtctcaggtcgcagccaccctgcgatccttcggcgtccagaagggcgatactgtggccgtctacctgcccatgatccccgaggccattgtcactctgctggccatcacccgaattggcgctgtccactcggtcatcttcgccggcttctcctccggttctctgcgagaccgaatcaacgacgccaagtccaaggttgtcgtcaccaccgacgcctccatgcgaggaggcaagaccatcgacaccaagaagattgtcgatgaagccttgcgagactgcccctctgttacccacaccctggtcttccgacgagcaggtgtcgagaacctggcctggactgagggccgggacttctggtggcacgaggaggtcgtcaagcaccgaccctaccttgcccccgtccccgttgcctccgaggaccccatcttcctgctttacacctctggatccaccggcacccccaagggtctggcccacgctaccggtggctacctgcttggtgctgccctgaccgccaagtacgtgtttgacatccacggagacgacaagctgttcaccgctggagacgttggctggatcaccggccacacctacgtgctctacggtcctctgatgctcggagccaccactgttgtgttcgagggaacccctgcctacccctccttctcgcgatactgggacattgtcgacgaccacaagatcacccacttctacgtggctcccaccgccctgcgtctcctgaagcgggccggcacccatcacattaagcacgacctgtcgtctctgcgaaccctcggctctgtgggtgagcccattgcccccgacgtgtggcagtggtacaacgacaacattggccgaggcaaggcccacatctgtgacacctactggcagaccgagactggctcgcatatcattgcccccatggccggcgtgacccccaccaagcccggttctgcttccctgcctgtctttggaattgatcccgttatcattgatcccgtgtctggcgaggagctcaagggtaacaacgttgagggtgttcttgccctgcgatctccctggccctccatggcccgaaccgtgtggaacacccacgagcgatacatggagacctacctgcggccctaccccggctactacttcaccggtgatggtgctgcccgagacaatgacggcttttactggatccgaggccgagtcgacgacgttgtcaacgtttctggccaccgtctttccaccgccgagattgaggctgctctcattgagcacgctcaggtgtctgagtctgccgttgttggtgtccatgacgatctgactggccaggccgtcaacgcctttgtggctctcaagaaccccgtcgaggatgtggacgctctgcgaaaggagcttgttgtgcaggtgcgaaagaccattggaccctttgctgctcccaagaatgtcatcatcgtggacgatctgcccaagactcggtctggcaagatcatgcgacgaattctgcgaaaggtgcttgctggcgaggaggaccagctcggagacatttccactcttgctaaccccgacgttgtccagaccatcattgaggttgttcactcgttgaaaaagtaa

SEQ ID NO: 798 - protein, 657 aa, Yarrowia lipolytica
MSEDHPAIHPPSEFKDNHPHFGGPHLDCLQDYHQLHKESIEDPKAFWKKMANELISWSTPFETVRSGGFEHGDVAWFPEGQLNASYNCVDRHAFANPDKPAIIFEADEPGQGRIVTYGELLRQVSQVAATLRSFGVQKGDTVAVYLPMIPEAIVTLLAITRIGAVHSVIFAGFSSGSLRDRINDAKSKVVVTTDASMRGGKTIDTKKIVDEALRDCPSVTHTLVFRRAGVENLAWTEGRDFWWHEEVVKHRPYLAPVPVASEDPIFLLYTSGSTGTPKGLAHATGGYLLGAALTAKYVFDIHGDDKLFTAGDVGWITGHTYVLYGPLMLGATTVVFEGTPAYPSFSRYWDIVDDHKITHFYVAPTALRLLKRAGTHHIKHDLSSLRTLGSVGEPIAPDVWQWYNDNIGRGKAHICDTYWQTETGSHIIAPMAGVTPTKPGSASLPVFGIDPVIIDPVSGEELKGNNVEGVLALRSPWPSMARTVWNTHERYMETYLRPYPGYYFTGDGAARDNDGFYWIRGRVDDVVNVSGHRLSTAEIEAALIEHAQVSESAVVGVHDDLTGQAVNAFVALKNPVEDVDALRKELVVQVRKTIGPFAAPKNVIIVDDLPKTRSGKIMRRILRKVLAGEEDQLGDISTLANPDVVQTIIEVVHSLKK

SEQ ID NO: 799 - DNA, 2124 bp, Kluyveromyces lactis
  CDS (1)..(2124)
atgtctcctgctgttgataccgcttccaccgccaaagatccaatctcagtcatgaaatctaacgcttcagctgccgctgcagaccaaattaagacccatgaatacgaacatttaacttctgtgcctatagtgcagcctctaccaattactgataggttgagcagcgaagcagctcaaaaatataaacctaatttgccaggtgggttcgaagagtacaagtctttgcacaaggaatcacttgaaaatccagccaagttttaccatgaacgtgctcagctgttgaattggttcaaaccatacgatcaagttttcatcccagataccgaaggtaaaccaacttttgagaacaacgcttggtttaccaacggtcaattgaacgcttgttacaatttggtagacagacatgccttcactcaaccaaacaaggttgccattctttatgaagctgatgaaccaggtcaaggttatagtctcacttatgcggaattgttagaacaagtctgtaaagttgctcaaatcttgcaatactcgatgaacgtcaagaaaggtgacacggtcgcagtttatatgccaatgatcccacaggctttgattaccttgttggcaattactcgtatcggtgccattcattccgttgtttttgctgggttctcttcgaattcattgcgtgatcgtattaacgatgcttactcaaagacagtcatcaccaccgatgaatctaagagaggtggtaagaccatcgaaaccaagcgtatcgtcgatgaagccttgaaggatacccctcaagtaacaaacgttttggtcttcaaacgtactcataacgaaaatatcaagtacattccaggtagggatttggactgggatgaggaagtcaagaagtacaaatcttacaccccatgcgaacctgttgactctgaacatcctttgttcttattgtatacttcgggttccaccggtgctccaaagggtgttcaacattctacagcaggttacttgctccaagcattattaagtatgaaatacacctttgacatccaaaacgatgacatcttcttcaccgcaggtgacattggttggatcactggtcacacatactgtgtttacggtccattgttacaaggttgtactactttggtgttcgaaggtacacctgcctatccaaacttttctcgttattgggaaattgttgacaagtaccaagtgactcaattctatgtagccccaactgcactacgtctattgaagagagctggtgattcctttactgaaggattctctctcaagtcattgcgctccttgggttccgttggtgaacctatcgctgctgaagtttgggaatggtactctgaaaagattggtaagaatgagctaccaatcgtagacacatactggcaaactgaatctggctcccacttggtcactccattggctggtggtgctactccaatgaaaccaggtgcagcggcattcccattctttggtattgatttggcagtgttggatccaaccacaggtatcgagcaaactggtgaacatgcagaaggtgttcttgccattaaaagaccttggccatctttcgcaagaaccatttggaagaataacgataggttcttagacacgtacttgaaaccatacccgggctattacttcactggtgatggtgttgcccgtgataaagatggattcttctggatcttgggtcgtgttgatgatgttgttaacgtctcaggtcacaggttgtctactgctgaaattgaagctgctatcattgaagatgatatggttgccgaatgtgcagttgttgggtttaacgacgaattgactggtcaagccgttgctgcctttgtagtattgaagaacaagtctagtttaactgctgcaagcgagtccgagttacaagacatcaaaaagcatttgatcatcaccgttagaaaggatattggtccattcgctgctcctaagttgatcgtcctagttgatgatctaccaaagactagatctggcaagattatgagacgtattttgagaaagatcctagccggtgaatctgatcaattgggcgacgtctccacattatccaaccctggtatcgttaagcacttgatcgattccgtgaaattataa

SEQ ID NO: 800 - protein, 707 aa, Kluyveromyces lactis
MSPAVDTASTAKDPISVMKSNASAAAADQIKTHEYEHLTSVPIVQPLPITDRLSSEAAQKYKPNLPGGFEEYKSLHKESLENPAKFYHERAQLLNWFKPYDQVFIPDTEGKPTFENNAWFTNGQLNACYNLVDRHAFTQPNKVAILYEADEPGQGYSLTYAELLEQVCKVAQILQYSMNVKKGDTVAVYMPMIPQALITLLAITRIGAIHSVVFAGFSSNSLRDRINDAYSKTVITTDESKRGGKTIETKRIVDEALKDTPQVTNVLVFKRTHNENIKYIPGRDLDWDEEVKKYKSYTPCEPVDSEHPLFLLYTSGSTGAPKGVQHSTAGYLLQALLSMKYTFDIQNDDIFFTAGDIGWITGHTYCVYGPLLQGCTTLVFEGTPAYPNFSRYWEIVDKYQVTQFYVAPTALRLLKRAGDSFTEGFSLKSLRSLGSVGEPIAAEVWEWYSEKIGKNELPIVDTYWQTESGSHLVTPLAGGATPMKPGAAAFPFFGIDLAVLDPTTGIEQTGEHAEGVLAIKRPWPSFARTIWKNNDRFLDTYLKPYPGYYFTGDGVARDKDGFFWILGRVDDVVNVSGHRLSTAEIEAAIIEDDMVAECAVVGFNDELTGQAVAAFVVLKNKSSLTAASESELQDIKKHLIITVRKDIGPFAAPKLIVLVDDLPKTRSGKIMRRILRKILAGESDQLGDVSTLSNPGIVKHLIDSVKL

SEQ ID NO: 801 - DNA, 1962 bp, Pseudomonas putida
  CDS (1)..(1962)
atgagtgcggctccactgtatcccgttcgtcccgaggttgcggccactaccctgaccgacgaggccacctacaaggccatgtaccagaaatcggtgatcaacccggacggcttctggcgcgagcaggcccagcgtatcgactggatcaaaccgttcaccaaggtcaagcaaacctcctttgacgaccaccacgtcgatatcaaatggttcgccgacggcactctgaacgtttcctccaactgcctggaccgccacctcgaagagcgcggtgatcagttggccatcatctgggaaggcgacgacccttccgaacaccgcaacatcacttaccgtgaactgcacgagcaggtctgcaagttcgccaacgccctgcgtggccaggacgtgcaccgtggtgacgtggtcaccatctacatgccgatgatccccgaggccgtggtggccatgctggcctgtgcccgtattggtgcgatccactcggtggtgttcggtggcttctcccctgaagcgctggccggccgcatcatcgattgcgagtccaaggtggtgatcaccgccgacgaaggcgtgcgtggcggccgtcgtaccccgctcaaggccaacgtcgacctggcgctgaccaaccctgaaaccaaaagcgtgcagaagatcatcgtgtgcaagcgcaccggtggtgatattgcctggcaccagcaccgcgacatctggtacgaagacctgatgaaagtggcctccagccactgcgcgccaaaggaaatgggtgctgaagaagcgctgttcatcctttatacctctggctccacgggcaagccgaagggtgtgctgcacaccaccggcggttacctggtgtatgccgcgctgacccatgagcgcgtgttcgactatcgcccgggcgaggtctactggtgcaccgccgacgtcggttgggtcactggccacagctacatcgtctacggcccgctggccaacggcgccactaccttgcttttcgaaggcgtgccgaactacccggacattacccgcgtctcgaagatcgtcgacaagcacaaggtcaacatcctctacaccgcgccaaccgccatccgcgcgatgatggccgaagggcaggccgctgttgaaggggccgatggttccagcctgcgtctgcttggctcggtgggcgagccgatcaaccctgaagcctggaactggtactacaagactgtaggcaaggagcgttgcccgatcgtcgacacctggtggcagaccgaaaccggcggcatcctgatcagcccgctgccgggcgctaccggcctcaagccgggctcggcaacccgcccgttctttggtgtggtgcccgccctggtggacaacctgggtaacctgatcgaaggtgcggccgaaggcaacctggtgatcctcgactcctggccaggccagtcgcgttcgctgtacggcgaccacgaccgctttgtcgacacctacttcaagaccttccgtggcatgtacttcaccggcgacggtgcgcgccgcgacgaagatggctactactggatcaccggtcgtgtggatgacgtgctcaacgtctccggtcaccgcatgggtactgccgaaatcgaaagcgccatggtcgcgcattcgaaagttgccgaggctgcagtggttggcgtgccgcacgacatcaagggccagggcatctatgtgtatgtcaccctcaattccggtatcgaggccagtgagcagttgcgcctggagctgaaaaactgggtgcgcaaggaaatcggcccgattgcctcgccggacgtgatccagtgggcgccgggcctgccgaagacccgttcgggcaagatcatgcgccgcatcctgcgcaagattgccaccggtgagtacgatgcgctgggcgatatctcgacactggctgacccgggtgtggtgcagcacctgatcgatacccacaaggccatgaacctggcttcggcctga

SEQ ID NO: 802 - protein, 653 aa, Pseudomonas putida
MSAAPLYPVRPEVAATTLTDEATYKAMYQKSVINPDGFWREQAQRIDWIKPFTKVKQTSFDDHHVDIKWFADGTLNVSSNCLDRHLEERGDQLAIIWEGDDPSEHRNITYRELHEQVCKFANALRGQDVHRGDVVTIYMPMIPEAVVAMLACARIGAIHSVVFGGFSPEALAGRIIDCESKVVITADEGVRGGRRTPLKANVDLALTNPETKSVQKIIVCKRTGGDIAWHQHRDIWYEDLMKVASSHCAPKEMGAEEALFILYTSGSTGKPKGVLHTTGGYLVYAALTHERVFDYRPGEVYWCTADVGWVTGHSYIVYGPLANGATTLLFEGVPNYPDITRVSKIVDKHKVNILYTAPTAIRAMMAEGQAAVEGADGSSLRLLGSVGEPINPEAWNWYYKTVGKERCPIVDTWWQTETGGILISPLPGATGLKPGSATRPFFGVVPALVDNLGNLIEGAAEGNLVILDSWPGQSRSLYGDHDRFVDTYFKTFRGMYFTGDGARRDEDGYYWITGRVDDVLNVSGHRMGTAEIESAMVAHSKVAEAAVVGVPHDIKGQGIYVYVTLNSGIEASEQLRLELKNWVRKEIGPIASPDVIQWAPGLPKTRSGKIMRRILRKIATGEYDALGDISTLADPGVVQHLIDTHKAMNLASA

SEQ ID NO: 803 - DNA, 1644 bp, Acinetobacter sp
  CDS (1)..(1644)
atgcaaacattagagcaagcatatcaagcatttgatttgaatcaattaatagagcagcaattgataggccatccccaatcgatcaatgcttatgaagaatgttgtggccgttatgtgggacaaaataaaatcgcattgatttgggaagggcttgagggtgagacaaagcaattcaccttcgatgagttggcaacttattctggtcaattggcaaattattttaagtctcaaggtgtgcaacccggacaatgcattgcgggtctattacctcgtactcccgaattgttgattacaattttagccacttggcgaatgggagctatttatcaaccgttatttactgcatttgaatcaaaagcaattgaacatcgtttgagtgtagctcagacacaactggttgtgaccaacaaagaacaagcggcaaaattaaatgctgtgaacaatttaaaagtcttaacagtagaaaaagattcatttgatattttagatcaacctgatttttggaatgcacttaagcattttgatgcccaatatcaatctgaaatgattacctttaatgatcattttttgatgatgtttacgtctggaacgactggtttggctaaacctgtgcctgtgccactcaaagcaattttatcttttaaaggctatatgacgcacgctgttggattaaatcagtcagattctttctggaatctcgcagatcctggctgggcctatggtttgtactacgggataacagggcctttaagcctgggccatagcatcattttagatgaacaaggatttagtgttgatcgtgcaattgaattaattaaaaaatacaaagtctctaatttgattggatcgcctactgcctttaggatgttctttggatttaaagaaaaatttgatgctgaaattaaagattatttacgtgtggtgagtagtgccggagaacctttaacaccagaggtcgtccattggtttaagaatgatttagacatcaatatttatgatcagtatggtcaaactgaactgggtatggtcatcgcaaatcaccatgcacttgagcatcatgtaaagattggctctgctggatatgcaattcctggttatcgttttgtcgtattagatgaacatcatcaagaactatcatctgattctattggtgtattagcaatagatagtgctgcctctccattattctggtttacagggtacggcgaaaacaatcgaagcgcatttgttggtcagtattatattacgggtgatactgtgaaaatgaatgcgtttggcagtatcgactttgtcgggcgtatagatgatgtaattacaacatcgggttatcgtgtagggccttttgatgttgaaagtactttacttgagtgccaagaggttcttgaatctgcggtgattggtaagcctgatgcaatcagaactgaaattgtaaaagcttttgttgttttaaaatcacaatacaagtctcaggctgatcaatcactgagcgaaaaacttaaacaatatgtccgcggacgcctttcaaagcatgcttatcctaaagaaatagaatttgtagatcaattacctaaaacagccagtggcaaaatccagcgtggagttttaaaacaacaggaaatctcccgtatgcagttatcgggttaa

SEQ ID NO: 804 - protein, 547 aa, Acinetobacter sp
MQTLEQAYQAFDLNQLIEQQLIGHPQSINAYEECCGRYVGQNKIALIWEGLEGETKQFTFDELATYSGQLANYFKSQGVQPGQCIAGLLPRTPELLITILATWRMGAIYQPLFTAFESKAIEHRLSVAQTQLVVTNKEQAAKLNAVNNLKVLTVEKDSFDILDQPDFWNALKHFDAQYQSEMITFNDHFLMMFTSGTTGLAKPVPVPLKAILSFKGYMTHAVGLNQSDSFWNLADPGWAYGLYYGITGPLSLGHSIILDEQGFSVDRAIELIKKYKVSNLIGSPTAFRMFFGFKEKFDAEIKDYLRVVSSAGEPLTPEVVHWFKNDLDINIYDQYGQTELGMVIANHHALEHHVKIGSAGYAIPGYRFVVLDEHHQELSSDSIGVLAIDSAASPLFWFTGYGENNRSAFVGQYYITGDTVKMNAFGSIDFVGRIDDVITTSGYRVGPFDVESTLLECQEVLESAVIGKPDAIRTEIVKAFVVLKSQYKSQADQSLSEKLKQYVRGRLSKHAYPKEIEFVDQLPKTASGKIQRGVLKQQEISRMQLSG

SEQ ID NO: 805 - DNA, 1644 bp, Acinetobacter sp
  CDS (1)..(1644)
atgttggattatcaaacggtcgcaacctcatttgactttcatagagcagcaaatgaaatgttatctggttcactggatcaagttaatgcatgttacgaatgttgtgatcgacatgcagaatcaaaccccgaaaaaatagcattatattggcaaggcaaagatggtcgtcaatatcaatatacgtttgcacaattacaaaagtggtccagtcaatttgccaattttttaaaatcacaaggggttcaaacaggcgatcgtatttcaggtttattacccagaacacctgaattattggtggtgattttaggtgcttggcgaattggtgcagtttatcagccactttttacggcatttggcccgaaagcgattgagcatcgcgtgcagcttgcaaaaagtaaattggttgtgactgatttgggtaatcggagcaagcttgatgaagtagcgcattgtccacccatcatgacggttattggcgaaaaagatcatgcagtaaatgatcaagacttaaatttttggaagcaagtgagtcaagcgtctgaccactgtgatttggttttacaagacattcaaaaaccatttttactgatgtttacgtcgggaaccacaggccctgcaaagcctttggaagtgcctttaaaggcattaatcgcgtttggtcattatatgaaagatgccattggtttacgcaccgatgatgtcttttggaatcttgcagatcctggctgggcatatggtttatattatgccataaccgggccactgcttttggggcatgcaaccttattttatgagggtggttttagtatcgatagtttgtgccaaattattgaggattataaaattaccaatttggcaggtgcaccgactgcataccgcatgatgatggcagcagatccagcgaaaatcgcctgcctaaagggtaaattacgtgtgataagtagtgcaggtgaaccactcaatccagaagtatttcgttggtttaaacacactttagatgcccctatttttgatcattatggtcagactgaagtgggtatggtggtatgtaatcatcacggtttaagccatgatgtgcgtgcaggaacagcaggttttgcaagtccaggctatcgtgtggccgtagtggatgagcagggcaatgaacttccagcggatacggctggaatattggccgtcgatattcaaaagtcgccgatgatgtggtttggtggttatcaagaaagtcgaaaatctccttttttaaagcattattacttaacaggtgatacagccgaattacatgcggatggcagtatgagttttgtagggcgtagtgatgatgtcatcaccacatcaggctatcgtattggtcctttcgatgttgaaagtgcattaattgaacatcaagctgtaattgaagcagcagttattggtgtgcctgacccagaaagaacggaaattgtaaaagcatttgtgattttgacagcacagacgagcccatcagagcaattggccgaggaactacgccaatttgttaaaaagcgtttatcggcacatgcttatccaagacaagttgagtttgtgacagagttgcctaaaactccaagtggtaagattcaacggtttttgttgcgtaatcaagagattgccaagcaatcctaa

SEQ ID NO: 806 - protein, 547 aa, Acinetobacter sp
MLDYQTVATSFDFHRAANEMLSGSLDQVNACYECCDRHAESNPEKIALYWQGKDGRQYQYTFAQLQKWSSQFANFLKSQGVQTGDRISGLLPRTPELLVVILGAWRIGAVYQPLFTAFGPKAIEHRVQLAKSKLVVTDLGNRSKLDEVAHCPPIMTVIGEKDHAVNDQDLNFWKQVSQASDHCDLVLQDIQKPFLLMFTSGTTGPAKPLEVPLKALIAFGHYMKDAIGLRTDDVFWNLADPGWAYGLYYAITGPLLLGHATLFYEGGFSIDSLCQIIEDYKITNLAGAPTAYRMMMAADPAKIACLKGKLRVISSAGEPLNPEVFRWFKHTLDAPIFDHYGQTEVGMVVCNHHGLSHDVRAGTAGFASPGYRVAVVDEQGNELPADTAGILAVDIQKSPMMWFGGYQESRKSPFLKHYYLTGDTAELHADGSMSFVGRSDDVITTSGYRIGPFDVESALIEHQAVIEAAVIGVPDPERTEIVKAFVILTAQTSPSEQLAEELRQFVKKRLSAHAYPRQVEFVTELPKTPSGKIQRFLLRNQEIAKQS

SEQ ID NO: 807 - DNA, 2115 bp, Candida glabrata
  CDS (1)..(2115)
atgtcaccatctgctattgctgagaagaaacaggtggacaacatccaggagatcaaggacaagaaccaggagcctgcgcaccacgagtacgagcacttgaccaatgtcggtgtggtcaagcagaagcctatcgaccacaggttgaaggacaacatcaagacccactactcgcctcacctggacggcttgcaggagtacaagagacagtaccaggagtccatcgagaacccagagaagttcttcagcgagaaggcacgctctttcatgaactggttcagggacttcgacagggtcttcgtgccagacgtggacaacccaacaaaaccttccttcgagaacaacgcctggttcctgaacggccaattgaacacttgctacaactgtgtcgacagacacgctttgaagactccaaacaagaccgccatcatctacgaggcagacgagcccggtgaaggctactcgatgtcttacaaggaactgctggagaaagtctgccaagtggcacagatcttgaagtactccatgaacgtcaagaaaggtgacactgttgcagtctacatgccaatgatcccagaagcactcatcactttgctagccatctcgagaatcggtgccatccactccgtcgtcttcgcaggtttctcttcaaactccctaagagaccgtatcaatgacgccggctcccgcgtagtgatcaccgctgatgagtccaacagaggcggcaagatcatcgaaacaaagagaatcgtagatgacgccttgagagaaaccccacaagtcgaacacgtcctggtctacaggcgtaccaacaaccctcaagtcaacttccaagctccaagagacttggactgggaaactgagagaaagaagtacaagacttacttcccttgcgaacccgtcgactcagaacacccattattcttgctttacacctcgggatctacaggtactccaaagggtgttcaacactctaccgcaggctacctactgggcgccctgttgacgatgagatacactttcgacgtccatcaggaagacgtgttcttcaccgctggtgacatcggttggatcacaggccacacatactgtgtatacggtcctttgctgtacggttgtactactttggtcttcgaaggtacccctgcttatccaaacttctctcgttactgggaaatcattgacaaacaccaagtcacccagttctacgttgcaccaactgctctgcgtctactaaagagagctggtgactcattcatcgacggcttctccctgaagtctctacgttgtttgggctcagttggtgaacctatcgctgctgaagtctgggaatggtactctgacaagatcggtaagaacgagattcctatcgtcgacacttactggcaaaccgagtctggttctcacttggtcactcctttggcaggtggtgtcacaccaatgaaaccaggttctgcatcattgccattctttggtatcgaaaccgtcatcctggacccaactactggtgaagagattaacgactctcatgcagaaggtgtcctggcaattaagagaccatggccatcctttgccagaaccatttggaagaaccatgacagattcttggacacctacttgaacccatacaagggctactatttcacaggtgatggtgccgctagagacaaggatggctacatctggattttgggtcgtgttgacgatgtcgttaacgtctccggtcacagactatccacagctgaaattgaagctgccattatcgaggacagaatggtcgccgagtgtgctgtcgttggtttcaacgacgatctgaccggtcaagctgttgctgctttcgtggtcttgaaggacaaatcgacctgggcttctgcctccgaggaagaacttcaagatattaagaagcacttgattttgactgtgagaaaagacattggtccctttgctgcaccaaaattgattgtcttggttgatgacttaccaaagaccagatccggtaagatcatgaggcgtatcttgagaaagattttggcaggtgagtctgatcaattaggtgacgtctctaccttatccaatcctggcgttgttaagcatttgattgactctgttaaattgtga

SEQ ID NO: 808 - protein, 704 aa, Candida glabrata
MSPSAIAEKKQVDNIQEIKDKNQEPAHHEYEHLTNVGVVKQKPIDHRLKDNIKTHYSPHLDGLQEYKRQYQESIENPEKFFSEKARSFMNWFRDFDRVFVPDVDNPTKPSFENNAWFLNGQLNTCYNCVDRHALKTPNKTAIIYEADEPGEGYSMSYKELLEKVCQVAQILKYSMNVKKGDTVAVYMPMIPEALITLLAISRIGAIHSVVFAGFSSNSLRDRINDAGSRVVITADESNRGGKIIETKRIVDDALRETPQVEHVLVYRRTNNPQVNFQAPRDLDWETERKKYKTYFPCEPVDSEHPLFLLYTSGSTGTPKGVQHSTAGYLLGALLTMRYTFDVHQEDVFFTAGDIGWITGHTYCVYGPLLYGCTTLVFEGTPAYPNFSRYWEIIDKHQVTQFYVAPTALRLLKRAGDSFIDGFSLKSLRCLGSVGEPIAAEVWEWYSDKIGKNEIPIVDTYWQTESGSHLVTPLAGGVTPMKPGSASLPFFGIETVILDPTTGEEINDSHAEGVLAIKRPWPSFARTIWKNHDRFLDTYLNPYKGYYFTGDGAARDKDGYIWILGRVDDVVNVSGHRLSTAEIEAAIIEDRMVAECAVVGFNDDLTGQAVAAFVVLKDKSTWASASEEELQDIKKHLILTVRKDIGPFAAPKLIVLVDDLPKTRSGKIMRRILRKILAGESDQLGDVSTLSNPGVVKHLIDSVKL

SEQ ID NO: 809 - DNA, 2052 bp, Candida glabrata
  CDS (1)..(2052)
atgacattaaaagaacataagactgtgcatgaagcacagaacgctgttgctcgccaagctccagagcatttctacaagagccagccaagcagaggtggtttcataaaggacatctccgaatatgaaagactttacaagcagtcgattgaggacccagagactttcttcagtgaaaaggctcgtgaactattgcactgggacgccccattctctaaagtatcgtacggttctctagagcaaggtgatgtcgcttggttcctaaacggtaaactaaacgcctcttacaactgtgtggacagacacgcctttgccaacccagacaagcctgccattatctatgaagcagacgacgagaaggacaactataccatcacttttggtgaattgctgagaagagtatctaaggttgctggtatcttgaagagctggggtgtcaagaaaggtgacactgttgccatttacttgccaatgatcccagaagctattattgctatgttggccgttgtgcgtcttggtgccatccactctgtcgtcttcgccggtttctcagctggttctttgaaagaccgtgtagtcgatgctggttccaaggttgtcatcacttgtgatgaaggccgtagaggtggtaagactgtccacttgaagaaaatcgttgatgaaggtttgaacggtgtcgatcaagtctctcgtattttggttttcaagagaacaggtactgaaggtattccaatgaaggctggtagagatttctggttgcacgaggaagctgacaagagaagatcatatctaccacctgttccatgtgatgccgaagatccactattcctactatatacatctggttctaccggctctccaaagggtatcgtgcacactactggtggttatttgctaggtgccgctatgactactaagtacgtcttcgatgttcatccagaggatgttttcttcactgctggtgatgtcggctggattacaggtcacacctacgctctatacggtccattgttgctaggtgtaccaactatctgcttcgaatctacaccagcttacccagattacggtagatactggagaattgtcgaacgtcacaaggccacccacttctacgttgcaccaactgctatgagattgattaagcgtgttggtgaagctgaaattagcaagtacgacttgtcctccctacgtgtcctaggttctgtcggtgaaccaatttctcctgaactatgggaatggtacaacgaaaagattggtaacaacaattgtgttgtttgtgacactttctggcaaactgaatccggttctcatttgattgccccaatggcgggtgccatcccaaccaaaccaggttctaccactcttccattcttcggtattgatgcttgtatcattgatccagtttctggtgttgaaattgaaggaaacgatgtcgaaggtgttttagctgttaaatcaccatggccatccatggctagatctgtctggaacgatcacgttcgttatgtcgacacttacatgaagccatacccaggttactactttacaggtgatggtgctggtagagaccacgatggttactactggatcagaggtagagttgacgatgttgttaacgtctctggtcataggttatctactgcagaaattgaagcctgtttggttaaccatgagaatatctctgagaccgctgtggttggtatcaatgacgaattgaccggtcaagctgttattgcattcgtatcattgaaggaaggctacctacaaaatgatgccccagaaggtgatgctgaacatattactcctagtaacttacgtagagagttgattctacaagtcagaggtgaaattggtccattcgcttctccaaagtgtattatcttggtcagagacctaccaaaaaccagatctggtaagatcatgagaagagttttaagaaagatcgcttccaatgaagcagaccaactaggtgatttgtctactttggctaatgctgatgttgttcctgccattatctctgcctgcgaaaaccaattcttcgcagaaaagaaataa

SEQ ID NO: 810 - protein, 683 aa, Candida glabrata
MTLKEHKTVHEAQNAVARQAPEHFYKSQPSRGGFIKDISEYERLYKQSIEDPETFFSEKARELLHWDAPFSKVSYGSLEQGDVAWFLNGKLNASYNCVDRHAFANPDKPAIIYEADDEKDNYTITFGELLRRVSKVAGILKSWGVKKGDTVAIYLPMIPEAIIAMLAVVRLGAIHSVVFAGFSAGSLKDRVVDAGSKVVITCDEGRRGGKTVHLKKIVDEGLNGVDQVSRILVFKRTGTEGIPMKAGRDFWLHEEADKRRSYLPPVPCDAEDPLFLLYTSGSTGSPKGIVHTTGGYLLGAAMTTKYVFDVHPEDVFFTAGDVGWITGHTYALYGPLLLGVPTICFESTPAYPDYGRYWRIVERHKATHFYVAPTAMRLIKRVGEAEISKYDLSSLRVLGSVGEPISPELWEWYNEKIGNNNCVVCDTFWQTESGSHLIAPMAGAIPTKPGSTTLPFFGIDACIIDPVSGVEIEGNDVEGVLAVKSPWPSMARSVWNDHVRYVDTYMKPYPGYYFTGDGAGRDHDGYYWIRGRVDDVVNVSGHRLSTAEIEACLVNHENISETAVVGINDELTGQAVIAFVSLKEGYLQNDAPEGDAEHITPSNLRRELILQVRGEIGPFASPKCIILVRDLPKTRSGKIMRRVLRKIASNEADQLGDLSTLANADVVPAIISACENQFFAEKK

SEQ ID NO: 811 - DNA, 1959 bp, Bartonella quintana
  CDS (1)..(1959)
atgtctgaaaaaatctatccagtaccaaccgatatcaaaaaaaatgctttgatcaatgaagagacctatcaaaaatggtatcgggaaagcattaatgatccagaagccttctgggcaaaacatggccaacgcattgagtggtttaagccctatacaaaagtaaaaaacacttcatttaacggtgatgtatcgattcaatggtacgaagatggtataacaaatgttgcctataattgcattgatcgtcatctaaaaaactctggcaaccatatcgcactgatttgggaggggaataacccttatcatgataaaaaaataacctataatgaactttatgaacatgtttgtcgctttgctaatatattaaagaatcatggcgtaaaaaaaggtgacagagttaccatttacctcccgatgatacccgaagccgcttatgccatgctcgcctgcgctcgcattggtgctattcattcggttatttttgccggcttttcttctgaagcgatagcagaccgcattgttgattgcaaatcaacctttatcatcaccgctgatcaaggcctgcgtggaggaaaattgatcaagttaaaaaacaatattgatcatgctattgatattgcagcacgccgtggtgttcatgttaatcaagtcttggtcatacggcgtacaagtggaacaattgattgggtaaagggacgtgatttttggtatcatgaagaaatatctcatgccaaaacggattgtccagcagaaatgatgaatgctgaagatccactttttattctttatacctccggttcaacaggcaaaccaaaaggtgttctgcatacaacagctggctatctcgtttatgtatcgatgacacatcaatatgtttttgattatcatcctggtgaaatttactggtgtactgccgatattggctggatcagtggtcattcttacttgatttatggtcctctatgcaacggtgccaccactttaatgtttgaaggtataccaacctttcccgaccaaggtagattctgggaaattgtcgataagcataaagtaaatacgctttacactgcaccaactgctattcgcgcattaatgggtgctggaaattcttttgttgaacattctaaaagaacatccttacgcctcttaggcaccgtaggcgaaccgattaatccagaagcatggaaatggttttatcatacggttggagacaatcgctgtcccattctcgacacatggtggcaaacagaaacaggagggcatatgatcacgcccctaccaggcgcaacacaactcaaagcaggatcagccacccatccattctttggtgttcaactccaaatcattgatggcgaaggaaatgttctggaaggtgaagcagaagggaatctctgtattattgactcatggcctggtcaaatgcgcactctctataatgaccatgagcgttttatcgaaacctatttttccacatataaaggaaaatattttacaggcgacggttgtaaacgagacaatgacggttattactggattacaggacggattgatgacattctcaatgtctctggacacagattaggaacagctgaaattgaatcagcgcttgtttctcaccccgctatttcagaagcagctgttgtcggttaccctcatcccattaaaggacaaggaatttacagttttgtcaccttaatggaaggcataaccccaagtgaagaattgtataaagatcttattcagcatgtcaaaaaagaaataggatcgattgccctcttggataaaattcagtttacacctcagctccccaaaacgcgatcgggaaaaattatgagacgcattttgagaaaaatcgccgaaaatgatttcgataacctaggagatatttcaacccttgccgaaccacaagtcgttgacgatcttattgccaacagacaaaatacagaagccacggcttaa

SEQ ID NO: 812 - protein, 652 aa, Bartonella quintana
MSEKIYPVPTDIKKNALINEETYQKWYRESINDPEAFWAKHGQRIEWFKPYTKVKNTSFNGDVSIQWYEDGITNVAYNCIDRHLKNSGNHIALIWEGNNPYHDKKITYNELYEHVCRFANILKNHGVKKGDRVTIYLPMIPEAAYAMLACARIGAIHSVIFAGFSSEAIADRIVDCKSTFIITADQGLRGGKLIKLKNNIDHAIDIAARRGVHVNQVLVIRRTSGTIDWVKGRDFWYHEEISHAKTDCPAEMMNAEDPLFILYTSGSTGKPKGVLHTTAGYLVYVSMTHQYVFDYHPGEIYWCTADIGWISGHSYLIYGPLCNGATTLMFEGIPTFPDQGRFWEIVDKHKVNTLYTAPTAIRALMGAGNSFVEHSKRTSLRLLGTVGEPINPEAWKWFYHTVGDNRCPILDTWWQTETGGHMITPLPGATQLKAGSATHPFFGVQLQIIDGEGNVLEGEAEGNLCIIDSWPGQMRTLYNDHERFIETYFSTYKGKYFTGDGCKRDNDGYYWITGRIDDILNVSGHRLGTAEIESALVSHPAISEAAVVGYPHPIKGQGIYSFVTLMEGITPSEELYKDLIQHVKKEIGSIALLDKIQFTPQLPKTRSGKIMRRILRKIAENDFDNLGDISTLAEPQVVDDLIANRQNTEATA

SEQ ID NO: 813 - DNA, 1959 bp, Bartonella henselae
  CDS (1)..(1959)
atgtctgaaaaaatctacccaataccggataatatcaaaaaaaatgctttgatcgatgaagaaacctatcaacaatggtatcaggaaagcatcaatgatccagaaagtttctgggcaaaacatggtcaatgtattgaatggtttaaaccttatacaaaagtaaaaaatacttcctttaatggcgatgtatcgattcaatggtatgaagatggcataacaaatgttgcctataactgcattgatcgccacctaaaaacccatggtgataaaatcgcactgatttgggaaggagataacccttatcacgataaaaagataacctataatgaactttatgaacatgtctgtcgttttgccaatattttaaaaaatcacggtgtcaaaaaaggcgataaggttaccatttacctaaccatgatccctgaagcagcctatgcaatgctagcctgtgcccgtattggcgctattcattcggttatttttgcaggtttttctcctgaagcaatagcaggacgcattgtagactgcgaatcgacttttatcattaccgcaaatcaaggcttgcgtggaggaaaacagattaatttaaaagacagtgttgaccatgctattgagattgccgctcgccagaatgtgcatgtggatcaagtcatggtcatacggcgaacctgtggaccaatccattgggtagagggacgtgatttttggtatcatgaagaagtatctcataccaaaacggactgtccagcagaaaagatgaatgctgaagatccactttttattctttatacctcaggctcaacaggtaaacccaaaggtgttttgcatacaacagcgggctatcttgtttatgcatcaatgacccataaatatgtttttgattatcatgctggtgaaatttactggtgtactgctgatattggttggatcaccggccattcttatttggtttatggtcctctttgcaacgctgctactactttaatgtttgaaggcacaccaacctttcccgacaacggcagattctgggaaattgtcgataaacatcaagtcaatatattctacaccgcaccaacagctattcgcgccttaatgggtgcgggcaattcatttgttgaacgctcgaaaagaacatccttgcgtcttttagggtccgtgggcgaacccattaatccagaggcatgggaatggttttaccacacagttggaaacaatcattgccccattctcgatacatggtggcaaacagaaacaggaggacatatgatcacccccctccccggtgcgacaccccttaaagcaggatcagccacacgtcctttttttggagtacaactccaaatcatagatgcagaaggaaatgtcctagaaggtgaaacagaaggcaatctttgtattattgattcatggccaggacaaatgcgcacactctataatgatcacgagcgctttattcaaacttatttttccacctataaagggaaatattttacaggcgatggctgtaggcgcgatagcgatggctattattggattacaggacgagtggatgacattctcaatgtttctggacacagactaggaacagcagaaattgaatcagcgcttgtttcgcatcccgctgtttcagaagccgccgttgttggctaccctcatactattaaaggacaaggaatttacagttttatcaccttaatggaagggacagccccaagtgaagagttgcatcaagagcttatccgacatgtcagaaaggaaataggctccattgccatattggataaagttcaatttgctcctcagctccccaaaacgcgatcaggaaaaattatgagacggattttgcgaaaaattgccgaaaataattttgataatctaggagatatttccactctttctgaaccacaagtcattgatgatcttattgctaatcgtcaaaacagagaaattacagcgtaa

SEQ ID NO: 814 - protein, 652 aa, Bartonella henselae
MSEKIYPIPDNIKKNALIDEETYQQWYQESINDPESFWAKHGQCIEWFKPYTKVKNTSFNGDVSIQWYEDGITNVAYNCIDRHLKTHGDKIALIWEGDNPYHDKKITYNELYEHVCRFANILKNHGVKKGDKVTIYLTMIPEAAYAMLACARIGAIHSVIFAGFSPEAIAGRIVDCESTFIITANQGLRGGKQINLKDSVDHAIEIAARQNVHVDQVMVIRRTCGPIHWVEGRDFWYHEEVSHTKTDCPAEKMNAEDPLFILYTSGSTGKPKGVLHTTAGYLVYASMTHKYVFDYHAGEIYWCTADIGWITGHSYLVYGPLCNAATTLMFEGTPTFPDNGRFWEIVDKHQVNIFYTAPTAIRALMGAGNSFVERSKRTSLRLLGSVGEPINPEAWEWFYHTVGNNHCPILDTWWQTETGGHMITPLPGATPLKAGSATRPFFGVQLQIIDAEGNVLEGETEGNLCIIDSWPGQMRTLYNDHERFIQTYFSTYKGKYFTGDGCRRDSDGYYWITGRVDDILNVSGHRLGTAEIESALVSHPAVSEAAVVGYPHTIKGQGIYSFITLMEGTAPSEELHQELIRHVRKEIGSIAILDKVQFAPQLPKTRSGKIMRRILRKIAENNFDNLGDISTLSEPQVIDDLIANRQNREITA

SEQ ID NO: 815 - DNA, 2763 bp, Oryza sativa
  CDS (355)..(2472)
ggatttggcatcctctgaggaatgaattgtaaaaacaaaaaagggaaaaaaaggagggagaagaaaacaaagtcaacctctcgtcggttacattacaatttacaggagcaagcagcttaattagcaaaggctgcgtagcgtaatccgatcaccgatgtatccatccagcaatccatccaagatcgatcaacccctcgtcgtgatctcgtcgtcgtactattatttatagtccaccgctagccatcgcactctgcagcagcagcagcagccgcgcccccacacctcgcctcctcctcggcttggatctcgccgcatcatctgccgccgacgacgacgaagaggaagacgaccgccatggggacggcgagcggggaccagccggcaggggcgtcgtcggacaagctgcggcacgtggagtccatgtcggagctgccctccggcgccggcaggatctccgggatcaacgccgtcgtcctcggcgagtcactcgccgccgaggagcacgacctcgtctacccctccgccgagttctccgccgacgccctcgtcccctcccccaagaagtaccaaaagatgtatgagaggtcaatcaacgacccggccgggttctggtcggagatcgccgacgccttctactggaaggagaagtggaaccccagtgaggtctgctccgagaacctcgacgtcaccaaggggcctgtccagatcagttggttcaaaggtggcaaaacaaacatatgttacaatgctgttgatcgcaacgtcgaggctgggaacggagacaagatcgcgatgtattgggagggcaatgagcctggtcaggatgggaagctcacctattcagagctcttggacagggtttgccagcttgccaattacttgaagagtgttggtgtcggcaagggtgatgctgtgatcatctacttaccaatgttgctggagcttcccattgccatgcttgcttgtgcccgcattggtgctgttcactcggttgtatttgctggcttttctgcggattccctggcccaaaggatcgttgattgcaagcctaagcttgtgatcacttgcaatgcagtcaaaagaggggtgaagcccatccttctgaaagatatagtggatgctggtctggctgaaagtgagaaacaaggagtcgctgtaggtctatgtttgacatatgaaaatcagtcagcaatgaagagagaagacacaaaatggcaagcaggaagggatgtttggtggcaggatgttgtgaccagtttcccaaccaagtgcgatgtagaatgggtggatgcagaggacccattgttccttctgtacacaagtggcagtacaggaaagccaaagggtgtgttgcatactactgggggctacatggtttacagtgcaacaacatttaagtatgcatttgattacaagccgtcggacatatactggtgcactgcagactgtggctggattactggacacagctatgtgacgtatggtccactcctgaatggagcaacagttctcgtttttgaagggactccaaattaccctgattctggtcggtgctgggacattgtggacaagtacaaggtgacaatattttacactgcaccaacactcgttcgatcactcatgcgtgatggcaccgagtatgttacacgtcactctcgaaaatctcttcgagtcttgggaagtgttggtgagccaattaatcctagcgcatggagatggttctacaatattgtcggggactctcgatgccctatctccgacacctggtggcagactgaaactggtggcttcatgatcactcctttacctggcgcctggcctcaaaaaccaggttctgcaacctttcctttctttggtgttcagcctgtcattgttgatgagaaagggaaggagattgaaggagaatgcagtggatatctttgcataaagaaatcatggcctggggctttccggactctctatggagatcatgatagatatgagaccacttacttcaagccatttgctggctactattttactggggatggttgcagcagggacaaagacggttaccactggctgactggaagagtagatgatgtcatcaatgtcagtggacaccggattggtacagcagaggttgagtctgcgttggtttcacacccaaagtgtgcagaggctgctgttgttgctgttgagcatgaagtgaaaggtcaaggaatatatgcttttgtaactttggtggatggtgttccttatagtgaagaactacggaaaagcctcatattgacagtccgcaaccagattggggcatttgcagctcctgacaagatccactgggcaccaggacttcctaaaacgagaagcggtaagataatgcgcaggattctgcgcaaaattgcctcaaaacagctggatgaacttggtgacacaagcacccttgctgatcctggcgtcgttgaccagctgattgcgctcaaagattgctagattgtaaaaattagatgacagatgcacttccactgatgcttgtgcgttccatttctcttcctatatgatggagatgcactttctcttcctacattttagtgtccatagtctttcgtttattcggtggaagttgctcctggtctagggaactgaaacacgatatggaatgatctgagagtgcggtgttggacttctgtatacttgtgttacacattgagatgacttgctccatgaatgtatttgatggacgcaataaatccatttcaataaaatattttgtatgattttccc

SEQ ID NO: 816 - protein, 705 aa, Oryza sativa
MGTASGDQPAGASSDKLRHVESMSELPSGAGRISGINAVVLGESLAAEEHDLVYPSAEFSADALVPSPKKYQKMYERSINDPAGFWSEIADAFYWKEKWNPSEVCSENLDVTKGPVQISWFKGGKTNICYNAVDRNVEAGNGDKIAMYWEGNEPGQDGKLTYSELLDRVCQLANYLKSVGVGKGDAVIIYLPMLLELPIAMLACARIGAVHSVVFAGFSADSLAQRIVDCKPKLVITCNAVKRGVKPILLKDIVDAGLAESEKQGVAVGLCLTYENQSAMKREDTKWQAGRDVWWQDVVTSFPTKCDVEWVDAEDPLFLLYTSGSTGKPKGVLHTTGGYMVYSATTFKYAFDYKPSDIYWCTADCGWITGHSYVTYGPLLNGATVLVFEGTPNYPDSGRCWDIVDKYKVTIFYTAPTLVRSLMRDGTEYVTRHSRKSLRVLGSVGEPINPSAWRWFYNIVGDSRCPISDTWWQTETGGFMITPLPGAWPQKPGSATFPFFGVQPVIVDEKGKEIEGECSGYLCIKKSWPGAFRTLYGDHDRYETTYFKPFAGYYFTGDGCSRDKDGYHWLTGRVDDVINVSGHRIGTAEVESALVSHPKCAEAAVVAVEHEVKGQGIYAFVTLVDGVPYSEELRKSLILTVRNQIGAFAAPDKIHWAPGLPKTRSGKIMRRILRKIASKQLDELGDTSTLADPGVVDQLIALKDC

SEQ ID NO: 817 - DNA, 1941 bp, Bacillus thuringiensis serovar konkukian str
  CDS (1)..(1941)
atgaaacaagcagtttggtttccaacagaagagtataaagaaaaaacacgcttatatggttggatgaaatcattggggtatgaagattatgaaacgttttataataaatctattgaagaaacagcttggttttggggagaagctgagaaagcggttggctatcaatggatgaaaccttatacagaagtgttagacttgcaaaatggtacaccgtttgcacagtggtataatggcggaacatgtaacgttgtagaatcagtgttatcacgctggcttgcagatgatgaaacaagaacgcaaccagcacttcagtatgaaggagaaaatggaacttcaaaatcatttacatatgaagaacttgatagctgggtaagtcgcgttgcaaatggtttgaaacatgcgggtattgaaaaaggcgaccgagtaacaatttatatgccaatgattccagaaacagttgttgcgatgctagctgtaatgaaaatcggagcaattatttcaccaatattctcaggatttgcgtctgatgcagtcatgacacgcgtgcaagcagcaggatcaaagatgatcattactgcagatggtttttcacgccgaggtaagattgtttcattaaaagatgaagtagataaagcttgtgagcattgtccaactgttgaaaaagtcgttatcgtgcgccacgcaggaaatgattttacaccgcataattatgatttctcatggagtacgttagaaaaagaaaagccatttgtacatgctgaagaaatgcatagtgacgatccgttaatgctcatttatacatcaggtacaacaggaaaaccgaaagggaccgtgcacactcatgctggtttccctttgaaagcagcatttgatgcagggtttgggatgaatataaaacaaggcgaccgcgtattatgggtaactgatatgggctggatgatgggaccatttttactatttggctctctcattaatggagcaacgatggttatgtatgaaggtgttccggacttcccagaagcagatcgtttatgggagacagttgataaatatgaaattacacatctcggtatatcaccaacattaattcgtgcgttaatggcaaaaggtgatgagtatgtaaataaacattcgcttaagagtttagaagtatttgcctcaacaggcgagccttggaatccagacccttggatgtggctatttgaaatggttggaaaaagtaatgtgccaatttgtaactattcaggcggaactgaaatttcaggtgggattttcgggaacgtccttattaaaccaattgcaccgattagctttaatgcttctttaccagggatggcggcggttgtgctcgatgatcaaggtaatccaattcgcgatgaagttggagaattatgtttagagaaaccttgggttggtatgacgaaaagtttctgggaagacgatgagcgttatgtgaacacatattggtcacgttttgaaaataaatgggttcatggtgactgggtggtttatgatggtgagcaatatattattacaggacgctcagatgatacgctaaacattgctggaaaacgcattggacctgctgaatatgaatctattcttgtgaagcataatgatgtcatagaagctgccgcgattggtgtaccagatgatgtaaaaggtgaagtttgtcattgttttgtagtattaagagataatgtaacatttacaggagaattaaagaaagaattaatgagtttagtaaactctcatattggaaaagcattatgtccaaaagatattcacgttgtagaagatttaccgaaaacgcgtaattctaaagtaatgcgacgtgtcattaaagctgcttatctagggaaagaattaggtgatttatcatcacttgtaaaccctgaagtagtgccatttattcagggattgcagtctagtaaattataa

SEQ ID NO: 818 - protein, 646 aa, Bacillus thuringiensis serovar konkukian str
MKQAVWFPTEEYKEKTRLYGWMKSLGYEDYETFYNKSIEETAWFWGEAEKAVGYQWMKPYTEVLDLQNGTPFAQWYNGGTCNVVESVLSRWLADDETRTQPALQYEGENGTSKSFTYEELDSWVSRVANGLKHAGIEKGDRVTIYMPMIPETVVAMLAVMKIGAIISPIFSGFASDAVMTRVQAAGSKMIITADGFSRRGKIVSLKDEVDKACEHCPTVEKVVIVRHAGNDFTPHNYDFSWSTLEKEKPFVHAEEMHSDDPLMLIYTSGTTGKPKGTVHTHAGFPLKAAFDAGFGMNIKQGDRVLWVTDMGWMMGPFLLFGSLINGATMVMYEGVPDFPEADRLWETVDKYEITHLGISPTLIRALMAKGDEYVNKHSLKSLEVFASTGEPWNPDPWMWLFEMVGKSNVPICNYSGGTEISGGIFGNVLIKPIAPISFNASLPGMAAVVLDDQGNPIRDEVGELCLEKPWVGMTKSFWEDDERYVNTYWSRFENKWVHGDWVVYDGEQYIITGRSDDTLNIAGKRIGPAEYESILVKHNDVIEAAAIGVPDDVKGEVCHCFVVLRDNVTFTGELKKELMSLVNSHIGKALCPKDIHVVEDLPKTRNSKVMRRVIKAAYLGKELGDLSSLVNPEVVPFIQGLQSSKL

SEQ ID NO: 819 - DNA, 1953 bp, Picrophilus torridus
  CDS (1)..(1953)
atgtatagtttaatgttaaatactataatgagtgagacattaccaacagatgagagatacaatacctcttttagcaggtatcttgatgagtacaggagatccattgagaacacagaggagttctggaatgaaaaatcaaaaataatagaatggttcagggactacgacagggttctggatgattcgaagaagccattttttagatggtttgtcaatggaaaaacaaacgtttcatacaactgccttgacaggcatataaagaccgataaaagaaacaaggttgcatacatatgggtctcagaatcaggaaatgaaaagatagtaacatactacggtttatacagaagggtcaatgcccttgcaaggggacttttaaacatgggccttagaaaaggggatcacgttacaatatacatgccaatgatacttgaggctccggttgcaatgcttgcatgtgccagaataggtgttgtgttcaacgttgttttctctggctttggcgctgaggcacttgcagagagaataaaggattcaagatcaaagatggttataacagctgatggtgcatggcgccgtggaaagatcgttgagttaaaaagcatagttgacagggcacttgagttaaccgagaacgttgagagcgtaatagttgtgaaaaatacaaacaatgagataaacatggaatcagagcgcgatttctattacaatgatattatagaggacggctacgttgaaccagagaaaatggattcaaacgatcctttgtttatattatacacatcgggaacgactggaaagccaaagggcatagtccatggcaacggcggttaccctgtatggatatcaaacacaatgaaatgggcctttgatccaaaggacgaggatagatactggtgcgccgcggatattggctggataaccgggcacagctatattgtctttgcgccgctgctccttggagtaacatcaataatgtacgagggcgcaatagattatccaaagccggatcgtgtctgggatataatagaaaggtacggtgttaacatattatacacgtccccaacggccataagattgttaatgaagtacggagataagtatccaaattcacatgatctgagctcattaaaaacgcttggaactgttggtgagccaataaacccggctgcatggcactggttctatgaggtaataggaaaatcaaggtgtccaataatagatacctactggcagaccgagaccggtggattcacaatagcacctgcgcttggacttggacttcctgatttaaaaccgggctctgcaacatttccgctgcctggaatagatcctgtgatactcgatgacaatggaagggaggtaaagagaaacgagaagggatacattgttttaagaaggccatggcccggtttaatgctaacagtgaacaacgacgataaaaggtacatagaaacctatttttcaaagtttaaggatatgtacttaatgggcgactacgcggtaaaggacgatgatggctacatatggctgcttggccgtgctgacgaggtattaaaggtctcagggcatagaataggaacaatagaaatagaggatgcacttgtatcgatgaaggagatagccgaggcagctgtgttcggaaaacctgatacaataaagggcgatacaataatagcatttgtaacattaaaggagggctatgaaaagagtcctgacctgatagattattttaaaaggaagatcagggaagagcttggaccaatcatggttcctgaggagatacatatagtcgattcactgccaaagacaagatcaggaaagatcatgaggcgtgttataaaggccgtttatctggaccagcttccaggggatatcacaacgcttgaaaacgaggcatctgtagacgagataaaaagggccgttgaggaattaaaaaggtacacaggtgattaa

SEQ ID NO: 820 - protein, 650 aa, Picrophilus torridus
MYSLMLNTIMSETLPTDERYNTSFSRYLDEYRRSIENTEEFWNEKSKIIEWFRDYDRVLDDSKKPFFRWFVNGKTNVSYNCLDRHIKTDKRNKVAYIWVSESGNEKIVTYYGLYRRVNALARGLLNMGLRKGDHVTIYMPMILEAPVAMLACARIGVVFNVVFSGFGAEALAERIKDSRSKMVITADGAWRRGKIVELKSIVDRALELTENVESVIVVKNTNNEINMESERDFYYNDIIEDGYVEPEKMDSNDPLFILYTSGTTGKPKGIVHGNGGYPVWISNTMKWAFDPKDEDRYWCAADIGWITGHSYIVFAPLLLGVTSIMYEGAIDYPKPDRVWDIIERYGVNILYTSPTAIRLLMKYGDKYPNSHDLSSLKTLGTVGEPINPAAWHWFYEVIGKSRCPIIDTYWQTETGGFTIAPALGLGLPDLKPGSATFPLPGIDPVILDDNGREVKRNEKGYIVLRRPWPGLMLTVNNDDKRYIETYFSKFKDMYLMGDYAVKDDDGYIWLLGRADEVLKVSGHRIGTIEIEDALVSMKEIAEAAVFGKPDTIKGDTIIAFVTLKEGYEKSPDLIDYFKRKIREELGPIMVPEEIHIVDSLPKTRSGKIMRRVIKAVYLDQLPGDITTLENEASVDEIKRAVEELKRYTGD

SEQ ID NO: 821 - DNA, 2994 bp, Plasmodium falciparum
  CDS (1)..(2994)
atgaataatttgaagagttatggaagtctatcaaaagtcgactctgttcaaatcaacggtatggatatagatacaaatatttttcttaatatgaattcttaccctaccaaggaaatatatgatgatgagaataataagaatgatggaaatcataacataaaaaatttccaagcatataaagcaatgtatgaagagagtataaataatccagaagctttttggggaaatttagcaaagaataatttaatatggtataaattatttactaaagtatttttaggtaattttaaaaaaggaaatataaattggtttgttaatgggaaaattaatgcttgtgaaaattgtgttgatagatgggttgaaaaagatcctaataaaattgcacttatatgggaacaagattgtccagatcaatataaaaagattacatatcagaaattattagaaaagacttgtaaagtagctaatttattaaaacttattggtgttaaaaaacaagacactgttactatttatttacctatgatacctgaattgatttattctatgctagcttgtgttcgtattggagctattcataatgtagttttcgctggttattcggcagctagcttgagcgatagaataatagattctagatctactgttttaattacttctgattttggattgagaggtgggaaattaaccaaattaaaacaaattgctgatgtagctatggatatgtgtggaatgatacaaacatgcatagtattcaaaaataaaactaaaatgaaagataaaaatatacaaattaaaacacctatggaaaatcctatttataattttacaagttttgattctaatagtgcacaaaattttacaattaataattctaatgattttattcaaataaaatcaactcattcccatcaaagtgatcatcaaaatgatttctctcttcagcaggaagataataattatacaaaaaactctaatatgtcttatactacgagtatgtattatcatgataataatttaaaccatataaacactaataaaaataacgatcattataacaataatttaaataataaaaattatttaaataataatattaatgatcaaagccctatgtatgttcataccatgaaccataatgacaataatgatgataataataataataataataataacaatgtagatgatgataataatagtaatatacaaaatgatgaacaatcttattttaatcaacaaaataatacatataacaaaaatgatcattctgatgacaataataagaataaaggaaaaacaaccttacataaaaaaattacaaaaaataatcctataaatcataaaatttcttactcagaaaaaagttactcaaaagaattaataaacactgacatggtaaataacgataatcaatttggtgatttaaaaacaaaaaaaaaatttataaatattaataatattataacttgtaatcagaatggatattctacaaataaacaatattttcctgaacctgataaaaatagcacaagcaattttgatgaaactttatgtgttttaaaaaaaggaagagatatagatggtactgctttattaaaaaatatgagatcttactgtcctatagaatatgtagatagtgaagatttcttatttttattatatacatctggatcaactggtaaacctaaaggtgttgcacatacaacagctggatatttattatatgcatatacaacatgtaaatatatatttgatgtaaaagaaaatgatatatttggttgtgtagcagatataggttgggttaccggacatacatatgtattgtatggtcctttattaaatggtataactacagttattttttcttctataccaacatatccagattgtggtagatactggagtctaatacaaacacataaagtgacacaattttatacggctccgacagccttaagagcattaatgaaatatggagatgaatggatacaaaaatatgatctatcttcatgtcgtattttgggaagtgtgggtgaaccaatcaatccagaaacatggagatggtattataatgtagtaggtaaaaaaaaatgtacaatagtagatacatattggcaaacagaaacaggtggtatcgttatagcacctataccacatttattcagtatgaaaccaggatgtgctagtttaccattcttaggtgttcaattagaaatattagattcaaaaactttacaacctttaagtggtaataatgtatgtggtttattatgtataaagagcccatggccaggaatgttacgtacagtatatggaaatcatcaaagattaataaaaacatattttaccatgtgtcctaattattattttaccggagatggagcgttcagagatgaagatggatactattggatatctggacgaatcgatgatacattaaatgtagcagggcacagattaggagcagcagaaattgaacatgcactagttcaacatttttatattgctgaagcagctgttgtttcatttcatcataatgttaagggagaaggaattttatgttttgtcgttaaaaaaaaaggagacataaaaaattatagtaaaggtattacagatattgttaatagtaataataacaataatagaaatgaattacataataatagtccatttttgatatgctctaataatattactgatattgaagaatttaaaaaaaattttaccgatgaaaaattaatagaacaactaaaattatatgtaagacaagttattggacccatagcaacacctgacctaatttgtgtggttccagatttgccaaaaaccagaagtggaaaaattgttagaagaatattaagatgtatagcaaatggtataacagatttcggagatatttccactgtctctaattatgaagttattgaaactattaataatacacttattgaatgtaaaaaaaagttaaagcatattgaaattaagaaataa

SEQ ID NO: 822 - protein, 997 aa, Plasmodium falciparum
MNNLKSYGSLSKVDSVQINGMDIDTNIFLNMNSYPTKEIYDDENNKNDGNHNIKNFQAYKAMYEESINNPEAFWGNLAKNNLIWYKLFTKVFLGNFKKGNINWFVNGKINACENCVDRWVEKDPNKIALIWEQDCPDQYKKITYQKLLEKTCKVANLLKLIGVKKQDTVTIYLPMIPELIYSMLACVRIGAIHNVVFAGYSAASLSDRIIDSRSTVLITSDFGLRGGKLTKLKQIADVAMDMCGMIQTCIVFKNKTKMKDKNIQIKTPMENPIYNFTSFDSNSAQNFTINNSNDFIQIKSTHSHQSDHQNDFSLQQEDNNYTKNSNMSYTTSMYYHDNNLNHINTNKNNDHYNNNLNNKNYLNNNINDQSPMYVHTMNHNDNNDDNNNNNNNNNVDDDNNSNIQNDEQSYFNQQNNTYNKNDHSDDNNKNKGKTTLHKKITKNNPINHKISYSEKSYSKELINTDMVNNDNQFGDLKTKKKFININNIITCNQNGYSTNKQYFPEPDKNSTSNFDETLCVLKKGRDIDGTALLKNMRSYCPIEYVDSEDFLFLLYTSGSTGKPKGVAHTTAGYLLYAYTTCKYIFDVKENDIFGCVADIGWVTGHTYVLYGPLLNGITTVIFSSIPTYPDCGRYWSLIQTHKVTQFYTAPTALRALMKYGDEWIQKYDLSSCRILGSVGEPINPETWRWYYNVVGKKKCTIVDTYWQTETGGIVIAPIPHLFSMKPGCASLPFLGVQLEILDSKTLQPLSGNNVCGLLCIKSPWPGMLRTVYGNHQRLIKTYFTMCPNYYFTGDGAFRDEDGYYWISGRIDDTLNVAGHRLGAAEIEHALVQHFYIAEAAVVSFHHNVKGEGILCFVVKKKGDIKNYSKGITDIVNSNNNNNRNELHNNSPFLICSNNITDIEEFKKNFTDEKLIEQLKLYVRQVIGPIATPDLICVVPDLPKTRSGKIVRRILRCIANGITDFGDISTVSNYEVIETINNTLIECKKKLKHIEIKK

SEQ ID NO: 823 - DNA, 2007 bp, Photobacterium profundum
  CDS (1)..(2007)
atgacagtaaacaccgacgatccacacatgctgtggcgcccttcacgggagcgtattcaatccagtttgctctatcaatttatgattcaattaagtgagcaacaaaatacgctgtttcatgattaccaccagctacatcattggtctattacccatagcgacatcttttgggatcaagtttgggatttttctgatgtgataggtcataaaggcgagcccacttgcttaacacccccacaatcaacactgcctgctaaagagacgcagtggtttcctaatgcaacgctgaactttgcagagaatctactcaaaaactggaatcgacatgcagccgcagatgccatcgtatttcattgtgaagggcaaaaagagctgcaacaacgtataagctggcaacagctctatcgtcaaacatcacaactaacccagtttctcgccgctaaaggggttaaaaaaggtgatgtagtcgcaggatacatacccaacatacctcaggccattattgccatgttagctacatcgacattgggcgcaatttggacatcgacgtcacccgactttggtgcagatagtgttgtagagcgatttggtcaaaccaagcccaaagtattattaacggcagacggctatttttataacggaaaatcacacagcagcttagacaatatcacgcaaatgctcgctcaacttcccagcgtcgaacaattgatcgttattccctatactcaggtagatatacgtgaattgacagcttctatccctaaaactatcacgctaactctttggcaaagtgcattagaaccatacgaaccaacagatattcaatttgcaccagtgccttttaaccatccgctgtatatcttgtattcgtctggtacaacaggcaaacccaaatgcattgttcacagcacgggcggtttgctactgaatcaccttaaagaacacaagttacactgtaacacaaggaatggtgatcggattttctatttcacgacatgcggctggatgatgtggaattggttagtcagcgggttagcctctggggctacaatcgtactgtatgacggttcaccattttacccaaatgcgagtgtattatgggatatggcagagcaagaacagctttcattgtttggcacatctgccaaatatttagaagcactcgaaaaacaaaattacagcccaaaccagttccattctttaccacacctacaaacattatgttcaacaggttcagtgcttgcaccagaacaatttgactatgtgtacagccacatcaaatctgatctacagcttgcttctatttctggtggtacagatatttgtggttgctttgctatcggtaatcccttgagtccggtttataaaggagaatgccaaagccaagcattaggtatggatgtacgtgtgttcaatgaacaaggtcaaacagaattaacccaacaaggtgagcttgtttgttgtaatagtttcccaaatcaacctattggtttttggaatgatcctgatggaaagcgctatcacaatgcgtattggaatacctatccgaatacatggcatcacggcgattttgtagcgttaagcagtacgggtggcatggttttctttgggcgttctgatgccgtattaaacccaggcggtgtacgtatcggtacagcagaggtttaccgccaagtaaacccattacacgaaattaccgattcagtggtaataggacaaaactggaagaacgatgtgcgggtggtgttatttgttcagcttgccgatggttacctgttagacgacgcactcaaagccacgatacgccagcgcattaaacaccattgctctccccgtcatatacctgccgttattctgccagttactgatatacctagaaccaaatctggtaagttggtggaacttgccgtgcgtaacatcgtgcataatttgccagtaacaaatataggagccttggcaaacccagcagcattagaagagtataaaggccgtaaagaattaaaataa

SEQ ID NO: 824 - protein, 668 aa, Photobacterium profundum
MTVNTDDPHMLWRPSRERIQSSLLYQFMIQLSEQQNTLFHDYHQLHHWSITHSDIFWDQVWDFSDVIGHKGEPTCLTPPQSTLPAKETQWFPNATLNFAENLLKNWNRHAAADAIVFHCEGQKELQQRISWQQLYRQTSQLTQFLAAKGVKKGDVVAGYIPNIPQAIIAMLATSTLGAIWTSTSPDFGADSVVERFGQTKPKVLLTADGYFYNGKSHSSLDNITQMLAQLPSVEQLIVIPYTQVDIRELTASIPKTITLTLWQSALEPYEPTDIQFAPVPFNHPLYILYSSGTTGKPKCIVHSTGGLLLNHLKEHKLHCNTRNGDRIFYFTTCGWMMWNWLVSGLASGATIVLYDGSPFYPNASVLWDMAEQEQLSLFGTSAKYLEALEKQNYSPNQFHSLPHLQTLCSTGSVLAPEQFDYVYSHIKSDLQLASISGGTDICGCFAIGNPLSPVYKGECQSQALGMDVRVFNEQGQTELTQQGELVCCNSFPNQPIGFWNDPDGKRYHNAYWNTYPNTWHHGDFVALSSTGGMVFFGRSDAVLNPGGVRIGTAEVYRQVNPLHEITDSVVIGQNWKNDVRVVLFVQLADGYLLDDALKATIRQRIKHHCSPRHIPAVILPVTDIPRTKSGKLVELAVRNIVHNLPVTNIGALANPAALEEYKGRKELK

SEQ ID NO: 825 - DNA, 1899 bp, Photobacterium profundum
  CDS (1)..(1899)
atgaataggcgaaaggagaccactatgtcagcctatcaggatgcatttgattttgccgccaacgagccagaactcttttggaaacaacaagcacagtctatttcttggtttcgatttcccgaaacaatattaagcaatgatgagaacggtatagagcgctggtttgccgacggtgagctcaatactgcgtacttagcattagattatcatgtcgataatggccgaggtgatcaaactgcccttatttatgactcccccgttacgggaaaaaaggcgcgctatagttaccgtgtattacgggatcaagtcgcgaaaacggctggtatgctggcaagcttaggggtcgaaaaaggtgatcgagttgtaatctatatgccgatgatccctgaagcggccatggcaatgttagcgtgtgcccgattaggggcgattcactccgtggtatttggcgggtttgcacccagtgagcttgccgttcgtatagaagatgctgaaccgaaagtcgtattaacagcatcatgcggtgttgaagtcagtaaagttattccttataaaccgctggtggatcaagcggtaatggatagtcgctggaaacccgatagtgtcgtggtattccaacgaaaagaatgccttgcagatttaaatcaagcccgagatatcgattgggtaacgttattcaaccgttctgcacctcatgattgtgtgccagtaaaagcgacagatcctctgtacattttatatacatcaggcacaaccggaaaacccaaaggtgtggtgcgtgataacggcggacatgctgttgcaatgaaatacagcatggaatcaatttacaatgtaaaaccgggtgaagtgtattgggcggcatctgatatagggtgggttgttggacactcttacattgtttatgcgccgcttattcatggttgtaccacgatcatgtatgaagggaagccagtaaaaacaccggatcctgctgcattttggcgtgtgtgcgaagagtatggtgtgagtattttattttctgccccaacggcatttcgtgcgattaagaaagaagatccaaccggtgcattgctagctgcattcccgatgaaaaaactgcgcactatttttatggctggcgagcggttagatccgccaacccttgaatgggtagaaaccaaaacccaacgccctgttgtcgatcattggtggcaaactgaaacggggtgggcaattgctggcaatcctttgggtctagaaaaattcgacttaaaaccgggctcagcgaccaaagcgataccgggttatcaagttgaagtgctcaatgagttgggtgaacagcaagccatgaatgaacaaggctatatcgcgataaaacgccccctaccgccaagttgtttaccgaccgtatggcgtaaccatgatcgctttgaatcagggtatttaagccagtttccgggttattatgtatcgggtgatggtggttatattgatgaagatggctatctgtttgtgatggggcgtattgatgatgtgattaatgtggctgggcaccgcttatcgactggagaaatggaagaagtagtaggtgcccatgaagctgttgccgagtgtgctgttattggtatacacgatgatctaaaagggcagctaccattaggcttggtggtattaaaagacggttatgtctctgaaaatggcgctattgaggcagaattattgcagcaagttcgcgcaaaaataggcgcggtggcgtgctttaaacgtgcgttaattgtcgatcgtttaccgaaaacccgttcgggtaaaatactgcgtcgtgttattcgccaaatcgcagatggagaacaatatgtcgtaccatcgactatcgatgatccatcaagcttgaatgaaatagaaaaggcactttattaa

SEQ ID NO: 826 - protein, 632 aa, Photobacterium profundum
MNRRKETTMSAYQDAFDFAANEPELFWKQQAQSISWFRFPETILSNDENGIERWFADGELNTAYLALDYHVDNGRGDQTALIYDSPVTGKKARYSYRVLRDQVAKTAGMLASLGVEKGDRVVIYMPMIPEAAMAMLACARLGAIHSVVFGGFAPSELAVRIEDAEPKVVLTASCGVEVSKVIPYKPLVDQAVMDSRWKPDSVVVFQRKECLADLNQARDIDWVTLFNRSAPHDCVPVKATDPLYILYTSGTTGKPKGVVRDNGGHAVAMKYSMESIYNVKPGEVYWAASDIGWVVGHSYIVYAPLIHGCTTIMYEGKPVKTPDPAAFWRVCEEYGVSILFSAPTAFRAIKKEDPTGALLAAFPMKKLRTIFMAGERLDPPTLEWVETKTQRPVVDHWWQTETGWAIAGNPLGLEKFDLKPGSATKAIPGYQVEVLNELGEQQAMNEQGYIAIKRPLPPSCLPTVWRNHDRFESGYLSQFPGYYVSGDGGYIDEDGYLFVMGRIDDVINVAGHRLSTGEMEEVVGAHEAVAECAVIGIHDDLKGQLPLGLVVLKDGYVSENGAIEAELLQQVRAKIGAVACFKRALIVDRLPKTRSGKILRRVIRQIADGEQYVVPSTIDDPSSLNEIEKALY

SEQ ID NO: 827 - DNA, 1950 bp, Photobacterium profundum
  CDS (1)..(1950)
atgagtgaagttcatgtttatccagtcaatcaagagattgcagctacagcccacgtaaatgatgaacaatatcgtgagatgtaccagcaatcggtgatcaaccctgaaggtttctggcgtgaacacggtcagattgtagactggatcaaaccattcactaaagtgaagcacacttcttttgatactggccatgtcagcgttaagtggtttgaagatggcacgctgaacgtttcggcaaactgtattgaccgccacctcgcgacccgcggcgatcagcccgcgatcatttgggaaggcgacgatcctaccgatgatgccacatttacgtataacgaattacacgaacaagtctgtaagttctctaacgcactgaaaagccaaggcgtacgcaaaggcgatgtagtgtgtctttacatgccaatggtggcagaagcggcaattgctatgctggcttgcacacgaatcggggcggtacataccattgtatttggtggtttctctccagaagcgcttgctggccgtattgttgattccaacgcaaagctcgtgattactgccgatgaaggcgttcgggctggccgtgctgtaccactgaaaaagaatgtggatgatgccttagccaataaaaatgtcacgagtatcgaaaaagtcatcgtacttaagcgtactggcggtaatgttgaatggcacagcgagcgggatgtgtggtggcatgaagcaacagcagtcgcatcttctcactgtgagcctgaagaaatgaatgcagaagatcctcttttcattctatatacctcaggatcaacaggtaaacctaaaggtgttcttcacacaacaggtggttacttagtgtatgccaccatgacctttaaatatgttttcgattaccaagaaggcgatgtgtactggtgtaccgccgatgtcggttggattaccggtcacagttacttggtatatggcccgctggccaacggtgcaacaaccgtgctatttgaaggtgtgccaaactacccatcaaccagccgtatgagtgaagtggttgataagcataatgtcagtattctttatactgcaccaacagccatccgtgcattaatggcaaaaggcacagaagcgattaaaggtacgtcacgatcctcactgcgtattatgggatcagtcggcgagcccattaaccctgaagcatgggaatggtatcaccataccattggcgacagccgttgccctattgttgatacatggtggcaaacagaaacaggcggtatcttaattacgccattacctggcgcgacagcgctaaaacctggttctgccactcgtccatttttcggtgttcagccagccatcgttgataatatggggaatatcttagaaggtgtcgctgaaggtaacttggttatggttgattcatggcctgggcagatgcgtactttatggggtgaccatgaacgcttcgaacaaacttacttctcaaccttccaaggtatgtatttcaccggtgatggcgcacgtcgtgatgaagacggttactactggatcactggtcgtgtcgatgacgtcttgaatatctcaggccaccgtatgggtacagctgaaattgaatccgcattagtggctttcgataagatagcagaagctgcgattgttggggtgccacacgatattaaaggccaagcaatttatgcttatatcacgctgaatgatggtgaaatacccagcgctgagctgcataaagaagtgaaagattgggtacgtaaagaaattggtcctattgcgacccctgacttcctccattggaccgatgccttaccgaaaacacgttcgggtaaaattatgcgccgaattctccgtaagattgccacgggtgatactggaagtttgggtgatacatcaacgctcgctgaccctagcgtggttgataaactgatcgcagaaaaacaaactattttataa

SEQ ID NO: 828 - protein, 649 aa, Photobacterium profundum
MSEVHVYPVNQEIAATAHVNDEQYREMYQQSVINPEGFWREHGQIVDWIKPFTKVKHTSFDTGHVSVKWFEDGTLNVSANCIDRHLATRGDQPAIIWEGDDPTDDATFTYNELHEQVCKFSNALKSQGVRKGDVVCLYMPMVAEAAIAMLACTRIGAVHTIVFGGFSPEALAGRIVDSNAKLVITADEGVRAGRAVPLKKNVDDALANKNVTSIEKVIVLKRTGGNVEWHSERDVWWHEATAVASSHCEPEEMNAEDPLFILYTSGSTGKPKGVLHTTGGYLVYATMTFKYVFDYQEGDVYWCTADVGWITGHSYLVYGPLANGATTVLFEGVPNYPSTSRMSEVVDKHNVSILYTAPTAIRALMAKGTEAIKGTSRSSLRIMGSVGEPINPEAWEWYHHTIGDSRCPIVDTWWQTETGGILITPLPGATALKPGSATRPFFGVQPAIVDNMGNILEGVAEGNLVMVDSWPGQMRTLWGDHERFEQTYFSTFQGMYFTGDGARRDEDGYYWITGRVDDVLNISGHRMGTAEIESALVAFDKIAEAAIVGVPHDIKGQAIYAYITLNDGEIPSAELHKEVKDWVRKEIGPIATPDFLHWTDALPKTRSGKIMRRILRKIATGDTGSLGDTSTLADPSVVDKLIAEKQTIL

SEQ ID NO: 829 - DNA, 1674 bp, Methanococcus maripaludis
  CDS (1)..(1674)
atggtatcattacttaataaatttgttaaaaagacggaatttgagtcatatgaagattttgtggaaaatttcaagatagatgttccagaaaatttcaattttgcttacgatatcgttgacgaatatgcaaaaattgcaccggaaaagattgcaattatatggtgtgacgataacaacgacgaaaaaatctttacattcaaagatatgaaaaaatacagtgataaagcagctaatttctttttaaaacacggaattaaaaagggagacactgtaatgctcacattaaagagcaggtacgaattctggttctgcatgcttggacttcataaaattggggctgtcgcaattcctgcaacacacatgcttacaacaaaagatatcgtgtacaggattgaaaaagcaggcttaaaaatgatagtctgtatcggagaaaacggagttcccgactacgttgatgaagcagtatctgaaattaattcagatgttttaaaagcatgtgtttcaaatttaaacaatgatagttggattgatttttcaaaagaattggaagaatcatcagaagactttacaaggcctgttggagaaatggatactaaaaatgacgatgtattagttgcatatttttcatcaggaacaacaggatatccaaaattaattcagcacgaccacgaatatcctttaggacatattacgactgcaaaatactggcaaaatgttgaagacgatggacttcactacactgttgcagacagtggatgggcaaagtgtatccggggaaaactctacggacagtggattgcaggaactgcagtatttgtctacgactacgacagatttgatgcaggaaatatgcttgaaaaaattgcaaaatataaaattacaacgttctgcgcaccacctacaatttacaggttcatgatcaaacaggatatttcaaaagcagacttttcaagtttacactacgcagtaactgctggagaaccgctaaaccctgaagtttacaacaaatttttggagtttactgggcttagattaatggaaggatttggtcagaccgagaccgttgtatctgttgcaaactttacatggatggatccaaaacccggatcaatgggaaaaccagtgccaatttttgatttaatgataaaagggccagatggaaaagaatgcgatgtgggtgaagaaggagaacttgcattcaaaacagaagatggaaaacctcttggtcttttctcaggatactttaaagaccctgaaagaactaaaaaagcctggtacgatggatattaccatactggggatactgcatggaaagatgaagatggatacctctggtttgttggaagaaacgacgatttaatcaaaagttccggttacagaatcggtcctttcgaagtagaaagtgcacttatttcacaccctgcagtacttgaatgtgcaataactggagtaccggacccagtaaggggccagattgttaaagctacaattgttttaacgtctgaatatgaagcaagtgaggaacttaaaaaagaacttcaagaccacgttaaacacaacactgccccatacaaataccctcgagctattgaatttgtaaaagaactcccaaaaacaatcagcgggaaaatcaggcgtgtagaaatccgggaaactgatgaaaaaaataaataa

SEQ ID NO: 830 - protein, 557 aa, Methanococcus maripaludis
MVSLLNKFVKKTEFESYEDFVENFKIDVPENFNFAYDIVDEYAKIAPEKIAIIWCDDNNDEKIFTFKDMKKYSDKAANFFLKHGIKKGDTVMLTLKSRYEFWFCMLGLHKIGAVAIPATHMLTTKDIVYRIEKAGLKMIVCIGENGVPDYVDEAVSEINSDVLKACVSNLNNDSWIDFSKELEESSEDFTRPVGEMDTKNDDVLVAYFSSGTTGYPKLIQHDHEYPLGHITTAKYWQNVEDDGLHYTVADSGWAKCIRGKLYGQWIAGTAVFVYDYDRFDAGNMLEKIAKYKITTFCAPPTIYRFMIKQDISKADFSSLHYAVTAGEPLNPEVYNKFLEFTGLRLMEGFGQTETVVSVANFTWMDPKPGSMGKPVPIFDLMIKGPDGKECDVGEEGELAFKTEDGKPLGLFSGYFKDPERTKKAWYDGYYHTGDTAWKDEDGYLWFVGRNDDLIKSSGYRIGPFEVESALISHPAVLECAITGVPDPVRGQIVKATIVLTSEYEASEELKKELQDHVKHNTAPYKYPRAIEFVKELPKTISGKIRRVEIRETDEKNK

SEQ ID NO: 831 - DNA, 1911 bp, Methanococcus maripaludis
  CDS (1)..(1911)
atgaaaactggagacaaatacataatgcttgaaaaatattcagaattacagcaaaaagctttggatgaccctgaaaaattctggggagagcaggccaaatgtttagaatgggataaaacttgggataaagcactggactggaatcctccttatgcaaaatggtttaaaggcggcagtttgaatgcaagctacaactgtgttgataggcacataaaaggaaacaggagaaataaagctgcgataatttgcgaaaaagaggatgggagctgcggaattttaacttattacgagttatatcgggaagtaaataaatttgcaaacgttcttgagaatctgggcgttgaaaaaggcgatgttgtcacaatctacatgccgatgatgacagaggcaattattgcaatgctcgcatgttcaagaattggggcaattcacaacgttgtattttctggattttcttcagatgcacttgctgatcggataaacgattcgaaatcaaaaatattggtgactaccaatctcttatacaggcgtggaaaagagattgatcttaaaaaaatattggataaagcattattgaattgtaactcaataaaacacgtagtttatgcaaaaagaggcattgaagaatttaacttagtttctggaaaagagtacttctgggatgaattaatgggcggtgctaaaagctacgtagaaccggttcccgtggagtctgaacacccgctatttattctctacactagcggtacaactggaagtccaaaaggtgtagttcattcaacaggcggatatttaacttatgccacaaaaaccatggattggacatggggattaaatgaaatggatgtattttggtgtactgcagacattggatggattactgggcacacttacgtagtatatggtccgctttcacttggtgcaacgatagtactctacgagggtgcaatagactaccctgaacccgacagattgtggggtattgtagaaaatcatggggttacaattctttatactgcaccaaccgcgataagaatgcttatgatgtacggtgaaaaatgggtaaatactcacgatttatctacattgaggcttttgggaagtgtaggggaacccataaatccaagagcttggaaatggtattacaaagtaattggaaaagaaaaatgtccaatttgcgactgctactggcaaactgaaactggtgggcatattatatatcctccaattggaatccagtcagttccattaaaaccgggttcagcaacattccctggaatcggaattgatgttgatgttgtagacaacgaaggaaaccctgttgatgcaaatgtaaaaggaaatctaattataaaacgaccctggccaggaatgcttgcaggactctggaacaacgatgaaagataccgtgcggcatattgggataggttcaaaaacaaattttcaacatctgactatgcaataaaagatcaggatggatacatttgggtactaggacgatctgacgaagtattgaatgtttcaggacacaggattggaaccgcagaactcgaacacgaacttgtatcaaataaaatggttgcagagtctgcagtagtcggaaaaccagacgatgtgaaaggagaagttcctgttgcatttgttatattaaacgaaaaataccgtgaacttccatcaaatgaagtaaaggctgaacttatcaaacatattcgagatactgtaggcccaattggaactcctgcaatgatattctttgtaaacaaacttccaaaaacaagaagtggaaaaataatgagaagaatattgaaaaaactcataatgggcgaagagataggcgatgttaccacattggaagacaatacaagtttagaagaagttaaaaaagagcttgaagatttcaagtatgattaa

SEQ ID NO: 832 - protein, 636 aa, Methanococcus maripaludis
MKTGDKYIMLEKYSELQQKALDDPEKFWGEQAKCLEWDKTWDKALDWNPPYAKWFKGGSLNASYNCVDRHIKGNRRNKAAIICEKEDGSCGILTYYELYREVNKFANVLENLGVEKGDVVTIYMPMMTEAIIAMLACSRIGAIHNVVFSGFSSDALADRINDSKSKILVTTNLLYRRGKEIDLKKILDKALLNCNSIKHVVYAKRGIEEFNLVSGKEYFWDELMGGAKSYVEPVPVESEHPLFILYTSGTTGSPKGVVHSTGGYLTYATKTMDWTWGLNEMDVFWCTADIGWITGHTYVVYGPLSLGATIVLYEGAIDYPEPDRLWGIVENHGVTILYTAPTAIRMLMMYGEKWVNTHDLSTLRLLGSVGEPINPRAWKWYYKVIGKEKCPICDCYWQTETGGHIIYPPIGIQSVPLKPGSATFPGIGIDVDVVDNEGNPVDANVKGNLIIKRPWPGMLAGLWNNDERYRAAYWDRFKNKFSTSDYAIKDQDGYIWVLGRSDEVLNVSGHRIGTAELEHELVSNKMVAESAVVGKPDDVKGEVPVAFVILNEKYRELPSNEVKAELIKHIRDTVGPIGTPAMIFFVNKLPKTRSGKIMRRILKKLIMGEEIGDVTTLEDNTSLEEVKKELEDFKYD

SEQ ID NO: 833 - DNA, 1938 bp, Bdellovibrio bacteriovorus
  CDS (1)..(1938)
atgcacaaagaactttatcccgtgaattccgaggtggcgaaaaaagcctggattgatgaagccaaatacaaagccatgtatgagcgctccattcaagacaacgaagccttttgggccgagcaagccgagcgcctggactggatcaaaaagtgggataaggtcaaagaagtcagtttcaagaaacccgttagcatcaaatggtacttgggtggaaaaatgaatgtgtcctacaattgcgtggaccgtcatttaaaaacccgcggcgacaaaacagccctgctgtgggaagccgacaatccatccacaccttcacgcaaaatcacttacaaagaactgcatctggaagtgtgccgcttcgccaatgtcctgaaaaaaatgggcgtgaaaaaaggcgatgtggtgacgatctatatgccgatgattccggatacagccgtggcgatgctggcctgtgcgcgcatcggggcggttcattcggtggtgtttgccggtttttctccggattccatctcagatcgtattttggacgggcagtgccggtttgtgatcaccggtgatgccggcttccgcggcagcaaagtggtggcgttaaaagaaaatatcgataaagcacttgtgaaaactccggacgtgcaaaaagttctggtggtgaaatatgcgggcacgacggtggacatgaagccgggccgtgatctttggtatcacgaagaagtcaaaaccgtcagcgaccagtgtgaaccagaacccatggacgcggaagatcctttgtttattctttacacttccggttccacaggaaaacccaaaggggtgatgcacaccacggggggatatctggtgtatgccagcatgacccaccagtatgtctttgattatcacgaagatgatatctactggtgttctgctgacgtgggttgggtgaccggccatagctatatcgtgtatggcccgctggcgaatggggcgacaagtttgttctttgaaggggtgccgaactatccaactccaagccgtttctgggaagtggtcgacaaacacaaagtcacaatattctatacctcaccaacggcgattcgttctttgatgcgcgaaggggacgcggcggtgaaaaccacctcgcgaaaaaccctgcgcctgctggggtccgtcggggagccgatcaatccggaagcctgggcatggtatcacgatgtggtcggtgaaggacgctgcccggttgtcgatacatggtggcagacagaaaccggtggcattctgatcacgccactgccgggggcgattgcgcaaaagccggggtctgcaactttaccgttctttggggtgcaaccgaaacttttgaccaacgaaggacaagagatccatggaccgggcgaaggggtgctggtgattgcggattcctggccgggccagatgcgcacggtgtatcgcaatcacgaacgttttgaagacacgtatttctcgaactatcccgggtactatttcacaggcgacggctgtcgtcgcgatcaggacgggtattactggatcacgggacgggtggatgacgtgatcaacgtttccggtcaccgcctggggacggctgaaattgaatcagcgcttgtggcccatcacaaagtggctgaagccgccgtggttggatatccacatgatatcaaagggcaggggatttatgcctttgtcaccttgaagtccggtgaaacggccagtgaagagctgcgtaaagagctgattcagaccgtgcgtaaagagatcgggccgattgcgactccggatctgattcagtgggctccacgtctgccgaagacccgttctggcaagattatgcgccgaatcctgcgtaaaatcgccgagaaccacccggatcaactgggggatacgacaaccttgtcagagcctgcggtggtccaagaactggtggacaatcgcatgaaccggtga

SEQ ID NO: 834 - protein, 645 aa, Bdellovibrio bacteriovorus
MHKELYPVNSEVAKKAWIDEAKYKAMYERSIQDNEAFWAEQAERLDWIKKWDKVKEVSFKKPVSIKWYLGGKMNVSYNCVDRHLKTRGDKTALLWEADNPSTPSRKITYKELHLEVCRFANVLKKMGVKKGDVVTIYMPMIPDTAVAMLACARIGAVHSVVFAGFSPDSISDRILDGQCRFVITGDAGFRGSKVVALKENIDKALVKTPDVQKVLVVKYAGTTVDMKPGRDLWYHEEVKTVSDQCEPEPMDAEDPLFILYTSGSTGKPKGVMHTTGGYLVYASMTHQYVFDYHEDDIYWCSADVGWVTGHSYIVYGPLANGATSLFFEGVPNYPTPSRFWEVVDKHKVTIFYTSPTAIRSLMREGDAAVKTTSRKTLRLLGSVGEPINPEAWAWYHDVVGEGRCPVVDTWWQTETGGILITPLPGAIAQKPGSATLPFFGVQPKLLTNEGQEIHGPGEGVLVIADSWPGQMRTVYRNHERFEDTYFSNYPGYYFTGDGCRRDQDGYYWITGRVDDVINVSGHRLGTAEIESALVAHHKVAEAAVVGYPHDIKGQGIYAFVTLKSGETASEELRKELIQTVRKEIGPIATPDLIQWAPRLPKTRSGKIMRRILRKIAENHPDQLGDTTTLSEPAVVQELVDNRMNR

SEQ ID NO: 835 - DNA, 1911 bp, Rhodopseudomonas palustris
  CDS (1)..(1911)
atgactatccatgacaacagccgttaccgcgaggttcatgcccgctcgctggccgacccggagggattctggggagaggtcgcgaaagagatcgactggatcacgccgcccaccaaggtgttcgatccctcgctcggcctgtatggccgctggtttcccggcgccaaggtcaacacttgctacaacgccctcgatcgccacgtcgcgaacggccgcgctgatcagctcgcgctgatccacgactcgccgctgaccggcacggtgagcaaatacacttacgccgagatgctgcgcgaagtgcagacgctcgccgccatcatgcaggacttcggcgttcagaagggtgaccgcgtcattctctatatgccgatggtaccggaatcgatggtggcgatgctggcctgcgcccgcatcggcgcggtgcattcggtggtgttcggtggcttcgccgccaaggagctcgccacccgcatcgaagacgccaagccgaagctgatcctgtcggcgagctgcggcatcgagccgggacgcatcgtcaagtacaagccgctgctcgatgaagcgattgaactcgcctcggtgaagccggaagcttgtatcatcctcaagcggccgcagcaggattgcgagctgaaggcgggccgcgatcacgactgggcgagcttgcgcgagcaggcgctggcggccggcaagaaggccgactgcgtcgcggtcgatgcgaccgacccactctacatcctctacacatccggcacgaccggtaagccgaagggcgtggtccgcgacaatggcggccatctcgtcgcgctgaagtggacgatggaaaacctctacggcatcaaacccggcgaggtgtggtggtgcgcctccgatatcggctgggtggtcggccacagctacatcatctacggtccgctgatccacggcgcgacttcgatcatgtatgaaggcaagccggtcggcacccctgatgctggcgcgttctggcgggtgatttccgagcacggcgcggtggcgttgttcacggcgccgaccgcgttccgcgccatccgcaaggaagacggcgacgggagcttcatccgcaaatacgacctgtcgaaattccgcacgctgttcctggcgggcgaacgtgccgatccgccgacggtggaatgggccgagcagcaattgcaggtgccggtgatcgatcactggtggcagaccgaaaccggctggtgcatcgccggcaatccggtcggccttggcctgctgccggtcaagcacggctcgccgacggtgccgatgcccggctacaagctcgaggtcgtcgacgagggcgccaagccggtgccggccggaacgatgggctcgatcgtgatcaagctgccgctgccgcccggcaatctgccgacgctgtggcagcaggacgagcgctgccgcgagagctacttcgccgacttccccggctactacaagacttccgacgccggctatgtcgatgaagacggctatgtcttcgtgatgggccgcaccgacgacatcatcaacgtcgccggccaccggctgtcgaccggcggcatggaagagatccttgcgtcgcatccggacgttgccgaatgcgcggtgctcggcatcaacgatccgatcaagggcgaggtaccgtgcggcctgatcgtgctgaagagcggcgtcacccgcgatccggccgaaatcgagaaggagatcgtcaagctggtgcgcgacaagctcggcccggttgcggcgttcaagctcgcgatcaccgtgccgcggttgccgaagacccgctccggcaagatcttgcgcggcaccatcaagaagatcgccgacggcgatacctggacgatgccggccacgatcgaagatccgaccgcgctcgacgacatctcctcggcgctgaagagccatagctga

SEQ ID NO: 836 - protein, 636 aa, Rhodopseudomonas palustris
MTIHDNSRYREVHARSLADPEGFWGEVAKEIDWITPPTKVFDPSLGLYGRWFPGAKVNTCYNALDRHVANGRADQLALIHDSPLTGTVSKYTYAEMLREVQTLAAIMQDFGVQKGDRVILYMPMVPESMVAMLACARIGAVHSVVFGGFAAKELATRIEDAKPKLILSASCGIEPGRIVKYKPLLDEAIELASVKPEACIILKRPQQDCELKAGRDHDWASLREQALAAGKKADCVAVDATDPLYILYTSGTTGKPKGVVRDNGGHLVALKWTMENLYGIKPGEVWWCASDIGWVVGHSYIIYGPLIHGATSIMYEGKPVGTPDAGAFWRVISEHGAVALFTAPTAFRAIRKEDGDGSFIRKYDLSKFRTLFLAGERADPPTVEWAEQQLQVPVIDHWWQTETGWCIAGNPVGLGLLPVKHGSPTVPMPGYKLEVVDEGAKPVPAGTMGSIVIKLPLPPGNLPTLWQQDERCRESYFADFPGYYKTSDAGYVDEDGYVFVMGRTDDIINVAGHRLSTGGMEEILASHPDVAECAVLGINDPIKGEVPCGLIVLKSGVTRDPAEIEKEIVKLVRDKLGPVAAFKLAITVPRLPKTRSGKILRGTIKKIADGDTWTMPATIEDPTALDDISSALKSHS

SEQ ID NO: 837 - DNA, 1692 bp, Rhodopseudomonas palustris
  CDS (1)..(1692)
atgagcaacacccatcctgcggtcgcagccattgaagattatgccgacgtcctggcgcggtttcgccgcgaggacctcgaagccctgttcgacggcaacttcgcgaccggcatcaacgtctgcatcgaatgctgcgaccgtcacgtcgccggcggcggcaccgcactggattgggagagccaggacggccgcaccgcttccttcagctttgccgagatgaaggactatgcggcccgagtcgccaatctgctggtcgcgcagggcgtgaagcccggcgacgtcgtcgccggcatgctgccgcggacgcccgaactgctggcgctgatcctcggcacctggcgcgccggcgcggtgtatcagccgctgttcaccgcgttcggtccgaaggcgatcgaacaccgcgtcaagatgagcgccgccaagctggtggtcaccgatctggccaaccgcgccaagctcgccgacgtcgccgattgcccgaccgtcgcgatcgtgctccggcccggcgagaccgcgccgctcggcgatctcgatttccatgccgagatcgcggcgcaatcgaccgaattcgcgccggtgctgcgcaagggcaccgacctgttcctgatgatgtcgacctccggcaccaccggtctgccaaagggcgtgccggtgccgatcaacgcgttgccggcgttctattcgtatatccgcgatgcggtcgatctgcgcgcgggcgatatcttctggaacatcgccgatccgggctgggcctatggcttgtactacgcggtcactggcccgctgctgcacggccacgccaccaccttctacgacggtccgttcaccgccgagagcacctacggcctgatcaagcgtcgcggcatcaccaacctcgccggtgcgccgaccgcgtatcggctgctgatcgcagcgggtccggaagcggcggcgccggtgaagggccagctccgcgtcgtctctagcgccggcgagccgctcaatcccgaagtgatccgctggtttgccgagcatctcgccgcgccgatccacgatcattacggccagaccgaactcggcatggtggtcaacaatcaccaccgcctgcgacacaccgtgcatccgggttccgccggtctcgcgatgccgggcttccgcgtcgcggtgctcgacgagcacagcaacgaactgccgccgaacgtcccgggcgtgctcagcgtcgatttgaagcgttcgccgctgatgtggttctccggctactggcagcaggagacgccggcgatcgaaggcggttactaccgcaccggtgacaccgtcgaactggagccggatggctcgatcagcttcgtcggccgggccgacgacgtcatcacctcgtcgggctatcgtatcggtccgttcgacgtcgagagcgcgctgatcgagcacgccgcggtgatcgaggcggcggtgatcggcaagcccgatcccgagcgcaccgagatcgtcaaagcctatgtggtgctcgccaaggacgtgacgccgagcgaggcgctggccgaggagctgcggcaatacgtcaagaagcggctctccgcgcacgcctatccgcgcgagatcgaattcctggagcaactcccgaagacgccgagcggcaagctgcagcgcttcatcctgcgcaagcgcgacaccgaaccggcgggcacgacccagggctcttcttctgcagcttga

SEQ ID NO: 838 - protein, 563 aa, Rhodopseudomonas palustris
MSNTHPAVAAIEDYADVLARFRREDLEALFDGNFATGINVCIECCDRHVAGGGTALDWESQDGRTASFSFAEMKDYAARVANLLVAQGVKPGDVVAGMLPRTPELLALILGTWRAGAVYQPLFTAFGPKAIEHRVKMSAAKLVVTDLANRAKLADVADCPTVAIVLRPGETAPLGDLDFHAEIAAQSTEFAPVLRKGTDLFLMMSTSGTTGLPKGVPVPINALPAFYSYIRDAVDLRAGDIFWNIADPGWAYGLYYAVTGPLLHGHATTFYDGPFTAESTYGLIKRRGITNLAGAPTAYRLLIAAGPEAAAPVKGQLRVVSSAGEPLNPEVIRWFAEHLAAPIHDHYGQTELGMVVNNHHRLRHTVHPGSAGLAMPGFRVAVLDEHSNELPPNVPGVLSVDLKRSPLMWFSGYWQQETPAIEGGYYRTGDTVELEPDGSISFVGRADDVITSSGYRIGPFDVESALIEHAAVIEAAVIGKPDPERTEIVKAYVVLAKDVTPSEALAEELRQYVKKRLSAHAYPREIEFLEQLPKTPSGKLQRFILRKRDTEPAGTTQGSSSAA

SEQ ID NO: 839 - DNA, 1953 bp, Rhodopseudomonas palustris
  CDS (1)..(1953)
atgtccgagaagatctacgacgtgcccgcagagtgggcgagccgcgccttcgtcgacgacgccaaatatcgccagatgtacgagcgctcggtcacggatccgaccggattctgggcggagcacgccaagcgcgtcgactggatcaaggcgccgaccaagatcgacaactggtcgttcgcgcccggcaacgtttcgatcaagtggttcgaggacggcgtcctcaacgccgcctacaactgcatcgaccgccacctcgacaagcgcggcgaccaggtcgcgatcatctgggaaggcgacgatccttcgcagtcgcgcagcatcacctatcgcgagctgcacgacgaggtctgcaagttcgccaacatcctgcgcaaccgcaatgtcggcaagggtgaccgcgtcaccatctatctgccgatgattccggaagccgcgttcgcgatgctggcctgcgcccggatcggcgcgatccactcggtggtgttcgccggcttctcgcccgacagcctcgcgggccgcatcaacgactgcaactcgaagatcgtcatcaccgccgacgaaggcctgcgcggcggccgcaaggtgccgctgaaggccaatgtcgacgcggcgctgaagaagtgcgagggcgtcgactgggtgatggtggtcaaacgcaccggcgccgcggtcgaaatggatgacgtccgcgacttctggtaccacgaagccgccgaggtggtgacgaccgagtgcccggtcgagcacatgcatgccgaagacccgctgttcatcctctacacctcgggctcgaccggccagccgaagggcgtgctgcataccaccggcggctatctggtgttcgcgtcgatgacgcaccaatacgtcttcgattatcacgacggcgacatctactggtgcaccgccgacgtcggctgggtcaccggccacagctacatcctgtacgggccgctcgccaacggcgccacgacgctgatgttcgaaggcgtgccgaactatccgaccaattcccggttctgggaagtgatcgacaagcacaaggtcaacatcttctacaccgcaccgaccgcgatccgcgcgctgatgcaggccggcgacgagccggtgaagaagacctcgcgcaagtcgctccgcctgctcggctcggtcggcgagccgatcaatccggaagcctgggagtggtaccaccgcgtcgtcggcgaggaccgctgcccgatcgtcgacacctggtggcagacggagaccggcggcatcctgatcaccccgctgcccggcgccaccaagctgaagcccggctctgcgacccggccgttcttcggcgtggtacccgagatcctcgatccggaaggcaacgttctggaaggcgaatgcaccggcaacctctgcctcgcccgctcctggccgggacaaatgcggaccgtgtacggcgaccatgcccggttcgagcagacctacttctcggcctacaagggcaagtacttcaccggtgacggctgccggcgcgacaccgacggcttctactggatcaccggccgggtcgacgacgtcatcaacgtctcgggtcaccgcatgggcaccgccgaggtcgaatcctcgctggtggcgcatccgaaggtgtccgaggcggcggtggtcggctatccgcacgacatcaagggccagggtatctacgcctatgtgaccctgatggccggcgaagagccgaccgaggagctgcgcaaggaactggtcgcctgggtccgcaaggacatcggcccgatcgcctcgcccgacctgatccagttcgcgcccggcctgcccaagacccgctccggcaagatcatgcgccgaatcctacgcaagatcgcggaggacgaaccgtcctcgctcggcgacacctcgacgctggccgatcccgcggtggtcgacgatctggtcgagcatcgccagaacaagcaccacaaggcgagctga

SEQ ID NO: 840 - protein, 650 aa, Rhodopseudomonas palustris
MSEKIYDVPAEWASRAFVDDAKYRQMYERSVTDPTGFWAEHAKRVDWIKAPTKIDNWSFAPGNVSIKWFEDGVLNAAYNCIDRHLDKRGDQVAIIWEGDDPSQSRSITYRELHDEVCKFANILRNRNVGKGDRVTIYLPMIPEAAFAMLACARIGAIHSVVFAGFSPDSLAGRINDCNSKIVITADEGLRGGRKVPLKANVDAALKKCEGVDWVMVVKRTGAAVEMDDVRDFWYHEAAEVVTTECPVEHMHAEDPLFILYTSGSTGQPKGVLHTTGGYLVFASMTHQYVFDYHDGDIYWCTADVGWVTGHSYILYGPLANGATTLMFEGVPNYPTNSRFWEVIDKHKVNIFYTAPTAIRALMQAGDEPVKKTSRKSLRLLGSVGEPINPEAWEWYHRVVGEDRCPIVDTWWQTETGGILITPLPGATKLKPGSATRPFFGVVPEILDPEGNVLEGECTGNLCLARSWPGQMRTVYGDHARFEQTYFSAYKGKYFTGDGCRRDTDGFYWITGRVDDVINVSGHRMGTAEVESSLVAHPKVSEAAVVGYPHDIKGQGIYAYVTLMAGEEPTEELRKELVAWVRKDIGPIASPDLIQFAPGLPKTRSGKIMRRILRKIAEDEPSSLGDTSTLADPAVVDDLVEHRQNKHHKAS

SEQ ID NO: 841 - DNA, 1959 bp, uncultured bacterium 314
  CDS (1)..(1959)
atgaataatcaactttggaagattaaaaaagaagaattaaataaaactaatttttttttatattctaattttattaaacaaaattttaaaattgatacaggtaatgattttaataaaatttggaaatggtctgtcgataatacggaaattttttggaaatcaatttgggatttcacaaaagtcaaaggtgttttaggaaagaatttgcttcaaaaatcgaatattttttataataataaattttttcctgacactaaacttagttatgcagaaaacttacttaaaaaaaataacacaacacccgctattatatttaaaagtgaaaacggctatagaactgcactttcttggaaagatctaaatttaaatgttgcaaaaatttcagattggatgcgagctaatggactacaaaaaggagatagagtggcagcctatctcccaaatataccagaaacagtaacagcttatctcggaacatctgctgtaggagcaatatggtcttcatgctcacctgactttggaacagttggagttatagacagattttctcaaataaatccaaaaatattatttattggtgacaagtatttttataacggaaaaacaatcaatattgccgaaagattaaaagaaataatgagtaaaatacctacaattgttaaagttgtaattgtgtcctatccaggcacagaaattgaaaaaaaagataatcttaaagtagatatatatcgttggcatgaaatcatggctttaaaaaaggaaaataatattcaatatgaaatgtcgtattttaatgatcctctcgcaattctttactcaagtggcacaacgggaaaaccaaagtgtatttgtcatggaactggagggattttgcttcagcataataaggaattacaaatacattgtgatgtgaaagaaaatgatcgtgtgttttattttaccacatgcggatggatgatgtggaattggttagttggttcgctttcatcaggagcaacaattttattatttgatggttttcctttatacaaaaaagacgatttattatttgaatttgccagtgaagaacaaattactctttttggtattagtgctaaatatattgatactcttagcaataataaggtagttccaaaaaataatcacgatatgtcaaaattgaaaactgtttgttcaacaggttctccattatcgattgatggatttagatatatttataaaaatattaaagaagatgttcatttagcgtctattgcaggaggaactgatattgtttcctgttttgttttgggcaacccattgcagccggtttatgcaggagaaattcaaaacagaggattgggtatggatgtggatgtatttgacgaaaaagggttttcaataaaaaatacaaaaggagagttagtttgtaaaaaaccttttccttctatgccagttaaattttggaatgataatgaagataaaaagtacagatcttcatattttgaaaagtataaaaacgtttggcatcatggtgattttgctaaagtaactgacaatggaggatttattatatacggcagatctgatactacacttaaccctggtggcgtaagattgggtactgctgaaatatatagtgtggttgaaaaatttgaggaaattcaagaatcaatcgtaataggacaatcatggaacaacgatattagaataatattatttattattcttaatcaaggttataaattaaatgacaaaataaaagacaaaattaaaaaagcaataagatctaatacttctcccaggcatgtaccttcaaaaataatatccattttggacatcccgaaaacaaaaaatggaaaacttgtagagttagctgttaaacaaactgttgaaggtgaaccaataaaaaatttggaagctttagctaatccagatagtttaaaacaatttaaaaatattaaagaattaaatgaataa

SEQ ID NO: 842 - protein, 652 aa, uncultured bacterium 314
MNNQLWKIKKEELNKTNFFLYSNFIKQNFKIDTGNDFNKIWKWSVDNTEIFWKSIWDFTKVKGVLGKNLLQKSNIFYNNKFFPDTKLSYAENLLKKNNTTPAIIFKSENGYRTALSWKDLNLNVAKISDWMRANGLQKGDRVAAYLPNIPETVTAYLGTSAVGAIWSSCSPDFGTVGVIDRFSQINPKILFIGDKYFYNGKTINIAERLKEIMSKIPTIVKVVIVSYPGTEIEKKDNLKVDIYRWHEIMALKKENNIQYEMSYFNDPLAILYSSGTTGKPKCICHGTGGILLQHNKELQIHCDVKENDRVFYFTTCGWMMWNWLVGSLSSGATILLFDGFPLYKKDDLLFEFASEEQITLFGISAKYIDTLSNNKVVPKNNHDMSKLKTVCSTGSPLSIDGFRYIYKNIKEDVHLASIAGGTDIVSCFVLGNPLQPVYAGEIQNRGLGMDVDVFDEKGFSIKNTKGELVCKKPFPSMPVKFWNDNEDKKYRSSYFEKYKNVWHHGDFAKVTDNGGFIIYGRSDTTLNPGGVRLGTAEIYSVVEKFEEIQESIVIGQSWNNDIRIILFIILNQGYKLNDKIKDKIKKAIRSNTSPRHVPSKIISILDIPKTKNGKLVELAVKQTVEGEPIKNLEALANPDSLKQFKNIKELNE

SEQ ID NO: 843 - DNA, 1938 bp, uncultured bacterium 311
  CDS (1)..(1938)
atggcaaaagaaatcttgtatcaagttcccgatctcataaagaaaaatgctttattgaacgaagaagaatacgaactgctttatagagaatctttagaccattcagaagacttttggtctaagcaagctaaagaatacttagattggatattaccttgggaaaaagtttctgaaagcgaccttaccaagggcgaggtctcttggtttagtggaggaaaaattaatgcttcagaaaattgcatcgacaggcatctagaagaaaggtctagccaaattgctattatttgggagggagatgatccctctgtctccaaatctataacctatcaggaattatacgaatcggtttgtagatttgccaacgctcttaaagagagaggaataaagaaaggagacagagtttgtatttacatgcccatgattcctgaagcagcttatgccatgctagcttgtgccaggataggagctattcattcagtggtattcggaggtttttctcctgagtcgctgaaagacaggattttagattcagattgccagactgtgataacagcagatgaaggactaaggggagccaaaaaaatcccgctcaaacaaaatgtcgatgaagctttagttaactgtcctagcgttgatacagtattcgttgtaaagagaactggagctgaaataaattgggttgatgaaagagatgtctcttatgaagagattgttagttcaatgagttcagattgtccgccagaggtaatggattctgaagaccctctttttattttatacacatcaggttctacaggaaaaccaaaaggggtcttgcacacaactgcaggttatcttcttcaaactacaatgagccataaattaatctttgattaccatgagggagaggttttctggtgtactgcagatgtcggttgggttacaggtcactcatatattgtttacggacctttatcgaatggagctacaaccctaatgtttgaagggatacctacctaccccagcccatcaagattttgggaggtggttgataagcatcaagtgaatatattttatactgctcctacggccctaagggctctgatggctcaaggcaatgagcctttggagtctacttctagagagtctttaagagttctaggtacagttggtgagcccatcaatcctgaagcttgggaatggtattaccgagtagtgggcgataagagatgtccgatagtggatacttggtggcagactgaaaccggatcggccatgatcagccctttggctggttcaacccctcaaaaacctggaagcgctactaaacccttttttggaattgaaccagctctgttagacgaaaatggacaagaaattgagggagaaggttcaggcaatctagtcattaaaagaagttggccttctcaaattagaactgtgtatggtgatcataaaaggtgtgtggaaacttattactccctttaccctggttactacaccacgggggatggagcaagaagagataaagatggctattattggatcactggaagagtcgatgatgttctgaatgtatcaggacatagattaggaaccgccgaggtagagagtgctctggtattacacgaaactgtcgctgaagcagcagttgtgggttatgagcatgacatcaaaggtcaaggaatatactgttatgtaaccctgatgaacggcatagaacccagcgatgaacttaaaagtgatttagttgggctggtagctaaagaaattggagctattgccaaacctgatattattcaatgggcccctggtcttccaaaaactagatccggtaaaattatgcgaagaattttacgaaaaattgcaggaaatgagattaaggatcttggagatactactactttagccgagcctagtgtggtagaacagattatagaaaatagagaaaatcgataa

SEQ ID NO: 844 - protein, 645 aa, uncultured bacterium 311
MAKEILYQVPDLIKKNALLNEEEYELLYRESLDHSEDFWSKQAKEYLDWILPWEKVSESDLTKGEVSWFSGGKINASENCIDRHLEERSSQIAIIWEGDDPSVSKSITYQELYESVCRFANALKERGIKKGDRVCIYMPMIPEAAYAMLACARIGAIHSVVFGGFSPESLKDRILDSDCQTVITADEGLRGAKKIPLKQNVDEALVNCPSVDTVFVVKRTGAEINWVDERDVSYEEIVSSMSSDCPPEVMDSEDPLFILYTSGSTGKPKGVLHTTAGYLLQTTMSHKLIFDYHEGEVFWCTADVGWVTGHSYIVYGPLSNGATTLMFEGIPTYPSPSRFWEVVDKHQVNIFYTAPTALRALMAQGNEPLESTSRESLRVLGTVGEPINPEAWEWYYRVVGDKRCPIVDTWWQTETGSAMISPLAGSTPQKPGSATKPFFGIEPALLDENGQEIEGEGSGNLVIKRSWPSQIRTVYGDHKRCVETYYSLYPGYYTTGDGARRDKDGYYWITGRVDDVLNVSGHRLGTAEVESALVLHETVAEAAVVGYEHDIKGQGIYCYVTLMNGIEPSDELKSDLVGLVAKEIGAIAKPDIIQWAPGLPKTRSGKIMRRILRKIAGNEIKDLGDTTTLAEPSVVEQIIENRENR

SEQ ID NO: 845 - DNA, 1743 bp, Rattus norvegicus
  CDS (1)..(1743)
atggcaatgttacttcgtgctaggtgttttcaccgcctagcaatccctgatcccaggagaatcttgtataaagattacagaacagcgattcctcagaacttttccaactatgagtccatgaaacatgacttcaaaatagagattccagagtatttcaattttgcaaaagatgttttggaccaatggaccaatacggaaaagactggaaaaagactttccaatccagccttctggtgggtagatggaaatggaaaggaggtgagatggagttttgaagaacttgggtctttatccaggaaatttgccaacatactcacagaagcctgttccctgcaaagaggagatagagtaatggtgattctgcccaagatcccagagtggtggcttgcaaatgtagcctgtctgcgaacagggacagttttaattccaggaaccactcagctgacccagaaagacatcctctacaggctacaatcttcaaaatcaaagtgcattattactgatgatactttggccccagcagtagatattgtagcagctaaatgtgaaaatctccactccaaattaattgtgtctcagcactccagagaaggctgggggaacctcaaggagatgatgaaatatgccagtgacagccacacctgtgtggacacaaaacacaatgagttgatggccatctacttcaccagtgggacgactgggcctccgaagatgattggacacacccacagcagttttggtttaggactgtctgtcaacggaaggttctggctggatttgatagcctctgacgtgatgtggaatacgtcagatacaggctgggcaaagtctgcatggagtagtgttttttctccgtggacccaaggagcatgtgtttttgcacactatttgccccgttttgattcaacttccatcttgcaaaccctctccaagtttcccatcactgtcttctgttctgcaccaactgcctaccggatgcttatacagaatgacataaccagctataagttcaacagtttgaagcactgtgtgagtgccggggaacccatcaaccctgaagtgatggaacaatggaaaaagaagacaggactagacatctacgaaggatatggacagacagaaacggtgctgatctgtggaaatttcaaggggatgaaaattaagcctggctcaatggggaagccctctcctgcttttaatgtggagattttagatgaaaatggcactattcttcctcctggacaagaaggggatattgctgttcaagttcttcctgatcgaccatttggcctttttactcattatgtagataatccttcgaaaacagcttcaactctacgagggaatttctacatcactggggacagaggctatatggatgaggatggctatttctggtttgttgcaagatcagacgatgtcatattatcctctggttaccgaattggaccatttgaggtagagagtgctctcatagagcatccttccattgcagagtcagctgttgtcagcagccctgaccccatcagaggagaggtagtaaaggcctttattgtcctgaatcctgattacaaactccatgatcaagaacaactgaaaaaagagattcaggagcatgtgaaaaagactacagcaccttacaaataccccaggaagatagaatttattgaggagctgccaaagactgtcagtgggaaggtcaaaagaaatgaactgaggagaaaggaatggacaacaacttaa

SEQ ID NO: 846 - protein, 580 aa, Rattus norvegicus
MAMLLRARCFHRLAIPDPRRILYKDYRTAIPQNFSNYESMKHDFKIEIPEYFNFAKDVLDQWTNTEKTGKRLSNPAFWWVDGNGKEVRWSFEELGSLSRKFANILTEACSLQRGDRVMVILPKIPEWWLANVACLRTGTVLIPGTTQLTQKDILYRLQSSKSKCIITDDTLAPAVDIVAAKCENLHSKLIVSQHSREGWGNLKEMMKYASDSHTCVDTKHNELMAIYFTSGTTGPPKMIGHTHSSFGLGLSVNGRFWLDLIASDVMWNTSDTGWAKSAWSSVFSPWTQGACVFAHYLPRFDSTSILQTLSKFPITVFCSAPTAYRMLIQNDITSYKFNSLKHCVSAGEPINPEVMEQWKKKTGLDIYEGYGQTETVLICGNFKGMKIKPGSMGKPSPAFNVEILDENGTILPPGQEGDIAVQVLPDRPFGLFTHYVDNPSKTASTLRGNFYITGDRGYMDEDGYFWFVARSDDVILSSGYRIGPFEVESALIEHPSIAESAVVSSPDPIRGEVVKAFIVLNPDYKLHDQEQLKKEIQEHVKKTTAPYKYPRKIEFIEELPKTVSGKVKRNELRRKEWTTT

SEQ ID NO: 847 - DNA, 1740 bp, Klebsiella pneumoniae
  CDS (1)..(1740)
atgacgctctgtggcaggcggagatcatcgcgcgccgcgccgggcatatcgccgcgcaggaggccgtcgatgcgaacagtgcagagtgagcacgatccctttctgcgcgacttctggcgggaagagtccgcgcggctttactgggaaacggattttaccgaggtggtggaaagccttgacggcagcccgcgctgccgctggtttacgggcgggcgcaccaatctcagcttcaacgccctggaccgccatttagcagagaaaggggagaagtgcgccattattcatcgcgactatctcgggcaaacgcaccggcttagctatcgcgagctttggcagcaggtgaataccctctgcagcatgatgcaaagctggggcgtgaagccgggggaccgggtactcatcgccctgccgatgacgccgctggtggccgtcgctatgctggcgtgcgcgcgcattggcgcggtgcatgtcgtgctctattcctccatcacccatgaggccctgatgcagcgcatcgccgtcagccagccggtgctgctgttgcatagccgcgagcagcgaggccgcaaggaactgcccgttatcgccgagcggatggccggactgcgggtagtagatacgtacagccgggcatttgaagagctgttggcacgacatcgtggcaacgtcgtgccctgtacctggcttgcggcctccgcgccttcgcatctgctgtttacgtcggggactacaggaacgccgaaagggatcgtccgcgacacgggcggttacgccgtggcgctgctggccagccttgtgcatctctttcggctgcgggacgacgagattttctttacaaccgccgacgccggctgggtgaccgggcacagctacgggatctatgggccgctgctggcggggctgacgacggtgctctgcgaggttaactcgccgggagaatactggtggcagatggtggaaaccctcggcatcacccggatgctgaccattgccggggcgattcgcatggcccggcggcagggtaagccgcgcgccgatctgacctcgctgcgcacgctctatctcgccggcgagccgctggataacgccaccgatgagtgggtggccgcacagctgggggtgccctgcgagaaccattactggcagaccgaatccggctggccgctgctggccggctccggtagagcgctctcgccggtattcacgcgcgcggctgaggtggttcatcccgccagcgggaaaacctgcgcgccgggcgagacgggcatgcttgtgattaacaatacgcttggccccggcgggatgtcgacgttgtggcagaatgatatccagcacgaccagtactactggtcgtatcggcagcgacagtggcgctatgccacccacgattgcgcgataagggttggtgagcggattattatccaggggcggatggatgacgtgatgaatatcggcggtaagcgcatcgccaccgcagagatagaaaatgccctgatggggcttgagggggttgtcgaggtggttgccgccgggacggcacactacctgctgggggaaatggtggcgctgtttgtggtcaccgatatcgccgaccctgcgcagcaggccgcgctcaaaaaaaacatttgcgcccggctggtggcgagatgcggtcgcttcgccgtaccgcggcgcatccacatcacctcggccctgcctaaaaccttctccgggaaggtgatgcgccgcatactggcttag

SEQ ID NO: 848 - protein, 579 aa, Klebsiella pneumoniae
MTLCGRRRSSRAAPGISPRRRPSMRTVQSEHDPFLRDFWREESARLYWETDFTEVVESLDGSPRCRWFTGGRTNLSFNALDRHLAEKGEKCAIIHRDYLGQTHRLSYRELWQQVNTLCSMMQSWGVKPGDRVLIALPMTPLVAVAMLACARIGAVHVVLYSSITHEALMQRIAVSQPVLLLHSREQRGRKELPVIAERMAGLRVVDTYSRAFEELLARHRGNVVPCTWLAASAPSHLLFTSGTTGTPKGIVRDTGGYAVALLASLVHLFRLRDDEIFFTTADAGWVTGHSYGIYGPLLAGLTTVLCEVNSPGEYWWQMVETLGITRMLTIAGAIRMARRQGKPRADLTSLRTLYLAGEPLDNATDEWVAAQLGVPCENHYWQTESGWPLLAGSGRALSPVFTRAAEVVHPASGKTCAPGETGMLVINNTLGPGGMSTLWQNDIQHDQYYWSYRQRQWRYATHDCAIRVGERIIIQGRMDDVMNIGGKRIATAEIENALMGLEGVVEVVAAGTAHYLLGEMVALFVVTDIADPAQQAALKKNICARLVARCGRFAVPRRIHITSALPKTFSGKVMRRILA

SEQ ID NO: 849 - DNA, 1821 bp, Homo sapiens
  CDS (1)..(1821)
atgttaaaaacttttctttttctggaaaagtactttccatgcattaagtattccagtgcctgttttcctggcactgggctggatgtatatgacataaaatttgcagtattgctccacccccaaactgctctgcattttggccctcctccatctctgatggctttctcttccctgtgctgcagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcggagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggtgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaatgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtga

SEQ ID NO: 850 - protein, 606 aa, Homo sapiens
MLKTFLFLEKYFPCIKYSSACFPGTGLDVYDIKFAVLLHPQTALHFGPPPSLMAFSSLCCRELLETTCRLANTLKRHGVHRGDRVAIYMPVSPLAVAAMLACARIGAVHTVIFAGFSAESLAGRINDAKCKVVITFNQGLRGGRVVELKKIVDEAVKHCPTVQHVLVAHRTDNKVHMGDLDVPLEQEMAKEDPVCAPESMGSEDMLFMLYTSGSTGMPKGIVHTQAGYLLYAALTHKLVFDHQPGDIFGCVADIGWITGHSYVVYGPLCNGATSVLFESTPVYPNAGRYWETVERLKINQFYGAPTAVRLLLKYGDAWVKKYDRSSLRTLGSVGEPINCEAWEWLHRVVGDSRCTLVDTWWQTETGGICIAPRPSEEGAEILPAMAMRPFFGIVPVLMDEKGSVVEGSNVSGALCISQAWPGMARTIYGDHQRFVDAYFKAYPGYYFTGDGAYRTEGGYYQITGRMDDVINISGHRLGTAEIEDAIADHPAVPESAVIGYPHDIKGEAAFAFIVVKDSAGDSDVVVQELKSMVATKIAKYAVPDEILVVKRLPKTRSGKVMRRLLRKIITSEAQELGDTTTLEDPSIIAEILSVYQKCKDKQAAAK

SEQ ID NO: 851 - DNA, 1716 bp, Thermoproteus tenax
  CDS (1)..(1716)
atgttgccaggaactgctgtgaacggtattaaatatcccaaagcgtatagcgatagactagaaatagatataagaaatttttcttttaattcatatgaagatatatatagaaaatttatttggaatataccaaaatattttaatataggatatgctataacggacagagcaatcgcgttgggacgcggagaaaacgttgcgatatattacgaggacgacgaggggcggagagaagttgtaagattcagcgaactgaagactaggtccgacgcgtttgcgagatcgcttctggacaacggagtaaggaagggggacgtcgttggcgtatatctctaccctgggccggaggttgtaatcgctctaagcgccatttataagataggagcaattgcattgtcgatatctccgttgatagggaccgagggagtagaatacagattgaaacacagcgaggcaaaggcgtttgtgacagacggcacgaagaaagaggcgatctcgatagcgaatagattgaacacaataagagcgatatatgtagtgggttcagagccctctggcggcaaggagttgtctttcgaggatcagaccaaggccggatcagcggaaatagccgagacagagagcgatgagccggcccagttgttttatacatcgggcagcacgggcccgcccaagggagtgctacacgcccatcggtttcttctgggccatataccgacctaccaactgtactttgagatggcccctcgcgatggcgacgtatattggacaaacgcagactgggggtggatcggcgccttgggcgacgtagtactgccctcgctctacttcggcatgcctgtagtggcatacaggaggacaagcggcttcagtgcccggagagcgctggaggtgatgtcacagtacggagtcactgcggcctttataactcctactgctctccgtataattagaagggagtatccggagccgttgaaagatttcgatataaagttgagggccttgagcacggcgggagagtcgccaggacgggagcttgtgctctgggcctcggaggcttttaaagcttcagtgaacgagttctacggctgcactgagactaatctagttgtcactaacaactccatttgggccaagccaggttcgctgggaaagcctgcgcctgggcacatcgtcgaggttgtcgacgacaaggggaacccgcttcctccaaatgccgagggatggatagctgtcaaattgccagatccggtggcatttctagggtacttcaaaaaccccgaggccacggccgcgaaaataaagaacggctggttcctcataggagatatggggcttaaagatgccgagggctacctctggtttaagggcagaggggatgacgtcataaaagtctcaggctacaggatcgggcccgaggagatagaggaggtaatcacaaaacatccggcagtcctagaggctgccgtgattgggaagccggatcctgtccgcggcactatagttaaggccttcgtagtcctcaaaccaggtattgagccaagcgatattttggccagagagatccaagagtttgtaaaaacacggctcgccgcatatgcatatcctagagaagtggagtttgtagatcaattgcccagaacggagaccggaaaactcaagaggtatgagctgaggcgcagagagcttgagaggggcaatgtacagagcggttga

SEQ ID NO: 852 - protein, 571 aa, Thermoproteus tenax
MLPGTAVNGIKYPKAYSDRLEIDIRNFSFNSYEDIYRKFIWNIPKYFNIGYAITDRAIALGRGENVAIYYEDDEGRREVVRFSELKTRSDAFARSLLDNGVRKGDVVGVYLYPGPEVVIALSAIYKIGAIALSISPLIGTEGVEYRLKHSEAKAFVTDGTKKEAISIANRLNTIRAIYVVGSEPSGGKELSFEDQTKAGSAEIAETESDEPAQLFYTSGSTGPPKGVLHAHRFLLGHIPTYQLYFEMAPRDGDVYWTNADWGWIGALGDVVLPSLYFGMPVVAYRRTSGFSARRALEVMSQYGVTAAFITPTALRIIRREYPEPLKDFDIKLRALSTAGESPGRELVLWASEAFKASVNEFYGCTETNLVVTNNSIWAKPGSLGKPAPGHIVEVVDDKGNPLPPNAEGWIAVKLPDPVAFLGYFKNPEATAAKIKNGWFLIGDMGLKDAEGYLWFKGRGDDVIKVSGYRIGPEEIEEVITKHPAVLEAAVIGKPDPVRGTIVKAFVVLKPGIEPSDILAREIQEFVKTRLAAYAYPREVEFVDQLPRTETGKLKRYELRRRELERGNVQSG

SEQ ID NO: 853 - DNA, 2118 bp, Agrobacterium vitis
  CDS (1)..(2118)
atgtctaatttgcccgccatgtggcgacctgataagaattggcagtatgacacctatatcattgatgcagagccactgcaccgcatcatgccaggtccatgtttgagagaggtgaggactctcccgcagcctgtcatggctgcgtcacatcaggaggatttcctgtctgccaagacccatcccgctttaaaggccgccaaggcccaggctttgatcgataacgacaaatacctgaaatggtacgaggaaagcatcgaggagccggagaatttctggtccaagcacggcaagcggatcgattggttcaagccctataccaaggccaagaacaccagtttcaagggcaaggtaccgatcaaatggttcgaggacgggctgaccaatgtctcctataattgcattgaccgacatctgaaaacccatggcgagcgcaccgcgatcatctgggaaggggacaatccctatatcgacaagcggatcacctataaccagctttatgacaatgtctgccggcttgccaatgtgctgaaggcgcatggtgtcaagaagggcgaccgcgttacaatctatatgcccatggtgccggaagcgacctatgccatgctggcgtgttcgcgtattggtgctgtgcattcggtggtgtttggcggtttttcgcctgaagccctggctggccggatcgtcgattgcgaatcgaccttcgtgatcacctgtgacgaaggggtgcgcggcggcaagccggtggctctcaaggaaaacaccgatgtcgccatcgacattgcagcgaaacaatatgtcatcgtcaacaaggtgttggtggtgcgccgtaccggcggcaaggtcggctgggctccggggcgcgatctctggtaccatcaggaaatcgccaaggtgaagccggattgcccgccggagaaaatgaaggcggaagatccgctgttcattctctacacctccggctccaccggcaagccaaagggcgtgctgcacacgaccggtggctatctcgtctatgcggcgatgacccacgaatatgtgttcgactacaaggacggcgaaatattctggtgctcggcagacgtgggttgggtgaccggccattcctatatcgtctacgggccgctggccaattgcgcgacgacggtgatgttcgaaggtgtgcccaatttccccgaccagggacggttctgggaaattatcgacaagcacaaggtcaatattttctataccgcacccaccgccatccgttcgctgatgggggccggagacgatttcgtcaagcgctcctcgcgctccagcctgcgattgctgggctcggtcggtgagccgatcaatccggaagcctgggaatggtattataacgtggtcggtgatcagcgctgcccgattgtcgatacctggtggcagaccgagaccggtggcattctcattagccccctgcccggcgccacggatctcaagcccggttccgcgacccggccgttcttcggcgtcaagccggagctggtggacaatgaaggcaaggtgctggagggggctgccgatggcaatctctgcctgatcgacagctggccgggccaggcacggacgatttacggcgaccacaatcgcttcgtccagacctatttttccacctataagggcaagtatttcaccggcgacggctgccgtcgcgacgaggacggttattattggatcaccggtcgcgtcgatgacgtgctgaatgtgtccggccaccgtctgggaactgccgaggtggaatcggcactggtctcgcatcatttggtctcggaagccgccgtggtcggttatccgcacggcataaaaggccagggcatttattgctatgtgacgctgatggcgggccatgagggcgatgaggaattgcgccagacgttatcaagcatgtccgttccgaaatcggcccgattgcctctcccgacaaggttcagttcgctcccggcctgccgaaaacccggtccggcaagatcatgcgtcgtaatcctgcgcaagatcgccgaggacgatttcggcgcgctgggcgatacatcgacgctcgccgatcctggcgttgtcgacgatctgattgccaaccggcagaacagggctccggcctga

SEQ ID NO: 854 - protein, 705 aa, Agrobacterium vitis
MSNLPAMWRPDKNWQYDTYIIDAEPLHRIMPGPCLREVRTLPQPVMAASHQEDFLSAKTHPALKAAKAQALIDNDKYLKWYEESIEEPENFWSKHGKRIDWFKPYTKAKNTSFKGKVPIKWFEDGLTNVSYNCIDRHLKTHGERTAIIWEGDNPYIDKRITYNQLYDNVCRLANVLKAHGVKKGDRVTIYMPMVPEATYAMLACSRIGAVHSVVFGGFSPEALAGRIVDCESTFVITCDEGVRGGKPVALKENTDVAIDIAAKQYVIVNKVLVVRRTGGKVGWAPGRDLWYHQEIAKVKPDCPPEKMKAEDPLFILYTSGSTGKPKGVLHTTGGYLVYAAMTHEYVFDYKDGEIFWCSADVGWVTGHSYIVYGPLANCATTVMFEGVPNFPDQGRFWEIIDKHKVNIFYTAPTAIRSLMGAGDDFVKRSSRSSLRLLGSVGEPINPEAWEWYYNVVGDQRCPIVDTWWQTETGGILISPLPGATDLKPGSATRPFFGVKPELVDNEGKVLEGAADGNLCLIDSWPGQARTIYGDHNRFVQTYFSTYKGKYFTGDGCRRDEDGYYWITGRVDDVLNVSGHRLGTAEVESALVSHHLVSEAAVVGYPHGIKGQGIYCYVTLMAGHEGDEELRQTLSSMSVPKSARLPLPTRFSSLPACRKPGPARSCVVILRKIAEDDFGALGDTSTLADPGVVDDLIANRQNRAPA

SEQ ID NO: 855 - DNA, 1578 bp, Listeria monocytogenes
  CDS (1)..(1578)
atgaattcagaaaatttaatcgctccagaactttataatattaccgacgagattgctaaattcagttctgaaaaaactgctttaatttggaaaaatgagcataacgaaacaaaaacttggagttaccgccacctgcttgaacaagcgaataaatttgccaatgttgtcaaagacgcaggcataaaaaaaggtgaccacgttatcgtcatgacacctagattactcgaaacgtacgcaatttacatgggcttatggaaagctggtgccattatcatcccggcatccgagctacttaaagcgcacgatttagaataccgcatccaccatgcaaacgtaaaagcaatcgtttcttacaatggaatgactgctgaatttgataaaattgaaagcatcccttctgtttcgaaaaaaattattgttggggagaaattatccggctgggatcactacgaaacattaatggaagccgcttcaaccgaatttgaacgcgtggaaacttcgcgcgatgatgcttgtctgcttgcattcacgagtggaacaacaggtaatcctaaaggcgttgtacatattcacggctggggttacgcgcatattcgtatcgctgctgatcattggctcgatattcacgaagacgatatcgtttgggctacagccggacctggttggcaaaaatgggtttggtctcctttcctttctgtactcggaaaaggtgccactggcttcatttacaacggtcgtttcattcctgaaaaacaacttcatttactggaagaagaaaaaatcaacgtgctgtgctgtacgccaacagaatatcgcttaatggctaaagtaaataatttgcgcgaacatgatttaagttcccttcgtagcgccgtatcagcaggagaacctctaaaccgcgaagtaattcaagttttccaagataattttgatattaaagttcgcgacggctacggtcaaacggagagtacactgttgattgggacactggttgatacgccgattcgccctggttcgatgggcaaaccaattatgcctgaatacatggcgattattgatgctgaaggaaatccagttggtgtcggtgaaattggtgatatcgcgatgcgtagagatttcccagcacttttcaaagagtactataaagaaccagaacgtttgcaaaaagcgattcgcggtgattatttcgtttctggtgaccgcgctatccgcgatgaagataattattactggttccaaggccggaatgacgatattattattagctctggttacacgattggaccgttcgaagtagaggacgcgctcacacatcatccagccgtaaaagaagtcgctgttgtcgcaagtcctgacgaaatccgcggtacggtcgtaaaagctttcatcgtcttaaaagatggatacgagggcacggaagatcttgtgcacgaattacaaacatttacgaaagaacaaacggctccgtataaatatccgcgccggattgagtttgttgaagcgttaccgaaaactgattctggtaaaattcgccgcgttgagttgcgtgatgctgagtttgctagtgtgcacggatga

SEQ ID NO: 856 - protein, 525 aa, Listeria monocytogenes
MNSENLIAPELYNITDEIAKFSSEKTALIWKNEHNETKTWSYRHLLEQANKFANVVKDAGIKKGDHVIVMTPRLLETYAIYMGLWKAGAIIIPASELLKAHDLEYRIHHANVKAIVSYNGMTAEFDKIESIPSVSKKIIVGEKLSGWDHYETLMEAASTEFERVETSRDDACLLAFTSGTTGNPKGVVHIHGWGYAHIRIAADHWLDIHEDDIVWATAGPGWQKWVWSPFLSVLGKGATGFIYNGRFIPEKQLHLLEEEKINVLCCTPTEYRLMAKVNNLREHDLSSLRSAVSAGEPLNREVIQVFQDNFDIKVRDGYGQTESTLLIGTLVDTPIRPGSMGKPIMPEYMAIIDAEGNPVGVGEIGDIAMRRDFPALFKEYYKEPERLQKAIRGDYFVSGDRAIRDEDNYYWFQGRNDDIIISSGYTIGPFEVEDALTHHPAVKEVAVVASPDEIRGTVVKAFIVLKDGYEGTEDLVHELQTFTKEQTAPYKYPRRIEFVEALPKTDSGKIRRVELRDAEFASVHG

SEQ ID NO: 857 - DNA, 1986 bp, Desulfovibrio vulgaris
  CDS (1)..(1986)
atgagccaggaacgtatcgagagcatgatggatgagaagcgccacttcgcccctcccgctgacagccggggcagggcacatgtgtccggcgaagccgcgcgagaggcgcttgtgcggcgtgccgccgaagaccccgaaggcttctggggcgaacgtgcggcacagctcatcgactggttcaagccgtgggataccgtgctggatgccgacatgaacgaaccgcgcatcgagtggttcaagggcggaaggctcaacgtggcccacaactgcctcgacaggcatgtggcaggaaaccggcgcaacaaggccgccatcatctggcagggcgaacccgaagaggacgtgcgggtgctcacctaccagatgctgtatgacgaggtgcgccgtttcgccgccgttctgcgcaagatgggcgtgcacaagggcgaccgcgtctcgctgtacatgcccatgattcctgaactggctgtcgccatgctcgcctgcgcgcgcatcggggctgtccattccatcgtctttgccggattctcggctgtgagccttcagaatcgcatccacgactgcgaggccaaggtcgtggtcaccgccgacgcggtgctgcgtgccggacggcgcatccccctcaaggtgaacgtcgacgaggccgtgcgccagtgtcccagcgtggagaaggtcgtcgtcgtcaaccgcgggagcctcgaagtgaccatggaggaggggcgtgacctgtggtggcatgaggtcatggccgaccgcaccctcgacgtcgaccgcccctgcgaggagatggatgcggaggacatgctgttcatcctctacaccagtggcagcaccggcaagcccaagggcgtggtgcacaccacgggcggctatcttacctatgccgcgcacaccacgcagtgggtcttcgacgtgcaggacgacgacgtgtactggtgcaccgccgacatcggctggattaccgggcacagctacatcgtctacggcccgctggccctcggggcgacctcgctgatgttcgagggtgtgccctcgtggccctcgcccgaccgtttctggcgcatcgtcgagaagttccgcgtcaacatcttctacaccgcccccaccgtcgtccgcgcactcatgcgtgaaggcacggactggacggaacggcacgacctttcgtcgttgcgtgtcctcgggtcggtgggcgaacccatcaaccccgaagcgtggatgtggtaccatacccacatcggcaagggacgcctgcccatcgtcgacacatggtggcagacagagacgggtggcatcatgatttcgggcctgccctacgccaccaccctcaagcccggttcggcaacgcagccgctgcccggcgtcgatgccgccatcgtccggcccgacggcagccccgcagggcccaacgaaggcgggcatcttgtcatccgcaagccgtggccgggcatgttgcgcggcatcttcggctcgcccgaacggtaccgctcgacatacttcgaacgctttcccggcatgtacgagtccggcgatggcgcacgcaccgatacggacggctatttctggatcatgggccgcctcgacgacgtcatcaacgtctcgggacaccgcatgggcacggccgaggtcgagtctgcgctggtcgcccatcccagcgtcgcggaagccgccgtcgtgggcatgccacacgccgtgaagggtgaggccatctacgcctacgtgactctcggcgccgatgcggaagagaccgaggagctccgcgccgagctgcgcgcatgggtgcgcaaggagataggccccatcgccacgcccgatgtgctccagttcgcagaggggctccccaagacgcgtagcggcaagatcatgcggcgcatcctgcgcaagatcgccgccggggccaccagcgagttcggggacacttctactctcgccgaccccggggtcgtctccgacctcattgaaggtcgcctgcaacttaccggaaggtag

SEQ ID NO: 858 - protein, 661 aa, Desulfovibrio vulgaris
MSQERIESMMDEKRHFAPPADSRGRAHVSGEAAREALVRRAAEDPEGFWGERAAQLIDWFKPWDTVLDADMNEPRIEWFKGGRLNVAHNCLDRHVAGNRRNKAAIIWQGEPEEDVRVLTYQMLYDEVRRFAAVLRKMGVHKGDRVSLYMPMIPELAVAMLACARIGAVHSIVFAGFSAVSLQNRIHDCEAKVVVTADAVLRAGRRIPLKVNVDEAVRQCPSVEKVVVVNRGSLEVTMEEGRDLWWHEVMADRTLDVDRPCEEMDAEDMLFILYTSGSTGKPKGVVHTTGGYLTYAAHTTQWVFDVQDDDVYWCTADIGWITGHSYIVYGPLALGATSLMFEGVPSWPSPDRFWRIVEKFRVNIFYTAPTVVRALMREGTDWTERHDLSSLRVLGSVGEPINPEAWMWYHTHIGKGRLPIVDTWWQTETGGIMISGLPYATTLKPGSATQPLPGVDAAIVRPDGSPAGPNEGGHLVIRKPWPGMLRGIFGSPERYRSTYFERFPGMYESGDGARTDTDGYFWIMGRLDDVINVSGHRMGTAEVESALVAHPSVAEAAVVGMPHAVKGEAIYAYVTLGADAEETEELRAELRAWVRKEIGPIATPDVLQFAEGLPKTRSGKIMRRILRKIAAGATSEFGDTSTLADPGVVSDLIEGRLQLTGR

SEQ ID NO: 859 - DNA, 1656 bp, Desulfovibrio vulgaris
  CDS (1)..(1656)
atggataagctcacctttgccagctacgacgagttcttgcgtgtcttctcgctggatgcgccagagaccttcaatttcgccttcgacgttctcgatgccatggccaacgagactcccgacaggctcgccattgcccacgtcgatgacgccggggtgcggcgcgactacaccttcgcatggcttgccgacgcttctgcgcggcttgccaacgcgctcaaggccagaggtgtgcgcaagggccatcgggtcatgctggtcttgcaccggcgtatcgaattctgggtctccatgctggcattgcatcgtctcggcgcggtagccattcccgccccagcgcaactgacccccaaggatatcgtgttccgcgtcgaacgcgcgcaggttcgtgccgtcatcgtcgacgacggcatcaccgaccgtatcgaggccgcgcgtcccgactgtccgaccctttcagtgctcgtgcagtgcggcgggacaccgttgcccgatggctggtgcgactacgaggccctctgtgcggatgcctcgccctctttcccgcgcccgacagcacccgacgaacttgcctgcggcgaagacccgctgctcatattcttctcgtccggcaccacgggcatgccgaagatggtggaacatgtgcacacctaccccctcgggcacctcgtgacgggcatgtactggcacgacctgcgccccggcgacctgcacctcaccgtggccgacacgggttggggcaaggccgtgtggggcaagttctacgggcagtggatggcgggggcagccgtcttcgtctacgacttccgcggcaagttcgaccccgaagcgttgctcgatgtcgtcgcgaagaacggcgtcaccaccttctgcgccccgcccaccgtgtaccgctttctcgtgcgggccgacctttcgcgttacgacctctcgaagctgcgccactgcacaacggcaggtgaactgctcaacgagagcgtgttccacgggtggaaggccgcaacgggcctttccatctacgagggatacggccagaccgagaccacgttgcagattgccacgctctcgtgcatggaggccaagcccggttccatcgggcgccccatgccggggtggggcatcacgcttctcgaccacgagggcaaggaatgtccgacgggcgaagagggcgaaatctgcatccgcatcagcgacggactgcctgtggggcttttccggggctatgtggaggacgccgagaagaccgcatcggtcatgttcgacgggtactaccacaccggcgacaaggcgtggatggacgaggacggctacctctggttcctcgggcgtgtggacgacctcatcaagagttcgggctatcgcatcgggcccttcgaggtcgagagcgccctcgtggcccatcctgccgtcgtcgaggccgccgtcaccggcgtgcccgacccgttgcgcgggcaggctgtgaaggccaccatcgtgcttgccgcaggctacgaggcgggcgaggtgctcacgaaggagttgcaggaccacgtcaagaaggtcaccgctccctacaagtacccccgcatcgtcgagtacgtggcagagttgcccaagaccatcagcggcaagatcaaacgcgccgaaatacgccagcgcgatagcgaaaagagcgcatag

SEQ ID NO: 860 - protein, 551 aa, Desulfovibrio vulgaris
MDKLTFASYDEFLRVFSLDAPETFNFAFDVLDAMANETPDRLAIAHVDDAGVRRDYTFAWLADASARLANALKARGVRKGHRVMLVLHRRIEFWVSMLALHRLGAVAIPAPAQLTPKDIVFRVERAQVRAVIVDDGITDRIEAARPDCPTLSVLVQCGGTPLPDGWCDYEALCADASPSFPRPTAPDELACGEDPLLIFFSSGTTGMPKMVEHVHTYPLGHLVTGMYWHDLRPGDLHLTVADTGWGKAVWGKFYGQWMAGAAVFVYDFRGKFDPEALLDVVAKNGVTTFCAPPTVYRFLVRADLSRYDLSKLRHCTTAGELLNESVFHGWKAATGLSIYEGYGQTETTLQIATLSCMEAKPGSIGRPMPGWGITLLDHEGKECPTGEEGEICIRISDGLPVGLFRGYVEDAEKTASVMFDGYYHTGDKAWMDEDGYLWFLGRVDDLIKSSGYRIGPFEVESALVAHPAVVEAAVTGVPDPLRGQAVKATIVLAAGYEAGEVLTKELQDHVKKVTAPYKYPRIVEYVAELPKTISGKIKRAEIRQRDSEKSA

SEQ ID NO: 861 - DNA, 1947 bp, Desulfovibrio vulgaris
  CDS (1)..(1947)
atggcatcgcccgccgccactctcgatgcgctgctgcgtgaagagcgcgtgttccgccctctgccacgcgtcgtcgccgatgccgtggtcaaccctcaggacgtggcccgcgcacgcgaacaggccggaacggcccctctcgccttctgggaagaggccgccgaagagctggaatggttccgccgctgggacggtgtgctcgatgacagcaacgccccgttcatgcgctggtttcccggtgcgctgtgcaacatcgtccacaacgccctcgaccggcatatcgagacatccaaccgccaccgccttgccctcatatgggaaggcgaaccgggtgacagccgtcgtttcacctatttcgacctctaccgtgaggtgaaccgcctcgccaatgccatgcgttccctcggcgtgacgaagggcgacagggtggtcatctacatgccccccctgcccgagacggtcttcgccatgctcgcctgcgccaagataggcgcggtacacagcacggtgttcggtggcttctcggcccgttcgctgtgcgaccgcgtcgaagacgcaaggcccaccctgctgctgacggttgacggattctaccgcaacggccgcgtcgtaccgctcaaacccgtcgccgacgacgccgtggacgccctgtcaccggaggcacgggccggtctgcatcatgtcgtggtcgtgcatcgcgcccacctcgagacccccatgcgcgacgggcgcgacatctggtatcacgacctcgtgcgcggacagtccaccgaggcgcttaccgaagtcctctccgccaacgacccgctgttcgtcctctacacttccggcactacaggcaagcccaaggggctggtgcacagtcacggcggctacatggtgggcgtacaccgcaccatgcgctgggtcttcgacgtgcggcccaccgacatcttctggtgcactgccgaaccgggctggataacgggccatagctacggcgtgtacgggccgctcatggcgggcaccaccaccgtcctctacgaggggcaccccctgtaccccgaagcgggcaggctgtggtccatggtcgaacgatggggtgtcaccatcctgtacaccgtccccacggtcatccgcatgctcatgcgattcggtccgctgtaccccgcgcgccacgacatcaccacgctacggcttctggctaccgtaggcgaacccatcagcccggagacatgggtgtggttctaccgcaccatagggcgagggcgctgcccggtgctcgacacatggtggcagacggagacgggcatgatcatggtcagcccgctgccggtgtcggccctgaaacccggttcggtggcccgccccctgcccggtgtggatgtggatatcgtggacggggaaggtgcccccgtcccccccggcaggggtggactgctggtggtgaagaacccgtggcccgccatggcatgcggtgtcttcggtgacgatgaggccttccgcaggctttactgggagcgctttcccggatggtactgcacgggtgacgtggcccgccgggatgacgacgggtacatctggatacagggacgtgccgacgacgtcattctcatcgccggacaccgtatcgggacggcagagatggaagcggccctcgcgtcgcatcccgccgtggcggaatgcgccgtcatcggcgtgcccgacaggctgaagggcgaagtgggcaaggcgttcgtcgttctgcgcgataccgaagaggctgcggcagaagagcaggccctagccacgtcactggtggggcatgtccggcgtgaactcggcccggtggccgtcatacgcgatgtcgtattccgtgagggactgccacgcaaccgcagcggcaagatcatgcgccgtattcttcgttcggaagagatgggcgtggagacgggtgacctctcgacgctggaagacgcctatatctga

SEQ ID NO: 862 - protein, 648 aa, Desulfovibrio vulgaris
MASPAATLDALLREERVFRPLPRVVADAVVNPQDVARAREQAGTAPLAFWEEAAEELEWFRRWDGVLDDSNAPFMRWFPGALCNIVHNALDRHIETSNRHRLALIWEGEPGDSRRFTYFDLYREVNRLANAMRSLGVTKGDRVVIYMPPLPETVFAMLACAKIGAVHSTVFGGFSARSLCDRVEDARPTLLLTVDGFYRNGRVVPLKPVADDAVDALSPEARAGLHHVVVVHRAHLETPMRDGRDIWYHDLVRGQSTEALTEVLSANDPLFVLYTSGTTGKPKGLVHSHGGYMVGVHRTMRWVFDVRPTDIFWCTAEPGWITGHSYGVYGPLMAGTTTVLYEGHPLYPEAGRLWSMVERWGVTILYTVPTVIRMLMRFGPLYPARHDITTLRLLATVGEPISPETWVWFYRTIGRGRCPVLDTWWQTETGMIMVSPLPVSALKPGSVARPLPGVDVDIVDGEGAPVPPGRGGLLVVKNPWPAMACGVFGDDEAFRRLYWERFPGWYCTGDVARRDDDGYIWIQGRADDVILIAGHRIGTAEMEAALASHPAVAECAVIGVPDRLKGEVGKAFVVLRDTEEAAAEEQALATSLVGHVRRELGPVAVIRDVVFREGLPRNRSGKIMRRILRSEEMGVETGDLSTLEDAYI

SEQ ID NO: 863 - DNA, 1890 bp, Thermus thermophilus
  CDS (1)..(1890)
atggaaccagtctggtaccctgacgcgcgcgcccaagaaacctggcttggccgcttcatggccgagctcggcttccaggactacgaggccttccaccgctacagcgtagaggaggccgaggccttctaccacgccttcttcacccggctcggcgtgccctggcgggccccgtacacacgggtggtggaaggccacttccccttcccccgcttcttcgtggggggaaggctcaacctggtggaggcctgcctgcgccacgaccccacccggcccgccctcgtccacgagacggaggacggccacgtccggagcctcacctacggggaggcccgccgggaggtggaaaggctcgcagggggcctgcgggccctcggggtggggcggggagaccgggtggggctatggcttcccatgggcctcgaggcggccttggccctcctcgccgtggcccacctcggggggatcgccgtccccatcttctcgggctacggggcggaggccgccgccctccgcctcaaggacgccgaggccaagctcctcatcgtccaagacggcttccttcgccggggacgccgggtggagctcctccccgaggcccggaaggccagggccatggcggggacggaaaaggtggccgtggtccgccgcctcggcctccccctggaggaggaggcggacctcgccgccctcgccggccccctctcgccgccggaggagatggagagcatggaccccttcatgctcatctacacctccgggaccacgggccgccccaagggcacggtccactaccacgcgggctttcccctgaaggccgccctggacctcgccctcctctttgacctgagggaggaagaccgcctcttctggttcaccgacctcggctggatgatggggccctgggccatcctgggaggcctcatcctcggggccaccgtcttcctctacgacggggcgccggaccatccgggcccggaccgcctctggcgcatggtggcggcccaccgcctcacccacttaggcctctcccccaccctggtgcgggccctcatcccctttggggaagcccccgtggaggcccacgacctctcctccctccgggtcctcggctccacgggagagccctggaacctcgagccctacctctggttcttccgggtggtgggcaaggagcggcttcccatcgtgaactactcggggggcaccgaggtctcggggggcatcctggggaacgtcctggtgaggcccatcaagcccatggggttcaacaccgccgtgcccggcatgaaggccgccgtcttggacgaggaggggaggcccgtggtgggcaaggtgggggagctcgccgtcctcgccccctggcccgggatgaccaagggcttctggcgggacgaggcccggtacctagagacctacttccagaaggtgcccggggtctgggtccacggggacttcgccctcctggacgaggaggggcacttcttcctcctcggccgctccgacgacaccctgaaggtggcgggaaagcgggtgggccccgccgaggtggagacggcggccatggcccatcccgccctgcgggagtgcgccgccatcggtgtgccccacccggtgaagggggaggccatcgtcctcttcgccgtgctgaagccgggcttcgccccctcggaggccctggccgaggaggtggcggagcgggtggccgaggccttggggaagccccttaggccggagcgggtcctcttcgtccccgacctgcccaagacgcgcaacgccaaggtgatgcgccgggtggtgcgggccgcctacctgggccaggaccccggggacctctccgccttggagaacccggaggcggtggaggccatcaagcggacccgggagggttaa

SEQ ID NO: 864 - protein, 629 aa, Thermus thermophilus
MEPVWYPDARAQETWLGRFMAELGFQDYEAFHRYSVEEAEAFYHAFFTRLGVPWRAPYTRVVEGHFPFPRFFVGGRLNLVEACLRHDPTRPALVHETEDGHVRSLTYGEARREVERLAGGLRALGVGRGDRVGLWLPMGLEAALALLAVAHLGGIAVPIFSGYGAEAAALRLKDAEAKLLIVQDGFLRRGRRVELLPEARKARAMAGTEKVAVVRRLGLPLEEEADLAALAGPLSPPEEMESMDPFMLIYTSGTTGRPKGTVHYHAGFPLKAALDLALLFDLREEDRLFWFTDLGWMMGPWAILGGLILGATVFLYDGAPDHPGPDRLWRMVAAHRLTHLGLSPTLVRALIPFGEAPVEAHDLSSLRVLGSTGEPWNLEPYLWFFRVVGKERLPIVNYSGGTEVSGGILGNVLVRPIKPMGFNTAVPGMKAAVLDEEGRPVVGKVGELAVLAPWPGMTKGFWRDEARYLETYFQKVPGVWVHGDFALLDEEGHFFLLGRSDDTLKVAGKRVGPAEVETAAMAHPALRECAAIGVPHPVKGEAIVLFAVLKPGFAPSEALAEEVAERVAEALGKPLRPERVLFVPDLPKTRNAKVMRRVVRAAYLGQDPGDLSALENPEAVEAIKRTREG

SEQ ID NO: 865 - DNA, 1884 bp, Thermus thermophilus
  CDS (1)..(1884)
atggcgctggaaaagctccttaaggttcaggaaaggctttgggcaccggaggacttgcggaagaaggcgaacctccaggactacgcggcggagtaccggaagagcctcgaggaccccgagggcttctggggggcttgggcgcggcgcttccactgggaaaagccctttgagaaggtccttgagtggaccctcccagagcaccgctggttcctgggcggcaccaccaacgccgtttacaacgccctggagcggaacgtggaaaggggcctaaggaacaaggtggccctcctctacctcgccgaggacggccgggaggaaaagctcacctacggggagcttctggaccgggtgcgccgcctggccacggggcttaggcgcctcggggtgggaaagggggaccgggtggtgatctacatgcccctcaccctggaaggggtcctcgccatgctcgccaccgcctacatcggcgccatccacagcgtggtctacgccgggcttggggtctcggccctgagggagcgcatcctggacgcccaggccaagctcctcatcgccggggacgtaagcttccggcgggggaagggggtggacctcaggagcatcgccgaggaggccatccgggaccttcccctaaaagtggtctggttccagcgggcgtacaaggcggagctttccgaagggcactacgacttccacgagctcctctggggtaacccccccgaggcccgggcggagatggtggacgccgagcaccccctcttcatcctctacacctcgggctccacgggaaagcccaagggcgtggtccacgtccacggggggtacatggtgggcaccacctaccacctgcgcaccttctttgacgtgaaggacgaggacgtcttctgggccacgagcgacatcggctggatcgtgggccactcctacatcgtctacgccccccttcttgaggggatcacctccgtcctccgggaaggggcccccgaccaccccgaccccggggccctctggcaggcggtggagcggtaccgggtgaacgtgatgttcaccgcccccacggcggtgcgcatgttcatgaagtacggccccgagtggcccaggaagtacgacctcagctccttgcgccttctggccgtggccggggagcccttgaaccccgaggccctgaagtgggcctacgagcacctggtggacgggggcaggcggggcttcgtggcggacaactggtggcagacggagctcggcggccccaccctgggaacccccctcaccctccccgccaagcccggcttcgccggggtggccctccccggggtggaggcggaggtggtggacgaggagggcaggcccgtccccccggggcagggcggcctcctcgtcctcaagcggcccttcccccacatgatgcgcaccgtctgggggaaccacgagcgctacctccggtactggcaggaggtcccggggggcgtctacgccagcggggacgtggcgagcaaggacgaggaggggtacttcagcgtcttgggccgggcggacgacgtgctgaacgtcgcggggcaccgcatcggtaccgccgacgtggaaagcgccctggtctcccaccccgccgtggccgaggccgcggtcatcggcgtccccgaccccctgaagggggaggccatcaaggccttcgtggtccttaggcttgggcaaaccccctccgaggagctgaaggaggccctcgtccagcacgtgcgccgggagctcgggcccatcgccacgccgagcgaggtggtcttcctggacaagctccccaagacccgctcggggaagatcctgaggcggctcctcaaggcccaggccctgggcaaggaccccggggacctctccaccctcgaggagtag

SEQ ID NO: 866 - protein, 627 aa, Thermus thermophilus
MALEKLLKVQERLWAPEDLRKKANLQDYAAEYRKSLEDPEGFWGAWARRFHWEKPFEKVLEWTLPEHRWFLGGTTNAVYNALERNVERGLRNKVALLYLAEDGREEKLTYGELLDRVRRLATGLRRLGVGKGDRVVIYMPLTLEGVLAMLATAYIGAIHSVVYAGLGVSALRERILDAQAKLLIAGDVSFRRGKGVDLRSIAEEAIRDLPLKVVWFQRAYKAELSEGHYDFHELLWGNPPEARAEMVDAEHPLFILYTSGSTGKPKGVVHVHGGYMVGTTYHLRTFFDVKDEDVFWATSDIGWIVGHSYIVYAPLLEGITSVLREGAPDHPDPGALWQAVERYRVNVMFTAPTAVRMFMKYGPEWPRKYDLSSLRLLAVAGEPLNPEALKWAYEHLVDGGRRGFVADNWWQTELGGPTLGTPLTLPAKPGFAGVALPGVEAEVVDEEGRPVPPGQGGLLVLKRPFPHMMRTVWGNHERYLRYWQEVPGGVYASGDVASKDEEGYFSVLGRADDVLNVAGHRIGTADVESALVSHPAVAEAAVIGVPDPLKGEAIKAFVVLRLGQTPSEELKEALVQHVRRELGPIATPSEVVFLDKLPKTRSGKILRRLLKAQALGKDPGDLSTLEE

SEQ ID NO: 867 - DNA, 2538 bp, Thermus thermophilus
  CDS (1)..(2538)
atggcgcgcaagcgagggctttccaccgtgcagcaggccctgcgccttctggcctacctggccgaccacccggaaggggtgggggcgaaggaggtggcccgcctcctggggaagagcctctcctccgcctacgccctcctccacagcctgatggaggagggcttcgtggtgaaggaggaggggggcttccggctcgcgcggcaaaagcccgtccccttggagcccacgcccttggaggaggccttggaggagctctacctgcgcacccgggagcggtgctacctcgtcctcctcaccccccagggggtgcggctcaagacccgggggcggcagggccagctccaccccctgggggagaccctgcccccggagtggcacgccctggccctgggaaaggtgctcctcgccttcggggacttccccctgccccccctcacccccaagaccccctacaccctcaccgaccccctggccctcgaggaggagctgaagcgcgtccgggcctcggggcttgcggtggagatggaggagtacgccctcggggtctccggggtggccgtccccctcctgagcccggaggggcgcctcctcggggccctgggggtcaaggtgccctcgcgccgcttccccttcgcctttggccgcctggcccgggccctggccgaggtggcccgggtctccgcccaggtcctgcccgaggaagaggcccccgctcccccgcccgccctccccgagccgggaagggtggagcggatagacccccccgaggccctccgccgcgccgccaacctgcccgacccccgggccgcccaccgggcgagcctcgaggaccccgaggccttctgggaaggcttcgcccggggtttcgcctgggaaaggccctggaaggcggtcttccgccgggaggaccggacctggttcgcgggcggcctcaccaacgtggccctaaacgccctggaccggcacctcccggaaaaggcccagcaggtcgccctcctcaccctggacggagaagggcggctcggcaagtggacctacaaggaggtccgggagctctcaagcaggctcgccgggctcttccggaccctcggggtggggcggggggacagggtggccctctacctgcccacgggcctcgaggccgccctcgccgccttggcctgcgcccggatcggggcggtgcacgccgccctgcccctgggcctgggcccggaggccctgaggcggcgcctcgaggacctgaggccccggctcctcgtggcggcggacgcctacttctaccggggccagcccgtgcgggtgcgggaggtggtggaggccgcaatccagggcctggacctcaaggtcctctggcacgtccggggaagccccgagtttctggagcggctttacgaggcccggcccgccgagcccgagcccgtgcccgcggcccaccccctcttcctccttcccacctcgggctccacggggaagcccaagggcgtggtccacggccacggggggtacatggtgggggtcgcctgggccctccgacacgtctttgacctgaagccgggagaggtgttccacaccaccgccgacctcttctggatcgtgggccactccttcggcctctacgcccccttgctcctcggcggcacctccctcctcgtggaggaccggcccgaccacccgagccccggggccttctacgagcgcctggcccacctcggggtggacgtcctcctcacctcccccgcggtgctccggaccctgaggcgccacggggaggcccggcccacgggcctccgcctggcggcgagcgtgggcgaggtgctgagccccgagatctggcgctggacccgggagcacctggcctggcccgtggacaactggtggcagacggagctcggggcccccgccctggccacgccccccgccctcccggccaagcccggccacgtgggcctccccctccccggggtggaggcccgggtggtggacgaggaggggcggcccctccctcccgggagcaaggggcacctggtcctcggcgccacggggcccgcccacatggtggacctccagggggggcgctccccctggcggggaggcctctactggacgggggacctcgcggagatggacgaggaagggtacttccgcatcctgggccgcaccgaggaggtcatcaaggtgggcgaggcccggatcggccccgcggaggtggaggccgtcctcctcacccacccccaggtggcggaggcggccgcggtgggggtgccgggggagacgggggaggagatcgccgtcttcgtggtgccgcaggcccgggagttccccgaggagctcaagcccctcctggcggaaaagctcaaggcccacatcctgcggcacctgggccccgtcccgccgcccagggtcttcttccgggaacgccttccccggacccgctcagggaagatcctgaggcggctcctcaaggcggagcttctcggcctagacccgggggacacctcgggactggaggaggactatggcgctggaaaagctccttaa

SEQ ID NO: 868 - protein, 845 aa, Thermus thermophilus
MARKRGLSTVQQALRLLAYLADHPEGVGAKEVARLLGKSLSSAYALLHSLMEEGFVVKEEGGFRLARQKPVPLEPTPLEEALEELYLRTRERCYLVLLTPQGVRLKTRGRQGQLHPLGETLPPEWHALALGKVLLAFGDFPLPPLTPKTPYTLTDPLALEEELKRVRASGLAVEMEEYALGVSGVAVPLLSPEGRLLGALGVKVPSRRFPFAFGRLARALAEVARVSAQVLPEEEAPAPPPALPEPGRVERIDPPEALRRAANLPDPRAAHRASLEDPEAFWEGFARGFAWERPWKAVFRREDRTWFAGGLTNVALNALDRHLPEKAQQVALLTLDGEGRLGKWTYKEVRELSSRLAGLFRTLGVGRGDRVALYLPTGLEAALAALACARIGAVHAALPLGLGPEALRRRLEDLRPRLLVAADAYFYRGQPVRVREVVEAAIQGLDLKVLWHVRGSPEFLERLYEARPAEPEPVPAAHPLFLLPTSGSTGKPKGVVHGHGGYMVGVAWALRHVFDLKPGEVFHTTADLFWIVGHSFGLYAPLLLGGTSLLVEDRPDHPSPGAFYERLAHLGVDVLLTSPAVLRTLRRHGEARPTGLRLAASVGEVLSPEIWRWTREHLAWPVDNWWQTELGAPALATPPALPAKPGHVGLPLPGVEARVVDEEGRPLPPGSKGHLVLGATGPAHMVDLQGGRSPWRGGLYWTGDLAEMDEEGYFRILGRTEEVIKVGEARIGPAEVEAVLLTHPQVAEAAAVGVPGETGEEIAVFVVPQAREFPEELKPLLAEKLKAHILRHLGPVPPPRVFFRERLPRTRSGKILRRLLKAELLGLDPGDTSGLEEDYGAGKAP

SEQ ID NO: 869 - DNA, 1947 bp, Thermus thermophilus
  CDS (1)..(1947)
atggacaggctggagtcggtgctcaaggaggagcgggtcttttaccccagcgaggagttccgcaagcaggcccacatcaagagcgaggaggagtaccagcgcctctacgaggagagcgtccgtgaccccgaggggttctggggacgggtggcctcggagctccactggtttgaaccctggcggaaggtcctggaaggggacctgccccaccccaagtggttcgtgggggggaagaccaacctctcctacaacgccctggaccggcacgtgaagacctggcggcgcaacaaggcggccatcgtttgggagggggagccgggggaggagagggtcctcacctaccacgacctctggcgcgaggtgcagaggttcgccaacgtcctcaagcgcctgggggtgaagaagggcgacagggtcaccatctacctccccatgatccccgaggcggccatcgccatgctcgcctgcacccggatcggggccgtccactccgtggtcttcggcggcttctccgccggggcgctggcggaccggatcaaggacgccgaggccaaggtcctcatcaccgccgacgggggcttccgccggggcgggatcgtccccctcaagcagaacgccgacgaggccctaaaggacgccacgagcgtggagcacgtggtggtggtgcgccgcaccggggaggaggtgccctggaccccgggccgggaccactggtggcacgagctcatggaggccgcccccgaccggtgcgatcccgaatccatggaggcggaggagcccctcttcatcctctacacctccggctccaccgggaagcccaagggggtgttgcacaccacgggcggctacatgacctacgtctactacaccaccaagctggtctttgacctcaaggacgaggacgtctactggtgcaccgccgacgtgggctggatcacggggcactcctacgtggtctacgggcccctcctcaacggggccaccacggtgatgtacgagggggcccccaactggcccgagcccgaccgcttctggcggatcgtggacaagtacggggtgaccgtcttctacaccgcccccaccgccatccgcagcttcatgaagtggggcgagggctggccgggcaagcaccgcctggactccttaaggctcctcggcaccgtgggcgagcccatcaaccccgaggcctggctctggtactaccacgtgatcggcaagggccgctgccccatcgtggacacctggtggcagacggagacgggcggcatcatgatcaccaccctccccggggcccacgccatgaagccggggcacgcggggaagcccttcttcggcgtggtgcccgagattttggacggcgagcaccgccccgtggagaaccccgacgaggggggccacctctgcatcacccgtccctggcccagcatgctccgcaccgtctggggcgacccggagcgcttcctgcagcagtacttcagccagcaccccggggtctacttcagcggcgacggggccaagcgggacaaggacgggtactacatgatcctgggccgggtggacgacgttctgaacgtggccgggcaccgcctgggcaccatggagatcgagtccgccctggtggcccaccccgccgtggccgaggcggcggtggtgggcaggcccgatcccgtgaagggggaggccatcgtggccttcgtgaccctgaaggaggggcacaccccctcggacgccctcaaggaggagctcagggcccacgtggccaaggtcatcggccccatcgcccgcccggacgagatccgcttcaccgacgccctgcccaagacccgctcgggcaagatcatgcgccgcctcctccggcagatcgccgccggggagaaggagatcaagggggacacctccaccctcgaggaccgctccgtggtggagcggctgaaggagggcgcctaa

SEQ ID NO: 870 - protein, 648 aa, Thermus thermophilus
MDRLESVLKEERVFYPSEEFRKQAHIKSEEEYQRLYEESVRDPEGFWGRVASELHWFEPWRKVLEGDLPHPKWFVGGKTNLSYNALDRHVKTWRRNKAAIVWEGEPGEERVLTYHDLWREVQRFANVLKRLGVKKGDRVTIYLPMIPEAAIAMLACTRIGAVHSVVFGGFSAGALADRIKDAEAKVLITADGGFRRGGIVPLKQNADEALKDATSVEHVVVVRRTGEEVPWTPGRDHWWHELMEAAPDRCDPESMEAEEPLFILYTSGSTGKPKGVLHTTGGYMTYVYYTTKLVFDLKDEDVYWCTADVGWITGHSYVVYGPLLNGATTVMYEGAPNWPEPDRFWRIVDKYGVTVFYTAPTAIRSFMKWGEGWPGKHRLDSLRLLGTVGEPINPEAWLWYYHVIGKGRCPIVDTWWQTETGGIMITTLPGAHAMKPGHAGKPFFGVVPEILDGEHRPVENPDEGGHLCITRPWPSMLRTVWGDPERFLQQYFSQHPGVYFSGDGAKRDKDGYYMILGRVDDVLNVAGHRLGTMEIESALVAHPAVAEAAVVGRPDPVKGEAIVAFVTLKEGHTPSDALKEELRAHVAKVIGPIARPDEIRFTDALPKTRSGKIMRRLLRQIAAGEKEIKGDTSTLEDRSVVERLKEGA

SEQ ID NO: 871 - DNA, 1719 bp, Bacillus cereus
  CDS (1)..(1719)
atgaaagtagaaacgcttcctgtcattaaaggagaaaataatttgccgaattatgatgaggcatacgcaaattttaactgggaagaggttaataaaaactttacttggaatgaaacaggccgagtaaatatggcgtatgaggcaattgataagcatgcgaaatccgatcgaaagaataaagtagccctttattatcaagatggatcgcgaaaagagaagtatacatttaaggaaatgaaggatttttctaataaagcaggaaacgtcctgaaaaattatggcgatgtagaaaaaggcgatcgcgtttttatttttatgccgcgttccccagagttatatttcgcccttcttggtgcagtgaaattaggggcaattgttggtccgttatttgaagcatttatggaaggcgcagttcgcgatcgtttagaagatagcgaagcaaaagtgttaattacaacgcctgaattgttagagcgcgtaccattaaatgatttaccagctttaaaaacagtcttccttgttggagatcatgtagaagaaggcggtaaaacagtagcattcaatcctttattcgaacaagcttcaaaagaattacatattgaatggttaggccgtgaagacggtctgattctacattacacgtctggttctactggtaagccaaaaggtgtgctccatgcgcaaaacgcaatggttcagcactatcaaacggcgaaatgggtattagatttaaaagaagacgatgtatattggtgtacagctgacccaggctgggtaactggtacagcttacggtattttcgcaccgtggttagtcggagcatcaaatgttattttaggcggacgttttagtccagaagcttggtatgaagcgctgcaagattacggcgtaacagtttggtatagcgcaccaacggcgttccgtatgttaatgggtgctggacaagatgcaattaaaaaatacgatttatcacaagtgcgccacgtgttaagcgttggtgaaccgttaaatccagaagtaattcgctgggggatgaacgcatttggacttcgtattcatgatacgtggtggatgacagaaacaggtggacaagttatttgtaactacccttgtatggaaatccgtccaggttcaatgggtaaaccaattccaggtgtaaaagcagcgattgttgataatgaaggaaatgaagtgcctccctacacaatgggtaacttagcaattagcaaaggttggccagcgatgatgcgcggaatttggaataacaaacaaaagtatgaatcttacttcatgccaggcgattggtacgtatcaggtgattctgcctatatggacgaggatggatacttctggttccaaggacgtattgacgatgtaattatgacgtcaggtgagcgcgttggtccgtttgaagtagaaagcaaattaatcgagcatgctgctgttgcagaagctggtgtaatcggtattcctgatccggtgcgcggcgaaattattaaagcatttatcgcgcttcgtgcagggtacgaaccatctgaagagttaaaagaagaaattcgtcaatttgtaaagaaaggtctagcagctcatgcagcgccaagacaaattgaatttagagataaattaccgaaaacgagaagcggtaaaattatgcgccgcgtattaaaagcgtgggagttaaacttgccaacaggtgacttatcaacgatggaagattaa

SEQ ID NO: 872 - protein, 572 aa, Bacillus cereus
MKVETLPVIKGENNLPNYDEAYANFNWEEVNKNFTWNETGRVNMAYEAIDKHAKSDRKNKVALYYQDGSRKEKYTFKEMKDFSNKAGNVLKNYGDVEKGDRVFIFMPRSPELYFALLGAVKLGAIVGPLFEAFMEGAVRDRLEDSEAKVLITTPELLERVPLNDLPALKTVFLVGDHVEEGGKTVAFNPLFEQASKELHIEWLGREDGLILHYTSGSTGKPKGVLHAQNAMVQHYQTAKWVLDLKEDDVYWCTADPGWVTGTAYGIFAPWLVGASNVILGGRFSPEAWYEALQDYGVTVWYSAPTAFRMLMGAGQDAIKKYDLSQVRHVLSVGEPLNPEVIRWGMNAFGLRIHDTWWMTETGGQVICNYPCMEIRPGSMGKPIPGVKAAIVDNEGNEVPPYTMGNLAISKGWPAMMRGIWNNKQKYESYFMPGDWYVSGDSAYMDEDGYFWFQGRIDDVIMTSGERVGPFEVESKLIEHAAVAEAGVIGIPDPVRGEIIKAFIALRAGYEPSEELKEEIRQFVKKGLAAHAAPRQIEFRDKLPKTRSGKIMRRVLKAWELNLPTGDLSTMED

SEQ ID NO: 873 - DNA, 1653 bp, Treponema denticola
  CDS (1)..(1653)
atgttttataaagaatatataaactatattgaaagcgatgattgggaaaccgtacataattctttttcagttaaagctcccgagaattttaattttgcttatgacataatagatagaatggctaaggaataccccgaaaaagaggctctcgtatggtgcgatgaaaccgaagaaaggattttttcgttcggagaattggcaaagcagataaataaaacagccaacttttttaaggccatgggaataggaagaggcgacacggttttgctttttttgcgaagaagatacgagttttggtttgttcttcctgccctgcacaaaataggggcaatagccgttcctgcaacggtccagctcgcagctcacgacatcgaataccgtattcaatccgccaatataaaaatgataatggccgtacaagaaaagaatttgcaagaagaaattcaaaaagctgctgagtccgcttataataagccccttcttgtctgggtgcatgacgaaatggagggttggatttcctttgatgaactcgtaaaaaatatgagtgaagattttacacctccccaagggaattcctacccttgcggaaaggacatagctcttttgtactttacctcaggtacttcgggcaatcccaaaatggtggagcataattttttatatcctcttggacacattgcgactgcaaaattttggcaaaatgtcaaggaaggcggaagacacttaagcgttgcagaaacaggctgggcaaaggctatgtggggaaagatttacggtcaatggctctgcggctgtgccgtctttgtgtacgacatgaaaatgtttatccctaaaaacctgctcgaaaaattatcaaaatacagggtaacttccttttgtgcacctcctaccgtttacaggtacttaatccgcgaaaaaatagaagattacgatttatcctcattggaagaatgtacaacggcaggtgaagcccttagcatggacatattcaatacatttaaagaaaagactggaatagaactgcgggaaggctacgggcaaacagagcttaccctcacaacaggaaccttccccggcatgaaaattaaacccggctcgatgggaaagcccgcccccggctatgagatagatattatccgccccgacggatcttcttgcaaggcaggagaatcgggagaaatcatcttgcgtttggataaaaaggttcctttcggaatgttcgggggttattataaaaatgaagaaaaaacggccgaggtttttaaggacggagtttaccacacgggagacgccgcctatagggatgaagacggttatttttggtttgaaagccgaaccgatgaccttataaaaagctccggtttccgtataagcccctttgaggtggagtcggttcttctccagcatccggcagtctttgaatgtgcggtaacaggcgtacccgaccctaagagaggtcaggcggtaaaggcctttgttgttttgaacaaaacctatcagccgagccaagccttggaaaaagagcttatgttctttgcaaagaaaaatgcggccctttacaaggccccgcgttctctcgaatttgtagaaactttgccgaaaacccataacggcaagataagccgggctgcaatcagaagccgaaaggtctga

SEQ ID NO: 874 - protein, 550 aa, Treponema denticola
MFYKEYINYIESDDWETVHNSFSVKAPENFNFAYDIIDRMAKEYPEKEALVWCDETEERIFSFGELAKQINKTANFFKAMGIGRGDTVLLFLRRRYEFWFVLPALHKIGAIAVPATVQLAAHDIEYRIQSANIKMIMAVQEKNLQEEIQKAAESAYNKPLLVWVHDEMEGWISFDELVKNMSEDFTPPQGNSYPCGKDIALLYFTSGTSGNPKMVEHNFLYPLGHIATAKFWQNVKEGGRHLSVAETGWAKAMWGKIYGQWLCGCAVFVYDMKMFIPKNLLEKLSKYRVTSFCAPPTVYRYLIREKIEDYDLSSLEECTTAGEALSMDIFNTFKEKTGIELREGYGQTELTLTTGTFPGMKIKPGSMGKPAPGYEIDIIRPDGSSCKAGESGEIILRLDKKVPFGMFGGYYKNEEKTAEVFKDGVYHTGDAAYRDEDGYFWFESRTDDLIKSSGFRISPFEVESVLLQHPAVFECAVTGVPDPKRGQAVKAFVVLNKTYQPSQALEKELMFFAKKNAALYKAPRSLEFVETLPKTHNGKISRAAIRSRKV

SEQ ID NO: 875 - DNA, 1953 bp, Mycobacterium paratuberculosis
  CDS (1)..(1953)
atgaccgccagcaacaccgcaagccccgcgtcgtatccgccgccgccgcagttcgtcgagcaggccaatgcggatgagcagttgtaccgcgaggccgagcgggaccggctgacgttctgggccgagcaggccaaccggttgtcctgggccacaccgttcaccgaggtgctggactggtcccgggcgccgttcgccgagtggttcgccgacggcacgctcaacgtcgcctacaactgcgtggaccgccacgtgcaggccggccacggcgaccgggtcgccatccactgggagggcgaatctcccggcgatcagcgcagtctgacctattccgagctgtacacgcaggtgtgcaaggccgccaacgcgctgaccgatctcggtctggtcgccggcgaccgcgtcgccatctatctgccgctgatccccgaggcggtgatcgcgatgctggcctgcgcgcggctgggcgtcatgcacagcgtggtgttcgccggcttcaccgccaaggcgctgcaggcccgcatcgccgacgcggcagccaagctgctgatcaccagcgacgggcagttccgccgcggcaagcccgcgccgctcaaggacgccgccgacgaggcggtcgccgaccccgacagcccggtcgagcacgttgtggtggtgcggcgcaccggaattgacgtgtcctggaccggcggccgcgacctgtggtggcacgacgtcgtcgacgccgccgcgcccgaacacacccccgagccgttccccgccgagcagccgctgtttctgctgtacacctcgggcaccaccggcaagcccaagggcatcgtgcacaccagcggcagctatttgacccaggccgcctacacgcactattacgtcttcgacatcaaggccgacaccgacgtgttctggtgcaccgccgacatcggctgggtcaccggacacacctacggcgtctacggcccgctggccaacggggtcaccgaggtgctctacgagggaaccccggacacaccgacccagcaccggcatttcgagatcatcgaaaagtacggcgtgacaatctattacaccgcgcccacgctgatccgcacgttcatgaagtggggccgggaaatccccgacgcgcacgacctgtccagcctgcggctgctgggttcggtcggcgaaccgatcaatcccgaggcgtggcgctggtatcgcagcgtgatcggcgccgaccggctgccgatcgtcgacacctggtggcagaccgagaccggcgccacgatgatctccccgctgcccggagtcgctgcggccaaaccgggttcggcgatgcggccgctgccgggcatctcagccaggatcgtcgacgaccacggcgaccagctggtgccgggcatccaccacggcgagcacgtcaccggctacctggtgctggaccaaccgtggccgtcgatgctgcgcggcatctggggcgaccccgaccgctacgtcgagacctactggtcgcggttcgccgagcagggctggtatttcgccggggacagcgcctattacgaccgcgacggcgccatctgggtggtcggccgcatcgacgacgtgatgaacgtgtcggggcatcggctgtccaccgccgaggtggagtcggcgctggtcggacaccacggcgtcgccgaggcggcggtggtcggcgccaccgacgccacgaccggccaggccatctgcgcgttcgtcgtgctgtgcgccgattaccaggtgcacgacgggatcgtcgacgagctgcgcgccgaggtggcccgggagatctcgccgatcgccaagccgcgggaggtgcacgtggtgcccgagctgccgaagacccgcagcggcaagatcatgcgccggctgctgcgcgacatcgccgagaaccgcgaattgggcgacacctcaacgctgctcgaccccggggtgttcgacgcgatccgggcggcgaagtag

SEQ ID NO: 876 - protein, 650 aa, Mycobacterium paratuberculosis
MTASNTASPASYPPPPQFVEQANADEQLYREAERDRLTFWAEQANRLSWATPFTEVLDWSRAPFAEWFADGTLNVAYNCVDRHVQAGHGDRVAIHWEGESPGDQRSLTYSELYTQVCKAANALTDLGLVAGDRVAIYLPLIPEAVIAMLACARLGVMHSVVFAGFTAKALQARIADAAAKLLITSDGQFRRGKPAPLKDAADEAVADPDSPVEHVVVVRRTGIDVSWTGGRDLWWHDVVDAAAPEHTPEPFPAEQPLFLLYTSGTTGKPKGIVHTSGSYLTQAAYTHYYVFDIKADTDVFWCTADIGWVTGHTYGVYGPLANGVTEVLYEGTPDTPTQHRHFEIIEKYGVTIYYTAPTLIRTFMKWGREIPDAHDLSSLRLLGSVGEPINPEAWRWYRSVIGADRLPIVDTWWQTETGATMISPLPGVAAAKPGSAMRPLPGISARIVDDHGDQLVPGIHHGEHVTGYLVLDQPWPSMLRGIWGDPDRYVETYWSRFAEQGWYFAGDSAYYDRDGAIWVVGRIDDVMNVSGHRLSTAEVESALVGHHGVAEAAVVGATDATTGQAICAFVVLCADYQVHDGIVDELRAEVAREISPIAKPREVHVVPELPKTRSGKIMRRLLRDIAENRELGDTSTLLDPGVFDAIRAAK

SEQ ID NO: 877 - DNA, 2064 bp, Ashbya gossypii
  CDS (1)..(2064)
atgtcttgcaaggaacacaaggtggtgcatgaggcgcacaatgtggaagcacgcaagacgcccgaccacttctatcggtcgcaacccggcccgtcgtatgtgcaggatatagagcaatatcggacgatgtaccaacagtcaattgaagatccggatgccttttttggtgagaaggcgcgggagttcttacactgggagaaggacttcacgcacgttcgggcggggagtttgcggaccggggacacggcgtggtttctcaacggtgagttgaacgcagcttacaactgtgtggatcggcacgcgctggagaatccagacaaggtggcgataatctacgaggctgatgacgaggctgacaaccgtgttgttacattcggtgagcttctacggcaagtgtcgcaggtggcaggcgtgctacagtcgtggggcgtgaagaagggagatactgttgctgtctatatgccgatgatcccggaggcggttgtggcaatgctcgccgtcgcccgtttaggcgccgtgcattccgtgatttttgccggattttcatctgggtcgctacgtgatcgtatcgtggacgctgaatccaaagtggtaataacgtgcgatgagggccgccgtggtgggaagacagtgcacacaaagaagattgtagatgagggcctagctggcgttggcgttgtcagccacattttagtgttccagagaaccggttccgagggaattccaatgaaggccggcagggacttctggtggcacgaggaggtacgcaagcaacgaggctatcttccaccggtttctgtgaatgcagaagacccgatcttccttctctacacctctgggtctaccggatctcctaaaggagtggtccacaccactggcgggtatttgctaggcgccgctctaactaccaggtatgtatttgacatccatcctgaggacgtacttttcactgcaggcgatgtcggctggattactggacacacctatgcgctctacggtccattatgcctaggaactgctactataatattcgagtctactccggcgtatccagactatggcagatattggcggattattcagcgccacaaggcgacacacttctacgttgcaccaacggccatgcggttaatcaagactgttggggagcaagaaatttcaaagtacgatttatcctctttgagagttctagggtccgtcggggaaccgatcgctccagatttgtgggaatggtacaatgaaaaggtgggcaataacaactgtgttgtctgcgatacgatgtggcaaactgagtctggttcacatttgattgctcctttggctggtgcaattccaacaaagccgggatctgcaactgtcccattctttggtattaatgcgtgtatcattgatcctgttacgggtgatgaattggagggcaatgacgtggaaggcgtgcttgcgatcaagtcaccttggccctcgatggcgcgttcagtctggaataatcatgaccgctacattgaaacgtacctaaaaccctaccctggctactacttcacaggtgatggagctggaagagatcatgacggatattactggatcagaggcagagttgacgatgtcgtaaacgtttcgggtcaccgtctctctactgctgaaatagaggccgcgttatcggaacacgagggtgtatcgcaggccgctgtcgttggtattgcggatgagctaactggacaagccgttgttgctttcgtgtctttaaaggaaggatatggaagaggatcttctacggatacggacccggagtcgatcgcacccgatgttgttcctttagacactctgcgccgcgagctagtgctgcaagttagagcagaaatcggtccatttgctgcgccaaaatcggttattgtcgtggacgatcttcccaagaccagatctggcaagatcatgagaagaacactaagaaaaatatcggcaaatgaggccgaccagcttggtgacttgtctacgcttgcgaacccagagacagttcccgccattattgctgctgtaggtgcccaatttctcaagggaaagaaataa

SEQ ID NO: 878 - protein, 687 aa, Ashbya gossypii
MSCKEHKVVHEAHNVEARKTPDHFYRSQPGPSYVQDIEQYRTMYQQSIEDPDAFFGEKAREFLHWEKDFTHVRAGSLRTGDTAWFLNGELNAAYNCVDRHALENPDKVAIIYEADDEADNRVVTFGELLRQVSQVAGVLQSWGVKKGDTVAVYMPMIPEAVVAMLAVARLGAVHSVIFAGFSSGSLRDRIVDAESKVVITCDEGRRGGKTVHTKKIVDEGLAGVGVVSHILVFQRTGSEGIPMKAGRDFWWHEEVRKQRGYLPPVSVNAEDPIFLLYTSGSTGSPKGVVHTTGGYLLGAALTTRYVFDIHPEDVLFTAGDVGWITGHTYALYGPLCLGTATIIFESTPAYPDYGRYWRIIQRHKATHFYVAPTAMRLIKTVGEQEISKYDLSSLRVLGSVGEPIAPDLWEWYNEKVGNNNCVVCDTMWQTESGSHLIAPLAGAIPTKPGSATVPFFGINACIIDPVTGDELEGNDVEGVLAIKSPWPSMARSVWNNHDRYIETYLKPYPGYYFTGDGAGRDHDGYYWIRGRVDDVVNVSGHRLSTAEIEAALSEHEGVSQAAVVGIADELTGQAVVAFVSLKEGYGRGSSTDTDPESIAPDVVPLDTLRRELVLQVRAEIGPFAAPKSVIVVDDLPKTRSGKIMRRTLRKISANEADQLGDLSTLANPETVPAIIAAVGAQFLKGKK

SEQ ID NO: 879 - DNA, 2085 bp, Ashbya gossypii
  CDS (1)..(2085)
atggtgacctcagcaggtgtgggacatgcagaatataacaacggggccgacgtacagcacgcagactacgcgcatctgacgagcgttgggcaggtggaacagaaaccgcttggcgggcggttaggggcgctggcggagtactacaagcccaacgtggcgagcatggaggagtaccgggcgatgcacgcgcagtcgataacggacccggcggcgttctacggtgagcgggcgcgcacgtacgtggactggttccggccgttcgacgcggtgttcttgccggggccggacgggcggccgagcttcgataacaacgcatggttcgtgaacggacagttgaacgcgtgctacaacctggtggaccgacacgcagcgcgaacgccggacaaggtggcaatcatctacgaggcggacgagccaggcgaggggtacagcctcacgtaccgcgagctcttggcacaggtgtgcaaggtggcacaggtgcttcagtactcgatgggcgtgcggaagggagacacagtggcggtgtatatgcccatgataccccaggcgttggtgacgcttcttgcgatctcgcggattggggccatacactcggtggtgtttgcggggttctcgtccaactcgctccgcgacagaatcaacgacgcgcgtagcgaggtcgtggtaaccacggacgagtcgaagcgcgggggcaagatcatcgagacgaagcgcattgtggacgacgccatcaaggagaccccgcagctacgcaaggtgttggtgtacaagcgcacatgcaacccctccgtgtcttacgtcgccgaccgggacctggattgggacactgaggtcaagaagtacaagtcatactgtccatgcgagcccgtagactccgaacacccgttatttttgttgtacacctcggggtcgacgggcgctccgaagggtgtccagcattccactgcagggtatttactacaagcatatctaagtatgctttactcgttcgatgtgcacagcgatgacatcttctttactgcgggtgacattggatggataacggggcacacgtacgtcgtgtacggaccattgttttccggatgtacgactgtggtgttcgagggtacgccagcgtatccctcttattcgcgctactgggacattattgacaaatacagtgtgacacaattctatgttgcacccaccgctctccgcttattaaagcgcgcaggtgactcttacgtggatggatactcgttgcggacgctacggtcacttggcactgtaggcgagccgattgccgcagaggtgtgggagtggtactacactgtaattggcaaacgggaaatccccgttattgatacctactggcagactgaatctggagcccacttggtaactccgttagcaggcggctccacacctatgaagccggggtctgccagcttcccattcttcgggatagatttggccattttagatccacaaacaggtgaggaacttcttgggccgaatgtagagggtgttttagctgtgaagcagccttggccctccttcactcgcacaatctggaacaaccacgataggtaccttgacacctatctcaatccatacaagggctactactttgcaggcgatggagcggcccgcgactcacaaggcttcatatggatacttggccgcgtggacgatgttgtgaacgtgtctggacatcgcctctctactgcggaggtggaggctgctattatccaagagagcatggtagcagagtgcgccgttgttgggtttgcagatgagttgactggccaagcgattgccgcctttgtggtcttgaagcagaagagcagctggaacacagcgagcgagagggagctccaggagatcaaaaagcacctaattctgtctgtccgtcgcgatattgggccgtttgctgcccctaagcttatcgtgctcgtggatgacttgccaaagactcgctcaggcaaaattatgcgccgtatattgcgcaaaatccttgctggggaggcagatcagttaggggatgtctcgaccttgtccaacccaggtattgtgaaacatttgattgagtctgtgaaattttaa

SEQ ID NO: 880 - protein, 694 aa, Ashbya gossypii
MVTSAGVGHAEYNNGADVQHADYAHLTSVGQVEQKPLGGRLGALAEYYKPNVASMEEYRAMHAQSITDPAAFYGERARTYVDWFRPFDAVFLPGPDGRPSFDNNAWFVNGQLNACYNLVDRHAARTPDKVAIIYEADEPGEGYSLTYRELLAQVCKVAQVLQYSMGVRKGDTVAVYMPMIPQALVTLLAISRIGAIHSVVFAGFSSNSLRDRINDARSEVVVTTDESKRGGKIIETKRIVDDAIKETPQLRKVLVYKRTCNPSVSYVADRDLDWDTEVKKYKSYCPCEPVDSEHPLFLLYTSGSTGAPKGVQHSTAGYLLQAYLSMLYSFDVHSDDIFFTAGDIGWITGHTYVVYGPLFSGCTTVVFEGTPAYPSYSRYWDIIDKYSVTQFYVAPTALRLLKRAGDSYVDGYSLRTLRSLGTVGEPIAAEVWEWYYTVIGKREIPVIDTYWQTESGAHLVTPLAGGSTPMKPGSASFPFFGIDLAILDPQTGEELLGPNVEGVLAVKQPWPSFTRTIWNNHDRYLDTYLNPYKGYYFAGDGAARDSQGFIWILGRVDDVVNVSGHRLSTAEVEAAIIQESMVAECAVVGFADELTGQAIAAFVVLKQKSSWNTASERELQEIKKHLILSVRRDIGPFAAPKLIVLVDDLPKTRSGKIMRRILRKILAGEADQLGDVSTLSNPGIVKHLIESVKF

SEQ ID NO: 881 - DNA, 1977 bp, Dictyostelium discoideum
  CDS (1)..(1977)
atgtttaaattaagtgacccttttgattatgaaaatgattgcaaatactctcaaataaatccaatttcattttgggatgaagttgcaaaaaaatatgcccactgggataaaatgtatgataaagtttatagtagtgatggaatgtatccagattggtttaaaggtggagaattaaatacatgttataatgttttagataaacatgttaaaaatccttcaaaaagagatcaagatgcattaatttatgaatgtccatttataaagaaaacaattaaattaacatatttccaattatatgaaaaagtatgtgaattttcaagagtacttttaaatttaaatatatcaaaaaatgataatgttttaatttatatggcaaatacattagaaccaataattgcattgttatcatgtgctcgtattggtgcaacatttatagtattatacgatggttatccagttaaaagtttgattgatagaattgacacatttacaccaaaattaattattacatcaaattgtggtattttaaatgatgaaattattacatttacatcagatttaaaagatgcaatccaattatcaacttttaaaccaaatcatgttattactcattttagaaataatgaagatattgaattcaatgatagtattattataggaaccataccaatcataccaaatacattagattgggacaaagaaattcaaaaaataaaagataataatcaaaaaccattctatgaatatgtaccagtagaatcaagtcatccactaagtatttatttcccaagtggtacatctggtaattataaagcaattgtaagaagtaatggtggtagtatagttggactggcttatagttggtttagttgtatttctaaaaaagatgaaacagtttacctttcacactcaagtattggatgggctacttttcatttgggattatttggatcattaggacttggaaatacaatggtgatgtttgaaggcgacattatgaaaccaattcattatgaacattatttatgggcaactattgaaaaacataaaatcaatacatttttaacatcaccaaaaacaataagataccttataaagaatgatccagatgctagtaaaattaagtcaaaatatgatttatcaagtttagtttcaatttggacatctggcgaagttattgaacaatcaattcctgaatatattgaaagtaaattaaaatgtcgttcatcaaatttatacggtcaaactgaaagtggttgtgcacttttatttaattataaaagaataattactaaacagaataatacactaattaatccaacaccatttttaaaaccatcaatattttcagaggatggtattgaattaccagagaatcaagttggtgaagttgcattcaaattaccattaccaccaagttttgcaacaacattttataaaaatgaattactttataaaaagatgttcaataaatttccaggttattataatagtggtgatttaggttttaaaaatgaaaatgattattatggtatagtttcaagagcagatgatcaaattaacagtcgtggcttttatgttctattaaatgaaattgaaacatcaattttaaaacatccattagttttggaatgttgttcaattggtattcatcatcaagatttagccaatgttccaattggattattagttttaaatcaacaacaaccagataattcatcattatcatcatcatcatcatcatcattaattgatttaaaaaatcaaattaatgaaattattaaaaatgatatggattattattcagaattatcgaaaattataattgttccacaattaccaaaaacaaaaactggtaaaattcctagacaaatcatttcaaaatttttaaatgaaccaaactatcaattactggatagtacatttgatcgtaaagttttttactctataaaagagttatatgaaaaaaatctttag

SEQ ID NO: 882 - protein, 658 aa, Dictyostelium discoideum
MFKLSDPFDYENDCKYSQINPISFWDEVAKKYAHWDKMYDKVYSSDGMYPDWFKGGELNTCYNVLDKHVKNPSKRDQDALIYECPFIKKTIKLTYFQLYEKVCEFSRVLLNLNISKNDNVLIYMANTLEPIIALLSCARIGATFIVLYDGYPVKSLIDRIDTFTPKLIITSNCGILNDEIITFTSDLKDAIQLSTFKPNHVITHFRNNEDIEFNDSIIIGTIPIIPNTLDWDKEIQKIKDNNQKPFYEYVPVESSHPLSIYFPSGTSGNYKAIVRSNGGSIVGLAYSWFSCISKKDETVYLSHSSIGWATFHLGLFGSLGLGNTMVMFEGDIMKPIHYEHYLWATIEKHKINTFLTSPKTIRYLIKNDPDASKIKSKYDLSSLVSIWTSGEVIEQSIPEYIESKLKCRSSNLYGQTESGCALLFNYKRIITKQNNTLINPTPFLKPSIFSEDGIELPENQVGEVAFKLPLPPSFATTFYKNELLYKKMFNKFPGYYNSGDLGFKNENDYYGIVSRADDQINSRGFYVLLNEIETSILKHPLVLECCSIGIHHQDLANVPIGLLVLNQQQPDNSSLSSSSSSSLIDLKNQINEIIKNDMDYYSELSKIIIVPQLPKTKTGKIPRQIISKFLNEPNYQLLDSTFDRKVFYSIKELYEKNL

SEQ ID NO: 883 - DNA, 2046 bp, Dictyostelium discoideum
  CDS (1)..(2046)
atgtttaaattaagtgaccctttcgattatgaaaatgattataattactctcaaataaatccaatttcattttgggacgaagttgcaaaaaaatatgttcactgggataaaatgtatgataagatttatagtagtgatggaatgtatccagattggtttaaaggtggagaattaaatacatgttataatgttttagataaaaatgttaaaaatcctgtaaaaagagatcaaaatgcattaatttatgaatgtccatttataaagaaaacaattaaattaacatattttcaattatacgaaaaagtatgtgaattttcaagagtacttttaaatttaaatatatcaaaaaatgatactgttttaatatttatggcaaatacattagaaccaataattgcattgttatcatgtgctcgtattggtgcaacattttcaactttattcgatggttatccagttagaagtttaattgatagaattgataaattgacaccaaaactaattataacatcaaattatggaattttaaatgatgaaattatcacatttacaccaaatttaaaagatgcaatccaattatcaacttttaaaccaaatcatgttattactcattttagaaataatgaagatattgaatccaatgatagtagtatagaaaccataccaatcataccaaatacattagattgggacaaagaaattcaaaaaataaaagacaacaatcaaaaaccattctatgaatatgtaccagtagaatcaaatcacccattaagtatttatttttcaagtggtacaactggtaattgtaaagcaattgtaagaagtaatggtggtaatttagttggactggtttatagttggtttagttgtatttctaaaaaagatgaaacagtttacttttcacattcaagtattggatggatttcatttcatttgggattatttggatcattagtacttggaaatacaatggtgatgtttgaaggcgacattatgaaaccaattcattatgaacattatttatgggaaactgttgaaaaacataaaatcaatacatttttaacatcaccaaaaacaataagattccttataaagaatgatccagatgctaataaaattaagtcaaaatatgatttatcaagtttagtttcaatttggacatctggcgaagttattgaacaatcaattcctgaatatattgaaagtaaaataaaatgtcgttcatcaaatttatacggtcaaactgaaagtggttgtgcccttttatttgactataaaagaataaatagtaaacagtttaaaacactatttaaaccaacaccatttttaaaaccattaatattttcagaggatggtattgaattaccagagaaccaagttggtgaagttgcattcaaattaccattaccaccaagttttgcaacaacattttataaaaatgaattactttataaaaagatgttcaataaatttccaggttattataatagtggtgatttaggttttaaaaatgaaaatgattattatggtatagtttcaagagcagatgatcaaattaaaattggtggttttgatgttctattaaacgatattgaaacatcaattttaaaacatccattagttttagaatgttgttcaattggtatttatcatcaagatttagccaatgttccaattggattattagttttaaatcaacaacaaccagataattcaccatcatcatcatcatcatcatcatcatcatcatcatcatcatcatcatcatcatcatcatcatcatcatcatcatcatcatcatcatcagcattatcattatctttaattgatataaaaaatcaaattaatgaaattattgaaaatgatattggtttttattcagaattaacaaaaatcatatttgttccacaattaccaaaaacaaaaactggtaaaattcctagacaaatcatttcaaaatttttaaatgaaccaaactatcaattaaaagatagtacatgtgatcgtgaagttttttactccattaaagagttatatgaaaaatga

SEQ ID NO: 884 - protein, 681 aa, Dictyostelium discoideum
MFKLSDPFDYENDYNYSQINPISFWDEVAKKYVHWDKMYDKIYSSDGMYPDWFKGGELNTCYNVLDKNVKNPVKRDQNALIYECPFIKKTIKLTYFQLYEKVCEFSRVLLNLNISKNDTVLIFMANTLEPIIALLSCARIGATFSTLFDGYPVRSLIDRIDKLTPKLIITSNYGILNDEIITFTPNLKDAIQLSTFKPNHVITHFRNNEDIESNDSSIETIPIIPNTLDWDKEIQKIKDNNQKPFYEYVPVESNHPLSIYFSSGTTGNCKAIVRSNGGNLVGLVYSWFSCISKKDETVYFSHSSIGWISFHLGLFGSLVLGNTMVMFEGDIMKPIHYEHYLWETVEKHKINTFLTSPKTIRFLIKNDPDANKIKSKYDLSSLVSIWTSGEVIEQSIPEYIESKIKCRSSNLYGQTESGCALLFDYKRINSKQFKTLFKPTPFLKPLIFSEDGIELPENQVGEVAFKLPLPPSFATTFYKNELLYKKMFNKFPGYYNSGDLGFKNENDYYGIVSRADDQIKIGGFDVLLNDIETSILKHPLVLECCSIGIYHQDLANVPIGLLVLNQQQPDNSPSSSSSSSSSSSSSSSSSSSSSSSSSSSSSALSLSLIDIKNQINEIIENDIGFYSELTKIIFVPQLPKTKTGKIPRQIISKFLNEPNYQLKDSTCDREVFYSIKELYEK

SEQ ID NO: 885 - DNA, 2316 bp, Oryza sativa
  CDS (1)..(2316)
atggcccagctgcatatatacgccagctgcggctgcgcacgcgcccgcgctgcgatcccgcttcccgcgcaggctcaggcatccgctgcggctctaccttgggtgatgtccgtgacttcgccgccgctgctccggcgaggagggtgggcgatgggcgcgagcgatcacgccgcggtggcggcggcggcgagcggtaacggcaagccgcgggcgaggaggccctccgccgccgcggcggccgtgctgggcgagccggtggcggcgtccgacgaccacggcctcgtccaccccagcacggacttcgcctcccaggccctcgtctcctccacgcagcaggtgatcgccgatacacgcctctctgcttttcttactgctttgccgatttcctctcggttgctgtcaattcgctctccccctcgaactggcggcgcatcgcgcgttcaaaggccgtaccttcaatttgaggcgcgcagcgatccatccatcgctggccgcagaggcgcagataaggcaagagtggcagacagcgacggcgcagtcgtataccaagaaatgtaccgacgttcgatcgacgatccggccgggttctggtcggagatcgcggagacgttctactggaagcacaagtggaaccctgacgaggtctgcaccgagaatctggatgtcaccaaggggccgatcaagatcgaatggttcaaagggggcaagaccaatatatgctacaatgcggtggaccgcaacgtggaggctggcgacggcgagaagatagcgatgtactgggaagggaacgagcccggccaggacgcgaagctcacctactccgagctcctgaacaaggtttgccagctggcaaattacctgaagagcgtcggcgtcgggaagggtgatgccgtggtgatctacctgccgatgctgatggagctgcccattgcgatgctcgcgtgtgctcggattggcgctgttcattcggttgtgtttgctggcttctctgctgacgcactagcacaaagaatcattgactgcaagcctaaggttgtgattacgtgcaacgcggtgaaaaggggaaagaaactcatagctctcaaagatatagtagatgtgtcgctggctgacagtgcgaagaatggagtcgatgtaggcatttctttgacatacgaaaatcagtcggcaatgaagagagaagacacaaaatggacgtcaggcagagacgtttggtggcaggatgttgtgcccaattttccaacaaaatgtgatgtggaatgggtagatgcagaggatccattgtttcttctatatacaagtggtagcacaggaaagccaaaggctccaaactatcctgatcctagtcgttgttgggacgttgttgacaaatacggggtgacgatattttatactgcaccaacacttattcgtgcactcatgcgtgatggtaccgagtatgttactcggtattctcgtaaatctcttcgagttctaggaagcgtaggcgagccaatcaatcccactgcttggagatggttctatgatattattggtgatgcaagatgcccaatatcagacacttggtggcagactgaaactggtggttttatgatcactcctttacctggcgcttggcctctgaaacccggatctgcgacatttcctttcttcggtgtacagccagtaatagtagatgagaaagggaaggaaatggaaggagaatgcagcggatacctttgcataaagaagtcatggcctggggctttccggacactttatggagacaaggacagatatgaaaccacatacttcaagccatttgctggctattacttctccggtgatggttgcagcagaattaccggatgtttacacactggcaaatgtaatttgaatgccagggacaaagatggataccattttctgactggacgggttgacgatgttatcaatgtcagcggccaccggattgggacagcagaggttgagtctgctctggtttcacatccaaaatgcgccgaggccgctgttgttggaattgaccatgaggttaaaggccagggaatttacgctttcgtgacattggtggacggtgttccttacagcgatgagctacggaaaagcctcgttatgactgttcgcagccagattggggcgttcgcggcgccggacaagatccactgggcgccggggctcccgaagacgcggagcggcaagatcatgcggaggatcctgcggaagatcgcgtccaggcagctggacgagctcggcgacaccagcacgctcgccgaaccaggcgtcgtcgaccagctcatcgcgctcgccgatagctag

SEQ ID NO: 886 - protein, 771 aa, Oryza sativa
MAQLHIYASCGCARARAAIPLPAQAQASAAALPWVMSVTSPPLLRRGGWAMGASDHAAVAAAASGNGKPRARRPSAAAAAVLGEPVAASDDHGLVHPSTDFASQALVSSTQQVIADTRLSAFLTALPISSRLLSIRSPPRTGGASRVQRPYLQFEARSDPSIAGRRGADKARVADSDGAVVYQEMYRRSIDDPAGFWSEIAETFYWKHKWNPDEVCTENLDVTKGPIKIEWFKGGKTNICYNAVDRNVEAGDGEKIAMYWEGNEPGQDAKLTYSELLNKVCQLANYLKSVGVGKGDAVVIYLPMLMELPIAMLACARIGAVHSVVFAGFSADALAQRIIDCKPKVVITCNAVKRGKKLIALKDIVDVSLADSAKNGVDVGISLTYENQSAMKREDTKWTSGRDVWWQDVVPNFPTKCDVEWVDAEDPLFLLYTSGSTGKPKAPNYPDPSRCWDVVDKYGVTIFYTAPTLIRALMRDGTEYVTRYSRKSLRVLGSVGEPINPTAWRWFYDIIGDARCPISDTWWQTETGGFMITPLPGAWPLKPGSATFPFFGVQPVIVDEKGKEMEGECSGYLCIKKSWPGAFRTLYGDKDRYETTYFKPFAGYYFSGDGCSRITGCLHTGKCNLNARDKDGYHFLTGRVDDVINVSGHRIGTAEVESALVSHPKCAEAAVVGIDHEVKGQGIYAFVTLVDGVPYSDELRKSLVMTVRSQIGAFAAPDKIHWAPGLPKTRSGKIMRRILRKIASRQLDELGDTSTLAEPGVVDQLIALADS

SEQ ID NO: 887 - DNA, 1965 bp, Wolinella succinogenes
  CDS (1)..(1965)
atgacccaaacccattctacggagttgttcaaacccaatcgtgcgtttgccaagaccgcccgtatcaagaatctctgtgaatatgaagacctgcgcttagatgcggaagaggactttgaaggtttctgggggaaattggccaaagagaaaattgactggatggagcccttttccaaggtactagacgagagcgaggctcccttttacaaatggtttgtcggaggcaaactcaatgtctgcgctcagtgcctcgatcgccatcttgacactcgcaaaaacaaagccgccatcatctttgaaggagagcttggtgattctcgtatcatcacctatcgagagctcttttacgaggtcaagcgcaccgccaacctcctcaaaaacaagttcaatgtcaaaaaaggcgaccgtgttgtcatctatatgcccatgattcccgaagcggccttcatgatgcttgcttgtgcgagaatcggagcgatccactccgtcgtctttggaggattctcggctgaggcgttgcgcgatcgaattattgacgccgaggcaaaactcgtcatcaccgctgatggagcctacagaagaggcaagccctatatgctaaagcccgtagtcgatgatgcactcgccgaaggcgcctgcccaagcatcgagaaggtgctcatcgtgattcgcaacaaagaagagatcaactatgtccctggacgcgactacatctacaacgagatgatcgggctagaatcagcccactgcccccctgagcctatggacgccgaagaccctctcttcttgctctacacctcaggctccacaggcaagcccaagggcgtccagcacaaccaagcaggctacatcctttgggcacagaccaccatggagtgggtctttgatgtgaaggagaatgacacctattggtgcaccgcggatgtgggctggatcacgggtcatacctatatcgtctatggccctctagccatgggcgctaccaccgtcatgtatgagggcgtgcccatctaccctgacacaggtcgatggtggaagatgatcgaacactaccgagtcaatcagttctacactgctcccacggcgattcgactccttcacaaagagggcaaagaggagcccaaaaaatacaatctctccaacctcaaagtgcttggcacggtgggcgaacccatcaaccctgatgcatggaattggtactacaacgagattggcggggggcaatgccccattgtagatacatggtggcagaccgagacagggggtcatatgatctcccctcttcccggcgcgacccctataaaacccggatgtgcgactttgcctttgccaggaatctttgcagaggtgattgacgaagaggggaatccaaagcctgcgggtgagcagggctacctctgcatcaccaagccttggccctctatgattcgcaatatttggggcgaccccaagcgctacgaatcgagctactttagcacttgtaagaaaaacggcaaacccgtctattttgctggagatggggcgattcgtgatgagagaggctacatcaccatcacagggcgaatggatgatgtcatcaatgtctctggccaccgcctcggaaccgccgagatcgaatcggctatcgccaagcaccccggagtcgccgagacagccgtggttagccgcttggatgagatcaaaggcgaatcggtttatgccttcatcgtgctcaaacccggctatgaggataatgtcgctgaagagctacaactcctcaaagagattaatgccgtcatcacaagagagatcgggcccttggctaaagccgacacgatgctctttgtccccggacttccaaaaactagaagcggaaagatcatgcggcgtatcctccgctctatcgccagaggcgaagagatcacgcaggacacctccaccctcgaagaccccgctatcgtccaaaaaatccaacaactcgcctaa

SEQ ID NO: 888 - protein, 654 aa, Wolinella succinogenes
MTQTHSTELFKPNRAFAKTARIKNLCEYEDLRLDAEEDFEGFWGKLAKEKIDWMEPFSKVLDESEAPFYKWFVGGKLNVCAQCLDRHLDTRKNKAAIIFEGELGDSRIITYRELFYEVKRTANLLKNKFNVKKGDRVVIYMPMIPEAAFMMLACARIGAIHSVVFGGFSAEALRDRIIDAEAKLVITADGAYRRGKPYMLKPVVDDALAEGACPSIEKVLIVIRNKEEINYVPGRDYIYNEMIGLESAHCPPEPMDAEDPLFLLYTSGSTGKPKGVQHNQAGYILWAQTTMEWVFDVKENDTYWCTADVGWITGHTYIVYGPLAMGATTVMYEGVPIYPDTGRWWKMIEHYRVNQFYTAPTAIRLLHKEGKEEPKKYNLSNLKVLGTVGEPINPDAWNWYYNEIGGGQCPIVDTWWQTETGGHMISPLPGATPIKPGCATLPLPGIFAEVIDEEGNPKPAGEQGYLCITKPWPSMIRNIWGDPKRYESSYFSTCKKNGKPVYFAGDGAIRDERGYITITGRMDDVINVSGHRLGTAEIESAIAKHPGVAETAVVSRLDEIKGESVYAFIVLKPGYEDNVAEELQLLKEINAVITREIGPLAKADTMLFVPGLPKTRSGKIMRRILRSIARGEEITQDTSTLEDPAIVQKIQQLA

SEQ ID NO: 889 - DNA, 1956 bp, Photorhabdus luminescens
  CDS (1)..(1956)
atgaccaaaataatgaagcaccctattcctatcgccattgcagaacatgccctgatgaatgagcaacaatatcagcaagactaccaattatcgttgcaagatcccgacaggttctggggtgaaaaaggaaaaattgttgactggattaagccttacaccaaggtaaagaatacctcttttgatcctggacatatcaatatccgctggtttgaagatggaacactaaacttaagcgcaaattgtctcgatcgtcatctaaaagaacgtggtgagcaaaccgctattatctgggaaggtgatgatccaacagaatccaaagcaataacctatcgtgaactacaccatgatgtatgtcagtttgccaatgtattgaaaaatatgggtattaaaaaaggcgatgttgttgctatttacatgccgatggtgccagaagcagcggttgccatgttagcatgtgcccgcattggtgctattcactctgttattttcgcaggtttttctcctgatgctgtatccgggcgtatcatcgattcaaacaccaaattggtcattaccgccgatgaaggattaagagccggacgtacaatccccctgaaaaagaatgttgatgacgcattaaataatgcagccgttgtcaatgtatccaatgtaatcgtttttaaacgtactggaaatattggtcactggcaatctggccgtgacctttggtggcatgaattggtcgcagacgcgagtgctgactgtccagttgaagagataaatgcagaagacccgctgtttattctctatacctcaggctctaccggtaaacccaaaggggtactgcacaccactggaggttaccttgtatatgcatctctaacatttaaatacgtattcgattatcagccgggggaagtctattggtgcacagccgatgtgggatgggttaccggacatagctacctgctctacggccccctttcctgtggtgctattaccctaatgtttgaaggcgtaccaaactatcctgcggttaaccgcctaagtcagattattgataaacatcaggtaaatatcctatatacagcacccacagcgattcgtgccctaatggcggaaggtgataaagctattgaaggaacaaaacgtacttccctgcgtattatgggatcagttggcgaaccgattaatccggaagcttgggaatggtattaccagaaaattggtaacagcaaatgcccgattgtcgatacctggtggcaaacagaaactggtggcttcatgatcacaccactaccaggcgcaaccgaactaaaagcaggttccgcaacgctacctttcttcggtgttcagcccgcattggttgataatcttggtgaacaactagaaggtgtttgtgaaggaaacctagttattaccgattcctggccaggacaagcacgctcactatttggcgatcatgaccgtttcgaacaaacctatttctctacctttaagggaatgtattttagtggtgatggcgcacgccgtgatgaagatggctactattggataactggtcgtgttgatgatgtgctgaatatttccggccaccgtctaggtactgctgaaattgaatcagctttggtctcccatcctaaaattgcagaagctgctgtcgtaggtaccccacataatattaaagggcaggcaatttatgcctatgtcaccttaaatcacggtgaagaaccctctccagaactctatacagaagtccgtaattgggtacgtaaagaaatcggcccgattgctacaccagatatcctacactggacagactccttaccaaaaacccgttcaggaaaaattatgcgtcgtatcctgcgcaaaatagcctccggcgataccaacaatctaggggacatttcaacactagcagatccaggagtagtagaaaaattgttagaagaaaaacaaacaatgagtatttcgtga

SEQ ID NO: 890 - protein, 651 aa, Photorhabdus luminescens
MTKIMKHPIPIAIAEHALMNEQQYQQDYQLSLQDPDRFWGEKGKIVDWIKPYTKVKNTSFDPGHINIRWFEDGTLNLSANCLDRHLKERGEQTAIIWEGDDPTESKAITYRELHHDVCQFANVLKNMGIKKGDVVAIYMPMVPEAAVAMLACARIGAIHSVIFAGFSPDAVSGRIIDSNTKLVITADEGLRAGRTIPLKKNVDDALNNAAVVNVSNVIVFKRTGNIGHWQSGRDLWWHELVADASADCPVEEINAEDPLFILYTSGSTGKPKGVLHTTGGYLVYASLTFKYVFDYQPGEVYWCTADVGWVTGHSYLLYGPLSCGAITLMFEGVPNYPAVNRLSQIIDKHQVNILYTAPTAIRALMAEGDKAIEGTKRTSLRIMGSVGEPINPEAWEWYYQKIGNSKCPIVDTWWQTETGGFMITPLPGATELKAGSATLPFFGVQPALVDNLGEQLEGVCEGNLVITDSWPGQARSLFGDHDRFEQTYFSTFKGMYFSGDGARRDEDGYYWITGRVDDVLNISGHRLGTAEIESALVSHPKIAEAAVVGTPHNIKGQAIYAYVTLNHGEEPSPELYTEVRNWVRKEIGPIATPDILHWTDSLPKTRSGKIMRRILRKIASGDTNNLGDISTLADPGVVEKLLEEKQTMSIS

SEQ ID NO: 891 - DNA, 2043 bp, Vibrio vulnificus
  CDS (1)..(2043)
atgacttttgagcaaaatagaataaaacttatttgtgttaatgaatggttaacaatgagaataacaatgccaacatcaagccctatctggaacccttctccagagagaattgcaaccagcaacctcaaaaagttcatagaacacatcaacatgcaaggcgaagccatcgaaaactatgcgcagttgcatcagtggtcgattgtcgaaaataaaaagttttggatggaaatctggaccttctgcgatgtgattggttaccaaggtgactgtatcgtcggtgaagggaagccaaaatggggaaattacttttcgcaaagagacaacctttggttccctcaagcggaactcaactacgctgaaaacttactttcttccgcttaccaaaagccgccagagcccgccatcatcttccggaatgaacggaatgaagaatcctgtttctcttggcaagagctgtgtgatcacgtttcaatattgcagcaatggttaattcgcaatggtgtcggtaaaggtgatgtggtggctggctatcttccatatttaccagaaaccgtcattgccatgctggcaacaaccagccttggtgcggtttggacctccacctctcccgactttggtacagacagcgttatcgaacgattaggacaagtgaaccccaaaattctgttttgctgcgatggttactcattcaatggcaaaacgttcgatatgtcagaaaagaaccgcaaaatcgctgaacagctgccagacttgctcaatatttgtgaaattgagtatttggaatctcccgagacggactacaacactaactactccacttgggctgctatattagaaaactacgatgccaaaggtatcatctacgaacgtgtgccttttaattcgcccttgtttattctctactcttccgggaccactggtaaaccaaagtgcatcattcacacggtgggcggtaccattctcaatcacctgaaagaacatcaattacattgcgatattcagcctgatgatcgtgttttttattacaccacctgtggatggatgatgtggaactggcatgtgtccacactcgccagtggggcaacgctggtgatctacgatggtagccccgtttacccagaccaatcggttttgtgggatatggtggacgattgccaagtaacactgtttggcacctcagccaaatacttagaagcgattcaacatgcgcattacgagccagcactgttccatgatctcagtacgttaaaaacgatttgttcgactggttccgtgctctatccggagcaatttgattttgtctattcgtctatcaaatccgacgttcaccttgcatctatctctggtggcaccgacatttgtggctgttttgtactgggcaaccccatctcgccagtctaccgtggggaagtacagtacgcaggcttaggtgtctctatcgccgtttacgacgcttccggacaaccagtcgttggacaacgaggtgaactggtgtgtaccaactctctgcctaacttcccgctgggcttttggcacgatgatggcgagcgttatcaccaatcatactggagcaagtatcccaatgtgtggcatcacggtgatgatgtgatcatgacaagtcatggtggatttgtcttctacgggcgaagtgacactacacttaaccccggtggcgttcgaatcggcactgcggagctctatcaacaagtgaacgcactgaacagcattgacgattccattgcggtggggaaagtgcaaaaccgtagcgaagagatctggctgtttgtaaaacctgcgacgggtttcgacttgaacgatagcattgcagaacaaatccgttcaacgctgagaaaccactgctcaccacgccacgttcccagtcaaattttcgctatttcggatattcccaaaacgcgctcagggaagttggtcgaattggcggtaaaacaagtggtgaatgggcaagaagtgaaaaacctcggggcgatcgctaacccagaagttctagaggaaatcaaacgcgttacacaagcttatcgctaa

SEQ ID NO: 892 - protein, 680 aa, Vibrio vulnificus
MTFEQNRIKLICVNEWLTMRITMPTSSPIWNPSPERIATSNLKKFIEHINMQGEAIENYAQLHQWSIVENKKFWMEIWTFCDVIGYQGDCIVGEGKPKWGNYFSQRDNLWFPQAELNYAENLLSSAYQKPPEPAIIFRNERNEESCFSWQELCDHVSILQQWLIRNGVGKGDVVAGYLPYLPETVIAMLATTSLGAVWTSTSPDFGTDSVIERLGQVNPKILFCCDGYSFNGKTFDMSEKNRKIAEQLPDLLNICEIEYLESPETDYNTNYSTWAAILENYDAKGIIYERVPFNSPLFILYSSGTTGKPKCIIHTVGGTILNHLKEHQLHCDIQPDDRVFYYTTCGWMMWNWHVSTLASGATLVIYDGSPVYPDQSVLWDMVDDCQVTLFGTSAKYLEAIQHAHYEPALFHDLSTLKTICSTGSVLYPEQFDFVYSSIKSDVHLASISGGTDICGCFVLGNPISPVYRGEVQYAGLGVSIAVYDASGQPVVGQRGELVCTNSLPNFPLGFWHDDGERYHQSYWSKYPNVWHHGDDVIMTSHGGFVFYGRSDTTLNPGGVRIGTAELYQQVNALNSIDDSIAVGKVQNRSEEIWLFVKPATGFDLNDSIAEQIRSTLRNHCSPRHVPSQIFAISDIPKTRSGKLVELAVKQVVNGQEVKNLGAIANPEVLEEIKRVTQAYR

SEQ ID NO: 893 - DNA, 2013 bp, Vibrio vulnificus
  CDS (1)..(2013)
atgactgttttaaacgtcatggaactccatcacgaagacaaaggcacaaggagagagacaatgagtgaagcccacatttatccggtaaaagagaacatcaaagcccatacccatgcggataatgatacctacctagccatgtaccagcagtcagtcactgacccagaaggtttctggagtgaacacggcaaaattgttgactggattaagcccttcaccaaagtcaaacaaacgtcttttgatactggccacgttgatattcgctggtttgaagatggcacgctcaacgtctcagcaaactgtattgaccgccatctagcagagcgcggcgatgatgtcgccatcatttgggaaggcgacaacccagcggacgacaaaactctgacttacaacgagctctacaccgaagtgtgtcgtttctcgaatgcactcaaagagcaaggcgtacgcaaaggcgacgtggtgtgtctctacatgccaatggtccctgaagcggcggttgcgatgttggcctgtacccgtattggtgcggtgcacaccatcgtctttggtggtttttcaccagaagcactggctggccgcatcatcgactccgatgccaaagtcgtcatcacggccgacgaaggcgttcgtggtggtcgcgcggtgccactgaaaaagaacgtggacgaagcactaaccaacccagaagtgaaaaccatcagcaaagtggtggtgttcaagcgcactggcggcaacattgattggcacgaacatcgtgatgtttggtggcacgaagcgacagcaaaagtctctgacgtttgcccaccagaagagatgaaagctgaagatccgctgttcatcctctacacgtcaggctcaaccggcaaaccgaaaggcgtgctgcacaccacgggcggctatttggtctacgcgaccatgacctttaagtacgtgtttgactaccagccaggcgaaactttctggtgtacggccgacgtgggttggatcactggccacacgtatctggtttacggtccactggcaaacggcgcgaaaaccattctctttgaaggcgtgccaaactatccaaacaccagccgcatgagtgaagtggtcgataagcaccaagtcaacattctttacaccgcaccaacggccattcgtgcgctgatggcaaaaggcaacgaagcgattgaaggtacggatcgtagcagcctacgcatcatgggctctgtgggtgaacctattaacccagaggcgtgggagtggtactacaagaccatcggcaacgagaaatcaccgattgtcgatacttggtggcaaaccgaaaccggcggcattttgatcacaccactgccaggcgccaccgcgctgaaaccgggttctgcaacgcgcccattctttggtgttcagcctgcactggtggacaacatgggtaatgtgatcgaagaccaagccgcagaaggtaacctcgttatcctcgattcttggccaggtcaaatgcgcacggtttatggtgaccatgaacgtttcgaacaaacctacttctcaacctttaaaggcatgtactttaccggagatggtgcgcgccgcgatgaagatggttactactggatcacaggccgtgtggatgacgtattaaacgtttctggccaccgtatgggtacagcggaaattgaatccgccctagtggcacacccgaaaattgctgaagcggcgattgttggcattccacacgacatcaaaggccaagcaatttacgcctatgtcaccctcaatgcgggcgagtatccaaccgccgagctgcataaagaagtgaaagattgggtacgtaaagagattggccccatcgcaacaccagatgtcctgcattggacagatgcactaccgaaaactcgttcaggtaaaatcatgcgccgcattttgcgcaagatcgccacgggagacaccagcaacttgggtgacacctcaacactggccgacccaagcgtagttgataagctgatcgcagaaaaagccgaactggtttaa

SEQ ID NO: 894 - protein, 670 aa, Vibrio vulnificus
MTVLNVMELHHEDKGTRRETMSEAHIYPVKENIKAHTHADNDTYLAMYQQSVTDPEGFWSEHGKIVDWIKPFTKVKQTSFDTGHVDIRWFEDGTLNVSANCIDRHLAERGDDVAIIWEGDNPADDKTLTYNELYTEVCRFSNALKEQGVRKGDVVCLYMPMVPEAAVAMLACTRIGAVHTIVFGGFSPEALAGRIIDSDAKVVITADEGVRGGRAVPLKKNVDEALTNPEVKTISKVVVFKRTGGNIDWHEHRDVWWHEATAKVSDVCPPEEMKAEDPLFILYTSGSTGKPKGVLHTTGGYLVYATMTFKYVFDYQPGETFWCTADVGWITGHTYLVYGPLANGAKTILFEGVPNYPNTSRMSEVVDKHQVNILYTAPTAIRALMAKGNEAIEGTDRSSLRIMGSVGEPINPEAWEWYYKTIGNEKSPIVDTWWQTETGGILITPLPGATALKPGSATRPFFGVQPALVDNMGNVIEDQAAEGNLVILDSWPGQMRTVYGDHERFEQTYFSTFKGMYFTGDGARRDEDGYYWITGRVDDVLNVSGHRMGTAEIESALVAHPKIAEAAIVGIPHDIKGQAIYAYVTLNAGEYPTAELHKEVKDWVRKEIGPIATPDVLHWTDALPKTRSGKIMRRILRKIATGDTSNLGDTSTLADPSVVDKLIAEKAELV

SEQ ID NO: 895 - DNA, 1887 bp, Photorhabdus luminescens
  CDS (1)..(1887)
atgtcattcaacgctttttatcagcagtccattgatgatcccaacgctttctgggctgagcaggcgcaacgtattttctggcaacatccttttgagcaagtgctggattatagcaatcctccttttgctcgttggttttgcgggggaaaaaccaacctatgctacaacgcgttggatcgctggctggaaagccagcctgatgctaaggcgctcatcactatctcaacagaaaccaatagtgagaaagtatttactttcaaagaattacatcaggaagtgaatcgagcggctgccatgatgctctctctgggcgttaaaaaaggcgacagagttttggtttatatgccgatgattgccgaagcattgtttgttttgctcgcttgtgcccgtattggtgccgttcactctgttgtctttggtggttttgcttctcagagccttgccacacggttggataatgctgaaccggtgttggtggtatctgctgatgggggagcgcgtggtggaaaaattattccttacaagccattgttagatgaagccatcgaactggcgaaccacaaaccccgccatgtattgatggttaatcgtggattggcagaaatggtttgggtaccggggagagatatcgatttcgcgacattgcggcagaagtactttgatgctgacattcccgtaacctggcttgaatcaaatgaaacctcctgtgtgctctatacttccggtacgacgggcacgccaaagggcgtgcagcgtgatgttggcggttatgctgtcgcattggcaacatctatggatatcatttttggtggtaaagcgggtgaggtattttttagcacctcagatattggctggatcgtcgggcattcttatattgcctatgctcctttaattgcaggaatggcgacgattatgtatgaggggctaccgatacggccagatgcgggtatttggtggaaaatagtggagaaatatcaagtaacgcggatgttttcagcgcctacagctattcgtgtactgaaaaaatatccaattgaatgtattggtaaatacgatatttcatcacttaagacattgtatttggcgggagaaccgcttgatgaacataccgcccgctggattgctgaggctatcaacgtccctgtcattgataattattggcagactgagaccggttggccaattatggctatcgcccgtacgctggatgaccggccgagtcgatttggcagtaccggcttcccgatgtatggctttcatgtcaagctcatcaatgaactgactggagaggcgtgtggtgataacgaaaaaggtatgctcgtgattgaaggacctttgccaccgggttgtattcaaactatctatggtgatgatacccgttttatcaatacctattggcgacactttgagcatgctgtttattccacattcgattggggtatccgtgatagtgacggctattattttattttggggcgttcggatgatgtgattaatgtggccgggcatcgtctgggaacgcgggagatagaagagtgtattgccagccatgaagatgttgccgaagtggctgtgattggtattaaggatgccatcaaggggcaagtcgcggttgcttttgctgtcctcaaggatgggaaggagatccagaatgccgagcattttgctgctttggaaaaggttttgatggggttggtcaataaacagattggtagtgtgggccgcccggcacggatttattttgtctctcagcttcccaagacgcgttcaggaaaaatgctacgtcgaaccatgcaggcaatatgtgaagggcgtgaacctggcgatctttccttgattgaaaatcctgcctcattagacgtcattcgagaagctgttttttgctaa

SEQ ID NO: 896 - protein, 628 aa, Photorhabdus luminescens
MSFNAFYQQSIDDPNAFWAEQAQRIFWQHPFEQVLDYSNPPFARWFCGGKTNLCYNALDRWLESQPDAKALITISTETNSEKVFTFKELHQEVNRAAAMMLSLGVKKGDRVLVYMPMIAEALFVLLACARIGAVHSVVFGGFASQSLATRLDNAEPVLVVSADGGARGGKIIPYKPLLDEAIELANHKPRHVLMVNRGLAEMVWVPGRDIDFATLRQKYFDADIPVTWLESNETSCVLYTSGTTGTPKGVQRDVGGYAVALATSMDIIFGGKAGEVFFSTSDIGWIVGHSYIAYAPLIAGMATIMYEGLPIRPDAGIWWKIVEKYQVTRMFSAPTAIRVLKKYPIECIGKYDISSLKTLYLAGEPLDEHTARWIAEAINVPVIDNYWQTETGWPIMAIARTLDDRPSRFGSTGFPMYGFHVKLINELTGEACGDNEKGMLVIEGPLPPGCIQTIYGDDTRFINTYWRHFEHAVYSTFDWGIRDSDGYYFILGRSDDVINVAGHRLGTREIEECIASHEDVAEVAVIGIKDAIKGQVAVAFAVLKDGKEIQNAEHFAALEKVLMGLVNKQIGSVGRPARIYFVSQLPKTRSGKMLRRTMQAICEGREPGDLSLIENPASLDVIREAVFC

SEQ ID NO: 897 - DNA, 1944 bp, Gloeobacter violaceus
  CDS (1)..(1944)
atgtcttccttcgaaatcgagtcgctcctgcacgaaaaccgccgcttcgccccgcccgcgggctttggcgagggcgcctggattaagagtctcgagcactaccgcgagctgtgcgcgcgggctgaggccgatccggagggtttctgggcggatcttgcccgcagtgagctgcactggttcaccccctggcaacaggtactcgattggcaggagcccacggcccgctggtttgtgggcggcaagctcaatcttgcttataactgcctcgaccggcatctccagacgcgcggcgacaaggttgccgtgctctgggagggcgaaccgggcgaggtgcgtgcgcttacctaccgcgaactgcacgccgaggtctgccgcttcgccaatgccctgaaggcgctgggggtcggcaagggcgacgtggtggcgatttatatgccgctggtgccggaggcggccgtcgcgatgctcggctgcgcgcgcatcggggcaccccacacggtagtcttcggaggcttctcgggcgacgcgctgcgcgaccggctcatcgatgcccaggccagggtggtggtcaccgccgacggcggctggcgcaaaggggcgattgttcccctcaaaccgcgggtggacgaggcggtggcccaggctcccggcgtggctcatgtgatctgcctgaagcgggtaggccaggaggtggccatggagccggggcgcgatcactggtggcacgaactggtggcctcccggagcgccgagtgtccggctgaagcgatggactccgaagatttgctgtttattctttacaccagcggcaccaccggcaagcccaagggcgtcgtgcacacgactggtggttacaacctctatacccacatcaccagcaagtggatcttcgatctgcacgacgaggacgtctactggtgcaccgccgacgtaggctggatcacgggccattcgtacgtggtgtacgggcccctgtcgaacggggcgacgacctttatgttcgagggtgcccccaaccaacccgaccccggccgcttctggcagctcatcgaaaagcaccgcatcggcattttctataccgccccgaccgccattcgcaccttcatcaagtggggcgacgattggcctgcccgctacgatctttcttcgctgcggcttctaggcacggtgggcgaaccgatcaaccccgaagcgtggatgtggtaccaccgggtgatcggccaggagcgctgcccgatcgtcgatacctggtggcagaccgagacgggcgggatcatgatcaccccgcttccgggggcgaccatcaccaaacccggctcggcgacgatgccttttccgggcatcgtcgccgatgtggtcgaccgcgagggcaacagctgcccccccaaccagggcggctatctggtgattcgcaggccctggccctcgatgctgcgcacggtctaccgcgacccggagcgctaccgtcagaactactggagccaggttccccacgcctactttgcaggcgacggtgcccgccgcgacgaagagggctacttctgggtgatgggccgcgtcgacgatgtgatcaacgtctccggccaccgcctgggcacgatggagatcgaatcggccctggtctcccacccggcagtggccgaggccgccgtggtcggccgacccgatgagatcaaaggcgaagcgatcgtcgcttttgtgacggtcgaatcggaggtcgagacgacgcctcagttgctcgaggagttgcgtgcccacgtcgtcaaagaaatcggcgcccttgcccgcccggaggaaatccgctatgcggaggcgctacccaagacccgctcgggcaagatcatgcggcggctgttgcgctcgctcgcctcgggaagcgacctgactggcgacacctcgaccctcgaagatcgctcggtgctcgagaagctgcgcgagggctaa

SEQ ID NO: 898 - protein, 647 aa, Gloeobacter violaceus
MSSFEIESLLHENRRFAPPAGFGEGAWIKSLEHYRELCARAEADPEGFWADLARSELHWFTPWQQVLDWQEPTARWFVGGKLNLAYNCLDRHLQTRGDKVAVLWEGEPGEVRALTYRELHAEVCRFANALKALGVGKGDVVAIYMPLVPEAAVAMLGCARIGAPHTVVFGGFSGDALRDRLIDAQARVVVTADGGWRKGAIVPLKPRVDEAVAQAPGVAHVICLKRVGQEVAMEPGRDHWWHELVASRSAECPAEAMDSEDLLFILYTSGTTGKPKGVVHTTGGYNLYTHITSKWIFDLHDEDVYWCTADVGWITGHSYVVYGPLSNGATTFMFEGAPNQPDPGRFWQLIEKHRIGIFYTAPTAIRTFIKWGDDWPARYDLSSLRLLGTVGEPINPEAWMWYHRVIGQERCPIVDTWWQTETGGIMITPLPGATITKPGSATMPFPGIVADVVDREGNSCPPNQGGYLVIRRPWPSMLRTVYRDPERYRQNYWSQVPHAYFAGDGARRDEEGYFWVMGRVDDVINVSGHRLGTMEIESALVSHPAVAEAAVVGRPDEIKGEAIVAFVTVESEVETTPQLLEELRAHVVKEIGALARPEEIRYAEALPKTRSGKIMRRLLRSLASGSDLTGDTSTLEDRSVLEKLREG

SEQ ID NO: 899 - DNA, 1965 bp, Chromobacterium violaceum
  CDS (1)..(1965)
atgtcgacgctagattccatcctcaaggaaacccgcagcttcgccccgtcggaagaattccgccgcaaggcgtccatcagcgggatcgaagcctaccacgcgctgtgcgagcaggccgacgaccactacctgtccttctggggggatctggcgcgcgaactgatcacctggaaaaaaccgttctcccgcgtgctggacgacagccaggcgccgttcttcaagtggttcgacgacggcgtgctgaacgcctcctacaactgcctggaccgccacctggccgccaacgccaacaagatcgccatcatcttcgaagccgacgacggcgaggtcacccgcgtcacctactccgagctgcaccgccgcgtctgccagttcgccaacggcctgaagagcctgggcgtgaagaaaggagaccgcgtcgtggtctacatgccgatgggcatcgaggcggtggtgacgatgcaggcctgcgcccgtatcggcgccatccactcggtggtgttcggcggcttctccgccggcgcggtgcgcgaccgcatccaggatgccggcgccaccgtggtggtcaccgccaacgagagcgtgcgcggcggcaagaacgtgccgctgaaggccaccgtcgacgaggcgctggcgctggaaggcgccgaatcggtcaggcacgtggtggtgtaccagcgcaccaacggcggcgccgactggaccgacggccgcgacgtgtggtggcacaagctgatcgaaggccagagcgaggcctgcgagccggaatggatgggcgccgaagacccgctgttcatcctctacacctccggctccaccggcaagcccaagggcatccagcacagcaccgccggctacctgctgggcgcgctgaacagcttccgctgggtgttcgactacaaacccaacgacgtcttctggtgcaccgccgacgtcggctggatcaccggccacagctacgtctgctacggcccgctggccaacggcgccacccaggtgatcttcgagggcgtgcccacctatcccgacgccggccgcttctggaagatgatcgagcagcacaaggtgtccatcttctataccgcgccgaccgcgatccgctcgctgatcaagctgggttcggacctgcccaagcaatacgacctgtccagcttgcgcgtgctgggcacggtcggcgagcccatcaaccccgaagcctggatctggtactacgaaaccgtcggcggcggccgctgccccatcgtcgacacctggtggcagaccgagaccggctcgacgatgatcgcgccgctgccgggcgcgatcgccaccaagcctggctcgtgcacgctgccgctgccgggcgtgatcgccgacatcgtcgacgagtccggcgcccaggtggagccgggccgcggcggcttcctggtgatcaagaagcccttccccagcctggtgcgcaccatctggaacgatccggaacgcttcaagaaaacctatttccccgacgagttcgacggcaagtactacctggccggcgactccgcccaccgcgacgagaacggctatttctggatcatgggccgcatcgacgacgtgctgaacgtgtccggccaccgcctgggcaccatggagatcgaatcggcgctggtggccaacccgctggtggccgaggccgccgtggtcggcaagccgcacgaggtgaagggcgaggcggtagtcgccttcgtggtgctgaagggcgcgcgtccgcagggcgacgcggccaagaccgtggcggccgaactgaagaactgggtcgcgcacgagatcggcaagatcgcgcagccggacgacatccgcttcggcgagaacctgcccaagacccgctccggcaagatcatgcgccgcctgctgcgttccatcgccaagggcgaggagatcacccaggacgtctccacgctggaaaacccgcaaatcctgcaacaactgcagcagccgctgtaa

SEQ ID NO: 900 - protein, 654 aa, Chromobacterium violaceum
MSTLDSILKETRSFAPSEEFRRKASISGIEAYHALCEQADDHYLSFWGDLARELITWKKPFSRVLDDSQAPFFKWFDDGVLNASYNCLDRHLAANANKIAIIFEADDGEVTRVTYSELHRRVCQFANGLKSLGVKKGDRVVVYMPMGIEAVVTMQACARIGAIHSVVFGGFSAGAVRDRIQDAGATVVVTANESVRGGKNVPLKATVDEALALEGAESVRHVVVYQRTNGGADWTDGRDVWWHKLIEGQSEACEPEWMGAEDPLFILYTSGSTGKPKGIQHSTAGYLLGALNSFRWVFDYKPNDVFWCTADVGWITGHSYVCYGPLANGATQVIFEGVPTYPDAGRFWKMIEQHKVSIFYTAPTAIRSLIKLGSDLPKQYDLSSLRVLGTVGEPINPEAWIWYYETVGGGRCPIVDTWWQTETGSTMIAPLPGAIATKPGSCTLPLPGVIADIVDESGAQVEPGRGGFLVIKKPFPSLVRTIWNDPERFKKTYFPDEFDGKYYLAGDSAHRDENGYFWIMGRIDDVLNVSGHRLGTMEIESALVANPLVAEAAVVGKPHEVKGEAVVAFVVLKGARPQGDAAKTVAAELKNWVAHEIGKIAQPDDIRFGENLPKTRSGKIMRRLLRSIAKGEEITQDVSTLENPQILQQLQQPL

SEQ ID NO: 901 - DNA, 1962 bp, Chromobacterium violaceum
  CDS (1)..(1962)
atgcaagcacgcgttaccccgatctggagcccgtccgccgaacggctggccggctgccatctcaccgccttcgcccgcctggccgaaaccgtctggggcaaggaattgcccgattaccaccgcctgtggcgcgccagcgtggaagacccgggccgcttctggtcgctggtctgggactactgcggcgtgatcggcgacaagggcgccgtcgcgctggagaacggcgacgacatgctggccgcccgcttcttccccgaggcccggctcaacttcgccgaaaacttgctgcgccgcgacgacgacgcgctggcggtggtgttccgcggcgaggacaagatcgaacaaaagctgagctggcatgagctgaaccagctggtctcccggctgcagcaggcgatgcgcgccgccggcatccagccgggcgaccgcgtcgccggcttcatgcccaatatgccggccacgctggcggcgatgctggccgccagcagcctgggcgcggtgtggaccagcggctctcccgacttcggcaccgacggcgcgctggaccgcttcggccagaccgagcccaggatcctgttctgcccggacggctactggtacaacggcaaggcggtggacatccgcgccaagatgatccacctggcggaaaagctgcccagcgtggagcgcttcgtggtggtgccttacctgggcgacggcgccgacttcgccgccgccgtgccgcgcgcgcagacgctggacgccttcctggccggtttcgacgcccgtccggtcgaatacctccgcctgccgttcaaccatccgctgtacatcctctattccagcggcaccaccggcaagcccaagtgcatcgtccacggcgccggcggcacgctgctgcagcacctgaaggagcaccagctgcacgccgacgttcatgccggcgaccacctgttctacttcaccacctgcggctggatgatgtggaactggctggtcagcggcctggcctccggcgccgcgctgatgctgtacgacggctcgccgttcgccgacgagggacgcgtgctgtgggactacgccgccgagcacggcttcacccatttcggcacctcggccaagtacatcgacagcctgaagaagacgcccatcgtccccgcgcgcgactggcagctgcccaagctgcgcagcctgttctccaccggctcgccgctggtggcggaaagctacgactgggtgtacgagaacatcaagtccgacctcaacctcgcctccatttccggcggcaccgacatcgtgtcctgcttcgcgctgggcgccgccacgctgccggtctaccgcggcgagctgcaatgccgcggcctgggcatggcggtggacatctacgacgagctgggccgcccgctgtaccgcgagaaaggcgagctggtttgcctgaagccgttcccgtcgatgccgataggcttctggaacgacccggacggcgagaaataccgccaggcctacttcggccgcttccccaacatctggtgccacggcgactacgccgaagtcacccagcacgacggcgtgatcatctacggccgctccgacgcggtgctcaaccccggcggcgtgcgcatcggcaccgccgagatctaccgccaggtggaagttttcccggaagtgctggaaagcctggccgtcggccagacctggcaggacgacgagcgcgtggtgctgttcgtcaagctgcgcgaaggcgttcagcttgacgaggatctgagcagccggatcaaggcccagatcaagaatggggccagccctcgccacgtgccggcccgcatcgtcgccgtggccgacatcccgcgcaccgtcagcggcaagattgtcgagctggcggtgaagaacatcatccatggccgtccggtcagcaacgtcagcgcgctggccaatccggaagcgctgaaactgttcgaaaacctgagcgagctgggagaatga

SEQ ID NO: 902 - protein, 653 aa, Chromobacterium violaceum
MQARVTPIWSPSAERLAGCHLTAFARLAETVWGKELPDYHRLWRASVEDPGRFWSLVWDYCGVIGDKGAVALENGDDMLAARFFPEARLNFAENLLRRDDDALAVVFRGEDKIEQKLSWHELNQLVSRLQQAMRAAGIQPGDRVAGFMPNMPATLAAMLAASSLGAVWTSGSPDFGTDGALDRFGQTEPRILFCPDGYWYNGKAVDIRAKMIHLAEKLPSVERFVVVPYLGDGADFAAAVPRAQTLDAFLAGFDARPVEYLRLPFNHPLYILYSSGTTGKPKCIVHGAGGTLLQHLKEHQLHADVHAGDHLFYFTTCGWMMWNWLVSGLASGAALMLYDGSPFADEGRVLWDYAAEHGFTHFGTSAKYIDSLKKTPIVPARDWQLPKLRSLFSTGSPLVAESYDWVYENIKSDLNLASISGGTDIVSCFALGAATLPVYRGELQCRGLGMAVDIYDELGRPLYREKGELVCLKPFPSMPIGFWNDPDGEKYRQAYFGRFPNIWCHGDYAEVTQHDGVIIYGRSDAVLNPGGVRIGTAEIYRQVEVFPEVLESLAVGQTWQDDERVVLFVKLREGVQLDEDLSSRIKAQIKNGASPRHVPARIVAVADIPRTVSGKIVELAVKNIIHGRPVSNVSALANPEALKLFENLSELGE

SEQ ID NO: 903 - DNA, 1713 bp, Anopheles gambiae str
  CDS (1)..(1713)
atgcagcgcacccgctggttcccggacagccggctcaacttcgccgaaaacctgttacgccgccaggatgacacgccggccatcatctcccgcatcgaagggagccccagccagatcttgagctggcgtgagctggctgatcaggtggccaggctggcccagtggctgcgtggccagggaatcggccggggcgatgtggtggcagcctacctgcccaatatcccgcaaaccgtggtggctatgctggcgaccaccagcctgggggcgatctggacctccaccagccccgatttcggcgaagctagcgtggtggagcgcttcggccagacccggccgcgtgtgttgtttgcggtggatggctatcgctacaacggcaaggctatcgacattcaggacaaagtggcggtggtcgtcagccagatcgacagcatagagcagacggtcatgatccccttgctgggccaccccctgcagcttggccacgactggcgccagatcctggccggtcagccggatgccagcctgcagttcgagcccatggccttcaatgacccgctctacatcctctattcgtccggcaccaccggcaagcccaagtgcatcgtgcacggcatcggcggcactctgctgcaacatctgaaagaacaccagctgcactgcgacatcaagccgggggagcggatcttctacttcaccacctgcggctggatgatgtggaactggctggtgagcgccctcgcctccggcgcaactctggtgctctacgacggctcccccttctacccggacggcaacgtgttgtgggatctcgcccgcgacgaagaggtcgccctgttcggcacctcggccaaatacctggatgcgctgcacaagcagggctatgccccgatcaagactcaccagctgccgcagttgcggctgatctgcagcaccggctccgtgctctcgccggaggggttcgactacgtctatcagcagatcaagcgggatgtgcagctcagctccatctcaggtggcaccgacatctgctcctgcttcgtcatcggcaaccccatcagccctgtctaccgcggcgagagccagggacgcggcctcggcctcgcggtacaggtattcaacgaagcgggtcagccggtgcagggggaaaagggcgagctagtctgtaccaagcccttcccggcccagcccatcggcttctggggggacgacagcggcgacaagtaccacgccgcctatttcgaacggttcgacaacatctggtgccatggcgactggatcgagctgaccccgaccggcggcatcctgttctacggtcgctccgacgccaccctcaacccgggcggcgtgcgcatcggcaccagcgagatctatcgctacgtggaacagctggacgaggtggaagagagcatcgtcatcggccagcagtggcaacaggacgagcgggtggtgctgttcgtcaagctcaagccaggcctcatgctggacgaggcgctgcgcgagcgtatccgccagcaggtgcgcctgcactgcaccgcccgtcacgtgccggcccgcatcctgcaggtggacgccattccgcgcaccaagtccggcaagatagtggagctggcagtgcgggaagtggtgcacaaccggcccgtcaacaacacccacgccctcgccgatcccgaggtgctgagccagtatcgcaaccggcccgagctggccagctga

SEQ ID NO: 904 - protein, 570 aa, Anopheles gambiae str
MQRTRWFPDSRLNFAENLLRRQDDTPAIISRIEGSPSQILSWRELADQVARLAQWLRGQGIGRGDVVAAYLPNIPQTVVAMLATTSLGAIWTSTSPDFGEASVVERFGQTRPRVLFAVDGYRYNGKAIDIQDKVAVVVSQIDSIEQTVMIPLLGHPLQLGHDWRQILAGQPDASLQFEPMAFNDPLYILYSSGTTGKPKCIVHGIGGTLLQHLKEHQLHCDIKPGERIFYFTTCGWMMWNWLVSALASGATLVLYDGSPFYPDGNVLWDLARDEEVALFGTSAKYLDALHKQGYAPIKTHQLPQLRLICSTGSVLSPEGFDYVYQQIKRDVQLSSISGGTDICSCFVIGNPISPVYRGESQGRGLGLAVQVFNEAGQPVQGEKGELVCTKPFPAQPIGFWGDDSGDKYHAAYFERFDNIWCHGDWIELTPTGGILFYGRSDATLNPGGVRIGTSEIYRYVEQLDEVEESIVIGQQWQQDERVVLFVKLKPGLMLDEALRERIRQQVRLHCTARHVPARILQVDAIPRTKSGKIVELAVREVVHNRPVNNTHALADPEVLSQYRNRPELAS

SEQ ID NO: 905 - DNA, 2856 bp, Plasmodium yoelii yoelii
  CDS (1)..(2856)
atgaataacgcggaacacaatggagttgcttcaaagatggattcatcaaaaattgataatattgatatagatgaaaatattttccttaatagcaaatcatttccagtaaatgaagcatatgaggtcgatcaaaataaatttggtggtaacaaccaaattaaagatataaaagaatataaaaaaatgtatgaagagagtataaaaaaccctgagttattttggggtgatatggcaaaaaataatttaaggtggtctaaattatttactaagacatatattggcaattttaataaaggaaatgttagctggtttgttaatgggaaaataaatgcctgtgataattgtgttgatagatgggttgaaaagcatcctaataagactgccattatatgggaaaaggatacaccaaatgattataaaaaaataagttatcaaaaattattagaaaaagtttgtaaaattgctaatttattaaaaatgtatggagttaaaaaacaagattgtgtaaccatttatttgccaatgataccggaattgatatattctatgctagcatgcgctagaataggtgctatacataatgttgtttttgctggatattctactaggagtttatcagaaaggatagtcagttcaggatcaactattttaattactagcgattttggtttaagaggcggtaaattaaccaaattaaaaaatattgccgatggggcaatggagatgtctggaatgatcaaaacgtgtatagtttttaaaaataaaacaaaaagaaatgataacaataataatagtatattaaatagtaaatcaaataatatgtataatacatctaatatatgctctcaaggaagtagtcatttcttgcaatattacgcagttggaaatgcaacacataaaaacaataatgatccaagcccaaatgtatatgatagtatattacataatgatatttccaatcatattaaagaagatacatttgataaaaaaactgagaatttaaataattgtgttacaaataatataacaggcatatgtagtaatagcaatcataatgatattaatttatcttctaataatgatacgaatgatgtcaatttatccaaaaataataaaatcgataaaaagggtactaaagaaaaagatatacaaacacttaataaattaatatcaaaaaataccaatataaataaaaaaaatcaaaacaaggaaaatggtacatataaagagttatataacaataatgatcagtatataatagatggaaaggaaaataaattgactgaaaatgggacacaaatgaatggacatatttcatatgataataatatgattaactgtaatcaagtaaacgcttttgaacatattaatgattataatatacacaatggacacgccaattatgaacaaaattgtaaaagcaaatatgattttgatgaaaatatatgtacactaaaagaaggtcgagatattaatggatcaatgttaatgaaaaatatgagaccatattgcccaatagaatatgtagatagtgaagattttttatctatattatatacatctggttctactgggaaacctaaaggtgtgactcatactactgcaggatatttattatatgcatttgcaacatccaaatatatttttgatataaaagatgatgatatttttggttgtgttgctgatattggttgggtaacaggtcatacttatgtagtatatggaccattattaaatggaataacaaccactttattttcatctatacctacctatcctgattgtagtagatattggaacttaatacaaactcataaaataacgcaattttatacagcccctaccgcacttagaactttaatgaaacatggtgattattatattaaaaattatgatttatcatcttgtagaatattaggaagtgtaggcgaacctataaacccagaaacatggagatggtattataatgttgttggaaaaaaaaaatgtgtaattgtcgatacatattggcaaacagaaacagggggcattgtcattgcacctataccacatttatttaaaatgaaaccgggatctgcttctttaccattttttggtatacaattagagatattaaattcaaaaacattagagccattaaagggtccaaatgtatgtggtatattatgtataaaaagttcatggccaggtatgttaagaacagtttatggaaatcacaatagattaattaaaacctattttgaagcatgccccagttattattttactggagatggtgcatatagagatgaagatgggtattattggatatcaggaaggatagatgatacactaaatgtatcaggtcatagattaggcgctgcagaaattgaacatgctttagttcaacattcatgtatttctgaatcagcagttgtatctttttctcataaagttaaaggggaaggtattctatgttttgtcgttaaaaaactcacaagttttcaaaaatatccagaatgtaatggtgataataataataatgatgaattaaataatcgatctctattaagttcaaatgacaacattgtacaaaatcatactcatgaaaattataccgatgaaaagttaatagaagaattgaagctatacgttagaaaagttattggaccaattgctacaccagatataatatgtattgtccccgatttgccaaaaacaagaagtggaaaaattataagaagaatattaagagctatagcaatcggattgaatgattatggagatatttcaactgtttcaaattatgatgttattgaaattattaaaaataaatttatggaatctaaggaaaaacgttatggcgtagcatcataa

SEQ ID NO: 906 - protein, 951 aa, Plasmodium yoelii yoelii
MNNAEHNGVASKMDSSKIDNIDIDENIFLNSKSFPVNEAYEVDQNKFGGNNQIKDIKEYKKMYEESIKNPELFWGDMAKNNLRWSKLFTKTYIGNFNKGNVSWFVNGKINACDNCVDRWVEKHPNKTAIIWEKDTPNDYKKISYQKLLEKVCKIANLLKMYGVKKQDCVTIYLPMIPELIYSMLACARIGAIHNVVFAGYSTRSLSERIVSSGSTILITSDFGLRGGKLTKLKNIADGAMEMSGMIKTCIVFKNKTKRNDNNNNSILNSKSNNMYNTSNICSQGSSHFLQYYAVGNATHKNNNDPSPNVYDSILHNDISNHIKEDTFDKKTENLNNCVTNNITGICSNSNHNDINLSSNNDTNDVNLSKNNKIDKKGTKEKDIQTLNKLISKNTNINKKNQNKENGTYKELYNNNDQYIIDGKENKLTENGTQMNGHISYDNNMINCNQVNAFEHINDYNIHNGHANYEQNCKSKYDFDENICTLKEGRDINGSMLMKNMRPYCPIEYVDSEDFLSILYTSGSTGKPKGVTHTTAGYLLYAFATSKYIFDIKDDDIFGCVADIGWVTGHTYVVYGPLLNGITTTLFSSIPTYPDCSRYWNLIQTHKITQFYTAPTALRTLMKHGDYYIKNYDLSSCRILGSVGEPINPETWRWYYNVVGKKKCVIVDTYWQTETGGIVIAPIPHLFKMKPGSASLPFFGIQLEILNSKTLEPLKGPNVCGILCIKSSWPGMLRTVYGNHNRLIKTYFEACPSYYFTGDGAYRDEDGYYWISGRIDDTLNVSGHRLGAAEIEHALVQHSCISESAVVSFSHKVKGEGILCFVVKKLTSFQKYPECNGDNNNNDELNNRSLLSSNDNIVQNHTHENYTDEKLIEELKLYVRKVIGPIATPDIICIVPDLPKTRSGKIIRRILRAIAIGLNDYGDISTVSNYDVIEIIKNKFMESKEKRYGVAS

SEQ ID NO: 907 - DNA, 2130 bp, Neurospora crassa
  CDS (1)..(2130)
atggattcaaacaccaaaacgatgtcatttgtctcaaaattggccacgagtactcagaacaatctgtccattcacatcattgcttcggctagctccaaactccgacccagagatgggtgttcgctggcactccatagattaggtcacatcactatagacacaatgacccatcctcaagacgaggcccagcatctctctctcaccgatcccgaaggattctggggtcatcaagctgaacagcttcactggcacagaaagccttctgcggttctgaaacgcacgactaaagatctgaaattgggtacctctcacagtcattgggaatggttcccagacggcgagatatccacctgctataactgccttgaccgtcatgtcctagcggggcatggagatcagcccgccattctctacgacagttcggtcacgaacaccaagcagcggttgacttacaagcagcttcttgccgaggtcgaaacttttgccggggtccttcgagaggaaggcgttaagaagggagatgttgttttagtttacagtcagttcacccagttacggctttcacgagtgtccactgagccagctactgacagcctacctatttacatagtgcccatggtgcccgccactttgatcggcattctcgccattaatcgcttgggtgccatccacgctgttgtctttggtggctttgcttccacagccctggctcagcgcattgaagcctcacgtccagtcgctatcttgacagcttcttgtggtatcgaaggtaacaaagggcctgtcagttaccgcgcctatatcgaagaagctatcagcatctcatccttcaaaccccccaagactatcatctggcagcgtgagcagctagtgtggcgtccgatcaagaaaaccgagggcgagcgggattggcagaagctggtcaagagcgcgcggttcagaaatatcaaggttgagtgtgttcctgtaaggtcggctgatcccatttacatcatctacaccagcggaaccacaggtcgaccgaaaggtgtcgttcgcgatagcggcggtcatgctgttgggctgcacatgtcgatttcgtatctgttcggtatacatggaccaggtgacgtggcgccgccacggtcctctacgaaggaagaccctgacaatgtctttatcaccgagattggcagacgaggtgggctcaagagcctcaaagccctttttcttgctggagagcggtccgagccagctatcattaacatgtaccaggacttgctcaggcggtatggcgcggcaggctcccaggttgttgataactggtggtcgtcagaatctgggtcgccgatttcgggtgttgcgttggttccgcacgcaggcaagaacaggaagacgaatatgaaagatcatccgccattacctatcaagcccgggagtgctggaaaggccatgcctgggtttgatgtcagagttgtggatgacgaaggcaacgaggtgcccaggggcaacatgggaaacatcgttctgggccttccattggcacctactgcgtttcggacactttggggggatgaggaacgattctataagagttacatgattcgcttcaatggcaagtgggttgacactggcgatgccggctatgtcgaccaaacagggtacattcacattatggcacgcactgatgacattatcaacgttgccgcccatcgcacgctcgagcaagcagtcacaagccaccccctcgtcaccgaagcatgtgtggttagcgtccccgacgccctcaaaggccagcttcctttcgccttcgtcagcacctcggacggcggcgccgacgtcaagtcagacgagcagctgttccaggatatccagaagctcgtccgcgcccaggttggcgccatcgcctcgctgggcgggatgatccggggcaagggcatgattccgaagacgcgctcgggcaagaccttgaggagagtcctacgcgaactgctagaaaatgcggtccatgacgagttcgaaaagcccatcaatatcccctcgacggtggaggatccgagtgtagtggatgtggcgagggagaagattagggaatattggcatgcgaagagcgggttgcatgcggctatcgaggctagggcgaagctttga

SEQ ID NO: 908 - protein, 709 aa, Neurospora crassa
MDSNTKTMSFVSKLATSTQNNLSIHIIASASSKLRPRDGCSLALHRLGHITIDTMTHPQDEAQHLSLTDPEGFWGHQAEQLHWHRKPSAVLKRTTKDLKLGTSHSHWEWFPDGEISTCYNCLDRHVLAGHGDQPAILYDSSVTNTKQRLTYKQLLAEVETFAGVLREEGVKKGDVVLVYSQFTQLRLSRVSTEPATDSLPIYIVPMVPATLIGILAINRLGAIHAVVFGGFASTALAQRIEASRPVAILTASCGIEGNKGPVSYRAYIEEAISISSFKPPKTIIWQREQLVWRPIKKTEGERDWQKLVKSARFRNIKVECVPVRSADPIYIIYTSGTTGRPKGVVRDSGGHAVGLHMSISYLFGIHGPGDVAPPRSSTKEDPDNVFITEIGRRGGLKSLKALFLAGERSEPAIINMYQDLLRRYGAAGSQVVDNWWSSESGSPISGVALVPHAGKNRKTNMKDHPPLPIKPGSAGKAMPGFDVRVVDDEGNEVPRGNMGNIVLGLPLAPTAFRTLWGDEERFYKSYMIRFNGKWVDTGDAGYVDQTGYIHIMARTDDIINVAAHRTLEQAVTSHPLVTEACVVSVPDALKGQLPFAFVSTSDGGADVKSDEQLFQDIQKLVRAQVGAIASLGGMIRGKGMIPKTRSGKTLRRVLRELLENAVHDEFEKPINIPSTVEDPSVVDVAREKIREYWHAKSGLHAAIEARAKL

SEQ ID NO: 909 - DNA, 2070 bp, Synechococcus sp
  CDS (1)..(2070)
atggtttcaccctctgtccgacggattgatacgggtcgtggaacggtcgatcgactcctccgtacccttgcaacaacagtctttggcccgcctgctgtgaccgagtccaatacgtcgatcgaaagtgtcctgcaggagcagcgggtatttcagccgccggcggagatggcggctgcagcacgcatcggcagtctggagagttaccgcgccatggcggcggcggcgaccaaggatcccgatgggttctggggggaggcagcccgtcgtgagctgcattggttcgagccgttccacacggttctcgattggtcggaacctcctttcgcccgctggtttgaagggggcaccaccaacctgtcgtacaactgtctcgaccgacatctcgagggggccaaggccgagaagaccgcgctgatctgggaaggggagcccggagacgtgcgccgtttcagctaccgcgagctccatgccgaggtgtgcaaagccgccaacgctctgaaggccatgggcattggcaaaggcgatctggtcgccctctacatgccgatgattccagaggccgccattgcgatgctcgcctgcgctcgcatcggtgccccccattccgttgtgttcggtggtttctctgccgaggccttgcgcgatcgcctcaaggacggtgaggcgaaggccgtgatcacagcggatgggggattcagaaaggacaagcccgtttccctcaaacctgctgttgatgcagctctagcggagggcgcctgtccttcggtgaccggcgtgctcgtggtgcagcgcaccaagcagcccgtggagatggttgccggccgcgatcagtggtggcacgacctcgtggatgcccagggcagcgattgccctgcggagccgatggccagtgaagatcgactgttcgtgctctacacctcaggttccaccggcaaacccaagggtgtagtgcacaccactgccggttacaacctctgggcccatctcaccttccagtggattttcgacatccgcgataacgacgtctactggtgcacagcggatgttggctggatcactggccacagctacatcgtgtacggcccgctgtccaacggtgcgaccaccgtgatgtacgagggggcgccgcgcccctccaaacccggtgcgttctgggagttgatccagaagcacggcatcacgatcttttacaccgcgccgactgcgattcgagccttcatgaagagtggccgccaggtgccggatcaattcgacatgagcagccttcgcctgctgggcaccgttggtgaaccgatcaatccggaggcctggatgtggtaccgcgacgtgattggcggcaaccgctgtccgattgtcgacacttggtggcagaccgaaaccggtggcgtgatgatcagtccgctgcctggagccactcccaccaaaccgggatccgccacgctgccgctgccgggcattcaggccgacatcgttgatggagaaggcaacagctgcgggcccgatgaaggtggatacctggctgtccgagccccctggcctggaatgatgcgcacggtccatggcaacccccagcgctttcgtgagagctattgggagcacatccgtcctgccgatggctcgtacctctatttcgctggggatggcgcccgccgtgatgccgatggatatttctgggtgatgggccgggtggatgacgtgatcaacgtctccggtcaccgcctcggcacgatggaaattgagtcggctctggtgagccatcccgcggtggcggaagctgctgtggtgggtcgtcccgatgacctcaaaggtgaaggcatcgttgcgttcgtcacccttgagtcggggcgtgagtcgtcggatgatctgatcaagcaactcagggcccatgtgggcacggagataggaccgatcgctcggccggatgagattcgttgcagtgatgcactgcccaagacccgcagcggcaagatcatgcgccggatcctgagggccctggccgccggtcaggaggtcagcggcgacaccagcaccctggaggatcgttcggtcctcgatcggctgcgggcttga

SEQ ID NO: 910 - protein, 689 aa, Synechococcus sp
MVSPSVRRIDTGRGTVDRLLRTLATTVFGPPAVTESNTSIESVLQEQRVFQPPAEMAAAARIGSLESYRAMAAAATKDPDGFWGEAARRELHWFEPFHTVLDWSEPPFARWFEGGTTNLSYNCLDRHLEGAKAEKTALIWEGEPGDVRRFSYRELHAEVCKAANALKAMGIGKGDLVALYMPMIPEAAIAMLACARIGAPHSVVFGGFSAEALRDRLKDGEAKAVITADGGFRKDKPVSLKPAVDAALAEGACPSVTGVLVVQRTKQPVEMVAGRDQWWHDLVDAQGSDCPAEPMASEDRLFVLYTSGSTGKPKGVVHTTAGYNLWAHLTFQWIFDIRDNDVYWCTADVGWITGHSYIVYGPLSNGATTVMYEGAPRPSKPGAFWELIQKHGITIFYTAPTAIRAFMKSGRQVPDQFDMSSLRLLGTVGEPINPEAWMWYRDVIGGNRCPIVDTWWQTETGGVMISPLPGATPTKPGSATLPLPGIQADIVDGEGNSCGPDEGGYLAVRAPWPGMMRTVHGNPQRFRESYWEHIRPADGSYLYFAGDGARRDADGYFWVMGRVDDVINVSGHRLGTMEIESALVSHPAVAEAAVVGRPDDLKGEGIVAFVTLESGRESSDDLIKQLRAHVGTEIGPIARPDEIRCSDALPKTRSGKIMRRILRALAAGQEVSGDTSTLEDRSVLDRLRA

SEQ ID NO: 911 - DNA, 1983 bp, Prochlorococcus marinus subsp
  CDS (1)..(1983)
atgacattagataagaaacattcaatcaacaatattcttgaagaaaatagactcttccccccttcaaaagaattctcagataaatcaaatataaaaagttttgaggaattacaaagtttaaaaaaacaatctttagagaacccaacaaaattctgggaatcttttgcaaattcggaaattgattggttcgaaccatttcagactgttttagaccgagaaaatgcgcccttttttaaatggtttaaggaaggtaagttgaatatcacttataactgcttagatagacatatcaaaaacggaattgggaataaaacagcgcttgtatgggaaggcgagccaggagataacaagaaatatacgtatcaagaacttctcaaagaagtatgcaaagcttcaaatgctttgaaatctttgggaataaaaaagggtgatttggtctgtatttatatgccaatgattcctgaggcgatggttgccatgctcgcttgcgcgagaattggagctcctcattccgtagtttttggaggcttctcctctgagtcgttaaaagataggttaattgatggaaatgccagatttgttataacggcagatggtggttttagaaaagataaggtaattgagcttaagaaagctgttgatgcggcaattgaaagtggggcaaataagattgttgaaaaagttattgttgttcaaagaactaaaaaagatatctcgatggtaaacaatagggatttttggtggcacgaattattaaaagatcaaaaagattggtgtgaacctgaaattatgaatagcgaagatagattgtttgtcttatatacttcaggatccactggtaaaccaaagggtgttgttcatacaactgctggttataatctctggtctcaccttacattcaagtggatttttgatataaaagatgatgatgtctattggtgtacagcagatgttgggtggattactggacatagttatatagtatatggacctttatccaatggagcaacaactcttatgtttgaaggtgttccaagggcatctaacttaggggctttttgggaaattattcaaaaatacaaagttactattttctatacagcgccaacagcgataagatcatttatgaaatctggacgtgaaatccctgaccaatacgatttaagatctttgagacttttggggacagttggcgagccaattaatcctgaagcatggatgtggtatcgagaggtaataggtgataataagtgtccaatagtagatacatggtggcaaactgaaactggtggtgtgatgataagcccgttaccaggagccgttgctacaaagccaggttccgcaacattctctttgcctggaatcgaggttgaagttgtagataaaaatggagaaaaggtggtggaaaatgagggtggatatttggttgttaaaaaaccttggcctggaatgatgcgtacaattcatgaaaactctcaaagatatttagaaagttattgggaatatatttcttttaaaggtgaaaaaaatgtttatttcgctggtgatggggctcggattgataatgatggatatatttggattatgggaagagttgatgatgttataagtgtttccgggcatcgtttgggaactatggagatagagtccgcattagtaagtcataaatcagttgcggaagctgctgttgtcggaagaaaagatgatttaaaaggtgaggctattgttgcatttgtatctttagaaaaagatataaatagttttccagaaatagttgaggagttaaagaaacatgtagttaatgaaattggaattattgctaaaccagaaaaaataataatttcagattctcttccaaaaacgcgtagtggaaaaataatgagaagaattttgagatccttggcagaaggcgaaaaaataagtggagatattagtactcttgaagatagttctgttttagaaaaattaaaggaaatatcttaa

SEQ ID NO: 912 - protein, 660 aa, Prochlorococcus marinus subsp
MTLDKKHSINNILEENRLFPPSKEFSDKSNIKSFEELQSLKKQSLENPTKFWESFANSEIDWFEPFQTVLDRENAPFFKWFKEGKLNITYNCLDRHIKNGIGNKTALVWEGEPGDNKKYTYQELLKEVCKASNALKSLGIKKGDLVCIYMPMIPEAMVAMLACARIGAPHSVVFGGFSSESLKDRLIDGNARFVITADGGFRKDKVIELKKAVDAAIESGANKIVEKVIVVQRTKKDISMVNNRDFWWHELLKDQKDWCEPEIMNSEDRLFVLYTSGSTGKPKGVVHTTAGYNLWSHLTFKWIFDIKDDDVYWCTADVGWITGHSYIVYGPLSNGATTLMFEGVPRASNLGAFWEIIQKYKVTIFYTAPTAIRSFMKSGREIPDQYDLRSLRLLGTVGEPINPEAWMWYREVIGDNKCPIVDTWWQTETGGVMISPLPGAVATKPGSATFSLPGIEVEVVDKNGEKVVENEGGYLVVKKPWPGMMRTIHENSQRYLESYWEYISFKGEKNVYFAGDGARIDNDGYIWIMGRVDDVISVSGHRLGTMEIESALVSHKSVAEAAVVGRKDDLKGEAIVAFVSLEKDINSFPEIVEELKKHVVNEIGIIAKPEKIIISDSLPKTRSGKIMRRILRSLAEGEKISGDISTLEDSSVLEKLKEIS

SEQ ID NO: 913 - DNA, 1977 bp, Prochlorococcus marinus
  CDS (1)..(1977)
atgtcccctgatccatccggcaccattaagtcagtcctgcaggagcagcgcgtctttcatccctccgcagagttggcctcacagtcgatggttggaagcctggaagcctatcgtcggatggcagagcaagccaaaactgatcctgacagtttctggggtgaagccgctcgcactgagctggaatggttcgaaccctttgatagcgttctcgattggtcgaatcctccctttgcgcgttggtttgaaggaggcacgacaaatctttccttcaactgtcttgatcgccatctcaatgggccgaaggcaaacaaaacagccctgatctgggagggagagccaggtgatgtgcggcgcttcacctatcgagaacttcatgctgaagtgtgcagggctgccaatgcgctgaaagctcttggcattggcaaaggtgacctggttgccctttatatgccaatggtcccagaagcggccattgccatgttggcttgcgcccgtatcggagccccacattctgttgtctttggtggcttttccgctgaagcccttagagatcgtttggtggatggtgaagccaaagccgtgatcactgctgatggtggttttcgtaaggacaaggccgttgccttgaagccggcagtggatgctgcattagccgagggtgcctgccccagcgtgacgtcggtgctggtggtgcaacgcacgaaagaaagcgtggtgatggaagctggtcgagatcagtggtggcacgagcttgtgtcagctcaatcgcaagagtgcgcggcggaacccatggcgagtgaagatcgcctgtttgtgctctacacctctggctccactggaaagccaaagggcgttgtgcacagcacggcaggctataacctctgggctcacctcactttcaagtggatcttcgacattcgcgacgaagacgtctactggtgcacagccgatgtgggctggatcacaggccatagctacattgtttatgggcctctttccaatggggcgacaactgtgatgtatgagggggcaccacgcccatccaagcctggagccttttgggagctaattcagaaacacgggatcacgattttttacactgcacctacggcaattcgggcattcatgaaaagtggtcgggctgtacccgatcaatacgacatgagcagtctgcgcttgctaggtaccgtcggagaacccatcaatcctgaggcctggatgtggtatcgcgaggtcatcggtggtgatcgttgcccaattgtcgacacttggtggcaaacggagacaggtggggtgatgatcagcccattacctggtgcgacgccaacaaagccagggtctgcgacccttcccctaccaggcattgaggctgaggtggttgatgcacaaggcgagccagtagccgttgacgaaggtggatatctgatcgtgcgacgtccttggccaggaatgatgcgcaccgtgcacggaaatcctcaacgctttagagagagctattgggaatacttacgccctaaggatggcagtttcatctatttcgcaggcgatggagctcgtcgagatggtgatggttatttctgggtgatgggcagggtggatgatgtgattaacgtttcaggccatcgtcttggcacgatggaaatcgaatcggcattggtgagtcacccggcagtgtctgaagcggcagtggttggaagacctgatgaccttaaaggtgaagcgatcgtggccttcgtcaccttggaaggaagcagggaagtgagtgatgctttgattcaggagcttcgtgttcatgtgggcaaggagatcggccccattgctcgacctgatgagatccgttgcagtgatgccttacccaagacccgcagcggcaaaattatgcggcgtatcttgcgggctttggccgctggagaggaggtcaagggtgataccagcaccctggaagatcgctccgtactggatcggcttagagcctga

SEQ ID NO: 914 - protein, 658 aa, Prochlorococcus marinus
MSPDPSGTIKSVLQEQRVFHPSAELASQSMVGSLEAYRRMAEQAKTDPDSFWGEAARTELEWFEPFDSVLDWSNPPFARWFEGGTTNLSFNCLDRHLNGPKANKTALIWEGEPGDVRRFTYRELHAEVCRAANALKALGIGKGDLVALYMPMVPEAAIAMLACARIGAPHSVVFGGFSAEALRDRLVDGEAKAVITADGGFRKDKAVALKPAVDAALAEGACPSVTSVLVVQRTKESVVMEAGRDQWWHELVSAQSQECAAEPMASEDRLFVLYTSGSTGKPKGVVHSTAGYNLWAHLTFKWIFDIRDEDVYWCTADVGWITGHSYIVYGPLSNGATTVMYEGAPRPSKPGAFWELIQKHGITIFYTAPTAIRAFMKSGRAVPDQYDMSSLRLLGTVGEPINPEAWMWYREVIGGDRCPIVDTWWQTETGGVMISPLPGATPTKPGSATLPLPGIEAEVVDAQGEPVAVDEGGYLIVRRPWPGMMRTVHGNPQRFRESYWEYLRPKDGSFIYFAGDGARRDGDGYFWVMGRVDDVINVSGHRLGTMEIESALVSHPAVSEAAVVGRPDDLKGEAIVAFVTLEGSREVSDALIQELRVHVGKEIGPIARPDEIRCSDALPKTRSGKIMRRILRALAAGEEVKGDTSTLEDRSVLDRLRA

SEQ ID NO: 915 - DNA, 1977 bp, Prochlorococcus marinus
  CDS (1)..(1977)
atgagctctgattcttcagcaaaaattgagacagtacttcaggaagaaagggtttttaatccttctgatgaaacaattaatcgagcaagtattaaaggttttgctcaatatcagaagatggttaattctgccaagtcggatcctcaaaagttttggggtgaggcagctttagagggattgcattggtttaagccttttaatactgttttggattggactgatcctccttttgcaagatggtttgatggaggtaagacaaatgtttcatataattgtttagatcgtcatgtaaagcaagggaaaggcgaaaaaattgcaattatttgggaaggtgagcctggagaagttaggaaaatcacctataagcaacttttagaacaagtatgtcgcacagctaatgcattaaaagaaattggtattaaaaaaggtgatttggttgcactgtatatgccaatggtccctgaggctgctgtggctatgcttgcttgcgccagaataggggctcctcattctgtagtttttggaggtttctcttcagaagctttacgagaccgaataaatgatggccaagcaaaagcaattattactgcagatggtggttttcgtaaagataaaataatctccttaaaaaatgctgttgattctgctttgtcggggaatagttgtccaagcgttgaatctgttttagtagtaaaaagaacttctgaaagtatttcctttagtcctggtagagattattggtggcatgagttagtacctgctcaatcaatagattgccctgctgaagaaatggatagcgaggatagactttttgttctttatacgtcaggttccacaggaaagccaaaaggtgttgttcatactacggcaggttataacttgtgggcccatatgacttttcagtggatttttgatgttcgtgaagaggaaatttattggtgcacagctgatgttggatggattaccgggcatagctacatcgtttatggtccattgtctaatggttcaacaactgtcatgtatgaaggcgtaccacgcccttccaacccaggagcattttgggatcttatagaacgtcataagatcaatattttttatactgcgccaacagccattagagcttttatgaaatctggtagggatatcccagataaatataatttgaaaagtttgagattactaggaacagttggcgaacctattaatccagaagcttggatttggtatagagatgttataggaggcaattcctgtccaattgttgatacttggtggcagacagagactggcggtgtgatgataagtcctttgcctggcgcaattcctactaagcctggctcagcaactctccctttgcccggtatagaggctgaaatagttaatgctgaaggcaaatctgtagatgttaatcaaggtgggtatttagttatcaaacatccttggcctggaatgatgagaacggttcatggaaaccctcaaagatttcgtgaaagttattgggagtatttgcctccaattaatggaagccttgtttattttgccggtgatggtgctagacgagataaggatggctatttttggatcatgggaagggttgatgatgtaattaatgtatctggacaccgtttaggaactatggaaatagagtctgctcttgtaagccataattcagttgctgaagcagcagttgtaggaaaaccagatgatattaaaggagaagcaattgttgcgttcgtgactttggagtcaggagcaaatcacaacgaaaagcttttaactgatttaaaagtacatgtaagtacggaaataggagctattgctaggccggatgaaattcgttttaccaattctttaccaaaaacaaggagtggaaaaattatgcggcgattacttagagcattagcagcaggtgaggaagttaagggagacacaagtacattagaagataggaatgttttagatgaacttaggaagtga

SEQ ID NO: 916 - protein, 658 aa, Prochlorococcus marinus
MSSDSSAKIETVLQEERVFNPSDETINRASIKGFAQYQKMVNSAKSDPQKFWGEAALEGLHWFKPFNTVLDWTDPPFARWFDGGKTNVSYNCLDRHVKQGKGEKIAIIWEGEPGEVRKITYKQLLEQVCRTANALKEIGIKKGDLVALYMPMVPEAAVAMLACARIGAPHSVVFGGFSSEALRDRINDGQAKAIITADGGFRKDKIISLKNAVDSALSGNSCPSVESVLVVKRTSESISFSPGRDYWWHELVPAQSIDCPAEEMDSEDRLFVLYTSGSTGKPKGVVHTTAGYNLWAHMTFQWIFDVREEEIYWCTADVGWITGHSYIVYGPLSNGSTTVMYEGVPRPSNPGAFWDLIERHKINIFYTAPTAIRAFMKSGRDIPDKYNLKSLRLLGTVGEPINPEAWIWYRDVIGGNSCPIVDTWWQTETGGVMISPLPGAIPTKPGSATLPLPGIEAEIVNAEGKSVDVNQGGYLVIKHPWPGMMRTVHGNPQRFRESYWEYLPPINGSLVYFAGDGARRDKDGYFWIMGRVDDVINVSGHRLGTMEIESALVSHNSVAEAAVVGKPDDIKGEAIVAFVTLESGANHNEKLLTDLKVHVSTEIGAIARPDEIRFTNSLPKTRSGKIMRRLLRALAAGEEVKGDTSTLEDRNVLDELRK

SEQ ID NO: 917 - DNA, 1902 bp, Helicobacter hepaticus
  CDS (1)..(1902)
atgcccacatatcaagaaatttatcaacaatccattgagaatccagaaattttttgggcagaagctgctaaaaaagtgcattggtatcacgaatgggataaggtgcttgatgttgtcaatgaccattatcgttggtttgttggaggttgtatgaatacttgctacaatgctcttgacttgcacatagaaaatggcagaggagagcaagtagcactctattatgattcgcctgtaactgatacaaaaaaatcttatacttataaagaattgcgcaaacgcgtagccaaaactgctggaatacttgtgaataaaggtgtagttaagggcgatagagtgcttatttatatgcctatgattccagaggctgttattgctatgcttgcgtgtgcaaggattggtgctattcatagtgttgtatttggcggatttgcttcacacgagcttgcttcgcgtattgaagatgctaaaccacgagtgattataagcgcttcgtgtggcatagaaattagccgagtagtcaaatataaacctattcttgatgaggctattaaatcttcaaatcataaacccaccacttgtcttatttggcaacgcccacaagagagagcaaatatgctcccttggcgtgatgtagattgggagagtgaagaagagaaaactgaaggcgtagaatgtgttccgcttgatgcaactgaccctttatatgtgctttatacttcaggcacaacaggtaagccaaaaggtgttattcgtggcaatggaggacattctgtggctatgaaatggtcaatggataatatttataatgccaaaccaggcgatgtattttgggctgcaagtgatgtaggctgggtagttggacatagctatattgtatatgcaccgctaatgaatggttgcacaacaatcctttatgaaggaaaacctgtcaaaacccctaatcctggtgcattttggcgtgttgtccaagaatataaggttaatattctattctctgcacctactgcatttagggctattaaaaaagaagatcccaaaggcgaatggcttaaaaaatatgatctctcttcgcttaaagcagtgtttgttgctggagaacgttgcgatacagatacgctcaaatggattgaaaaaattaccaaaaaacctgtgattgaccattggtggcagacagaaaccggctgggcaatagcagctaatcctttaggtttagaaccacttcctatcaaagcaggttctcctactaagcctatgcccggattcaatcttaaggtgcttgatgaagagggtaaggaatgtaagaggggaaaattagggaatcttgttatcaagcttccattacctcctgcgtgtctttgcggtatttggggtgatgatgcacgatataaacgttcttacctcaatcactatccgggctattatcttacaggtgatagcgggtatattgacaaagacggctatgtgtttgtaatgggacgaatggacggagtaatcaatgttgcagggcatcgtctctccacgggtggtatggaagaagccatttcaaaacatccagatattgctgaatgtgcagttataggtgttaataatgaactcaaaggggagattccattagcctttgttgtgcttaaagacggacttgaacgtgatacacaaagtttatgcgagggtgttgttcaactcgtgcgagaggaaattggtgcagtagcgtcattgcatattgtagctgttgtggcaagacttcctaaaacacgaagtggtaaaatcttgcgtggcacaatgcgtgatattgctgatggcaatgaatggaagatgccctcaactattgaagattcaagcgttatgccagagatagaaaaaacacttgccacgcttggctatccaatcaaaacaaaggagtaa

SEQ ID NO: 918 - protein, 633 aa, Helicobacter hepaticus
MPTYQEIYQQSIENPEIFWAEAAKKVHWYHEWDKVLDVVNDHYRWFVGGCMNTCYNALDLHIENGRGEQVALYYDSPVTDTKKSYTYKELRKRVAKTAGILVNKGVVKGDRVLIYMPMIPEAVIAMLACARIGAIHSVVFGGFASHELASRIEDAKPRVIISASCGIEISRVVKYKPILDEAIKSSNHKPTTCLIWQRPQERANMLPWRDVDWESEEEKTEGVECVPLDATDPLYVLYTSGTTGKPKGVIRGNGGHSVAMKWSMDNIYNAKPGDVFWAASDVGWVVGHSYIVYAPLMNGCTTILYEGKPVKTPNPGAFWRVVQEYKVNILFSAPTAFRAIKKEDPKGEWLKKYDLSSLKAVFVAGERCDTDTLKWIEKITKKPVIDHWWQTETGWAIAANPLGLEPLPIKAGSPTKPMPGFNLKVLDEEGKECKRGKLGNLVIKLPLPPACLCGIWGDDARYKRSYLNHYPGYYLTGDSGYIDKDGYVFVMGRMDGVINVAGHRLSTGGMEEAISKHPDIAECAVIGVNNELKGEIPLAFVVLKDGLERDTQSLCEGVVQLVREEIGAVASLHIVAVVARLPKTRSGKILRGTMRDIADGNEWKMPSTIEDSSVMPEIEKTLATLGYPIKTKE

SEQ ID NO: 919 - DNA, 1890 bp, Bordetella parapertussis
  CDS (1)..(1890)
atgaaaaaaacccgggatttccattaccgttcgatacatgatcgcgatgggttctggcgcgaggaggcagggcggattcattgggagacgccgttcgagcaggtgatcgattattcccggccgccgtttgcgcggtggttcgtggggggcaggaccaacctctgttacaacgccgtcgaccgctggctgccgcagcaggccgaccagccggcgctgatctgggtatcgaccgaagtcgaccaggagcgcgtctacacccgccagcagttgcacgacgaggtcaacgccgtggcggctatgctgcgcgagcagggggtggagcggggcgaccgggtgctgctgtacatgcccatggtgcccgaggcggtgttcgccatgctggcgtgcgcgcgcatcggcgccatccattcggtggtgttcggcggcttcgcctcggtcaacctggcccagcgcatcgacgacgccgcgcccaaggtcgtcgtcagcaccgacggcggctcgcgcgcgggcaaggtggtggcgtacaagcccctgctggaccgcgcgctggcgctgtgccagaagccgcccggcgcggtgatcatcctcgaccgggggctcacgccatgcgagcggcaggccggccgcgacctggactacgctgagctgcgcgcccgccacgagggctcgcgcgtgccggtgcaatggctggagtcgtccgagccgagctacatcctctacacctcgggcaccaccggccgtcccaagggcgtgcagcgcgacaccggcggctatgcggtggcgctggcctcgtcgatggagtacctgttcgacggcaagcctggcgatacctatttctgcaccagcgacatcggctgggtggtgggccactcgtacatcgtctatggtccgctgatcggcggccagacgaccatcctgtacgaaggcacgccggtgcggccggacggcgccatcctgtggcagctggtcgagcgcttcggggtcaacaccctgttttccgcgccgaccgcggtgcgggtgctcaagcgccaggacgccgcgctgctgcgccggcacgacctgtccacgctgcgcgccgtatacctggccggcgagcccctggacgagccgaccgcgcagtggatttcccaggggctgggcaagcccatcatcgacaattactggcagaccgagtccggctggccgatcctgtcggcgcagcctggcgtcgagcgcgtgccgacccgcttcggcagcccctcgtttccggtctacgggttcgacgcgcgcatcgccagcgaaagcaccggcgaggacctggggcccgacgagaaaggcgtggtggccattgtgccgcccctgccgcccggtgccatgtccaccatctggggcgacgacgaacgcttcgtgcagacgtacttcacctcgatttccggccgccaggtgtattccacgttcgactgggggctggtcgacccggacggctactggttcatcctggggcgcaccgacgatgtcatcaacgtcgcgggccaccggctgggcacgcgcgagatcgaagagtcgatcaacagccatgcgggcgtggccgagtgcgccgtggtcggcgtggccgatacgttgaaggggcaggtggcgatggccttcgcggtgctcaaggatccggccggcgcggaaacgcgtgacggggcgctggcgctggaaggcgatatcatgcgcgtggtggaagaccagctgggcgcggtggcgcggccggcgcgcatccgtttcgtgggtgccttgcccaagacgcgttccggcaaggtgctgcgccgcgcgatcgtggccgtctgcgagggccgcgacccgggtgatctgaccaccatcgaagatccttccgccctagaacagatcaaggaatccctgcaatga

SEQ ID NO: 920 - protein, 629 aa, Bordetella parapertussis
MKKTRDFHYRSIHDRDGFWREEAGRIHWETPFEQVIDYSRPPFARWFVGGRTNLCYNAVDRWLPQQADQPALIWVSTEVDQERVYTRQQLHDEVNAVAAMLREQGVERGDRVLLYMPMVPEAVFAMLACARIGAIHSVVFGGFASVNLAQRIDDAAPKVVVSTDGGSRAGKVVAYKPLLDRALALCQKPPGAVIILDRGLTPCERQAGRDLDYAELRARHEGSRVPVQWLESSEPSYILYTSGTTGRPKGVQRDTGGYAVALASSMEYLFDGKPGDTYFCTSDIGWVVGHSYIVYGPLIGGQTTILYEGTPVRPDGAILWQLVERFGVNTLFSAPTAVRVLKRQDAALLRRHDLSTLRAVYLAGEPLDEPTAQWISQGLGKPIIDNYWQTESGWPILSAQPGVERVPTRFGSPSFPVYGFDARIASESTGEDLGPDEKGVVAIVPPLPPGAMSTIWGDDERFVQTYFTSISGRQVYSTFDWGLVDPDGYWFILGRTDDVINVAGHRLGTREIEESINSHAGVAECAVVGVADTLKGQVAMAFAVLKDPAGAETRDGALALEGDIMRVVEDQLGAVARPARIRFVGALPKTRSGKVLRRAIVAVCEGRDPGDLTTIEDPSALEQIKESLQ

SEQ ID NO: 921 - DNA, 2046 bp, Bordetella parapertussis
  CDS (1)..(2046)
atggcgatacggttgcgtgtcggcaagaaaaacggcagcaccagaatcattcatcggagacacaccatgtcgaatgccattcaatccgtcctggtcgagaatcgcgtattcccgccgccggcgagcgccgtgcaaggcgccgcgatttcgggcatggacgcctattgggccctgtgcgaggaagcggacaaggatttcaacgggttctggtcgcgcctggcgcgcgagaacctgcaatggagcaagcccttcacccaggtcctggacgagtccgaggcgcctttctatcggtggttcggcgatggcgaactcaacgtatcggccaactgcctggacgtgcacctgcataacggcaacgccgacaagaccgccatcatcttcgaatccgacgacggcaaggtcgacaagatcagctaccgcgaactgctggcgcgcgtgtgccgcttcgccaatggcctgaaggccatggggtacaagaagggcgaccgcgccatcatctacatgcccatgtcgatcgaggcggtggtggccatgcaggcctgcgcccgcctgggcgtgacccactcggtggtgttcggcggcttctcggccaagagcctgcaggagcgtatcgtcgacgtcggcgccacggtggtgatcaccgccgacgagcaggtgcgcggcggcaagaccatcccgctcaagcccgccgtcgaggaagcgttcgccatgggcggttgcgaggccgtttccaaggtggtggtgtatcgccgcaccggcggcaagatcgcctggcaggaagggcgcgatgtctggatgcacgacgtggaagccggccaggccgatacctgcgagccgcaggcggtcaatgccgagcatccgttgttcatcctgtacacgtcgggctccaccggcaagcccaagggcgtgcagcatgcctccgcgggctatctgctgtgggcgctgctgaccatgaagtggaccttcgacgcccgcgccgatgatgtgtactggtgcacggccgacgtgggctgggtgaccggccatacctatatcacctacggcccgctggccgccggcgtgacgcaggtggtgttcgagggcgtgcccacgttccccaatgccggacgcttctgggacatgattgcgcgccacaaggtgtcggtgttctataccgcgccgaccgcgatccgctcgctcatcaaggccgccgaggccaaccaggaggtgcacccgcgccaatacgacctggacagcctgcgcatcatcggttcggtgggcgagcccatcaaccccgaggcctggatctggtaccacaagaacgtcggccgcgagcgctgcccggtcgtcgacacctggtggcagaccgagaccggcgggcacatgctcacgccgctgccgggcgccacgtcgctcaagccgggatcgtgcacgctgccgctgccgggcattgtcgcggccatcgtcgacgagaccggcggcgatgtcgcgcagggcaatggcggcttcctggtcatcaagcgtccctggccggccatgatccgcaacatctggggcgacccggagcggttcaagaagagctacttcccgcccgagctgcgcggctactacctggccggcgacggcgcccagcgcgacgccgatggctatttctggatcatggggcgcatcgacgacgtgctcaacgtgtccggccaccgcctcggcaccatggaggtggagtcggcgctggtggcgcacgaaatggtggccgaggccgccgtggtgggccgtcccgacgacaccaccggcgaagccgtggtggccttcgtggtgctcaagcgcagccgtcccgagggcgacgaagcccaggccatcgccaggcaactgcgcgactgggtgggcaaggaaatcggccccatcgccaagcccaaggacatccgtttcggcgacaacctgcccaagacccgttcgggcaagatcatgcgccgcctgctgcgcgtggtcgccaagggcgaggaaatcacccaggacgtgtccaccctggagaaccccgccatcctcgagcaactggccaagccgttgtga

SEQ ID NO: 922 - protein, 681 aa, Bordetella parapertussis
MAIRLRVGKKNGSTRIIHRRHTMSNAIQSVLVENRVFPPPASAVQGAAISGMDAYWALCEEADKDFNGFWSRLARENLQWSKPFTQVLDESEAPFYRWFGDGELNVSANCLDVHLHNGNADKTAIIFESDDGKVDKISYRELLARVCRFANGLKAMGYKKGDRAIIYMPMSIEAVVAMQACARLGVTHSVVFGGFSAKSLQERIVDVGATVVITADEQVRGGKTIPLKPAVEEAFAMGGCEAVSKVVVYRRTGGKIAWQEGRDVWMHDVEAGQADTCEPQAVNAEHPLFILYTSGSTGKPKGVQHASAGYLLWALLTMKWTFDARADDVYWCTADVGWVTGHTYITYGPLAAGVTQVVFEGVPTFPNAGRFWDMIARHKVSVFYTAPTAIRSLIKAAEANQEVHPRQYDLDSLRIIGSVGEPINPEAWIWYHKNVGRERCPVVDTWWQTETGGHMLTPLPGATSLKPGSCTLPLPGIVAAIVDETGGDVAQGNGGFLVIKRPWPAMIRNIWGDPERFKKSYFPPELRGYYLAGDGAQRDADGYFWIMGRIDDVLNVSGHRLGTMEVESALVAHEMVAEAAVVGRPDDTTGEAVVAFVVLKRSRPEGDEAQAIARQLRDWVGKEIGPIAKPKDIRFGDNLPKTRSGKIMRRLLRVVAKGEEITQDVSTLENPAILEQLAKPL

SEQ ID NO: 923 - DNA, 1950 bp, Bordetella bronchiseptica
  CDS (1)..(1950)
atgatgcataccaacgattcctcccatgtctggcagccgggccagcgcgaactgcaggattccggcatcgcgcacctgatacgcaccctgggcgccgctacgtacgacgacctcatgcgggtgtcggtggaggagcccgagcgctactggaacaccgtgatgcgcgagtgcgcgatcgcgtgggacgagccgcccacgggctatgtggacctggcgcgcgggccgcagtttcccagctggtttcccggcggcaggctgaactgggtcaataccatctacgcctgggccaggaacccggccaccgcggggcagaccgccgtgatcggcgagcgcgaggacggcagcgtcggttcgctgacctaccaggaactcgagacccgcgtgcgtgaattcgcggccggcctggcgcggcacggcgccaggccgggcgaccgcatcggcctgctgatggaaaacggcgtcgatgccacggtgtccctgcttgccatcgtgcacctgggcgccctggtcgtgccgctgttcagcggtttcggcgtcgatgcgatcgtggcccgcctgtcggccgccgaggcgcgcatggtgatcgcgtccaccggcttccagcgccgtaccaagcgcgtggacgtgcagggcgcgctgcgcgacgcatggcgccagctgccgttgctcgagaacgtggtctggaagcgcgccgacggcgaaagcgcccaggaccagcgggacctggactggcagcagatcgccacggccgcgcagggccagggccaggatcccgtgtcggtgacgcccgatacgcccttcatggtgatctacacctcgggcaccaccggcaagcccaagggcgtcgtgcacacgcacggcagcttcccgatcaagatcgcgcacgattcgctggtccatttcgacgtccatcccggcgacgtgtattgctggccggccgacatgggctggatcgccggaacgctggtgctcggctgcgcattgctgcgcggcgccacgctggtgtgctatgacggcgcgccggactatcccgactggtcgcgcatgtcccgggtggtggagcgccacaaggtgacgcacttcggctcggcgcccacgctgatccgcggcatggccagcaacgagacgctggcgctggcgggcgatcgcgccacggtgcgcgtgctgatcacggcgggcgagggtatcgcgcccgagcatttcatctggttccagcagcgcttcggcgacggctcggcgccgctggtcaattacaccggaggcaccgaggtgtcgggcgcgctgctctcgagcgtgccgatccgcccgatcccgcccagcggcttcaataccatttcgccgggcgtggccgtcgacgtcgtcgatcccgacggccacagcgtgaccggcgaggtcggcgagctggcggtgcgcgcgcctttcgtgggcatgacccagtcgttctggcacgacgacgcgcgctatctcgaaacctactggcaggccatccccggcatctgggtgcatggcgacctggccctgcgcacccccgaaggctatttcttcatgatggggcgctcggacgacacgctgaaagtcgcgggcaagcgcctgggtccggccgaggtggaggaggtcgtcctggaactgcatgacgtggccgaggcggccgccatcggggtggccgacgccgccaagggccagaagctggtggtcttcgtcgtgcccaggcccggcgtcagcgtcccggacgacgcgctgcaggccgccgtgatcggccacgtggacaagcgcctgggccgtccgttccggcccggccgggtgcacgtggtgagccagttgcccaagacgcgcagttccaagatcatgcggcgcgtcatccgcagcgtgtactgcggacagccgccgggcgatctttcttcgttggacaacccggccgcgctcgacgaagtgcgtgcggccgcggcctga

SEQ ID NO: 924 - protein, 649 aa, Bordetella bronchiseptica
MMHTNDSSHVWQPGQRELQDSGIAHLIRTLGAATYDDLMRVSVEEPERYWNTVMRECAIAWDEPPTGYVDLARGPQFPSWFPGGRLNWVNTIYAWARNPATAGQTAVIGEREDGSVGSLTYQELETRVREFAAGLARHGARPGDRIGLLMENGVDATVSLLAIVHLGALVVPLFSGFGVDAIVARLSAAEARMVIASTGFQRRTKRVDVQGALRDAWRQLPLLENVVWKRADGESAQDQRDLDWQQIATAAQGQGQDPVSVTPDTPFMVIYTSGTTGKPKGVVHTHGSFPIKIAHDSLVHFDVHPGDVYCWPADMGWIAGTLVLGCALLRGATLVCYDGAPDYPDWSRMSRVVERHKVTHFGSAPTLIRGMASNETLALAGDRATVRVLITAGEGIAPEHFIWFQQRFGDGSAPLVNYTGGTEVSGALLSSVPIRPIPPSGFNTISPGVAVDVVDPDGHSVTGEVGELAVRAPFVGMTQSFWHDDARYLETYWQAIPGIWVHGDLALRTPEGYFFMMGRSDDTLKVAGKRLGPAEVEEVVLELHDVAEAAAIGVADAAKGQKLVVFVVPRPGVSVPDDALQAAVIGHVDKRLGRPFRPGRVHVVSQLPKTRSSKIMRRVIRSVYCGQPPGDLSSLDNPAALDEVRAAAA

SEQ ID NO: 925 - DNA, 3626 bp, Homo sapiens
  CDS (6)..(2069)
cctggatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcggagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacaggtggcatctgcatcgcaccacggccctcggaagaaggggcggaaatcctccctgccatggcgatgaggcccttctttggcatcgtccccgtcctcatggatgagaagggcagcgtcatggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgttcgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactcaagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcagtgagaaccactgaggtccaatgatgagacttggaggtctggatccagtctctctttgttttaatgtgacttaggtgctgtcgacattagcaagataatggaaatcacgacgccagtgggtgcttacctccctgctaggcatgcaggggctggcggttggcaggggaaggaggcacagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattttcaaaaaaaagaaaaaaaaaaaaaaaaca

SEQ ID NO: 926 - protein, 687 aa, Homo sapiens [sequence omitted]

SEQ ID NO: 927 - DNA, 1941 bp, Bacillus cereus
  CDS (1)..(1941)
atgaaacaagcagtttggtttccaacagaagagtacaaggaaaaaacacgtttatatggttggatgaaatcattgggatatgaagattatgaaactttttataataaatctatcgaggaaacagcttggttttggggagaggcagaaaaggcagtaggctatcaatggatgaaaccttatacagacgtgttagatttagaaaatggtacaccgtttgcacagtggtataatggcggaacatgtaacgttgtagaatcagctttatcccgctggcttgcggatgaagagacgagaatacagccagcacttcagtacgaaggggaaaatggaacttcaaaatcatttacatatgaagagcttgacaactgggtaagtcgtgttgcaaatggtttgaaacacgcgggtattgagaaaggtgaccgtgtaacaatttatatgccgatgattccagaaacagttgttgcgatgctagctgtaatgaaaatcggagcaattatttcaccaatattctcaggctttgcgtctgatgcagtcatgacacgtgtgcaagcggcaggttcaaaaatgattattaccgcagatggattttcacgccgcggtaaaattgtttctttaaaagatgaagtagataaagcttgtgaacattgcccaactgttgaaaaagttgttatcgttcgtcatgcaggaaatgattttacaccacataactatgacttttcgtggagtacgctagaaaaagaaaaaccattcatacatgccgaggaaatgcaaagtgatgatccattaatgctcatttatacatcaggaacgactggtaagccgaaaggaacagtacacacgcatgcaggatttcctttgaaagcagcttttgatgcaggatttggaatgaatattaaacaaggtgatcgtgtattatgggtaactgatatgggctggatgatggggccgtttctattattcggttcactcattaatggagcaacgatggttatgtacgaaggtgttccagacttcccagaagcagaccggttatgggagacagttgataaatatgagattactcatctaggtatttcgccaacgttaatccgagcattgatggcaaaaggtgatgagtatgtcaataaacattctttaaagagtttggaagtattcgcatcaacaggagaaccttggaatcctgatccatggatgtggctgtttgaaacggttggaaaaggaaatgtcccaatctgtaactactcaggtggaactgaaatctctggtgggattttcggtaatgttcttattaagccaatagcaccgattagttttaacgcatctttaccaggaatggcagctgtcgtactggatgatcaaggtaaaccaattcgagatgaagtcggagaattatgcttagagaaaccttgggtaggtatgacgaaaagcttctgggaagatgatgaacgttacgtaaacacatattggtcgcgttttgaaaataaatgggtccacggtgactgggtcatttacgatggtgaacaatatatcatcacagggcgttcagacgatacgttaaatattgcaggtaaacgtattggacctgctgaatatgaatctattcttgtgaaacataacgatgtaatcgaagctgctgcaattggtgtacctgacgaagtaaaaggtgaagtttgtcattgttttgtagtgttaagagatcatgtaacattcacaggagaattaaagaaagaattaatgagtttagtaaactctcatattggaaaagcgttgtgtcctaaagacatccacgttgtagaagatttaccgaaaacacgtaattctaaagtaatgcgccgtgttattaaagcagcttacttaggaaaagaattaggtgatttatcatcgcttgtaaatcctgaagtagttccgtttattcaggggttacagtctagtaaattataa

SEQ ID NO: 928 - protein, 646 aa, Bacillus cereus
MKQAVWFPTEEYKEKTRLYGWMKSLGYEDYETFYNKSIEETAWFWGEAEKAVGYQWMKPYTDVLDLENGTPFAQWYNGGTCNVVESALSRWLADEETRIQPALQYEGENGTSKSFTYEELDNWVSRVANGLKHAGIEKGDRVTIYMPMIPETVVAMLAVMKIGAIISPIFSGFASDAVMTRVQAAGSKMIITADGFSRRGKIVSLKDEVDKACEHCPTVEKVVIVRHAGNDFTPHNYDFSWSTLEKEKPFIHAEEMQSDDPLMLIYTSGTTGKPKGTVHTHAGFPLKAAFDAGFGMNIKQGDRVLWVTDMGWMMGPFLLFGSLINGATMVMYEGVPDFPEADRLWETVDKYEITHLGISPTLIRALMAKGDEYVNKHSLKSLEVFASTGEPWNPDPWMWLFETVGKGNVPICNYSGGTEISGGIFGNVLIKPIAPISFNASLPGMAAVVLDDQGKPIRDEVGELCLEKPWVGMTKSFWEDDERYVNTYWSRFENKWVHGDWVIYDGEQYIITGRSDDTLNIAGKRIGPAEYESILVKHNDVIEAAAIGVPDEVKGEVCHCFVVLRDHVTFTGELKKELMSLVNSHIGKALCPKDIHVVEDLPKTRNSKVMRRVIKAAYLGKELGDLSSLVNPEVVPFIQGLQSSKL

SEQ ID NO: 929 - DNA, 1968 bp, Streptomyces avermitilis
  CDS (1)..(1968)
atgaccccagcgaacccctcgccgctctggcgacccgacgaggaacgcatcgcccaggcacagatcaccaggttccagtcctgggcggccgaacaccacggagcacccgccgacggcggctacgcggcattgcaccgctggtccgtcgacgagctggacaccttctggaaagccgtcaccgaatggttcgacgtacggttttccaccccctacgcgcgcgtgctcggcgaccgctccatgcccggtgccgcatggttccccggagcgaccctgaactacgccgaacacgccctgcgcgccgccgacacgcgcgcggacgaaccggctctcctgcacgtcgacgagacccacgagccccgcccggtcacctggtccgaactgcgccgccaggtcggctccctggccgccgaactgcgctccctcggcgtacgccccggagaccgcgtcagcggctatctccccaacattccgcaggccgtggtcgccctcctcgccacggccgcggtgggcggcgtctggacgtcctgcgcccccgacttcggcgcccgcagcgtcctcgaccgcttccagcaggtcgagccggtcgtgctgttcacggtcgacggctaccggtacggaggcaaggagcacgaccgccgtgaaacggtcgccgagctgcgccgcgaactgcccaccctgcgtgccgtcgtccatatccccgtgctcggcaccgaggcccccgagggcgccctggagtggtccgccctgacctcctccgacgtggcgcccgagttcgagcaggtcccgttcgaccaccccctgtgggtcctgtactcctccggcacgaccggcctgccaaaggccatcgtccagtcccagggcggcatcctcgtcgagcacctcaagcagctcggcctgcactgcgacctcggccccgaggaccggttcttctggtacacgtccacgggctggatgatgtggaacttcctcgtctccggcctcctcaccggcaccacgatcgtcctgtacgacggcagcccgggctttccggacaccgccgcccagtggcgcatcgccgaacgcaccggcgcgaccctctacggcacctccgccgcgtacgtcatggcctgccgcaaggcgggcgtgcacccctcgcgcgacttcgacctcgcgcgcgtgcggtgcgtggcgacaaccggctcgccgctgccgccggacggcttcagctggctgcacgacgaggtccgcgccgacctctggatcgcctcggtcagcgggggcaccgacgtgtgctcctgcttcgcgggagccgttcccaccctgccggtgtacatcggcgaactccaggccccgggcctcggcaccgacctccagtcctgggacccgagcggcaagcccctggtcgacgaggtcggcgagctggtggtcaccaatccgatgccctccatgccgatccgcttctggaacgacccggacggcagccgctaccacggcagttacttcgacacgtatccgggagtgtggcgccacggcgactggatcaccgtcacctcccgcggctccgtggtcatccacggccgctccgactccacgctcaaccgccagggcgtccgcatgggctcggccgacatctacgaagcggtcgaacgccttccggagatcaaggaatccctcgtcatcggcgtcgaacagcccgacggcggctactggatgcctctcttcgtccacctcgccccgggagccaccctcgacgacgccctcctgggccgcatcaagcagaccatccgcgaacagctttcgccccggcacgtccccgacgagatcatcgaggtcccggccatcccgcacacgctcaccggcaaacgcatcgaggtcccggtcaaacgcctgctccagggcaccccgctggagaaggcggtcaatccgggctccatcgacaacctcgacctgctgggcttctacgaggacctggcccgcaagcgcgcctga

SEQ ID NO: 930 - protein, 655 aa, Streptomyces avermitilis
MTPANPSPLWRPDEERIAQAQITRFQSWAAEHHGAPADGGYAALHRWSVDELDTFWKAVTEWFDVRFSTPYARVLGDRSMPGAAWFPGATLNYAEHALRAADTRADEPALLHVDETHEPRPVTWSELRRQVGSLAAELRSLGVRPGDRVSGYLPNIPQAVVALLATAAVGGVWTSCAPDFGARSVLDRFQQVEPVVLFTVDGYRYGGKEHDRRETVAELRRELPTLRAVVHIPVLGTEAPEGALEWSALTSSDVAPEFEQVPFDHPLWVLYSSGTTGLPKAIVQSQGGILVEHLKQLGLHCDLGPEDRFFWYTSTGWMMWNFLVSGLLTGTTIVLYDGSPGFPDTAAQWRIAERTGATLYGTSAAYVMACRKAGVHPSRDFDLARVRCVATTGSPLPPDGFSWLHDEVRADLWIASVSGGTDVCSCFAGAVPTLPVYIGELQAPGLGTDLQSWDPSGKPLVDEVGELVVTNPMPSMPIRFWNDPDGSRYHGSYFDTYPGVWRHGDWITVTSRGSVVIHGRSDSTLNRQGVRMGSADIYEAVERLPEIKESLVIGVEQPDGGYWMPLFVHLAPGATLDDALLGRIKQTIREQLSPRHVPDEIIEVPAIPHTLTGKRIEVPVKRLLQGTPLEKAVNPGSIDNLDLLGFYEDLARKRA

SEQ ID NO: 931 - DNA, 2019 bp, Streptomyces avermitilis
  CDS (1)..(2019)
atgaccaccccgcaccccgcgccgtatccggaacccttcttcactcccgacccgaagtcggccgcccacagccgtatcgcggacttcgcccgatgggcggcccggcaccagggcgccgaagggatccaggaccccacggactaccgagccctgtaccagtggtccgtcaccgacctcgaagggttctgggccgcggtgtgggagtacttcgacatcgacgcgacgactgagtacgagggggtgctggccgaggagaccatgcccggcgcccgctggttccccggcgccaccctcaactacgtccatcacgcgctacgcaacctgcagccggacgctcccgcgatcaccgccctggacgagaccggagccggctatgagatcacgggccgggagctgcgcgcccgggtcgcctccgtcgctgccagcctgcgcgacctgggcgtcgcacagggcgaccgggtggtgggctatctgcccaacaccccccacgccgtcatcgccttcctcgccaccgcaagcctgggcgcggtgtggtcggtgtgcggccaggactacgtacccaaggccgccgccgaccgcttcgcccagctcgaacccacggtgctcatcaccgctgacggctacctcttcaacggcaccacacacgaccgccgcgccgcctcgctcgaactcgccgtcgccctgccgacgctgaaggccacggtgctcgtggatcacgtgggccttgcctggcccgagggcggggacttggggctgacagttccctgggaggacgcggccacccgcgccgagtacctcaccatcgccccggtgccgttcgaccaccctctctgggtcgtcttctcctccggcaccaccggactgcccaagggcatcgtccacggccacggcggggtcctgctcgaacacctcaagatgctcggcctgcacaccgatctgggcatcggggaccgcctgctgtggtacaccaccacccactggatgatgtggaacctggtcgtctccaccctgctgaccggtgccaccacctgcacctacgacggcagcccggcaccgcaggcgcgtccggacgtcctgtgggagctggcggcccgtcacaaggtcaccgtcttcggcaccagtcctcagtacctgctggccatgtccaagctgggcatcgcaccctccgtgtacgacctgtcggccatccgcgtcgtcggctgcaccggctccgctctgcccgcctccgcctacccctgggtccgcgaccacgtgggcgcaggcgtccagctggcctccaccagcggcggcacggacatcgtctccggcttcgccggcagtgccgccacgacccccgtctgggcgggggagctgtccgcccccggcctgggcgtggcgctggccgcctacgacgaggaaggcctccccgtcacggaccgggtcggtgaactggtcgtcacccgccccatgccgtccatgccgctgtacttctggaacgaccccgacggcagccgctaccgcgacgcctacttcggcgcctaccccggtgtgtggcggcacggtgactggatcacgctcacctcgcacggctcggtgatcgtccacggccgctccgacgccaccctcaaccgcaacggcgtgcgcctgggcagcgccgacatccacgacgtcgtcgaacgcctccccgagatcaccgaggccctcgtcatcggcgcggaggaacccgacggcggctactggatgccgctcttcgtggtcctcgccgacggggtcggcctggacgactccctgcgcgcgaagatccgcgacgcgatccgcgccggcgcctcaccccgccacgtccccgacgagatcctcgccgtaccggccctcccgcacacgaagaccggcaagaaactcgaggttcccgtcaagcgcctgctccagggcgctcccgccgagcaggtcctgaacccctcggcggtcgacaaccccgacctgatcgcctacttcgcccgcctgggcgcggagcggaacaagcggtcagcacaccacacatga

SEQ ID NO: 932 - protein, 672 aa, Streptomyces avermitilis
MTTPHPAPYPEPFFTPDPKSAAHSRIADFARWAARHQGAEGIQDPTDYRALYQWSVTDLEGFWAAVWEYFDIDATTEYEGVLAEETMPGARWFPGATLNYVHHALRNLQPDAPAITALDETGAGYEITGRELRARVASVAASLRDLGVAQGDRVVGYLPNTPHAVIAFLATASLGAVWSVCGQDYVPKAAADRFAQLEPTVLITADGYLFNGTTHDRRAASLELAVALPTLKATVLVDHVGLAWPEGGDLGLTVPWEDAATRAEYLTIAPVPFDHPLWVVFSSGTTGLPKGIVHGHGGVLLEHLKMLGLHTDLGIGDRLLWYTTTHWMMWNLVVSTLLTGATTCTYDGSPAPQARPDVLWELAARHKVTVFGTSPQYLLAMSKLGIAPSVYDLSAIRVVGCTGSALPASAYPWVRDHVGAGVQLASTSGGTDIVSGFAGSAATTPVWAGELSAPGLGVALAAYDEEGLPVTDRVGELVVTRPMPSMPLYFWNDPDGSRYRDAYFGAYPGVWRHGDWITLTSHGSVIVHGRSDATLNRNGVRLGSADIHDVVERLPEITEALVIGAEEPDGGYWMPLFVVLADGVGLDDSLRAKIRDAIRAGASPRHVPDEILAVPALPHTKTGKKLEVPVKRLLQGAPAEQVLNPSAVDNPDLIAYFARLGAERNKRSAHHT

SEQ ID NO: 933 - DNA, 1953 bp, Coxiella burnetii
  CDS (1)..(1953)
atggaagcgtcaaaaccactctgggaaccctcttcggaaactcgtttacaaagtcagatgagtcattttatctcggatattaacaaacgtttttcgttaaaaatcgagggttatcctgcactttaccaatggtccatcgatcagcctgcgctcttttggaaggccgtttgggatttttgtgggatcagcgcttcgcaagcacctaccaacgttttggtaagaggcaagcggatggaagaatcccaatggttcttaggtgccaaacttaactttgcagaaaatttattacggcatcgcaaccaaaacgttgcattaatttttacttccgaaacggggttttctcggagtattacttatgctgagctttacacggaagttgctgcgcttgctggttttttacgtcaatgccatgttgttcctggcgatcgcgtcgttggtgtcctctctaaccagatcgaaaccgtaattgccatgctggcgactgctagtgttggcgctatttggtcagcgtgttcgccggattttggattagaaggtctcgtagatcgttttggacaaattaaacctaaggtattattcgccgtcgacagccatacttataaaggcaaaacttatcatcaccttgataaaatccgccaactccagcagcaactgacttcactaacgcacacaatcatcgttcctaatcatcaaaaaaatatcgctattaatgagttaaaaaatgcttctctttatcccgactgccttcgtgcaacttctcttcctttttattttgaagcacttccctttgatcaccccgtctacattctttattcttcaggaaccaccggaaaaccaaaatgtatggtgcatagcgccggcggcactctgcttcagcatctaaaagaattaatattacacactgatttgcggccgtcgcagcgtattttcttttataccacctgtagctggatgatgtggaactggttaatgagtagtttggccgtcggcgccacggtcgtgctttacgatggcgcgcctttttatcctactcccacagctttattcgatttaatcgacaaggttggtatttctatttttggcgtgggtgcaaaaattttagagtcggctgaaaaattcgatttagttcctaaaaagacacataatctcttatccttaaaaacaattttaacgacaggctctccccttcttcctaaaagttttgattatgtttacaacaacgtaaaatccgacattcaattatcatccatctcgggcggcagcgatattatttcttgtttcgctttaggaaattctttattgcccgtctatcgcggcgaattgcagtgtatcggccttggcatggatgtaaaaatttttaacgacgacggggattccgtaattgaagaaaaaggcgaattagtctgtaaaagccctttcccttcaatgccaatttatttttggaatgatcctgagggcaaaaaatatcaccaagcttattttgataaataccctaatacctgggcgcacggcgattacgctaaaacaacaaaacgcggtacactgattatctacggacgctcggataccacgcttaatcctggcggaattcgcattggcaccgccgaaatttaccaacaagtcgaaaaaattaaggaaattctagattgtctggttaccagtcagcagtggaaaggagatgaacgaattatcttattcgttgttctccaaaaagaaactactttaactgatcccttgcggaaaaaaattcaaaccaccattcgccaaaatctatcacctcatcatgtaccgaataaaattatcgctgtgcccgacttaccccgaacaaaaagcggtaaaatagttgaattagcagtaaaaaaaattattaacggcgagtcggttaataacttaaccgctctcgaaaaccccaaaatactagaatatttccagaatctcaaagaattggggtga

SEQ ID NO: 934 - protein, 650 aa, Coxiella burnetii
MEASKPLWEPSSETRLQSQMSHFISDINKRFSLKIEGYPALYQWSIDQPALFWKAVWDFCGISASQAPTNVLVRGKRMEESQWFLGAKLNFAENLLRHRNQNVALIFTSETGFSRSITYAELYTEVAALAGFLRQCHVVPGDRVVGVLSNQIETVIAMLATASVGAIWSACSPDFGLEGLVDRFGQIKPKVLFAVDSHTYKGKTYHHLDKIRQLQQQLTSLTHTIIVPNHQKNIAINELKNASLYPDCLRATSLPFYFEALPFDHPVYILYSSGTTGKPKCMVHSAGGTLLQHLKELILHTDLRPSQRIFFYTTCSWMMWNWLMSSLAVGATVVLYDGAPFYPTPTALFDLIDKVGISIFGVGAKILESAEKFDLVPKKTHNLLSLKTILTTGSPLLPKSFDYVYNNVKSDIQLSSISGGSDIISCFALGNSLLPVYRGELQCIGLGMDVKIFNDDGDSVIEEKGELVCKSPFPSMPIYFWNDPEGKKYHQAYFDKYPNTWAHGDYAKTTKRGTLIIYGRSDTTLNPGGIRIGTAEIYQQVEKIKEILDCLVTSQQWKGDERIILFVVLQKETTLTDPLRKKIQTTIRQNLSPHHVPNKIIAVPDLPRTKSGKIVELAVKKIINGESVNNLTALENPKILEYFQNLKELG

SEQ ID NO: 935 - DNA, 1968 bp, Dictyostelium discoideum
  CDS (1)..(1968)
atgtttagtaatggattatcaaaattaataaaatccaaaatagcatctacatcaataattaccactaaaaataattattcaatttcaaaactatcattttcatcaacatcaattttattaaataaaaaatataaattaagtgaaccatttaattatgaacaagattgtgaatatgcattaaaagagccaatacaattttgggatgaagtagcttcaaaatatgtacattggaataaaagatatgaaaaagtttatagtggtgatgagtataatccagaatggtttaaaggtggtgtattgaatgcatgttataatgcattagatgttcatgcaaaggatccaattacaaagaatagaattgcaatcattcatgaaacaccatcaaagaataatacaaataaattgacctatggtgaactttgggatgaggtttgtatatttgcaaggggattacataatttaggtgttgaaaagggtgatagagtagtcatttatatgccaatgattaatcaggcgttgattgcaatgttggcatgcgcaagattgggtgcgacacatagtgtggtatttggtggttttgcatcaccccaattggctcaacgtattgagcatttcaagccaaaggtagtgatatctgcaaatttcggtgttgaaggccacaagatcaattgctacacaccactactttcaaaggcattagaactatcatcacataaaccaaatcataccattgtttacaatcgtttggatgtaaagttagacgcaggtgaagttttaccaccaagagttgagggatcgttggattggagtgaactaattaaaaatattgcaccgtatagggactatgcattggtagattcgacacacccattatacattctttacaccagtggtaccactggcatgccaaaaggtgtcgttagggacaccggtggctactcagtggctttgaattactccattagaaattgttatggtatgaagagtggtgatacatttttcgcaggttccgacgtaggttgggtagttggtcatactttatcagtctacggtccattgatggtaggtttaacatcgatcatattcgaaggtaaaccaacagttccagacgcctcaacctattggaaattgattgaaaagcatcgtgtaaatgcactattctctgcaccaacagcaattcgtgcaattcatagagatgatgctgatggtaagttggcatcaaaatgtgatctctcctcattgagatccatttggttgggtggtgaacgtttggatagttcaacattcaatttcttaagaaacatcaccaacaacaaaccaatcttggacaactattggaataccgagagtggttcaccattaatcaccaacccatcatgtcaagtaccaatcaaagcaaacgccactggtaagccaatgccaggttaccaattccatgtactctctccaacctctgaaagattgggtgccgataaaatcggtgaggtttgtataaagttaccagttgcaccaggttttacaaataccctatacctaaatccagaaggttacaagaatgcttatctcaacgagtatccaggttaccttagaaccgccgattcaggctactacgatgaaaatggttattatcatatcatttctagagttgatgatattatcaatgttagtggtcaccgtttatcaactggttcaatcgaagaaatcttagttaaacatccaaaaatagtagaatgcgcagtaattggtgtccacgatgaattaaaaggtgaaataccatttggtttggtagttttaaaacctcaatataaagattgtgctgaagaagttgaaaatgaattaattaaagaagttagagaaaatattggtcctgtcgcaacctttaaaaaagttttatctgtaaatcgtttaccaaaaactggtagtggtaaaattttaagaaatattttaagaaaaatgtataatatttaa

SEQ ID NO: 936 - protein, 655 aa, Dictyostelium discoideum
MFSNGLSKLIKSKIASTSIITTKNNYSISKLSFSSTSILLNKKYKLSEPFNYEQDCEYALKEPIQFWDEVASKYVHWNKRYEKVYSGDEYNPEWFKGGVLNACYNALDVHAKDPITKNRIAIIHETPSKNNTNKLTYGELWDEVCIFARGLHNLGVEKGDRVVIYMPMINQALIAMLACARLGATHSVVFGGFASPQLAQRIEHFKPKVVISANFGVEGHKINCYTPLLSKALELSSHKPNHTIVYNRLDVKLDAGEVLPPRVEGSLDWSELIKNIAPYRDYALVDSTHPLYILYTSGTTGMPKGVVRDTGGYSVALNYSIRNCYGMKSGDTFFAGSDVGWVVGHTLSVYGPLMVGLTSIIFEGKPTVPDASTYWKLIEKHRVNALFSAPTAIRAIHRDDADGKLASKCDLSSLRSIWLGGERLDSSTFNFLRNITNNKPILDNYWNTESGSPLITNPSCQVPIKANATGKPMPGYQFHVLSPTSERLGADKIGEVCIKLPVAPGFTNTLYLNPEGYKNAYLNEYPGYLRTADSGYYDENGYYHIISRVDDIINVSGHRLSTGSIEEILVKHPKIVECAVIGVHDELKGEIPFGLVVLKPQYKDCAEEVENELIKEVRENIGPVATFKKVLSVNRLPKTGSGKILRNILRKMYNI

SEQ ID NO: 937 - DNA, 1956 bp, Dictyostelium discoideum
  CDS (1)..(1956)
atgtatacattaagccaaccattcaattatgaaaatgattataaattctcaataaacaccgacccaatttcattttgggatcaagtagccactaaatatgtttattgggataaaatgtatgataaagtttatagtggtaatgaaatttatccagattggtttaaaggtggtgaattaaatacatgttataatttattagatagacaagttcagaatccattaaaaaaagatcaagttgcattaatttatgaatgtccatatttaaagaaaactgtaaaattaacttattatcaattatatgaaaaagtatgtgaattttcaagagtacttttgaatttaaatgtttcaaaaaatgataatgttttaatttatatggcaaatacagttgaagcaccaattgcaatgttatcatgtgctcgtattggtgcaactcattgtgctttattcgatggttattcagttaaaagtttaatagatagaattgaaacaattacaccaaaattaataattacaacaaatttgggagttggacttgatgaaattgttgatattactacaaatttaaaagaagcaattgaattatcaacttttaagcctgacaatgtaataacactttatagaaatgatattgtttataataataataatttccaaacaataataccaaattcattaaattgggaagaagaaattaaaaaaattaaaattaataatcaatcaccattttatgattatgtaccagtagaatcaagtcatccaatctatttaatttatacaagtggtacaactggtaattctaaaccagttgtaagaagtaatggtagtaatttggttggacttttatatcattggaattgtttaagttcaaaggttaataatgatgaaaatgtagttttattttctgcaactagtgttggatgggtgtcattccatatgttcttttatgcatcattatcaaaaggaaatacatttgtaatgtttgaaggtggtttcttaaaacaaaataatgttgaagatgacatttgggcaaccattgaaaaacataatgtaaacatttatttagcattaccaattgtaatgagatatcttaagaaaatggatcccaatgctgaaagattacattcaaaatatgatatatcacgtttaaagcaagtttggattggtgctgaagttattgaaaaatcaattcaagattatattgaaaataaattaaatgctgaatcaattggtttatatggtcaaactgaaagtggaatgatgtatatttatgaatattcaagtataaataaaacatatgatacagtaggtataccatcaccatttattaaaccatcaatattatctgaagatggtaaagagttgggtgttaatgaaattggtgaattctctctcaaattaccattaccacctggatttgcgactacattttataaaaatgatgaacaatataaaaaattattttcaaaatttccaggttattataattctggtgatttaggttataaagatgaaaatggatattatggtattgtttcaagagctgatgatcaaattaaaattagtggtaataaagttcaactaaatacaattgaatcatcaattttgaaacatccaaatgttattgaatgttgttcaattggtattaatgattatgattgttataaagcaccaattggtatattggttttaaaaaaacaagattcaattttagatttcaatcaattaaaaaatgaaattaataatattattaatgatgatattgaaagttatgctgaactaaaacaaattatcattgtaaatcaattaccaaaaactaaaagtggtaaaattcaaagacatatactttctaattatttaaataacaataattttaaattaccagataatattgaaaatcttcaattattttataacataaaagattcttttattaaaaactcaaataaaaatatttaa

SEQ ID NO: 938 - protein, 651 aa, Dictyostelium discoideum
MYTLSQPFNYENDYKFSINTDPISFWDQVATKYVYWDKMYDKVYSGNEIYPDWFKGGELNTCYNLLDRQVQNPLKKDQVALIYECPYLKKTVKLTYYQLYEKVCEFSRVLLNLNVSKNDNVLIYMANTVEAPIAMLSCARIGATHCALFDGYSVKSLIDRIETITPKLIITTNLGVGLDEIVDITTNLKEAIELSTFKPDNVITLYRNDIVYNNNNFQTIIPNSLNWEEEIKKIKINNQSPFYDYVPVESSHPIYLIYTSGTTGNSKPVVRSNGSNLVGLLYHWNCLSSKVNNDENVVLFSATSVGWVSFHMFFYASLSKGNTFVMFEGGFLKQNNVEDDIWATIEKHNVNIYLALPIVMRYLKKMDPNAERLHSKYDISRLKQVWIGAEVIEKSIQDYIENKLNAESIGLYGQTESGMMYIYEYSSINKTYDTVGIPSPFIKPSILSEDGKELGVNEIGEFSLKLPLPPGFATTFYKNDEQYKKLFSKFPGYYNSGDLGYKDENGYYGIVSRADDQIKISGNKVQLNTIESSILKHPNVIECCSIGINDYDCYKAPIGILVLKKQDSILDFNQLKNEINNIINDDIESYAELKQIIIVNQLPKTKSGKIQRHILSNYLNNNNFKLPDNIENLQLFYNIKDSFIKNSNKNI

SEQ ID NO: 939 - DNA, 1968 bp, Dictyostelium discoideum
  CDS (1)..(1968)
atgtatagactaagcgaaccatttgattatttaaatgataaaacttatgcaaataatgagccagaagctttttgggatgaagttgcaaagaaattaattaaatgggataaaatgtatgataaagtttatagtggtgatgaaatgtatccagattggtttaaaggtggtgaattaaatacatgttataatgttttagatagacaagttcaaaatccattaaaaagagatcaagatgctttaatttatgaatgtccatatttaaagaaaactgttaaattaacatattatcaattatatgaaaaagtatgtgaattttcaagagtacttttaaatttaaatatttcaaaaaatgataatgttttaatttatatggcaaatacattggagcctttaattgcaatgttatcatgtgctcgtattggtgcaactcattgcacaatattcgatggttattcggttaaaagtttaatagatagaattgaaacaattacaccaaaattaataattacaacaaactatggtatattaaatgatgaaatcattacatttacaccaaatttaaaagatgcaattgaacaatcaacttttaaaccaagtaatgtaattactttatttagaaatgatattacaagcgaatcagatttaaagaaagtaaaagatataccaacgataccaaatacattaagttggtatgatgaaattaaaaaattcaaggaaaataatcaatcaccattttatgaatatgttccagtagaatcaagtcatccattatacataatatatacaagtggtacaactggaaattctaaagcagttgtaagaagtaatggttcacatatggtttgtttgaattactttaaccgatatatttcagaaaataatcaaagtacaacattattgacaacttcaagtgttggatgggtatcatttcatggtttcctatatggtatgttgtcatttggatctacatttgtaatgtatgaaggtggtattataaaaaataaacatattgaagttgacctttggaataccattgaaaaacataaagtaacacatgcattatcattggcaagcgctattagataccttattaaaactgatcctgaaggaacaatccttcgttcaaagtatgatttatcaaatttaaaagaaatatggattggtggtgaaccaattgaagaatcaatttcagaatacattgaacaaaagttaaaaataaaatcaacaaggggatatggtcaaactgaaattggtataacttatttatattgttttggtcatattaatatcccatactacgcaactggtttaccatcaattttcattagaccatcaatattttcagacgatggtaaagaattaggtgttaacgaaattggtgaaatcgcattcaaattaccaatgccaccaagttttgcaactacattttataaaaatgatgaaaagtttaaacaattattttcaaaatttccaggttactacaatcctggtgatttaggttttaaagatgaaaatggattttatacaattgtttcaagatcagatgatcaaattaaaatcagtggtaataaagttcaattaaatacaattgaaacatcaatactaaaacatccatcagttttagaatgttgttcaattggtattaacgatccaacttgttatagtgtaccaatagccttattagttttaaaacaacaacaacaacagcaacaagatcagtcaactcgacaaatagatttaaataaattacactctgaaattaataatatcattacacaagatattgcatcattagcagtcttaagaaaaattgtaattgttaatcaattaccaaaaacaaaaactggtaaaattccaagaccaattatatcaaagtttttaaatgattcaaattttctattacccgataacatcagtaatgttgaaatattttatgaaatcaaagaattatatacgaaaattaattag

SEQ ID NO: 940 - protein, 655 aa, Dictyostelium discoideum
MYRLSEPFDYLNDKTYANNEPEAFWDEVAKKLIKWDKMYDKVYSGDEMYPDWFKGGELNTCYNVLDRQVQNPLKRDQDALIYECPYLKKTVKLTYYQLYEKVCEFSRVLLNLNISKNDNVLIYMANTLEPLIAMLSCARIGATHCTIFDGYSVKSLIDRIETITPKLIITTNYGILNDEIITFTPNLKDAIEQSTFKPSNVITLFRNDITSESDLKKVKDIPTIPNTLSWYDEIKKFKENNQSPFYEYVPVESSHPLYIIYTSGTTGNSKAVVRSNGSHMVCLNYFNRYISENNQSTTLLTTSSVGWVSFHGFLYGMLSFGSTFVMYEGGIIKNKHIEVDLWNTIEKHKVTHALSLASAIRYLIKTDPEGTILRSKYDLSNLKEIWIGGEPIEESISEYIEQKLKIKSTRGYGQTEIGITYLYCFGHINIPYYATGLPSIFIRPSIFSDDGKELGVNEIGEIAFKLPMPPSFATTFYKNDEKFKQLFSKFPGYYNPGDLGFKDENGFYTIVSRSDDQIKISGNKVQLNTIETSILKHPSVLECCSIGINDPTCYSVPIALLVLKQQQQQQQDQSTRQIDLNKLHSEINNIITQDIASLAVLRKIVIVNQLPKTKTGKIPRPIISKFLNDSNFLLPDNISNVEIFYEIKELYTKIN

SEQ ID NO: 941 - DNA, 1944 bp, Dictyostelium discoideum
  CDS (1)..(1944)
atgtataagtttaattatgaaaatgatattgattttgcaaataaccaaccaatagaattttgggatgaagttgcaaaggatttagttcattgggataaaatgtatgaaaaagtttatagtgatgatgaaatatatccagattggtttaaaggtggtgaattaaatacatgttataatgttttagatattcatattaaaaatccagaaacaagagatcaagatgcattaatttatgaatgtccatatttaaagaaaactgtaaaattaacttattatcaattatatgaaaaagtatgtgaattttcaagagtacttttaaatttaaatatatcaaaaaatgataatgttttaatttatatgtcaaatacattagaaccattaattgcaatgttatcatgtgctcgtattggtgcaactcattgtgtgttattcgatggttattcagttaaaagtttaatagatagaattgaaacaattacaccaaaattaataattacaacaaattatggtatttttaatgatgaaattattaatttcataccaaatttaaaagaatcaattgaattatcaacttttaaaccaagtaatgtaattactttatttagaaatgatattacaagcgaatcagatttaaagaaagtaaatgatataccaacgataccaaatacattaagttggtatgatgaaattaaaaaattcaaagaaaataatcaattaccattttatgaatatgtaccagtagaatcaagtcatccattatatatactatatacaagtggtacaactggtaattctaaaggggctgttagaagtaatggtccacatttagttggtattaaatatcaaacattgatacaaaagggtaaaacaaaagtagtattttatcatacaagtgttgggtggatatcaattcataatgcttttaatggtttattatcacttggatatacattggttatgtttgaaggtgggcttactaaaacaaaacatatggaagatgatatttgggaagttattgaaagaaataaagtaacttgtgcatccataatggctaaagcaattagatacttaattaaagttgatcctgaatgtaaaaatttacattcaaagtatgatttatcaaatttaaaagaaataatagttggtggagaaccaattgaagaatcaattccaaattatattcaagagaaattaaaagtaaagtcaattcgtgtatacggtcaaactgaaactggagcatgttatttttattgttatgattataaaaatttaaaaattcctattaacacaagtggctttccattttcatctttaaaagcaatgattttttcagatgatggcaaagaattaggtgttaatgaaattggagagcttgtatttaaattaccattaccaccaagttttgcaactacattttataaaaatgatgaaaagtttaaacaattatttacaaaattcccaggttactataaccctggtgatttaggatttaaagatgaaaataattgttatggtgttgtttcaagatcagatgatcaaattaaaatcagtggtaataaagttcaattaaataaaattgaaacatcaattttaaaacatccattagttttagaatgttgttcaataggtatttataatccagattgttataatgtaccaatagcttttttagttttaaaacaacaagaagatcaatcaattcaacaaattgatttaaataaattacaatctgaaattaatataatcatttcaaaagatatagaaaattttgcaattttaagaaaaactttaatagttacacaaataccgaaaaccaaagctggtaaaattcaaagacaaatcatttctaaatatttaaatgatataaattatgaattaccagataatgtttgtgatgttgaaatcttttataaaatcaaggatttatataataatgttaaatag

SEQ ID NO: 942 - protein, 647 aa, Dictyostelium discoideum
MYKFNYENDIDFANNQPIEFWDEVAKDLVHWDKMYEKVYSDDEIYPDWFKGGELNTCYNVLDIHIKNPETRDQDALIYECPYLKKTVKLTYYQLYEKVCEFSRVLLNLNISKNDNVLIYMSNTLEPLIAMLSCARIGATHCVLFDGYSVKSLIDRIETITPKLIITTNYGIFNDEIINFIPNLKESIELSTFKPSNVITLFRNDITSESDLKKVNDIPTIPNTLSWYDEIKKFKENNQLPFYEYVPVESSHPLYILYTSGTTGNSKGAVRSNGPHLVGIKYQTLIQKGKTKVVFYHTSVGWISIHNAFNGLLSLGYTLVMFEGGLTKTKHMEDDIWEVIERNKVTCASIMAKAIRYLIKVDPECKNLHSKYDLSNLKEIIVGGEPIEESIPNYIQEKLKVKSIRVYGQTETGACYFYCYDYKNLKIPINTSGFPFSSLKAMIFSDDGKELGVNEIGELVFKLPLPPSFATTFYKNDEKFKQLFTKFPGYYNPGDLGFKDENNCYGVVSRSDDQIKISGNKVQLNKIETSILKHPLVLECCSIGIYNPDCYNVPIAFLVLKQQEDQSIQQIDLNKLQSEINIIISKDIENFAILRKTLIVTQIPKTKAGKIQRQIISKYLNDINYELPDNVCDVEIFYKIKDLYNNVK

SEQ ID NO: 943 - DNA, 1941 bp, Dictyostelium discoideum
  CDS (1)..(1941)
atgaaattaagtgatccttttgattatgaaaatgatctaaaatatgcagaatcccaacctgtttcattttgggatgacattgccaaaaaatatatacattgggataaaatgtatgataaagtttatagtggtgatgaaatgtatccagattggtttaaaggtggtgaattaaatacatgttataatgttttagatattcaagttcaaaatccattaaaaagagatcaagacgcattaatttatgaatgtccatttttaaagaaaactgttaaattaacttattatcaattatatgaaaaagtatgtgaattttcaagagtacttttaaatttaaatatttcaaaaaatgataatattttaatatttatggcaaatacagttgaagcaccaattgcaatgttatcatgtgctcgtattggtgcaactcattgtgtactattcgatggctattcaacaaaaagtttaatagatagaattgaagctgtaagaccaaaagttattattacctcaaattatggtattttaaatgaggaaattattacatttacaccaaatttaattgaagcaattgaaatatcaacttttaaaccagatcatgtaattacacataatagagatttaattagttccgatgcacaattatcaataattgaaactatacctactgtaccatcttctttggattgggacttggaaatcaacaaaattaaagaaaacaatcaaacaccattctatgaatatgttacagtagaatcaagtcatccactttacattatttatacaagtggtacaactggtaattcaaaaggagttgttagaagtaatggtccacatttagtttgttttggttatctttggccatcaattgttcaaaaaaatactactttcttttctcatactagtataggatgggtatcgtttcattcatttttgtatgcttcattattacatggatgttcatttgtgatgtttgaaggtggaattgtaaaaccaaaacatatggaagatgatatttggtcaattgttgaaaagcataaagttagtgcatttctaacattagcaaaaacaataagatatttaaataaagttgatccagatgcaaaacaaatacattcaaaatatgatatttcaagtttaaaatcaatttggaatggtggtgaagttattgaagattcaattccagaatatattgaaaacaaactaaaatcaagaccatctattggatatggtcaaactgaaactggttatttgtatttattcgattacataaaatcaaaaaaaaatccatacaacacagttggtccaccatcaccatttgtctacccatcaattttatcagaagatggtattgaattaccagtgaatcaaattggtgaaatcgtattcaaattaccattaccacctggattcgcttcaacattttataaaaatgatgaacaatttaaaaaagttttaacaaaattcccaggttattatagtagtggtgatttaggttataaagatgaaaatggatattatgctatcgtttcaagagcagatgatcaaattaaaattggtggtaataaagttcaattaaacacaattgaaacatcaattttaaaacatccaaatgttattgaatgttgttcaattggtatttacaatccagattgttataataaaccaattggtttattaactttaaaacaacaagattcaaatgtcgacttaattcaattaaaaaatgaaattaatagtatcatcacacaagatattgataaatttgctcaattaacacatataataattgttgaacaattaccaaaaactaaaagtggtaaaatccaaagattaatcatttctaaatttttaaatgataataattttaaattacctgatcatgtatttgaaagtcaacaaatatatacagatattaaaaatttatatttaaataatttataa

SEQ ID NO: 944 - protein, 646 aa, Dictyostelium discoideum
MKLSDPFDYENDLKYAESQPVSFWDDIAKKYIHWDKMYDKVYSGDEMYPDWFKGGELNTCYNVLDIQVQNPLKRDQDALIYECPFLKKTVKLTYYQLYEKVCEFSRVLLNLNISKNDNILIFMANTVEAPIAMLSCARIGATHCVLFDGYSTKSLIDRIEAVRPKVIITSNYGILNEEIITFTPNLIEAIEISTFKPDHVITHNRDLISSDAQLSIIETIPTVPSSLDWDLEINKIKENNQTPFYEYVTVESSHPLYIIYTSGTTGNSKGVVRSNGPHLVCFGYLWPSIVQKNTTFFSHTSIGWVSFHSFLYASLLHGCSFVMFEGGIVKPKHMEDDIWSIVEKHKVSAFLTLAKTIRYLNKVDPDAKQIHSKYDISSLKSIWNGGEVIEDSIPEYIENKLKSRPSIGYGQTETGYLYLFDYIKSKKNPYNTVGPPSPFVYPSILSEDGIELPVNQIGEIVFKLPLPPGFASTFYKNDEQFKKVLTKFPGYYSSGDLGYKDENGYYAIVSRADDQIKIGGNKVQLNTIETSILKHPNVIECCSIGIYNPDCYNKPIGLLTLKQQDSNVDLIQLKNEINSIITQDIDKFAQLTHIIIVEQLPKTKSGKIQRLIISKFLNDNNFKLPDHVFESQQIYTDIKNLYLNNL

SEQ ID NO: 945 - DNA, 2085 bp, Neurospora crassa
  CDS (1)..(2085)
atgacccatcctcaagacgaggcccagcatctctctctcaccgatcccgaaggattctggggtcatcaagctgaacagcttcactggcacagaaagccttctgcggttctgaaacgcacgactaaagatctgaaattgggtacctctcacagtcattgggaatggttcccagacggcgagatatccacctgctataactgccttgaccgtcatgtcctagcggggcatggagatcagcccgccattctctacgacagttcggtcacgaacaccaagcagcggttgacttacaagcagcttcttgccgaggtcgaaacttttgccggggtccttcgagaggaaggcgttaagaagggagatgttgttttagtttacatgcccatggtgcccgccactttgatcggcattctcgccattaatcgcttgggtgccatccacgctgttgtctttggtggctttgcttccacagccctggctcagcgcattgaagcctcacgtccagtcgctatcttgacagcttcttgtggtatcgaaggtaacaaagggcctgtcagttaccgcgcctatatcgaagaagctatcagcatctcatccttcaaaccccccaagactatcatctggcagcgtgagcagctagtgtggcgtccgatcaagaaaaccgagggcgagcgggattggcagaagctggtcaagagcgcgcggttcagaaatatcaaggttgagtgtgttcctgtaaggtcggctgatcccatttacatcatctacaccagcggaaccacaggtcgaccgaaaggtgtcgttcgcgatagcggcggtcatgctgttgggctgcacatgtcgatttcgtatctgttcggtatacatggaccaggtgacgtgatgggctgtttcagcgacataggctgggtagtttcacacagctacacactttatggtcccctactgacaggcgccgccacggtcctctacgaaggtaagcctgttggaacacccgacgcctcggctttctggagactagccgaggaatataagatcaacaccttgtttaccgcaccaacggcactcagagccatccgaaaggaagaccctgacaatgtctttatcaccgagattggcagacgaggtgggctcaagagcctcaaagccctttttcttgctggagagcggtccgagccagctatcattaacatgtaccaggacttgctcaggcggtatggcgcggcaggctcccaggttgttgataactggtggtcgtcagaatctgggtcgccgatttcgggtgttgcgttggttccgcacgcaggcaagaacaggaagacgaatatgaaagatcatccgccattacctatcaagcccgggagtgctggaaaggccatgcctgggtttgatgtcagagttgtggatgacgaaggcaacgaggtgcccaggggcaacatgggaaacatcgttctgggccttccattggcacctactgcgtttcggacactttggggggatgaggaacgattctataagagttacatgattcgcttcaatggcaagtgggttgacactggcgatgccggctatgtcgaccaaacagggtacattcacattatggcacgcactgatgacattatcaacgttgccgcccatcgtcttagcacaggcacgctcgagcaagcagtcacaagccaccccctcgtcaccgaagcatgtgtggttagcgtccccgacgccctcaaaggccagcttcctttcgccttcgtcagcacctcggacggcggcgccgacgtcaagtcagacgagcagctgttccaggatatccagaagctcgtccgcgcccaggttggcgccatcgcctcgctgggcgggatgatccggggcaagggcatgattccgaagacgcgctcgggcaagaccttgaggagagtcctacgcgaactgctagaaaatgcggtccatgacgagttcgaaaagcccatcaatatcccctcgacggtggaggatccgagtgtagtggatgtggcgagggagaagattagggaatattggcatgcgaagagcgggttgcatgcggctatcgaggctagggcgaagctttga

SEQ ID NO: 946 - protein, 694 aa, Neurospora crassa
MTHPQDEAQHLSLTDPEGFWGHQAEQLHWHRKPSAVLKRTTKDLKLGTSHSHWEWFPDGEISTCYNCLDRHVLAGHGDQPAILYDSSVTNTKQRLTYKQLLAEVETFAGVLREEGVKKGDVVLVYMPMVPATLIGILAINRLGAIHAVVFGGFASTALAQRIEASRPVAILTASCGIEGNKGPVSYRAYIEEAISISSFKPPKTIIWQREQLVWRPIKKTEGERDWQKLVKSARFRNIKVECVPVRSADPIYIIYTSGTTGRPKGVVRDSGGHAVGLHMSISYLFGIHGPGDVMGCFSDIGWVVSHSYTLYGPLLTGAATVLYEGKPVGTPDASAFWRLAEEYKINTLFTAPTALRAIRKEDPDNVFITEIGRRGGLKSLKALFLAGERSEPAIINMYQDLLRRYGAAGSQVVDNWWSSESGSPISGVALVPHAGKNRKTNMKDHPPLPIKPGSAGKAMPGFDVRVVDDEGNEVPRGNMGNIVLGLPLAPTAFRTLWGDEERFYKSYMIRFNGKWVDTGDAGYVDQTGYIHIMARTDDIINVAAHRLSTGTLEQAVTSHPLVTEACVVSVPDALKGQLPFAFVSTSDGGADVKSDEQLFQDIQKLVRAQVGAIASLGGMIRGKGMIPKTRSGKTLRRVLRELLENAVHDEFEKPINIPSTVEDPSVVDVAREKIREYWHAKSGLHAAIEARAKL

SEQ ID NO: 947 - DNA, 2034 bp, Vibrio parahaemolyticus
  CDS (1)..(2034)
atgccaagccaaactcctatttggtcgccatctgctgagcgagtcagagacagtaacctgcttcgatttatcgagagcactaatgcacgaagcagcacaagtaatgagattagcgattatgcgtcattacaccgctggtctattgaacacaatgacgcattttggcagcacacttggcaattttgtaaagtcgttggcaagttaggttcacaaatcaaaagtttaagcgagccaaaatggagcgattcaaactcaccaaatatcaacagagatacggtttggttctgcgatacaacccttaactacgctcagaatttacttgtacacgcagagcaatcgccagagcgacaattgattgttttcagcaatgaaagtggcgagcaaaaacagctctctggtcaacaattgattgagcaagtgtccatcgtccaacaatggttgattgcaaatggtgtcggcaaaggagatgtcgtggcggcctacttgccctaccttcctgagaccgtaatcgcgatgcttgcgaccaccagcctcggtgctatttggacgtcgacctctccagactttggcgtcgacagcgtgttggagcggttcggccaagtgacacccaaagtattgttttgttgtaatggctaccaatttggcggcaagatcttcgatatgacgcaaaaaaaccgagcgattagtagcaagctcggaaacaccattagcgtttgccaaattgactatttaacgccaagcagcgaattaacaccaagagacgaacgatccgactccgacttcattacatggagcgagttgtctgaacacattgctccacaatctgttcactaccaaccagcgctgtttaatgacccgttattcattttatattcgtcaggaaccacagggcagcctaagtgcattgtccattccgtagggggaaccttactcaatcatttgaaagaacatcagctgcactgcgatgtaaaacctctcgacaaggttttctactacaccacttgtggttggatgatgtggaactggcatgtttccgcactcgcgagcggtgccacgttggtgatttacgacggtagccccgtgtaccccgaccattctgtgctttggcgcttggcggaagaacagtcggtgtcactgtttggcacctctgcaaagtatctcgaagcgcttgagcaagccaattattcgcctcggtcagagcataatttggattcgctgaagaccttatgctctacaggttccgtgctctatccagagcagttcagttacgtttatcaacatatcaaacaggatttacacttagcttccatcgcaggcggaaccgacatttgtggctgctttgttctcggtaacccgatctctcccgtctacaaaggggaatgccaaggtgcggggctcggtaacaatgtaaaagtacttgatgacgcagggagcgaagtagtttcacaacgcggagaactgacatgtaacaactcgctgccaaactttcctatcggcttttggcatgacaatggcgaacgttatcacgatgcttactggagcaaatttgcggatacttggcaccacagtgatgacgtcatgcaaaccgcaaacggcggctttatcttctacggccgaagtgacgcaacgctcaatcccggcggagtacgtattggcacagcagaaatctatcaacaagtgaacgcgctatcgggtatcgaagattcgattgccgtcggtaagttgagccagcaatctgaagagatctggttattcgtcaaattaagccaaagtgttgaattaacgccacaactgactgacttgatccgccaaacgttgaaaacgaagtgctcaccgcgacatatcccgcgcaagatcttcgcactcagtgatattccacgaacgcgttccggcaaaacggttgaactggcagtaaagcaggccgtaaatggtcagacagttaaaaatatcggtgcaattgcgaatcctgaagttttggaagagatagcggcaattgccgttgaaacacagcccgcactgaccaatgcgctataa

SEQ ID NO: 948 - protein, 677 aa, Vibrio parahaemolyticus
MPSQTPIWSPSAERVRDSNLLRFIESTNARSSTSNEISDYASLHRWSIEHNDAFWQHTWQFCKVVGKLGSQIKSLSEPKWSDSNSPNINRDTVWFCDTTLNYAQNLLVHAEQSPERQLIVFSNESGEQKQLSGQQLIEQVSIVQQWLIANGVGKGDVVAAYLPYLPETVIAMLATTSLGAIWTSTSPDFGVDSVLERFGQVTPKVLFCCNGYQFGGKIFDMTQKNRAISSKLGNTISVCQIDYLTPSSELTPRDERSDSDFITWSELSEHIAPQSVHYQPALFNDPLFILYSSGTTGQPKCIVHSVGGTLLNHLKEHQLHCDVKPLDKVFYYTTCGWMMWNWHVSALASGATLVIYDGSPVYPDHSVLWRLAEEQSVSLFGTSAKYLEALEQANYSPRSEHNLDSLKTLCSTGSVLYPEQFSYVYQHIKQDLHLASIAGGTDICGCFVLGNPISPVYKGECQGAGLGNNVKVLDDAGSEVVSQRGELTCNNSLPNFPIGFWHDNGERYHDAYWSKFADTWHHSDDVMQTANGGFIFYGRSDATLNPGGVRIGTAEIYQQVNALSGIEDSIAVGKLSQQSEEIWLFVKLSQSVELTPQLTDLIRQTLKTKCSPRHIPRKIFALSDIPRTRSGKTVELAVKQAVNGQTVKNIGAIANPEVLEEIAAIAVETQPALTNAL

SEQ ID NO: 949 - DNA, 1971 bp, Vibrio parahaemolyticus
  CDS (1)..(1971)
atgcgcgagagcaacaaagtatggcaaccgagcgaaagtcgtatcgcagaagccaatattactcagtttatcgaacacattaatcgacaaggttttgacctaaaaaactacgcagacctgcaccaatggtctttggatcataacgagcagttttggcaagaggtctggctgttttgcgatgtaataggtaatgcaggtgagacggtaaaaagccaagccgagagcaaatggcaacaaccagtactcaatcgtgatttatgttggtttcctgacgctcatattaactacgcagaaaacttattgagttttgcttatcaaaaaccacatgagctcgccatctggtttgaaaatgagcgcgacgaacgacagacctatacgtggcaacagctgtgtgatgaagtctcgagtgttcaacagtggcttagggattgtggcatcaaacaaggcgatgttgttgctggttacttacctcaccttcctcaaaccgtcatcgcgatgttggcaaccaccagcttaggtgcgacatggacgtcaacctcgccagattttggcgtagaaagtgtgctggaacgttttggacaggtaaaaccaaaaattttgttcacttgtgatggctacacattcaatggcaaaactttcgacatggcggaaaaaaaccaacatatatccgatcatctcgatggcctcaaacaagtatgccaaatcagctatctcaagcctcacatctttgaatgtgatgtttgtacccaagattggcaaaacgtgcttaatcaatactcacctgagcccctcacctacactcgcgttaacttcaatgacccactctttgtgttgtattcatccggtacgacaggtaaacccaaatgcatcgtgcactcggtcggtggcaccattctgaatcacgtaaaagagcatcaactgcactgcgatattcaaccgaacgatcgagttttttactacacgacctgtggttggatgatgtggaattggcacgtttccgcccttgcaagcggagcgtgcttagtcatttttgacggtagccctgtttatccttctcacaaggtgctgtggaaccttgctcaaaatgctgacgtgaccttgtttggtacgtcggctaaatatctggaagcgcttgaaaaagcgcaattctcaccgaaaagagccgatgctttccccgcactcaagacgatttgctcaactggctctgtactttatcctgagcaattcaattacgtttacgagcacttaaaggaagacatacatttagcgtccattgctgggggcacagatatttgcggatgctttgtattaggcaatccgatatcaccagtctatcgaggcgagtgtcaatccgcaggcttaggcgttgatgtgcaagtatttaatccacaaggtcacagtgtcgtgggtgaacgaggtgagctggtttgcaccaattcactgcctaattttccttctgggttctggcgtgattcaggcgagcgttaccatcgcgcctactgggataagttcgataatgtttggcatcatggcgacgatgtagaaaaaagtgaggttggcggttttgttttttatggccgcagtgacaccactcttaatccaggcggagtcagaattggtaccgcagaaatttaccaacaggtgaatgctattgatggcattgttgactccatcgcagttgggaaagaagtggatcgaaatgaacagatctggctttttgttcaattagaaagccaagatgagttggatgatgagttaatcggtagcattaaagcgcagctgaaatcggcctgttcaccacgccatgtgccgagtgccattttcgccatcagcgatattccgaaaacgcgatcaggcaaactggtagaacttgccgtcaagcaggttgtcaatggtcgacaagttgaaaacttaggcgcaattgccaatccagagatacttcaagagattcaaaccgcgatatcagcttag

SEQ ID NO: 950 - protein, 656 aa, Vibrio parahaemolyticus
MRESNKVWQPSESRIAEANITQFIEHINRQGFDLKNYADLHQWSLDHNEQFWQEVWLFCDVIGNAGETVKSQAESKWQQPVLNRDLCWFPDAHINYAENLLSFAYQKPHELAIWFENERDERQTYTWQQLCDEVSSVQQWLRDCGIKQGDVVAGYLPHLPQTVIAMLATTSLGATWTSTSPDFGVESVLERFGQVKPKILFTCDGYTFNGKTFDMAEKNQHISDHLDGLKQVCQISYLKPHIFECDVCTQDWQNVLNQYSPEPLTYTRVNFNDPLFVLYSSGTTGKPKCIVHSVGGTILNHVKEHQLHCDIQPNDRVFYYTTCGWMMWNWHVSALASGACLVIFDGSPVYPSHKVLWNLAQNADVTLFGTSAKYLEALEKAQFSPKRADAFPALKTICSTGSVLYPEQFNYVYEHLKEDIHLASIAGGTDICGCFVLGNPISPVYRGECQSAGLGVDVQVFNPQGHSVVGERGELVCTNSLPNFPSGFWRDSGERYHRAYWDKFDNVWHHGDDVEKSEVGGFVFYGRSDTTLNPGGVRIGTAEIYQQVNAIDGIVDSIAVGKEVDRNEQIWLFVQLESQDELDDELIGSIKAQLKSACSPRHVPSAIFAISDIPKTRSGKLVELAVKQVVNGRQVENLGAIANPEILQEIQTAISA

SEQ ID NO: 951 - DNA, 1905 bp, Vibrio parahaemolyticus
  CDS (1)..(1905)
atgtcaggacatactggaggaagcaatatgtcttcatacgaaaaagaatatttatgggcgaaaaacgaaccggagagtttttggcgcgctcaagcggagaatatcgactggtttgaatctcctaaaaccatcttgaaatctgatgagaacggcatcgaacgttggttcccagatggggtgatgaatacgtcttggttggcactggattaccattgcgaacaaggacgtggtgataatactgcgctaatttatgactcaccagtaacgggaaataaaaagacttacacttaccgagagctacgcgatcaagttgcgaaaattgccggtatgctttctgcgcaaggcgttgaaaaaggcgaccgagttgttgtttacatgccgatgatcccagaagcggcaatggcaatgcttgcttgtgcacgtttgggtgcgattcactcagttgtgtttggtggttttgcgcctaatgagctggcggtacgtattgaagatgcagagccaaaagtcattatgacggcatcgtgtggcatcgaaatcagtaaaatcattccgtataaaccattagtagacaaagccatcatggacagccgttggaaacctgagaaagtgtttgttttccagcgtccagaatgtgaagccgagttaaatcaggaaagagatttggactggcaacaggaatacaaaaaagcgctgcctcatgcttgtgttcctgtattagcaacagacccactgtatatcctttatacctcaggcacgacgggcaaaccgaaaggggtggtacgtgataacggtggccatgcggtagcactgaagtactcaatgagcgcaatctacaacatcccgcaaggtggtgtgttctgggcggcatccgacgtgggctgggtagttggtcactcgtatattgtttacgcgccattaattcacggctgcaccacaatactgtttgaaggtaagccagtcagaactccgaatccgggggcattctggcgtgtgtgtgatgaatataaagtggatgctttgttctcggcgccaacggctttccgtgcgattaagaaagaagacccggaaggcgagttcttaaagcagtatgatctgtcaaacctgaaaaccatctttatggctggtgagcgtttagatcctcctacgctggaatgggtacaaagtaaaactgacaaaccggttatcgatcactggtggcaaacagagacaggttgggcgattgcggggaacccaacgggcattgaaatgatgccagtaaaagcgggttcttcaactaagcctattccgggttatcaagtagaaatcctcgatgaactgggtgaaccagtaaaacctaatcaacaaggtttcgttgcgctaaaacgtccgttaccgccaagctgcttaccaaccgtgtggcgaaaccatgatcgttttgaaacgggctacctaagccaattcccaggctactatgtgtcgggtgacggtggttatctcgacgaagacggttacctattcatcatggggcgtattgacgatgtgattaacgtggctggccaccgtctgtctactggtgaaatggaagaaattgttggtggtcacccagccattgcagaatgtgcagtagttggcattcacgatgatctgaaagggcagctaccacttggtttcgttgtgctgaaagatggcgtcaaggttgatgagttagcgctagaaggcgaacttgtgggtaaggtgagaaatgagattggcgcggttgcatgcttcaaacacgcactggttgtagatcgcttaccgaaaacacgttcgggtaaaattctgcgtcgaaccatccgccaaattgctgatggtgaacaatacaccgtgccatcgacgattgatgatccaacgagcctgaatgaaatagagcgagtattacgacgctaa

SEQ ID NO: 952 - protein, 634 aa, Vibrio parahaemolyticus
MSGHTGGSNMSSYEKEYLWAKNEPESFWRAQAENIDWFESPKTILKSDENGIERWFPDGVMNTSWLALDYHCEQGRGDNTALIYDSPVTGNKKTYTYRELRDQVAKIAGMLSAQGVEKGDRVVVYMPMIPEAAMAMLACARLGAIHSVVFGGFAPNELAVRIEDAEPKVIMTASCGIEISKIIPYKPLVDKAIMDSRWKPEKVFVFQRPECEAELNQERDLDWQQEYKKALPHACVPVLATDPLYILYTSGTTGKPKGVVRDNGGHAVALKYSMSAIYNIPQGGVFWAASDVGWVVGHSYIVYAPLIHGCTTILFEGKPVRTPNPGAFWRVCDEYKVDALFSAPTAFRAIKKEDPEGEFLKQYDLSNLKTIFMAGERLDPPTLEWVQSKTDKPVIDHWWQTETGWAIAGNPTGIEMMPVKAGSSTKPIPGYQVEILDELGEPVKPNQQGFVALKRPLPPSCLPTVWRNHDRFETGYLSQFPGYYVSGDGGYLDEDGYLFIMGRIDDVINVAGHRLSTGEMEEIVGGHPAIAECAVVGIHDDLKGQLPLGFVVLKDGVKVDELALEGELVGKVRNEIGAVACFKHALVVDRLPKTRSGKILRRTIRQIADGEQYTVPSTIDDPTSLNEIERVLRR

SEQ ID NO: 953 - DNA, 1953 bp, Pseudomonas putida
  CDS (1)..(1953)
atgaacgatgtgctctggcgaccgtccacaacgcagatcgaggccagccggatggatgccttccgccgccgggtcaacctgcgctacaacctgcaactcaacgactaccaggccctgcacggctggagcatcgaacagcggcccgccttctggcaaaccctggccgagtatttccaggttcattggcataccccacccagccaggtgctcagcgaagggccgcaaatgcccgatgcacagtggttcgccaatgccaccctgaactttgccgaacacctgctgcgccgccgcgacgaccgcccggccgtggtcgccgtacgcgaagacggccagcgcgaagtgttcacccatgccgaactggccgcacaggtggccggcctgcaaacggcattcaaggcggtaggtatcgtcccgggcgaccgggtagccgccatcatgcccaatacctggcaaacactggtggccatgctcgcctgcaccagccttggcgcggtctggtctacctcctcgcccgagttcggcgtgcacggcatcatcgaccgcttcggccagatcgaacccaagctgctgatcgtctgcgccggttaccagtatgcaggcaaggccatcgaccaggtgaccaaggtcaaccaggtgtgtgcgcagttgcctggcctggagcacctgatcgtggtgccccatacccgcaaaggcacgcgtgccgatgaattccaggcagccaacgtcagcctgtggaatgacttcttccagcccggcggcgagccccgtttcaccccgctgccgttcgaccacccgctgtacatcctctattccagtggcaccaccggcgtgcccaagtgcattgtccatcgcgccggaggcgtgctgttgcaacacctcaaggaacacggcctgcacaacgacctgaaggccgatgacgtgctgttctactacaccacctgcggctggatgatgtggaactggctggccagcggcctggcggtgggtgccacgctggtgctgtacgacggctcgccgttccacccgggccccgagcgccttctggacctgatagaggccgagggcatccacgccttcggcaccagcgccaagtacctggcggcactggagcaggcaggcctggaacctgccaacagccactgcctgaccagcctgcggctgctgctgtccaccggttcgccgctgtcaccgcacagctatgactatgtatacgacaagatcaaggccgacctgtggctcgtgtccatgtcgggcggcacggacattgtctcctgcttcgtgctgggcaacccgaccctgcctgtgcgtcgcggcgaaatccagtgcaagggcctgggtatggcggtggaggtgtggaacgagcagggtcagcccgtggtggacgaaaaaggcgagctggtgtgcacgcgcaacttcccctcgatgccactcggtttctggaacgacccggacggtcgccgttaccacgatgcctacttcagccagtttccgggggtgtgggcccagggcgactacgccgagcagcgtgccagcgggggcatggtgatccacggtcgctccgacgccgtgctcaacccgggcggtgtgcgcattggcacggcggagatctaccgccaggtggaaaaggtcgaacaggttgtggaaagcgtggccatcggccaggactggaacggggatgtgcgggtggtgctgttcgtgcgcctgcaagacggcctgcagctggatgaagccttgcgccagcacatccgccaggtgatacgccagtacaccacgccccgccatgtgccggcggtgatcgcccaggtcagcgacataccgcgcaccatcagtggcaagctggtggaactggcgattcgcgatgtggtgcatgggcggccggtgaagaacaccgatgccctggccaacccggaggcgctggagcagtttcgcgatcgcgcagagctgaagagctga

SEQ ID NO: 954 - protein, 650 aa, Pseudomonas putida
MNDVLWRPSTTQIEASRMDAFRRRVNLRYNLQLNDYQALHGWSIEQRPAFWQTLAEYFQVHWHTPPSQVLSEGPQMPDAQWFANATLNFAEHLLRRRDDRPAVVAVREDGQREVFTHAELAAQVAGLQTAFKAVGIVPGDRVAAIMPNTWQTLVAMLACTSLGAVWSTSSPEFGVHGIIDRFGQIEPKLLIVCAGYQYAGKAIDQVTKVNQVCAQLPGLEHLIVVPHTRKGTRADEFQAANVSLWNDFFQPGGEPRFTPLPFDHPLYILYSSGTTGVPKCIVHRAGGVLLQHLKEHGLHNDLKADDVLFYYTTCGWMMWNWLASGLAVGATLVLYDGSPFHPGPERLLDLIEAEGIHAFGTSAKYLAALEQAGLEPANSHCLTSLRLLLSTGSPLSPHSYDYVYDKIKADLWLVSMSGGTDIVSCFVLGNPTLPVRRGEIQCKGLGMAVEVWNEQGQPVVDEKGELVCTRNFPSMPLGFWNDPDGRRYHDAYFSQFPGVWAQGDYAEQRASGGMVIHGRSDAVLNPGGVRIGTAEIYRQVEKVEQVVESVAIGQDWNGDVRVVLFVRLQDGLQLDEALRQHIRQVIRQYTTPRHVPAVIAQVSDIPRTISGKLVELAIRDVVHGRPVKNTDALANPEALEQFRDRAELKS

SEQ ID NO: 955 - DNA, 1890 bp, Pseudomonas putida
  CDS (1)..(1890)
atgagctaccagcacagctacgcccattccatttccgaccctgccgctttctgggcggaacaggccgcacacctggcctggcaccgcaagcctgccctgaccctgcaagataacgccgacggtacccaccgctggttcgcggatggccgcctgaacagctgttacctggccctcgaccaccagatcgagcagggccgcggcgagcagttggcgctgatctacgattcgccagtgaccggcgtgcagcagacctacacctacaaccaattgcgcgacgaggtggcacgcctggccggtttgctgcgccagctgggggtgaacaagggcgatggcgtgatcatctacatgcccatggtgccgcaagcggccatggcgatgctggcctgcgcgcggatcggcgcggtgcattcggtcgtgttcggtggctttgccgccaacgagttggccctgcgcatcgatgacgcccggcccaccttgttgctgacggcatcgtgcgggctggagttcgaccgggtcattgcatacaaaccgctggttgaccgtgccctgcaactggcccggcaccagccgcgcaatgtgctggtgctgcagcggccacaggcacacgctgaactgctgcctggccgcgacctggactggcaggcggccttggccgacgccgagccggtggcccccgtcgagctggatgccggcgacccgctgtacatcatgtatacctcaggcaccaccggtaagcccaagggtatcgtccgggaaaacggcggcaatgccgtggcgctgtgttacgccatgcgccatatctatggcatgcaggccggtgatgtgtggtggggcatttccgacgtcggttgggtggtcggccactcactgatcgtctacgggccgttgatgagcggctgtaccacggtgttctacgaaggcaagccaatccgcaccccggatgcttcggcctattggcgggtggtggagcagtaccgggtcaacgcgctgttctgtgcacctacggccatgcgcgccatccgcaaggaggacccggagggcgacctgattcgcaaacatgacctcagctcgctgcggcaactgttcctggcgggggaaaagctggattccagcacccatgaatggctggaacgggtgagtggcaagccggtgcacgaccactggtggcagaccgagaccggctggccggtcaccgcgccttgcgtcgggctggagggcagtgcggcgaagccaggatcgagcaaccgggcggtgccgggttacaacgttcgcgtactggatgacgaaggccacttgctcggggccaaccatcagggttcgatcgtgattgccctgccattgccacccggttgcagtcagacgctgtggggggatcacgagcgctacctgcaggcctacctgcgcacgtatccggggtactaccacacgggcgatggcggctatctggacgatgatggtttcgtctacatcatggggcgcaccgatgatgtgatcaacgtttccggtcatcgtttgtccaccggtgaaatggaagacctggtcgcccgccacccggcggtagcggagtgtgctgtgatcggtgtgcatgacgagatcaagggccaggtaccgttggcgctggtggtactcaaggatggcgagggcattgccgaggcgcagttgctggtggagctggtgggcagcgtgcgcgaggaaattggcccgctggcctgtttcaaccgggtacggctggtgaagcgcctgcccaagacccgttccggcaagattctgcgggcggtgctgcgcaagattgccgatgggcaggattatgtgccgccgtcgaccctggatgacccggcagtgctgggggagatcgaagcggtgctggcagatttgcccagggcgggttga

SEQ ID NO: 956 - protein, 629 aa, Pseudomonas putida
MSYQHSYAHSISDPAAFWAEQAAHLAWHRKPALTLQDNADGTHRWFADGRLNSCYLALDHQIEQGRGEQLALIYDSPVTGVQQTYTYNQLRDEVARLAGLLRQLGVNKGDGVIIYMPMVPQAAMAMLACARIGAVHSVVFGGFAANELALRIDDARPTLLLTASCGLEFDRVIAYKPLVDRALQLARHQPRNVLVLQRPQAHAELLPGRDLDWQAALADAEPVAPVELDAGDPLYIMYTSGTTGKPKGIVRENGGNAVALCYAMRHIYGMQAGDVWWGISDVGWVVGHSLIVYGPLMSGCTTVFYEGKPIRTPDASAYWRVVEQYRVNALFCAPTAMRAIRKEDPEGDLIRKHDLSSLRQLFLAGEKLDSSTHEWLERVSGKPVHDHWWQTETGWPVTAPCVGLEGSAAKPGSSNRAVPGYNVRVLDDEGHLLGANHQGSIVIALPLPPGCSQTLWGDHERYLQAYLRTYPGYYHTGDGGYLDDDGFVYIMGRTDDVINVSGHRLSTGEMEDLVARHPAVAECAVIGVHDEIKGQVPLALVVLKDGEGIAEAQLLVELVGSVREEIGPLACFNRVRLVKRLPKTRSGKILRAVLRKIADGQDYVPPSTLDDPAVLGEIEAVLADLPRAG

SEQ ID NO: 957 - DNA, 1686 bp, Pseudomonas putida
  CDS (1)..(1686)
atgcttcaactccaaaaacaagaaaccaggagtccgatgatgcgcgattacgccgaggccgctcgtacgttcgaccatgaccaggccgttgtgacggcattgcacggcaaccttgaagcccttaatgcctgtgtcgaatgctgtgaccggcatgccggtgacggcaagctggcactgattcatgaggaccgcgatggtaacagcgcgtgctatagcttcgatcagcttcaggtgcaggctgctcggttcgccaatgtgttaaaggcgcagggggtaggcgccggagaccgggttgccggcttgatgccgcgtacccctgaactgctggtgaccatcctcgctacctggcgcctcggggcggtttaccagcccttgttcaccgcgttcggccccaaggccatcgagcaccggcttgagcaatcccatgcccgagtggtggtcaccgatagccacaaccgcgccaagctggacgatgtgcacgcctgcccgaccatcatcactgtcaaggcccgcagtggtgagctggacttccagcaatgcctggaacgcgcagcggacgtatgtgagccggtgatgcgctcaggcaacgatccattcctgctgatgttcacttccggaaccactggcccggcaaaacccctggaagtgccactgcgtgcgatcgtcgcgtttcagggctacatgcgtgatgccatcgagctgctgcccgaggacaacttctggaacctggccgacccgggttgggcttacggcttgtattacgccgttaccggtccgttgtcgctggggcacgccaccacgttctacgatggcccgttcagtgtcgagagctgcgcccgggtgatcgacaagctgggtatcaccaacctggccggctcgcccaccgcgtatcgcttgctgattgcggcgggcaaagatttctcggcaccgatcaagggccgcctgcgggtggtcagcagtgccggcgaaccgctgaaccccgaagtgatccgctggttcgccgacgagctgggcgtgaccattcacgatcactacggccagaccgaactgggcatggtgctgtgcaaccaccatggcctgcagcatccggtgcacctgggttctgccggctatgccatccccggccaccgcatcgtggtggtggacgagcaaggtaacgaactgccagccggccagccaggcatcctcgccgttgaccgtgagcagtcgccgctgtgctggttcggcggttaccacggcctgccgaccaaagccttcgtcggcaagtactacctcagcggcgacactgtcgagctgaacccggatggcagcatcagcttcgttggccgtagcgacgacgtgatcaccacctccggttaccgtgtggggccattcgatgtggaaagcgcgttgatcgagcacccggcggtgatcgaggcagcggtgatcggcaagcccgacccggagcgtaccgagctgatcaaggcgttcgtggtattggccagcggctacgccggcagcgtcgagctggaagaaaccttgcgccagcatgtgcgccagcgcctctacgcgcatgcctaccccagggaaatcgaattcgtcagcgagctgcccaagaccccgagcggcaagctgcaacgcttcatcctgcgcaaccaggaagtcgccaaacaacaagcgcaacaggccacccctgccagcgtctga

SEQ ID NO: 958 - protein, 561 aa, Pseudomonas putida
MLQLQKQETRSPMMRDYAEAARTFDHDQAVVTALHGNLEALNACVECCDRHAGDGKLALIHEDRDGNSACYSFDQLQVQAARFANVLKAQGVGAGDRVAGLMPRTPELLVTILATWRLGAVYQPLFTAFGPKAIEHRLEQSHARVVVTDSHNRAKLDDVHACPTIITVKARSGELDFQQCLERAADVCEPVMRSGNDPFLLMFTSGTTGPAKPLEVPLRAIVAFQGYMRDAIELLPEDNFWNLADPGWAYGLYYAVTGPLSLGHATTFYDGPFSVESCARVIDKLGITNLAGSPTAYRLLIAAGKDFSAPIKGRLRVVSSAGEPLNPEVIRWFADELGVTIHDHYGQTELGMVLCNHHGLQHPVHLGSAGYAIPGHRIVVVDEQGNELPAGQPGILAVDREQSPLCWFGGYHGLPTKAFVGKYYLSGDTVELNPDGSISFVGRSDDVITTSGYRVGPFDVESALIEHPAVIEAAVIGKPDPERTELIKAFVVLASGYAGSVELEETLRQHVRQRLYAHAYPREIEFVSELPKTPSGKLQRFILRNQEVAKQQAQQATPASV

SEQ ID NO: 959 - DNA, 1689 bp, Bradyrhizobium japonicum
  CDS (1)..(1689)
atggccgggactttgatcgcgaagacgcgcttcgcgctttcgcccggccatgacgccaagaccgtggaaacgcgagccatgctcaccgaagccaagacctacgacgagctctatcgcaacttccgctgggatatcccggcgcgcttcaacatggcggaggcgtgctgcgaccgccatgccgacggtaccggccgtctcgcgctgatctatgtcgacgagaacggcgccaccacgcgcacctccttcgacgaggtcgcggagatgtcgcgccgcttcgccaacgtgctgaaggcggatggccttgcgcgcggcgaccgcgtcgcggtgttcctgtcgcagtcgctggagctgcctatcgcgcatatggcggcgttccgctccgggctgatctcgatccctctgttcgcgctgttcggcgaggacgcgctggaatttcgcctgtcgaattcgcaagcaagagccatcatcactgatgaggcgggctgggagaagctcacgagggtccgcgatcggctgccctatttgcaggacatctatgtcacgagcggcgccgtccacgccggcgcaaaaccgttctggccggcgatcgaaaccgcgtccgaggattttgcgaccgtcgacacctcggccgacgatcctgcgctgatcatctacacctcgggcacaacgggcaatccgaagggagcgctgcatgcgcatcgcgtcgtgctcggccatctgccgaacgtcgagatgtgccacaacttcctgccgcgccccggcgatctgatgtggacgccggcggactgggcctggatcggcggcctcgtcaacggcctgctcgcgttctggtatcacggcattcccctggtcggtcaccgcgcccgaaaattcgagccgcaggcggcgatgcagatgatggccgatctttccgtccgcaacgtcttcctgccgccgacggcgctgaagctgatgcggcaggccggcgtgaagcatcccggcgtcaagctgcgcagcattttcaccggcggcgaatcgctcggcggcgaactcttgggctgggtgcgcgagaccttcggcatcgacgcgcacgaagtattcggccagaccgagtgcaatctcgtgatcggcagcaactccaacctgtttccgatccggcccggcgcgatgggcaaggcgacgccgggcttcgacgtccgcatcgtcaacgacaagggcgaggagcagccgcgcgggcagcgcggcatcatcggcgtgcgccagccgtgccccgtcaccatgctcgaatactggcgcaatccggaggcgacgcgtaagaaatatgccggcgacttcctgctcaccggcgatctcggcgtgcaggacgaggacggctatttctggtatgtcagccgcgaggacgacgtcatcaccaccgccggctatcgcgtcggcccatccgagatcgagcacacgctgatgaagcatccgtcggtggcgatggccgcggtggtcggtattcccgatccgatccgcacggagtcgatcaaggcctggatcgtgctgcgtccgggctttaccggcagcgacgcgctcgcgcgcgagatccaggagttcgtgaaggtgcagctcgccgcgcacgaatatccgcgcttcgtggagttcgccgagacgctgccgatgacggcgaccggcaaggtgctgcggcgcgaactgcgggcgaagggttag

SEQ ID NO: 960 - protein, 562 aa, Bradyrhizobium japonicum
MAGTLIAKTRFALSPGHDAKTVETRAMLTEAKTYDELYRNFRWDIPARFNMAEACCDRHADGTGRLALIYVDENGATTRTSFDEVAEMSRRFANVLKADGLARGDRVAVFLSQSLELPIAHMAAFRSGLISIPLFALFGEDALEFRLSNSQARAIITDEAGWEKLTRVRDRLPYLQDIYVTSGAVHAGAKPFWPAIETASEDFATVDTSADDPALIIYTSGTTGNPKGALHAHRVVLGHLPNVEMCHNFLPRPGDLMWTPADWAWIGGLVNGLLAFWYHGIPLVGHRARKFEPQAAMQMMADLSVRNVFLPPTALKLMRQAGVKHPGVKLRSIFTGGESLGGELLGWVRETFGIDAHEVFGQTECNLVIGSNSNLFPIRPGAMGKATPGFDVRIVNDKGEEQPRGQRGIIGVRQPCPVTMLEYWRNPEATRKKYAGDFLLTGDLGVQDEDGYFWYVSREDDVITTAGYRVGPSEIEHTLMKHPSVAMAAVVGIPDPIRTESIKAWIVLRPGFTGSDALAREIQEFVKVQLAAHEYPRFVEFAETLPMTATGKVLRRELRAKG

SEQ ID NO: 961 - DNA, 2049 bp, Bradyrhizobium japonicum
  CDS (1)..(2049)
atgaccgcacctttcgttccccagatcgccctctatcgcaactggctcgccgagcagcgcggcctcaccttcggcagctacgaagacatgcggcaatggtcggtgcgcgatctcgacggcttctggcgcagcatctgggactattatgatctgcaatcgccgacgccgttcgcggccgtgatcaccgagcgcaagatgcccggcgcggtctggtttccaggcgcgcaggtgaactatgcgcgtcaggtattccggcatgtcgaagcggccgacgccgccggcctgcccgcgatcgtcagcggcggcgaggacggcaggctgagggaaacgagctggccggagctgcggcgcaaggcggccgcgctcgcgctgcatctgaaggataacggtatcaagcccggcgaccgcgtcgcggcctacctgcccaacattcccgagaccatcatcgcgttcctcgcgaccgccagcatcggcgcggtctggagcgtctgcgcacccgacatggccgcgcccgccgtgatcgaccgcttcaagcagatcgaacccaaagtgctgatcgcctgcgacgccgtcacctatgccggccggcggcacgaccggcgcgacgtcgtcgccgaactgcggcgatcgctgcccacggtcgcgcatgtcatcctgcacagcgaggccggtgcgcctgccgcgccggatgccctgctctccgatattgtcgccaggacaagcgccgcgattgacacgttcgagccggcctggctgccgttcgatcatccgctctggatcgtctattccagcggcaccaccggcctgcccaagccgatcgtgcacggccatggcggcatcgtcatcgtggtgctcgcgctgctcggcctgcacaacgacatcggctgctcctatcaccaaaattctttcggcgagcgctatcactggtactcttcgaccggctggatcatgtggaattcgcaagtcggcggcctgctcggcggcgccacctgctgcatcttcgacggcagccccggcggcgccaaggacaagccggactggaccacgctgtggcgcttcgtggcgcaatcgaaagcgaccttcttcggcgcgggcgcggcgttcttcgccaactgcgccaaggccgaaatcgatcttgccgccgcgggcgatctgtcgcggctgcgctgcctcggctcgaccggatcgccgctcagcgccgacacgcaagcctggttcaacgaccgcttcgccgcactgtcgaagaccaatggcagcaaggcgcaggccgacatctggtgggcgaacatttccggcggcaccgatttcgccggtgccttcatcggcggcaaccgcgaattgccacaaacgcccggcgcgatgcagtgtcgcctgctcggcgccgccgtcgaagccttcagcgaacagggccgcgccgtcacggacgaggtcggcgagctcgtctgcaccgagccgatgccgtcgatgccgctctacttctggaacgacaaggacggcgtgcgttaccgctccagctatttcgagacctatccggacaatttcgacggcagcggccgcggccccgtgtggcggcacggcgactggctcaaggtcaacccggacggctcctgcatcatctacggccgcagcgatgccaccatcaaccggcacggcctgcgcatgggcacgagcgaactctattccgcgatcgaagccttgccggaggtgctggactccctcgtcgtcgacctcgaatatctcggccgcgacagctacatgccgctgttcgtggtgcttcgcgaaggcgtcgcgctcgacgccgcgatgcaggagaagatcaacaaggcgatcgaggccggtctctcccggcgcttcctgccgaacgaaatcttcgccgtcgccgagatcccgcgcacgctgtcgggcaagaagcaggagctgccgatcaagaagctgctgctcggccagcccgtcgagaaggtcatcaacaaggaggcgatggccaatcccggctgcctcgactggtatctcgccttcgcgcgcgactacctggcgcgaagcgctgcgtag

SEQ ID NO: 962 - protein, 682 aa, Bradyrhizobium japonicum
MTAPFVPQIALYRNWLAEQRGLTFGSYEDMRQWSVRDLDGFWRSIWDYYDLQSPTPFAAVITERKMPGAVWFPGAQVNYARQVFRHVEAADAAGLPAIVSGGEDGRLRETSWPELRRKAAALALHLKDNGIKPGDRVAAYLPNIPETIIAFLATASIGAVWSVCAPDMAAPAVIDRFKQIEPKVLIACDAVTYAGRRHDRRDVVAELRRSLPTVAHVILHSEAGAPAAPDALLSDIVARTSAAIDTFEPAWLPFDHPLWIVYSSGTTGLPKPIVHGHGGIVIVVLALLGLHNDIGCSYHQNSFGERYHWYSSTGWIMWNSQVGGLLGGATCCIFDGSPGGAKDKPDWTTLWRFVAQSKATFFGAGAAFFANCAKAEIDLAAAGDLSRLRCLGSTGSPLSADTQAWFNDRFAALSKTNGSKAQADIWWANISGGTDFAGAFIGGNRELPQTPGAMQCRLLGAAVEAFSEQGRAVTDEVGELVCTEPMPSMPLYFWNDKDGVRYRSSYFETYPDNFDGSGRGPVWRHGDWLKVNPDGSCIIYGRSDATINRHGLRMGTSELYSAIEALPEVLDSLVVDLEYLGRDSYMPLFVVLREGVALDAAMQEKINKAIEAGLSRRFLPNEIFAVAEIPRTLSGKKQELPIKKLLLGQPVEKVINKEAMANPGCLDWYLAFARDYLARSAA

SEQ ID NO: 963 - DNA, 1911 bp, Bradyrhizobium japonicum
  CDS (1)..(1911)
atgaacatccagggcaagagcagctatcacgaggtccatgcacgctcgctggctgatccccagggcttctgggccgaggcggccagggaaatcgactggatcgagccgcccaagacgatcttcgacgcgtcgcaaggaacctacggccgctggttcaccggcggcgtggtcaacacctgctataacgcgctcgaccgccatgtcgaacgcggccgcgccgaccaggtcgcgctgatccatgattcgccgctgacgaactcgatcaccaagctcacctatgccgagctgctgaacgaggtgcaggcgctcggcgccgtcatgcaggatttcggcgtcgccaagggcgatcgcgtcatcctttacatgccgatggtgccggaggcggtggtcgcgatgctcgcctgcgcgcgcatcggcgcggtgcattcggtcgtgttcggcggctttgccgcgaaggagcttgccacccgcatcgacgatgcacagccgaagctgatcctgtcggcgagctgcggcatcgagcccggccgcatcgtgcagtacaagccgctgctcgacgaggcgatcaggcttgccggcagcaagccgaaggcctgcatcgtgctgcaacgtccgcagctcacctgtgacctggcgccgggccgcgattacgattgggcgagcctgcgccgcaaggcgatgaacgacggcaagaaggcgccttgcgtgccggtcgccgccaccgatccgctctacatcctctacacctcgggcaccacgggcattcccaagggcgtggtgcgcgacaatggcggccatctggtcgcggtgaaatggtcgatgttcaacctctatggcgtcaagccgggcgaggtctggtggtgcggctccgacatcggctgggtggttggccacagctacatcgtctacggcccgctgctgcacggcgcgacctcgatcatgtatgagggcaagccggtcggcacgcccgatgccggcgcattctggcgcgtcatctccgagcacaaggcggtggcgctgttcaccgcgccgaccgcgttccgcgcgattcggaaagaggatccggaaggaaagttcatccggcaatacgacctgtcgacattccgcacgctgttcctcgccggcgagcgcgccgatccgcccacggtggaatgggcggagcagcagctgaaggtgcctgtgatcgaccattggtggcagaccgagaccggttggtgcatcgccggtaatccggtcggcctcggcatgctgccggtgaagcacggctcgccgacggtgccgatgccgggctaccaggtcgacgtggtcgatgaagcggccaagcctgtcggtcccaacaccatgggctcgatcgtcatcaagctgccgatgccgccgggctgcctgccgacgctgtggaagcaggacgagcgcttcaaggaggcttacctcagcgaattccccggctattacaagacctcggacgccggctacaaggatgaggacggctatgtctgggtgatgggccgtaccgacgacatcatcaacgtcgccggacatcgcctgtccaccggcggcatggaggagatcctggcctcgcatcccgatgtcgccgaatgcgccgtgctcggcgtcaaggacgcgatcaagggcgaggtgccctgcggcttcctggtgctcaaggccggcgtgcagcgcgcacccgccgagatcgagaaggaaatcattgcgctggtgcgcgacaagctcgggcccgtcgccgccttcaagctcgccatcaccgtcggccgcctgcccaagacgcgctccggcaagattttgcgcggcaccatcaagaagattgccgacggcgaatcctggaccatgcccgcgacgatcgaggaccccaaggtgctggacgagatcggggcggcactgaaggggcgggtgtga

SEQ ID NO: 964 - protein, 636 aa, Bradyrhizobium japonicum
MNIQGKSSYHEVHARSLADPQGFWAEAAREIDWIEPPKTIFDASQGTYGRWFTGGVVNTCYNALDRHVERGRADQVALIHDSPLTNSITKLTYAELLNEVQALGAVMQDFGVAKGDRVILYMPMVPEAVVAMLACARIGAVHSVVFGGFAAKELATRIDDAQPKLILSASCGIEPGRIVQYKPLLDEAIRLAGSKPKACIVLQRPQLTCDLAPGRDYDWASLRRKAMNDGKKAPCVPVAATDPLYILYTSGTTGIPKGVVRDNGGHLVAVKWSMFNLYGVKPGEVWWCGSDIGWVVGHSYIVYGPLLHGATSIMYEGKPVGTPDAGAFWRVISEHKAVALFTAPTAFRAIRKEDPEGKFIRQYDLSTFRTLFLAGERADPPTVEWAEQQLKVPVIDHWWQTETGWCIAGNPVGLGMLPVKHGSPTVPMPGYQVDVVDEAAKPVGPNTMGSIVIKLPMPPGCLPTLWKQDERFKEAYLSEFPGYYKTSDAGYKDEDGYVWVMGRTDDIINVAGHRLSTGGMEEILASHPDVAECAVLGVKDAIKGEVPCGFLVLKAGVQRAPAEIEKEIIALVRDKLGPVAAFKLAITVGRLPKTRSGKILRGTIKKIADGESWTMPATIEDPKVLDEIGAALKGRV

SEQ ID NO: 965 - DNA, 1656 bp, Bacteroides thetaiotaomicron
  CDS (1)..(1656)
atggtagaaagatttttagcacagactagctttgcctcacaagaggatttcatcaagaacctgaaaataaacgtaccggagaatttcaacttcggctacgacgtagtagatgcctgggctgccgaacaacccgacaagaacgctctgctctggaccaatgaccaaggcgaaagccgtcagttctccttcgccgacatgaaacgctatacggacatgacggcctcttacttccagagcctcggcatcggtcgcggagacatggtgatgctgattctgaagcgccgctatgagttctggtacagcaccatcgccctgcataagctgggagcaacggtgatccccgccactcacctgctgacaaagaaagatatcatctatcgctgcaacgctgccgacatcaaaatgattgtggctgccggcgaaggaatcatactgcaacacatcaaagatgctcttcccgagtgtccgagcgtggaaaagctggtcagtgtaggtccggaagttccggaaggattcgaagatttccatcagggaatcgataacgctgcccctttcatccgcccgagacatgccaatacgaatgacgacatctcactgatgtacttcacttccggcactaccggcgaacctaaaatggtagcacatgactttacgtatccgttaggccatatcgttacgggtagtttctggcacaatctggatgagaacagcctccacctcaccatcgccgataccggctggggaaaagccgtatggggaaaactctacggacaatggatcgccggagccaacattttcgtctatgaccacgaaaagttcacgcccgcagctattctggaaaagatacaggagtatcaggtgacttccctttgcgcacctccaaccatcttccgctttctgattcatgaagacctgactaaatatgacttgtcttcactgcggtattgcaccattgccggagaagcactgaaccctgccgtattcgaaaccttcaagaaactgacaggcatcaagctgatggaaggtttcggacagacggaaacgacactgacagttgccaccatgccttggatggaaccgaaaccgggaagcatgggactgcccaatccgcagtatgacgtagacctgatcgacagtgaaggtcgctccgtggaagccggagagcaaggacaaattgtgatccgtaccagcaaaggcaaacctctcggacttttcaaagagtactatcgggatgcggaacgtacacacgaggcttggcacgacggcatttactacacaggtgatgtagcgtggaaagacgaagacggatacctttggtttgtaggacgtgcagacgacgtaatcaagagttccggttaccgtatcggcccgttcgaagtggaaagcgctttgatgacgcaccctgccgtcatagaatgtgccatcaccggagtacccgatgagattcgcggacaggtagttaaagctactatcgtattgtccaaagactataaagcacgtgccggagaagaactgatcaaggaattgcagaaccacgtcaagaaggtgactgctccttataaatatccgcgtgtgattgagttcgttgacgaactgcccaagactatcagcggcaagattcgtcgcgtggaaattcgcgagaacgatgagaaataa

SEQ ID NO: 966 - protein, 551 aa, Bacteroides thetaiotaomicron
MVERFLAQTSFASQEDFIKNLKINVPENFNFGYDVVDAWAAEQPDKNALLWTNDQGESRQFSFADMKRYTDMTASYFQSLGIGRGDMVMLILKRRYEFWYSTIALHKLGATVIPATHLLTKKDIIYRCNAADIKMIVAAGEGIILQHIKDALPECPSVEKLVSVGPEVPEGFEDFHQGIDNAAPFIRPRHANTNDDISLMYFTSGTTGEPKMVAHDFTYPLGHIVTGSFWHNLDENSLHLTIADTGWGKAVWGKLYGQWIAGANIFVYDHEKFTPAAILEKIQEYQVTSLCAPPTIFRFLIHEDLTKYDLSSLRYCTIAGEALNPAVFETFKKLTGIKLMEGFGQTETTLTVATMPWMEPKPGSMGLPNPQYDVDLIDSEGRSVEAGEQGQIVIRTSKGKPLGLFKEYYRDAERTHEAWHDGIYYTGDVAWKDEDGYLWFVGRADDVIKSSGYRIGPFEVESALMTHPAVIECAITGVPDEIRGQVVKATIVLSKDYKARAGEELIKELQNHVKKVTAPYKYPRVIEFVDELPKTISGKIRRVEIRENDEK

SEQ ID NO: 967 - DNA, 2495 bp, Mus musculus
  CDS (87)..(1580)
gctcctgcaggctccccctcggggctagtgccacagctgttgggactgcaaactgctccgactgcagctagggacagagagaaagtatgaagccatcctggttgcaatgtcgcaaagtaacaggcgccgggacgcttggggcacctctgccaggatccccttcagtaagaggagccgctgtgacccgaagggctttggtggccgggtttgggggcaggggctgcagggctctgaccaccggcagtggtggtgagtacaagacccacttcgcagcctctgtggctgaccccgaaagattctggggtaaagctgctgagcagatcagttggtacaagccctggaccaaaactctagagagcagatacccgccttccacaagttggtttgtggaagggatgctgaacatttgttacaatgctattgatcggcacattgaaaatggccaaggggataagattgctatcatctatgacagtcccgttacagacaccaaagcaactatctcctataaggaagtcttggagcaggtctctaagctggctggtgtcttggtcaagcagggtgtcaagaaaggcgatacagtggtcatctatatgcccatgatcccacaagcaatatataccatgctggcgtgtgcaaggataggagcaatccacagtctcatatttggaggatttgcatccaaagaattaagtacgcgcattgatcatgcgaagcctaaggtggttgttacggcatcatttggcattgaaccaggaaggaaggtggagtacatcccacttctagaagaagctctgaggataggacagcacaggccagacagagttctcatttacagccgtccaaacatggagaaagttcctttgatgtcaggtcgtgatcttgattgggaagaagaaatggcaaaagcccagtctcatgactgcgtgcctgttctctcagagcatccattgtacattctctacacatctggaacaactgggctgcctaagggtgtggttagacccactgggggctatgctgtcatgttgaactggacaatgtcttccatatatggactcaaacctggagaggtatggtgggcagcttctgacttaggctgggttgttggacattcctatatttgctatgggcctcttctccatggaaacacaacagttttatatgagggaaagcctgtgggaacaccggatgctggcgcttatttccgtgtgcttgcagagcatggagtggctgccttgtttacagcaccaactgcaattagagccatccgtcaacaggaccctggggcagccttggggaagcagtactctctgacaaggttcaagacactgtttgtagctggggaaagatgtgatgtggagaccctagaatggtccaaaaaagtcttccgagttcccgttctagaccattggtggcaaacagagactggatcccccatcacagcatcatgtattggattaggtaactccaaaacacctccaccaggacaagcaggaaaatgtgttccaggaaacaatggacgatacctgcttcatcattctgcagagtctctgactcctcctgctatgggaaaatgagcccatatctgatgaatccctcaactgaacagtggttgtcctcactctttgatcagaaaacttgctttgtgttaagatacttttagtggttgccaattgtgggagatgctaaacacattttcccctagtatatgtgttccattcttatactcagtagtaagaaagagttaagctttgatgcctcctggaacattaatacagaaaattttcatttcaaaaaccactggctaccagaggagggattaaactactctagttgaagcatcagggactttgtgactgatacacttttagtttgtttaatggatatacataactttgaaagtataatataatacacagcacgatagtaaaagaaagctactttgagaaaggaaaggaaacctttctttgtgaaagaatccatgtggtattatatttaattttatacccattctctagatacccctacaatgagaagacattgcttttgttttataaagaggaaaccagaagggtataaaacaacatggcctggggcatgtagtaattaggatgttgtctttcatttgatgaaacaaagatgaatttggactggttttctcttataatgaactcataatcagcaaaacacggatatttataacttaaataactgtcataatgttttcccatagtgccctctagaaacacaagggaaagtgattaatttaatatcggttcagtgccttcccaaagttgtttaagaataatctaaatgaaaagaacaatatacaagacttcagaatctagataattgctgttcatttttacatgtgatgtgatgaattctggacaccagatactttatcaaacattttccatattctatcaggcatcatgaaaaatattggaatgatatatttggaaaaaataaaatgacccagtttacatatc

SEQ ID NO: 968 - protein, 497 aa, Mus musculus
MKPSWLQCRKVTGAGTLGAPLPGSPSVRGAAVTRRALVAGFGGRGCRALTTGSGGEYKTHFAASVADPERFWGKAAEQISWYKPWTKTLESRYPPSTSWFVEGMLNICYNAIDRHIENGQGDKIAIIYDSPVTDTKATISYKEVLEQVSKLAGVLVKQGVKKGDTVVIYMPMIPQAIYTMLACARIGAIHSLIFGGFASKELSTRIDHAKPKVVVTASFGIEPGRKVEYIPLLEEALRIGQHRPDRVLIYSRPNMEKVPLMSGRDLDWEEEMAKAQSHDCVPVLSEHPLYILYTSGTTGLPKGVVRPTGGYAVMLNWTMSSIYGLKPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKKVFRVPVLDHWWQTETGSPITASCIGLGNSKTPPPGQAGKCVPGNNGRYLLHHSAESLTPPAMGK

SEQ ID NO: 969 - DNA, 1881 bp, Vibrio vulnificus
  CDS (1)..(1881)
atgtctgcttatcagaaagaatatcaatgggcgaagcagcaaccggaaagcttttggcaagcccaagcaaagaacatcgattggtttgagttccctaaaaccattcttgccaatgatcccaatggcattgagcgttggtaccccgatggactgctcaatacttcatggttggcactcgattaccactgtgaacaaggtcgaggtgataaagcggcgctgatctatgattcacctgtgaccgaaactaagaaggtctacagctatttcgaaatgcgagatcgcgtggctcgtatcgctggcatgttggctgaccaaggcgtgacgaaaggtgatcgcgtggtgatttacatgccgatgatcccagaagcggcgatggcgatgcttgcctgtgcacgattgggggcgattcactcagtggtgtttggtggctttgccccaaatgagctggcggtgcgcattgaagatgccgagcccaaagtggtgctgacagcgtcttgtggtatcgaaatcaacaaagtcatcgcctataagcctatggtggataaagcgatcatggacagccgctggaaaccggaaaaagtggtggtactgcaacgtcctcagtgtgatgcccagctcaacagcgaacgcgatcttgattggcatcaagcggttgaaaacgcgctaccacatgcttgtgttccggtattggcaacggaccctctgtatatcctctacacctcaggcacgacgggcaagccgaaaggggtggtgcgtgacaacggtggccatgccgtggccatgaagtattcaatgagcgccatttacaatatgccgcaggatggcgtgttttgggccgcctctgacgtgggttgggttgtcgggcactcttatatcgtctatgcccctttaattcatggttgcaccacgatcttgtttgaagggaagccagtgcgcacgccggatccaggcgcattttggcgcgtatgtgaagagtatggagtgaatgttcttttctctgcgccaaccgcgttccgagcgattaaaaaagaagatccgcaaggcgagcatctaaagaactatgacctttccaagcttgatacgatttttatggcgggagaaaggcttgacccgccaaccttggaatgggttcaaagccaaacggccaagcccgtgattgaccactggtggcaaacggaaaccggctgggcgattgcaggcaacatggtgggtattgagctaatgcccgtcaaagcggggtcggccaccatgcctattccgggttatcaagtggacattctcgatgaaatggggttaagagctgggccgatgcagcaaggttttgtcgcattgaaaaggcctttgccgccaagctgcttgccaaccgtgtggcgcaatcatgatcgatttgaatcgggttatctgagccagttcccgggttactatgtttcgggcgatggcggttatctggatgaagagggttatctctttatcatgggtcgcattgatgatgtgattaacgtggctgggcatcgtctctctaccggcgaaatggaagagattgttggcgcgcaccctgccgttgcggaatgtgccgtggttggcgtgcacgatgagctcaaagggcagttgccactagggtttgtggtgctcaaagatggggtgaaaatcgacccaaccgagctggagcaagaactcgtcggcaaagtgcgtaatgaaattggcgccgttgcctgctttaaacaagccttggtggtggagcgtttacctaagacgcgctcaggcaagatcttgcgccgtaccatccgtcaaattgccgatggtgaacaatacgctgtgccatccaccattgacgatccgaccagtcttaatgagttgatcagattatttccagaaaaataa

SEQ ID NO: 970 - protein, 626 aa, Vibrio vulnificus
MSAYQKEYQWAKQQPESFWQAQAKNIDWFEFPKTILANDPNGIERWYPDGLLNTSWLALDYHCEQGRGDKAALIYDSPVTETKKVYSYFEMRDRVARIAGMLADQGVTKGDRVVIYMPMIPEAAMAMLACARLGAIHSVVFGGFAPNELAVRIEDAEPKVVLTASCGIEINKVIAYKPMVDKAIMDSRWKPEKVVVLQRPQCDAQLNSERDLDWHQAVENALPHACVPVLATDPLYILYTSGTTGKPKGVVRDNGGHAVAMKYSMSAIYNMPQDGVFWAASDVGWVVGHSYIVYAPLIHGCTTILFEGKPVRTPDPGAFWRVCEEYGVNVLFSAPTAFRAIKKEDPQGEHLKNYDLSKLDTIFMAGERLDPPTLEWVQSQTAKPVIDHWWQTETGWAIAGNMVGIELMPVKAGSATMPIPGYQVDILDEMGLRAGPMQQGFVALKRPLPPSCLPTVWRNHDRFESGYLSQFPGYYVSGDGGYLDEEGYLFIMGRIDDVINVAGHRLSTGEMEEIVGAHPAVAECAVVGVHDELKGQLPLGFVVLKDGVKIDPTELEQELVGKVRNEIGAVACFKQALVVERLPKTRSGKILRRTIRQIADGEQYAVPSTIDDPTSLNELIRLFPEK

SEQ ID NO: 971 - DNA, 1986 bp, Oceanobacillus iheyensis
  CDS (1)..(1986)
atgaaagtagaagaaggtacattattatgggaaccaagcgaccaacaaattaaacaatcaaatatgtatgcatatcaacaatggctagcaaacaataaacaacttcatttgaacgattatgcttctttgtggaaatggtcagtagacgatattagttctttttgggaaacgatatgggaatactttaatgtaatttctcaccacccttatcaacatgtaatatcaagtacatcaatgcctggttctagatggtttaaagaagcgaaagtcaattatgcagaacatgtatttaagcataaagataattccaaccctgccatcatacatgcttcagaaacaagaggaaagcaagaaatttcctggcaacaactttatcaagatacgactgctcttcaacttacacttaagaatatcggtgtaacaaaaggagaccgagtagttagttatgctcctaatatttatgaaactgtggtcgcttttctagctacttctagtctcggagcaatttggtccagtgcatctcctgactttggtaaacaaagtgttatcgagcgattccagcaaattgaacctaaagttatgattaccatagatggctatcaatatggtggtaaaagctttgatcgaatggcgattattgaagagattcaatcaacaataccttctttagaagctacgattgcgatcccttacttgcatgccgatacagatttttctaatttaaaacaaccaataacatggaaagatgcagtgcacactagtaaacccttagaactaacctttacacctgtcggctttaatgatccactttgggtactctattcatctggtacaacaggaaagccgaaagcaatcgttcatagtcagggtggtatgttactcgagcatctaaaagccactcacttacatctcgatttagatcagaattctcgatttttctggtttactacaaccggatggatgatgtggaattttcttgttggcgggctccttaatggtagctgtattattttatacgatggaagtccatcctacccagatgaacgtttcttatggaagtttgctgaggatacaaaaatgactgtatttggaaccagtgccagtttcataacttcttcgatgaagaaagatatccacccagaagaagaatttgatctttctgctttaaaaaacataagttcgactggatctccgttacctcctgaagggtttcaatggtgttatactcatgtaaaaaaagatatttgggtatcttctgttagtggcggaaccgatgtttgtacggcctttttacttggctctccaactctaccagtatatgcgggtgaattgcagtgtagtggtctaggagcaaaagtggaaagttttgattcaaatggaaattcattagttaatgaaattggcgagttagtactaacaaaaccatttccatgtatgccgatcttcttctggaatgacgatgatggtatgcgaatgtatcatagctattttgacacttatcgcggggtctggtgtcacggtgattatataaaaatcacggaaaaaggcacttctattatctatggtcgttcggacgcaacaatcaatcgcggaggtattcgtattggtacaagtgagatctatcgagcagttgatcaaatcgaagaagtagaagatagtttaatgatagatttacctcaaaccaacggagactcgattactcctttgtttgtagtaatgaaaaatagtaagcctttcacagatgaagtgaaaaactctattaaaaataacttaaaaacgcactgttcaccaagacatgtgcctactcatatgtttgaagtgaaggaattgcctaaaacattaaatggcaaaaagattgaagttcctataaagaaaatattaatgggcgaaagttttgagcaagtaatgaataaaggatcgcttatcaacgaaagtgctattgaatattttattaacttagccagagaatggaattccagcgtctga

SEQ ID NO: 972 - protein, 661 aa, Oceanobacillus iheyensis
MKVEEGTLLWEPSDQQIKQSNMYAYQQWLANNKQLHLNDYASLWKWSVDDISSFWETIWEYFNVISHHPYQHVISSTSMPGSRWFKEAKVNYAEHVFKHKDNSNPAIIHASETRGKQEISWQQLYQDTTALQLTLKNIGVTKGDRVVSYAPNIYETVVAFLATSSLGAIWSSASPDFGKQSVIERFQQIEPKVMITIDGYQYGGKSFDRMAIIEEIQSTIPSLEATIAIPYLHADTDFSNLKQPITWKDAVHTSKPLELTFTPVGFNDPLWVLYSSGTTGKPKAIVHSQGGMLLEHLKATHLHLDLDQNSRFFWFTTTGWMMWNFLVGGLLNGSCIILYDGSPSYPDERFLWKFAEDTKMTVFGTSASFITSSMKKDIHPEEEFDLSALKNISSTGSPLPPEGFQWCYTHVKKDIWVSSVSGGTDVCTAFLLGSPTLPVYAGELQCSGLGAKVESFDSNGNSLVNEIGELVLTKPFPCMPIFFWNDDDGMRMYHSYFDTYRGVWCHGDYIKITEKGTSIIYGRSDATINRGGIRIGTSEIYRAVDQIEEVEDSLMIDLPQTNGDSITPLFVVMKNSKPFTDEVKNSIKNNLKTHCSPRHVPTHMFEVKELPKTLNGKKIEVPIKKILMGESFEQVMNKGSLINESAIEYFINLAREWNSSV

SEQ ID NO: 973 - DNA, 1716 bp, Oceanobacillus iheyensis
  CDS (1)..(1716)
atggatatgcaagtagtacctgcacgtgaaggtaatcataatttaaaggattatgaagcattaagaaaggacttttcatgggaggaagtcaagaaaaatttctcttggtatgaatcagggaaggtgaatatggcatatgaagcagtagataaacatgcagctgatccaactaaaaaagatcaagcagcattattatactcagctcctgaccgtgaagagaaagtaacatttgaacaacttcgattaaagagtaatcaatttgctaatgtattgaaaaaatacgagattgaaaaaggagaccgtgtctttttatttatgccgagaagccctgaattctatgaggcattctttggtattttaaaaatcggcgctattgctggtccattatttgaagcatttatggaacaggcagtaggagatcgtttggacgacagtgaggctcgagtattaattacaacgccagaactactatatcgtgtgccacaagataaactcccgcatttagaaaaaattgtacttgtgggcgatcattcagaacaagatgataaatttattgattatgaagaagaaatgaaaggtgcatccgaagattttgacattgtttgggttgatttagaggatggaatgctattgcattacacatctggttcaacaggaaaaccaaaaggtattcttcatgtgcataatgccatgattcagcattatgctacagctgaatgggtgctagatctaaaagaagatgatgtttactggtgtacagcagatcctggttgggtaactggtacaagttatgggattttcgctccatggctccatggtgtgacgaatgttattcgtggaggccgatttacgccagatgattggtatcaaacattacaagactataaagtaacggtctggtatacagcgccaactgctttgcgtatgcttgtaagtcatggagaagacactgtgaaaaaatatgatctttcttctgtacgacacatccttagtgtcggagaaccattgaatccggaagtaattacatggggactaaaagcttttgatcttcgcattcacgatacatggtggatgactgaaacgggagcacaattgattgtaaacattccatcgcttgagattcgaccaggatccatggggaaaccaattcctggggtagaagcttcaatcgttgataatgagggaaatgagattccgccaaatcaaatggggaaccttgctattaaggaaggttggccatcgatgatgcgggaagtctggaagaataaaagtaaatttgaaagctattttgtaaatggctggtatgtatctggagatagtgcataccgcgatgaagatggatatttctggttccaaggtcgtctggatgatgttatcaatacatctggtgaaagagtgggtccatttgaagtagagagtaaattaattgagcatccagctgtttcagaagcgggtgttattggaaaaccgcatccggaacgcggagaaattataaaagcatttattaccttaaatgcaggctatgaagatagtgaagaattattagaggatattcgtcaatttgtaaaaacagggttaagtgcacatgcagctccacgagaaattgaagtgaaagatagtatcccaaaaacaagaagtggaaaaattatgcgtagacttctaaaatcttgggaacttggcttgccgacaggagatacatctactttagaagattaa

SEQ ID NO: 974 - protein, 571 aa, Oceanobacillus iheyensis
MDMQVVPAREGNHNLKDYEALRKDFSWEEVKKNFSWYESGKVNMAYEAVDKHAADPTKKDQAALLYSAPDREEKVTFEQLRLKSNQFANVLKKYEIEKGDRVFLFMPRSPEFYEAFFGILKIGAIAGPLFEAFMEQAVGDRLDDSEARVLITTPELLYRVPQDKLPHLEKIVLVGDHSEQDDKFIDYEEEMKGASEDFDIVWVDLEDGMLLHYTSGSTGKPKGILHVHNAMIQHYATAEWVLDLKEDDVYWCTADPGWVTGTSYGIFAPWLHGVTNVIRGGRFTPDDWYQTLQDYKVTVWYTAPTALRMLVSHGEDTVKKYDLSSVRHILSVGEPLNPEVITWGLKAFDLRIHDTWWMTETGAQLIVNIPSLEIRPGSMGKPIPGVEASIVDNEGNEIPPNQMGNLAIKEGWPSMMREVWKNKSKFESYFVNGWYVSGDSAYRDEDGYFWFQGRLDDVINTSGERVGPFEVESKLIEHPAVSEAGVIGKPHPERGEIIKAFITLNAGYEDSEELLEDIRQFVKTGLSAHAAPREIEVKDSIPKTRSGKIMRRLLKSWELGLPTGDTSTLED

SEQ ID NO: 975 - DNA, 1887 bp, Escherichia coli O6
  CDS (1)..(1887)
atgtcttttagcgaattttatcagcgttcgattaacgaaccggagaagttctgggccgagcaggcccggcgtattgactggcagacgccctttacgcaaacgctcgaccacagcaacccgccgtttgcccgttggttttgtgaaggccgaaccaacttgtgtcacaacgctatcgaccgctggctggagaaacagccagaggcgctggcattgattgccgtctcttcggaaacagaggaagagcgtacctttaccttccgccagttacatgacgaagtgaatgcggtggcgtcaatgctgcgctcactgggcgtgcagcgtggcgatcgggtgctggtgtatatgccgatgattgccgaagcgcatattaccctgctggcctgcgcgcgcattggtgctattcactcggtggtgtttgggggatttgcttcgcacagcgtggcaacgcgaattgatgacgctaaaccggtgctgattgtctcggctgatgccggggcgcgcggcggtaaaatcattccgtataaaaaattgctcgacgatgcgataagtcaggcacagcatcagccgcgtcacgttttactggtggatcgcgggctggcgaaaatggcgcgcgttagcgggcgggatgtcgatttcgcgtcgttgcgccatcaacacatcggcgcgcgggtgccggtggcatggctggaatccaacgaaacctcctgcattctctacacctccggcacgaccggcaaacctaaaggtgtgcagcgtgatgtcggcggatatgcggtggcgctggcgacctcgatggacaccatttttggcggcaaagcgggcggcgtgttcttttgtgcttcggatatcggctgggtggtagggcattcgtatatcgtttacgcgccgctgctggcggggatggcgactatcgtttacgaaggattgccgacctggccggactgcggcgtgtggtggaaaattgtcgagaaatatcaggttagccgcatgttctcagcgccgaccgccattcgcgtgctgaaaaaattccctaccgctgaaattcgcaaacacgatctttcgtcgctggaagtgctctatctggctggagaaccgctggacgagccgaccgccagttgggtgagcaatacgctggatgtgccggtcatcgacaactactggcagaccgaatccggctggccgattatggcgattgctcgcggtctggatgacagaccgacgcgtctgggaagccccggcgtgccgatgtatggctataacgtgcagttgctcaatgaagtcaccggcgaaccgtgtggcgtcaatgagaaagggatgctggtagtggaggggccattgccgccaggctgtattcaaaccatctggggcgacgacgaccgctttgtgaagacgtactggtcgctgttttcccgtccggtgtacgccacttttgactggggcatccgcgatgctgacggttatcactttattctcgggcgcactgacgatgtgattaacgttgccggacatcggctgggtacgcgtgagattgaagagagtatctccagtcatccgggcgttgccgaagtggcggtggttggggtgaaagatgcgctgaaagggcaggtggcggtggcgtttgtcattccgaaagagagcgacagtctggaagaccgtgaggtggcgcactcgcaagagaaggcgattatggcgctggtggacagccagattggcaactttggccgcccggcgcacgtctggtttgtctcgcaattgccaaaaacgcgatccggaaaaatgctgcgccgcacgatccaggcgatttgcgaaggacgcgatcctggggatctgacgaccattgatgatccggcgtcgttggatcagatccgccaggcgatggaagagtag

SEQ ID NO: 976 - protein, 628 aa, Escherichia coli O6
MSFSEFYQRSINEPEKFWAEQARRIDWQTPFTQTLDHSNPPFARWFCEGRTNLCHNAIDRWLEKQPEALALIAVSSETEEERTFTFRQLHDEVNAVASMLRSLGVQRGDRVLVYMPMIAEAHITLLACARIGAIHSVVFGGFASHSVATRIDDAKPVLIVSADAGARGGKIIPYKKLLDDAISQAQHQPRHVLLVDRGLAKMARVSGRDVDFASLRHQHIGARVPVAWLESNETSCILYTSGTTGKPKGVQRDVGGYAVALATSMDTIFGGKAGGVFFCASDIGWVVGHSYIVYAPLLAGMATIVYEGLPTWPDCGVWWKIVEKYQVSRMFSAPTAIRVLKKFPTAEIRKHDLSSLEVLYLAGEPLDEPTASWVSNTLDVPVIDNYWQTESGWPIMAIARGLDDRPTRLGSPGVPMYGYNVQLLNEVTGEPCGVNEKGMLVVEGPLPPGCIQTIWGDDDRFVKTYWSLFSRPVYATFDWGIRDADGYHFILGRTDDVINVAGHRLGTREIEESISSHPGVAEVAVVGVKDALKGQVAVAFVIPKESDSLEDREVAHSQEKAIMALVDSQIGNFGRPAHVWFVSQLPKTRSGKMLRRTIQAICEGRDPGDLTTIDDPASLDQIRQAMEE

SEQ ID NO: 977 - DNA, 1671 bp, Brucella suis
  CDS (1)..(1671)
atgactgaaagccctgcttcagcacggctcgaccgctacgatgatgccgttgcgcagttcgatattgcaaaagccattgcgcttcttgcaggaaatcctgatacgggtatcaatgcctgcattgaatgctgcgaccgatatacgggcgaaaatcgcgtggcgctgcgcgccatttccatcgacaatacgttgactgaactcacctttgaagacctgcgcgatatgtccgcgcgggtcggcaatatgctggccgatgccgggatcagcgcaggcgatgtggttgccggtcttctcccccgcacgcctgaactcgtcgccaccattctcggcgcctggcgcatcggcgcaatctatcagccgcttttcaccgccttcggcccaaaagccatcgaacagcgtttcggcaccagtggcgccaaactcgtcgtcaccaacctggccaatcgttccaaattggccgaagtggaaaactgcccccgcgtcgcaaccattcttgcccccggtgaaagcctgccggaaggcgatatcgactttcgcgcagccgtggcggcagcatcgaccgaatgcgagcccgtcatgcgcaagggcagcgaccttttcatgatgatgtccacctccggcacggcgggcctgcccaaaggcgtcccggtgccgctgcgcgccctgatggctttcggcgcctatatgcgcgatgccgtgggcctgcgcagcgacgatattttctggaatatcgccgatccgggctgggcatatgggctttactatgccgtgacgggtcccctgcttctgggtgtgccgacgatcctgaacgaaggcggtttcaccgccgaaaacacctatgacatcatcgaacgcctcggcgtgacgagccttgcgggctctccgactgccttccgcctgcttatggccgccgggccggaatctgctgcccgcgtcaagggccgcttgcgcgtggtatccagcgcgggcgagccgctgaacccggaagtcattcgctggttcgatgcctgtcttggcgcgccgatccacgatcattacggccagacggaactgggcatggtggtgaacaaccatcatggattggaacatccggtgcggcagggttcggcgggctatgccatgccgggctacagggttgcggttctggatgaagcgggcaaagaagtcggccccaatgaaccgggcgttctggccattgatatcgacaattcgccgcttctctggttcaccggctattataaaaaggatacgccctccatctccggcggatattatcgcaccggcgatacggtggaattcgagccggatgggtctatcagcttcatcggccgcgccgatgacgtcatcacctcctccggctatcgcatcgggcctttcgatgtggaaagcgcgcttctgaaacatcctgcggtcaacgaggctgcggtggtcggcgttcccgatccgcaacgcaccgaaatcgtgaaggcctttgtcatcctggcccccggcttcgagggtacgccggaactggcggaagaactggcgcttcacgtcaagaaacagctttccgcccatgcctatccgcggcagatcgactttgtggcggagcttcccaagacgctgagcggaaaaatacagcgcttcctcctgcgcaaggcggaagtcgaaaagcaacagcaacagaattag

SEQ ID NO: 978 - protein, 556 aa, Brucella suis
MTESPASARLDRYDDAVAQFDIAKAIALLAGNPDTGINACIECCDRYTGENRVALRAISIDNTLTELTFEDLRDMSARVGNMLADAGISAGDVVAGLLPRTPELVATILGAWRIGAIYQPLFTAFGPKAIEQRFGTSGAKLVVTNLANRSKLAEVENCPRVATILAPGESLPEGDIDFRAAVAAASTECEPVMRKGSDLFMMMSTSGTAGLPKGVPVPLRALMAFGAYMRDAVGLRSDDIFWNIADPGWAYGLYYAVTGPLLLGVPTILNEGGFTAENTYDIIERLGVTSLAGSPTAFRLLMAAGPESAARVKGRLRVVSSAGEPLNPEVIRWFDACLGAPIHDHYGQTELGMVVNNHHGLEHPVRQGSAGYAMPGYRVAVLDEAGKEVGPNEPGVLAIDIDNSPLLWFTGYYKKDTPSISGGYYRTGDTVEFEPDGSISFIGRADDVITSSGYRIGPFDVESALLKHPAVNEAAVVGVPDPQRTEIVKAFVILAPGFEGTPELAEELALHVKKQLSAHAYPRQIDFVAELPKTLSGKIQRFLLRKAEVEKQQQQN

SEQ ID NO: 979 - DNA, 1989 bp, Brucella suis
  CDS (1)..(1989)
atgagcaccgaggcgatctccagacagtcttcgcatgacaatccgctgtggcaaccggatggcgcgcgcattgcggccagcaatctcgaacaattccgcattcgcgccgaacggcataccggcctcagcctgccggattatgccgcgctgcatcgctggtctgtagaggatcgcgccgggttctggcaacttgtatgggatttctgctcggttatcggagagcgtggcaatacggcccttaccgacaggggccatatgcgcgcggcaaaattcttccccgaggcgcggctcaactttgccgaaaacctgttgcgccacaagggcgatggggaggccattgtctttcgcggggagaataaggtcgagcgccgcctgacctggaacgatcttcatgcgctggtctcgaagctacagcaattcatgctttccgagggcgtgcagccgggcgaccgtgtggcgggcatgatgcccaacatgccggaggcggtggcgctgatgctggcggcctcgtccatcggtgcggtctggtcgtcatgctcgccggattttggcgtgcagggcgtgcttgaccgtttcggccagatcgagccgaaactgttcttcgcctgcgatggctactggtataatggcaagcgcatcgcggttgccgacaaggtggctgaagtgacggcaaaactgccgggactgaagcgcgcggtcatcgtcacctatcttggcgaagcggaagccgtcgccgacaaggcggaaaagggcattgcactttatgcggcgctggagccattcaaggccaagcccgtggaattcacgcagcttcccttcgatcatccgctttatatcctgttttcgtcgggcacgaccggcattccgaaatgcatcgtgcatcgggctggcggcgtgctgctgcaacacctgaaggaacatcgccttcatgccgacctgcgcgatggcgaccgcttcttctatttcaccacctgcggctggatgatgtggaactggctggcttctggcatcgcctccggcgccacgcttatgctctatgacggctcgcccttctatccggacggcaatgtgctgttcgattatgccgctgctgagggcatgacctatttcggcacgtcggcaaaattcatcgatgccgtgctgaaagcgggattgaagcccggagaaacgcacgacctttcggctctgcgcaccatttcctccaccggctcgccgctgtcgccggaaggctttgccttcgtctatgatgcgatcaagaaggatgtgcatctcgcctccatttcgggcggaacggacattgtgtcctgcttcgtgctgggcgttccgaccgagcctgtctggcagggcgagatacagggtgccgggctcggcatggctgtcgatgtctggaacgatgacggcaagccggtgcggggcgaaaagggtgaactggtctgcacgaaggcatttccttccatgccgctgcaattctggaacgacgcgcaaggcgaaaaatatcaggccgcctatttcgagcgtttcgacaatatctggtgccatggcgattttgccgaatggaccgaacatggcggcatcgtcatccatggccgctcggacgcgacgctgaaccccggcggcgtgcgcatcggcacggcggagatctacaatcaggtcgagcagatgccggaaattgccgaggcgctctgcatcggacaggattgggacagggatgtgcgggtggtgcttttcgtacggcttgccgaaggggtggtgctggatgacgacctcaaggcgcgcatcaggaccaaaatccgcaccggcgccacaccgcgccatgtaccggcgaaaatcattgccgtccgcgatattccgcgcaccaaatcgggaaagatcgtggaacttgccgtccgcgatatcgtgcatggtcgcgaggtgaagaaccgtgaagcattggccaacccggaagcgctggaattttatcgcgacatagccgagttgcagcaggattga

SEQ ID NO: 980 - protein, 662 aa, Brucella suis
MSTEAISRQSSHDNPLWQPDGARIAASNLEQFRIRAERHTGLSLPDYAALHRWSVEDRAGFWQLVWDFCSVIGERGNTALTDRGHMRAAKFFPEARLNFAENLLRHKGDGEAIVFRGENKVERRLTWNDLHALVSKLQQFMLSEGVQPGDRVAGMMPNMPEAVALMLAASSIGAVWSSCSPDFGVQGVLDRFGQIEPKLFFACDGYWYNGKRIAVADKVAEVTAKLPGLKRAVIVTYLGEAEAVADKAEKGIALYAALEPFKAKPVEFTQLPFDHPLYILFSSGTTGIPKCIVHRAGGVLLQHLKEHRLHADLRDGDRFFYFTTCGWMMWNWLASGIASGATLMLYDGSPFYPDGNVLFDYAAAEGMTYFGTSAKFIDAVLKAGLKPGETHDLSALRTISSTGSPLSPEGFAFVYDAIKKDVHLASISGGTDIVSCFVLGVPTEPVWQGEIQGAGLGMAVDVWNDDGKPVRGEKGELVCTKAFPSMPLQFWNDAQGEKYQAAYFERFDNIWCHGDFAEWTEHGGIVIHGRSDATLNPGGVRIGTAEIYNQVEQMPEIAEALCIGQDWDRDVRVVLFVRLAEGVVLDDDLKARIRTKIRTGATPRHVPAKIIAVRDIPRTKSGKIVELAVRDIVHGREVKNREALANPEALEFYRDIAELQQD

SEQ ID NO: 981 - DNA, 2924 bp, Homo sapiens
  CDS (34)..(2178)
aaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccactccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagggtaaactgaaagagaaatccaagcgtgttcagccccagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacctgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatttcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaag

SEQ ID NO: 982 - protein, 714 aa, Homo sapiens [sequence omitted]

SEQ ID NO: 983 - DNA, 1899 bp, Encephalitozoon cuniculi
  CDS (1)..(1899)
atggacagaagcgagtatgagggattgtacaagagatctattgaggataaagagggtttttggggagagcaagcaaaggtgcttttgaagtgggacaggatgtttgacagggtttacaacaatgactttgagaactcaaggtggttcgaaggaggtatgttgaatgcatgctataattgcgttgatagacatgcggcctgcagcccggacaaagtcgcggttatttatgagggaaacgatggggagtcggtctactacacattcaaagacgtccttgatgaagttataaggatctgtaccatacttaaggacgaaggtcttgagaagggagatacggttgctatgtatatggcaatgtccccgtatgcagtgttttctgcacttgcatgtgctaggcttggtcttgtgcataatgcaatcttcggaggatttagtgcaagcagcgtggctctacggcttaacgactcgaatgccaagcttttaatagtccaggacgtcgttgcaaggcaagactccaccatgaacttccttgagaacacaagggtagcgctcaagggaaaatcaattcctgttctagtcttcgacacatttctggacgagagaaagatcttagattcactggatgggattggaggaaggattctgatatggtcaaaggttttgaagagggagaatgaattcattccctgtgtctcggtcaatgcagaggacagacttttctatctgtacacaagtggaagtacaggaaagccaaaaggaattatccacacggccggtgggtatctggtgtatgcgatgcttacttccaaaatatgctttgatcttcaagaaaacgatgtttttgcctgtacggcagacataggatggatcacagggcatacatatgtcatttacgggccgctgttgaatggaatcacgaccgttgtatttggaggaacgcccttctatccttcgtattacaggctcttcaagatggtcgaaaagtatagaataactcagttgtacactgcgcctacagttataaggatgctgaggaagcatttttccacaacaccccttgatcacaactatgacctgtcttccctgagaattctcggatctgttggagagccgataaataagaatgcccatctgtggtttagtgagaacttcaacggctgtcctgttattgatacatattggcaaactgaatctggtgggattctgattgcgcctattccgcacgccgtagacataaagcctgagtgtgcctgtcttccatttttaggccaagaggttgttattgcggatccgagctctagaagcgactgtgttgtcgaagcgaaggcctatgagttagggcgtgttcttctcaagggttcctggcctgggataaccagagggattctaggaaacccggagagattcagaaagggatattttttctacaagggattctacttcacgggcgacgaaggatataaagattctgatggacatgtgtggatcagaggaagagctgacgacgtgataaatgtctctggacacaggattagcacggcagaggtcgaaggcgcggcatgtacggatccgcatatagctgaggcagcagctgttgcagaaagcgacgatattactgggcaggccctttgcatttttgtggtcttgaaagacaggaaaacatctcatgaaggagtaagagcgtctctgagaacaactctgagaagcaagatcggaaagtttgttaatgcaaaaagaatctacttctgtgaaggtattcccaagactgcaactggaaagatcatgagaagagtcctgaaaagtatcctggccggagatccgcctggagatgtatcgacttgtaccaatgcagacattattgagggcctgagagaaattgctggatcggaagtaaattaa

SEQ ID NO: 984 - protein, 632 aa, Encephalitozoon cuniculi
MDRSEYEGLYKRSIEDKEGFWGEQAKVLLKWDRMFDRVYNNDFENSRWFEGGMLNACYNCVDRHAACSPDKVAVIYEGNDGESVYYTFKDVLDEVIRICTILKDEGLEKGDTVAMYMAMSPYAVFSALACARLGLVHNAIFGGFSASSVALRLNDSNAKLLIVQDVVARQDSTMNFLENTRVALKGKSIPVLVFDTFLDERKILDSLDGIGGRILIWSKVLKRENEFIPCVSVNAEDRLFYLYTSGSTGKPKGIIHTAGGYLVYAMLTSKICFDLQENDVFACTADIGWITGHTYVIYGPLLNGITTVVFGGTPFYPSYYRLFKMVEKYRITQLYTAPTVIRMLRKHFSTTPLDHNYDLSSLRILGSVGEPINKNAHLWFSENFNGCPVIDTYWQTESGGILIAPIPHAVDIKPECACLPFLGQEVVIADPSSRSDCVVEAKAYELGRVLLKGSWPGITRGILGNPERFRKGYFFYKGFYFTGDEGYKDSDGHVWIRGRADDVINVSGHRISTAEVEGAACTDPHIAEAAAVAESDDITGQALCIFVVLKDRKTSHEGVRASLRTTLRSKIGKFVNAKRIYFCEGIPKTATGKIMRRVLKSILAGDPPGDVSTCTNADIIEGLREIAGSEVN

SEQ ID NO: 985 - DNA, 2004 bp, Neurospora crassa
  CDS (1)..(2004)
atgtctggtagcaccgttcctgccggggcagtagtgcccgaggctcacactattgagaccttccagccccctagggagatgcttcagaaccacccaagcaaacctcatcttgccaactttgaggagtaccagaagctgtacaagcagtccatcaccgagcccaacgtgttctgggctgagcgcgcccgcgagcttctgtcgtggagcaaggatttccagacggtccacagcggctccctcgccaacggtgacaacgcctggttcgtagagggcgagctcaacgcctcgtacaactgcgtcgacagacacgcccacaaggaccccaacagagtcgccatcatctacgaggccgacgagcccggtcagggaaggaatgtcacctatggcgagctcctcagggaggtctccaagctcgcccatgtcctcaccaacttgggtgttcgcaagggagacaccgtcgccatctaccttcccatgattcccgaggccatcgttgccatgcttgcttgcaccagaattggcgccatccactccgtcgtttttgccggcttctcctccgactccctccgcgaccgtgtcgtcgatgcccagtccaaggttgtcatcaccaccgatgagggcaagcgcggtggcaagctgattggcaccaagaagatcgtcgacgaggctctccagcagtgccccgatgttcgcaacgtgctcgtctacaagcgcaccggcgccgacatcagcatgacccccggccgtgatctctggtggcacgaggaggttgagaagtaccctgcttactacacccctgtggccatggcctcggaggatcctctcttccttctctacacctctggctccactggcaagcccaagggagttgcccactctaccggtggttacctgctcggtgctgccatgaccggcaagtacgttttcgacatccatgacggcgacaggtatttctgcggtggtgacgtcggctggattaccggtcacacctatgtcctctacgccccgctcttgctcggtgtctctaccgtcgttttcgagggtacccccgcctaccccaacttctcccgctactgggacatcattgaggagcacaaggtcactcagttctacgttgctcccactgccctgcgcctgctgaagcgcgccggtgaccatcacgttcgcaacgagatgaagcacctccgtgttctcggctctgtcggtgagcccatcgccgccgaggtctggaagtggtactatgatgttgtcggcaagggccgcgcccagatttgcgacacctactggcagaccgagactggctccaacgtcatcactccccttgccggcgttacccccaccaagcccggttccgcttctttccccttcttcggtatcgagcccgcgcttgtcgaccccgttaccggcgaggagatccacggcaacgacgttgagggtgtcttggccttcaagcagccctggcccagcatggctcgcaccgtctggggtgcccataagcgctacatggagacctacctccatgtgtacaagggctactacttcacgggcgacggtgctgcccgcgatcacgagggcttctactggatccgcggccgtgtcgacgacgtcgtcaacgttagtggccaccgtctcagcactgccgagattgaggctgctctgattgagcatcactccattgccgaggctgctgttgttggtgttgccgacgagctcactggccaggccgtcaacgccttcgttgccgtcaaggagggtacccagatcaacgatgctctccgcaaggagttcgtcctccaggtccgccgcagcatcgggcccttcgctgctcccaaggccatctacatcgttcctgatcttcccaagactcgctctggcaagatcatgcgccgcattctgaggaagattgttgccggcgaggaagatcagcttggtgatatcactactctcagcgatcccagcgtcgttgccaagatcatcgatgtcgtccacgcgcagcgccagtaa

SEQ ID NO: 986 - protein, 667 aa, Neurospora crassa
MSGSTVPAGAVVPEAHTIETFQPPREMLQNHPSKPHLANFEEYQKLYKQSITEPNVFWAERARELLSWSKDFQTVHSGSLANGDNAWFVEGELNASYNCVDRHAHKDPNRVAIIYEADEPGQGRNVTYGELLREVSKLAHVLTNLGVRKGDTVAIYLPMIPEAIVAMLACTRIGAIHSVVFAGFSSDSLRDRVVDAQSKVVITTDEGKRGGKLIGTKKIVDEALQQCPDVRNVLVYKRTGADISMTPGRDLWWHEEVEKYPAYYTPVAMASEDPLFLLYTSGSTGKPKGVAHSTGGYLLGAAMTGKYVFDIHDGDRYFCGGDVGWITGHTYVLYAPLLLGVSTVVFEGTPAYPNFSRYWDIIEEHKVTQFYVAPTALRLLKRAGDHHVRNEMKHLRVLGSVGEPIAAEVWKWYYDVVGKGRAQICDTYWQTETGSNVITPLAGVTPTKPGSASFPFFGIEPALVDPVTGEEIHGNDVEGVLAFKQPWPSMARTVWGAHKRYMETYLHVYKGYYFTGDGAARDHEGFYWIRGRVDDVVNVSGHRLSTAEIEAALIEHHSIAEAAVVGVADELTGQAVNAFVAVKEGTQINDALRKEFVLQVRRSIGPFAAPKAIYIVPDLPKTRSGKIMRRILRKIVAGEEDQLGDITTLSDPSVVAKIIDVVHAQRQ

SEQ ID NO: 987 - DNA, 1899 bp, Ralstonia solanacearum
  CDS (1)..(1899)
atgcccatgtccgacgcctatcgcgcgctgtaccagcgttccatcgacgatcccgccgccttctggggcgagcaggcgcagcgcatcgactggcagacgccctacgccgccgtgctcgacgatgcgcggctgccgttcgcgcgctggttcgtcggcgggcgcaccaacctgtgccacaacgccgtcgaccgccatctcgccacgcgcggcgagcaggccgcgctggtgtatgtctccaccgagaccggcatcgagacgacctacacgtaccgagcgctgcatcgcgaggtcaaccgcatggcggcgtgcctgcaagcgctgggcgtcaggcgcggcgatcgcgtgctgatctacctcccgatgatcccggaagcggcgttcgccatgctggcctgcgcgcgcatcggcgcgatccattcggtggtgttcggcggcttcgcctccaacagcctcgccacccgcatcgacgacgccactccgcgcgtcatcgtcagcgccgacgccggctcgcgcggcggcaaggtggtcgaatacaagccgctgctcgatgccgccatcgacctcgccgtgcacaagccggcgcacgtcctgctggtcgaccgcaaacttgccccgatgcagcaccggccgcacgacattgactacgccgcgctggcccggcagcacacccacgccgacgtgccgtgcgaatggatggagtcgagcgagccgtcctacatcctctacacctcgggcaccaccggcaagcccaagggcgtgcagcgcgacaccggcggctacgcggtggcgctggccgcgtcgatgccgctgatcttcggcgcgcaggcgggcgacaccatgttcaccgcgtcggacgtcggctgggtggtcggccacagctacatcgtctacgcgccgctgctggcggggcttgccaccgtgatgtacgagggcacgccggtccgccccgacggcgccatctggtggcgcatcgtcgagcaataccgcgtcaacgtgatgttcaccgcgcccacggccatccgcgtgctgaagaagcaggatccggcgctgctgcggcggcatgacctgtccagcctgcggcgcctgttcctggccggcgagccgctcgacgagcccaccgctcgctggatcggcgacgcgctcggcaagcccatcatcgacaactactggcagaccgagaccggctggccgatgctggcgatcccgcagggcgtggcgccctcgacgcccaagctgggctcgcccggcttcccggtctacggataccggctcgacatcctcgacgaggcgacgggccagccctgcgcgccgggcgaaaagggcctgctggccgtcgccgcgccgctgccgccgggctgcatgagcaccgtgtggggcgacgatgcacgcttcctcaagacgtactggtccgccttccccgggcgcccgctctattccagcttcgactggggcgtgcgcgatgaagcgggctacatcaccatcctcggccgcaccgatgacgtgatcaacgtggccggccatcgcctgggcacgcgcgagatcgaagagagcctgtcgtcgcatccggcgatcgccgaggtggcggtggtgggggtggccgacccgctgaaggggcaggtggcgatggggtttgccatcgtgcgcgatgcggcccgcgttgccgagccggctggccgcatggcgctggagggcgaactgatgcgcacggtggaggggcagttgggcgccgtggcgcggccgtcgcgcgtgttcttcgtcaacgcgctgccgaagacgcgctcgggcaagctgctgcgccgggccatgcaggcggtggccgaggggcgcgatcccggcgacctgactaccatcgaggacccgaccgcgcttgcccaggtgcgcgaggcgatgcaggcgtga

SEQ ID NO: 988 - protein, 632 aa, Ralstonia solanacearum
MPMSDAYRALYQRSIDDPAAFWGEQAQRIDWQTPYAAVLDDARLPFARWFVGGRTNLCHNAVDRHLATRGEQAALVYVSTETGIETTYTYRALHREVNRMAACLQALGVRRGDRVLIYLPMIPEAAFAMLACARIGAIHSVVFGGFASNSLATRIDDATPRVIVSADAGSRGGKVVEYKPLLDAAIDLAVHKPAHVLLVDRKLAPMQHRPHDIDYAALARQHTHADVPCEWMESSEPSYILYTSGTTGKPKGVQRDTGGYAVALAASMPLIFGAQAGDTMFTASDVGWVVGHSYIVYAPLLAGLATVMYEGTPVRPDGAIWWRIVEQYRVNVMFTAPTAIRVLKKQDPALLRRHDLSSLRRLFLAGEPLDEPTARWIGDALGKPIIDNYWQTETGWPMLAIPQGVAPSTPKLGSPGFPVYGYRLDILDEATGQPCAPGEKGLLAVAAPLPPGCMSTVWGDDARFLKTYWSAFPGRPLYSSFDWGVRDEAGYITILGRTDDVINVAGHRLGTREIEESLSSHPAIAEVAVVGVADPLKGQVAMGFAIVRDAARVAEPAGRMALEGELMRTVEGQLGAVARPSRVFFVNALPKTRSGKLLRRAMQAVAEGRDPGDLTTIEDPTALAQVREAMQA

SEQ ID NO: 989 - DNA, 1956 bp, Pyrobaculum aerophilum
  CDS (1)..(1956)
atggaaaaactatataataaatatgaagtttacaatagatggctacaagattctgacggctattggcaggagtttatagaaaaaaccgcggggtatatatactgggctaagaaacctgagaaaatctttgagtggaatccgccaaatccgtttaaatggtttgttggaggctataccaacgccgggtatagcgccgttgattacaaattggggaggtttggcgacaaaactgcctatatttatataaacccagaggcaagtgttgagaggcgtattacctacggggagttgtaccaactggtttgtagaataagcgcagccctaagggcattcggcgtcaaaaagggcgatacaattctggtgtatatgcccaatagtattgaggcggttgcagttctcttagccgccgccagaataggcgcagtttccagtacagttttcgccgggttttcgccaaaggctgtggccgatagaatagaactcgtcgagcccaagataatattcactcaagactactcactgcggagggggaggcgaattgcgctgaaagagaatatagacgaggctttgaagctgtcgacttggaggccgcaggcagtggtggtgaaaagggcgttgggggaggagaaagagcctccaatggaaaggggccgcgacatgtggcttgaggagtttttagaaatgggcaaacacggcaactgcaccccggagtttgtggagtcaaatgagccccttttcgtactgccaacctctggcactacagcaaagcccaaaccagtagtacacgtccacggcggctatcaagtctggatagtccacggggctctcctcgtctatggattatctagcgacgacgtgattttcaacactagcgacattggctggatagtcggccagagttatatagtctttgcgcctacgataatggggacgacttcaatattatttgacggcgctattgattatcccaagcccgatcttttctgggaaattattgagaaatacaaaccgacattaatatggacatcccccacggcggctaggatgttaatgagactcggcgttagtcatgccagaagacacgatttgtctagcgtcaaaagagtagtcacagcgggggaggtgttaaacccagaggtgtggaggtggctgtatgaagaggcctttcaaaagaacgtgcccgtgatagaccactggtggcagacagagctaggcggacctgccataggctattactacgcccttgttaaagacatgcccgtgggccttgagtttatggaaataaagccgggctctgcgggagtgccgttgccaggcgtagaagtggaggtggtagacgagaggggcaacgccgtttcggccgggcagaaggggactttagtgttgaagaggcccttccccggcatgacgccgactttatggaaagatcacaagcggtacatggctgagtattgggagcgctacgaggggaagcttgtgtactacaccggcgacgccgcttatatagacgacgaaggctacgtgtggtttggcggcagagctgacgaagtgataaaaatagcgggccatagaataggcactatagaagtggagtcggcgttgttaactcaccccgcggtggcggaggccgcggtagtgggagtccccgatccgataagaggagaggccattgcggcttttgttgtgttaaaacccagttggagacccacggaggagttgagaaaagagttgatagaacatgtgagaaagacctttggccccatagctgtattcgccggcttggagtttgtcaacatgttgcccaagactagatctgggaaaatcatgaggagagtgctcaagcgcctgtggactggagagcctattggcgatatctctactatagaagacgaggcctctgtggaggagatcagagaggcaatatcgcgtttaaaagtggtcaaggtctctgagtaa

SEQ ID NO: 990 - protein, 651 aa, Pyrobaculum aerophilum
MEKLYNKYEVYNRWLQDSDGYWQEFIEKTAGYIYWAKKPEKIFEWNPPNPFKWFVGGYTNAGYSAVDYKLGRFGDKTAYIYINPEASVERRITYGELYQLVCRISAALRAFGVKKGDTILVYMPNSIEAVAVLLAAARIGAVSSTVFAGFSPKAVADRIELVEPKIIFTQDYSLRRGRRIALKENIDEALKLSTWRPQAVVVKRALGEEKEPPMERGRDMWLEEFLEMGKHGNCTPEFVESNEPLFVLPTSGTTAKPKPVVHVHGGYQVWIVHGALLVYGLSSDDVIFNTSDIGWIVGQSYIVFAPTIMGTTSILFDGAIDYPKPDLFWEIIEKYKPTLIWTSPTAARMLMRLGVSHARRHDLSSVKRVVTAGEVLNPEVWRWLYEEAFQKNVPVIDHWWQTELGGPAIGYYYALVKDMPVGLEFMEIKPGSAGVPLPGVEVEVVDERGNAVSAGQKGTLVLKRPFPGMTPTLWKDHKRYMAEYWERYEGKLVYYTGDAAYIDDEGYVWFGGRADEVIKIAGHRIGTIEVESALLTHPAVAEAAVVGVPDPIRGEAIAAFVVLKPSWRPTEELRKELIEHVRKTFGPIAVFAGLEFVNMLPKTRSGKIMRRVLKRLWTGEPIGDISTIEDEASVEEIREAISRLKVVKVSE

SEQ ID NO: 991 - DNA, 1881 bp, Pyrobaculum aerophilum
  CDS (1)..(1881)
atggaattatggcggccagaaaaacaccaccttgaggagtctaatgtggcaaagtacataacctcccacggcatcaaggggcttgacgacttcctctcgctcacttttgacaagcctgaggaattctggcgctccttcgagaaagaggtgttgaagcttggttggtacgaggagtacataaaggtgctggatctatccaagggagtccaatggcctaggtggttcgtcggcggcaagatcaacatagcggatcagctggaggattcctcccgtccccttgtcaaatgggagggggaagacgggtcgaccgccgtctggagctattctgaggtgctctacaaagccaaggcggtcgccagctggctgaagagaaacgggctcgagaagggggatcgcgtggctatcttcatgccgatggtgcccgagataatcccggtcatgctgggggccatcagagctggcggcgtcatagtcccgcttttcagcggcttcggcaaggaggccataagggttaggctcgaggacagcgaggctaagttcgtcttcgcctccgatatctcctacaggagaggcaaggagatcgatatgctctcggagctgagagccggcttgacgccctcagtgaagcgcgtggtggtgcaggaacgctccggacgtagcagcggctatacgccgctctccgaggtcttcaagaccggcggcgaccacgtagagagggcagacgcagaggatcccatcatgattatatatacctcgggcaccacggggaagcctaaaggcaccgtccatacgcacgacggcttccccgtgaaggccgccgccgacgtctacttccacttcgacgtgagcgagggcgagaccttgagctgggtgacagacatggggtggatgatggggccttggatggtcttcgccgcgtatctgctcagaggctccatggccttcttcgagggagctccagactaccccaaggacagactctggcgttttgtggagcgcttcaaggtgaacgccttgggcctggcggcgacgttaacgagatatctccgctccataggcgcagcggcggagcccggccagctggattcgctcaaagccttcggcaacacgggggagcccatagacgtcgagagctggctgtggctataccgcatgggaagggggcgcataccgattataaactactccggcgggaccgagatatcaggggggatattgggttgctacgtggtgaggcccataaagcccagctctttcaacgggcctagcataggcactaaagccgcggtgtttactgaggatgggaggccggccccgcctggcgttgagggagagctcgtggtactctcggtgtggcccggcatgacgagaggcttctggagggatccccaacgctatttagagacttactggaacaagtggcctggagtgtgggcccacggcgacgctgccgtagtggatgaagagggcttcttttacatactggggagggcagacgacaccataaaggtggccggaaagcggctgggacccgccgagattgagactgtcctcaacgcccatcctgccgtggccgagtccgcctgtataggcgtcccccatgagattaagggcgaggtgcccgtatgtttcgtggtgttgaagccgggctatgagcccagtgaggccttaaggcgcgagttgatcaagctgacggaggaggccttaggcaaagccttcggcgcggtggaggatataaggttcgtcaagatgttgccgaagacccgcaacgccaagatcatgaggagggtgataagggcggtgtacttaggccgcaaccccggcgacctatcggcgctcgaaaatccggaggccatagaggagataaaaagagctctgtga

SEQ ID NO: 992 - protein, 626 aa, Pyrobaculum aerophilum
MELWRPEKHHLEESNVAKYITSHGIKGLDDFLSLTFDKPEEFWRSFEKEVLKLGWYEEYIKVLDLSKGVQWPRWFVGGKINIADQLEDSSRPLVKWEGEDGSTAVWSYSEVLYKAKAVASWLKRNGLEKGDRVAIFMPMVPEIIPVMLGAIRAGGVIVPLFSGFGKEAIRVRLEDSEAKFVFASDISYRRGKEIDMLSELRAGLTPSVKRVVVQERSGRSSGYTPLSEVFKTGGDHVERADAEDPIMIIYTSGTTGKPKGTVHTHDGFPVKAAADVYFHFDVSEGETLSWVTDMGWMMGPWMVFAAYLLRGSMAFFEGAPDYPKDRLWRFVERFKVNALGLAATLTRYLRSIGAAAEPGQLDSLKAFGNTGEPIDVESWLWLYRMGRGRIPIINYSGGTEISGGILGCYVVRPIKPSSFNGPSIGTKAAVFTEDGRPAPPGVEGELVVLSVWPGMTRGFWRDPQRYLETYWNKWPGVWAHGDAAVVDEEGFFYILGRADDTIKVAGKRLGPAEIETVLNAHPAVAESACIGVPHEIKGEVPVCFVVLKPGYEPSEALRRELIKLTEEALGKAFGAVEDIRFVKMLPKTRNAKIMRRVIRAVYLGRNPGDLSALENPEAIEEIKRAL

SEQ ID NO: 993 - DNA, 1848 bp, Pyrobaculum aerophilum
  CDS (1)..(1848)
atggattatattgagttctggaggaagtctatcagttatcctgagattttctgggaatctgtagctaaagagctcttctggaagaaaaaatgggaaaagccattagacggctcaaatccgcctttttaccggtggtttgtaggaggcgttacaaatattacgtataatatcctagaacgtcattcaaaagataaaccagctattatatggttcaactccgaattaaagccgcacataattacatatggtgaattatctcaagaggttaataagtgggcgtgtctattgaaaaaagctggcgtacaacaaggcgatagagtaactatatacatgcccatgattccacaggcggcatatgccatgttagctgttgcaaaaataggcgcagtacataacgtcgttttttcaggcttcagcgttagagcattgcatgaaagaatattggactcaggctctaagattatcctaacagtagacgcaatgaggaggaggggaaaggttataaagctagctgaaatcgcattaaaggcggcggatagcgcgagagtagttgtatttaattacctgggcgaaaaaatagacggcgatttcgtacaggcagaaaacctcttagaaaaatgcgaaattgaatacacctgggtcaaatctgacgatccgctttttattctttacacatctggaacaaccggaaagcccaagggaatttatcacgggcacgggagctatatggtgtgggcttatgcgcacactaagtggttttttgggtttgaaaaaggagatattctattctccactgctgatataggttggataaatggacatacttatgggctctatgggccgttattaaacggctccaccgttgtgtggtatgaagatgcgcccgattacccgcacccgggcgtgtggtgggaaattgttgacagaagtaaggcgacgtttatatggctttcccccacggccgtgaggctattaatgagatatggcgaggagtggcccgctaagtattctcttgagagtttaaaaatggtggtgagcgcaggcgaaattttaggaaaagaggcttggaagtggctaaaaagccatgtgtgtaaaaaccggcaggggtgccacgtggtggagacgtggggacagaccgaaaactctggctttattgcagcacctggaggttatggagtcggggggattagatacaaagaagggagtgtaggtcttccatatccaggaattgatgtaagaatatatgacgataatggtcaagagcttccgcctggcgcaaaaggccatgttgttatattaccgcctacaccgccggcgttcgcattgggcatatggggaaatccagcgaggtggattgaggcgtattggtcaaaatttccgggagtgtactatactggcgacgttggcataaaagatgaagagggatacatctatatactcgggcgggcggatgatgtcatcaaaatagctggccatcgattaagccctgctgaggttgaaaatatagttgcaacattccccggcgttgttgaagcggctacggtaggagttcccgatgaaattaagggaactaccttggctatttttgtagtgcctaaagagggggtgagaataaactctcaagaagtagtagaatttcttaagagggagttcggcccagttgccgtagtatctaaagtttatgtagtaaataaactacctaagactaggacaggcaagattatgcgaagagttttgagggctttaattagcggcggtgaaataggtgatatctcgactttagaggacgaggcgtcaatagatgaagtgaaaagggcattagaagaagttaaaattatatcctcttga

SEQ ID NO: 994 - protein, 615 aa, Pyrobaculum aerophilum
MDYIEFWRKSISYPEIFWESVAKELFWKKKWEKPLDGSNPPFYRWFVGGVTNITYNILERHSKDKPAIIWFNSELKPHIITYGELSQEVNKWACLLKKAGVQQGDRVTIYMPMIPQAAYAMLAVAKIGAVHNVVFSGFSVRALHERILDSGSKIILTVDAMRRRGKVIKLAEIALKAADSARVVVFNYLGEKIDGDFVQAENLLEKCEIEYTWVKSDDPLFILYTSGTTGKPKGIYHGHGSYMVWAYAHTKWFFGFEKGDILFSTADIGWINGHTYGLYGPLLNGSTVVWYEDAPDYPHPGVWWEIVDRSKATFIWLSPTAVRLLMRYGEEWPAKYSLESLKMVVSAGEILGKEAWKWLKSHVCKNRQGCHVVETWGQTENSGFIAAPGGYGVGGIRYKEGSVGLPYPGIDVRIYDDNGQELPPGAKGHVVILPPTPPAFALGIWGNPARWIEAYWSKFPGVYYTGDVGIKDEEGYIYILGRADDVIKIAGHRLSPAEVENIVATFPGVVEAATVGVPDEIKGTTLAIFVVPKEGVRINSQEVVEFLKREFGPVAVVSKVYVVNKLPKTRTGKIMRRVLRALISGGEIGDISTLEDEASIDEVKRALEEVKIISS

SEQ ID NO: 995 - DNA, 1908 bp, Rhizobium meliloti
  CDS (1)..(1908)
atggcgagccgctattccgaagtgtatgccgcgtggaaaaccgatccgcacggcttctgggcagatgccgcatcggcgatcgactggttcaagcggccggagcgcattttcgagcctgccggcggcacctatggtcactggtttccggacggcgtcaccaacacctgccacaactgcctggaccggcatgtcgaggccggccgtggcgagcagctggcctttatatacgacagtcccgtcaccggacggatcgagaggatctcctatgcggacctgctcgccgatgtgaaggctatggctgcgatctaccgcaagctgggcgtcgacaagggcgatcgcatcatcatctacatgccgatgatcccgcaggcggcgatcgccatgctcgcggcagcgcggatcggcgcggtgcattccgtcgtcttcggcggctttgccgccaacgaactcgccatgcgcatcgatgattgccaggcgaagatcgtcgtctcggcgagctgcgggctggagcccgggcgaaccgtcgcctacaagcctctgctcgatcaggcgatcgaaacggccagccacaagccggcccgttgcctcatctatcagcgcgacatgctcgccgccgaaatggttagcggccgcgacatcgatttcgccgaagcgcttgcggcggccagagacgccggtgaggaagcctcttgcacgccggtcgcctccaccgatccgctctatgtcctctatacgtccggcacgaccggccagccgaaaggcgtcgtgcgggacaatggcggccacatggtcgcgctcagatggtcgatggagcacttcttcggagtcaatgccggcgacgtgttctgggcggcttccgacatcggctgggtggtcggtcattcctacatcgtctatgggccgctcctcaacggctgcacctcggtcctcttcgaaggaaagccggtcgggacgcccgaccccggaacctattggcgcgtcatttccgaacgcggcgtggccgtcatgttcaccgcgccgacggcgctgcgagcgatccgcaaggaggacccggaagcggcccatgcgggccgttacgacctgtcgcggttccgggcgctttatctcgcgggcgagcgggccgacccggacacgatccgctgggcggaacgggcgctgaaggtcccggtcatcgatcactggtggcagaccgaaacaggatggcccgttgccggcaatccattgggtctcggcctcctgccggtaaaatacggttccccggcggttcccctccccggctatgacgtgcaggtcgtcgacgacgcgggccacccggtggaaaccggcacgctcggcaatgtcgtgatcaagctgccgttgccgcccggctgcctgccgactctgtggaatgccgatcaccgcttccatgcggcctatctcgaggaatatcccggcttctacaagacggcggatgccggctatgtcgacgaggacggctatatcttcatcatggcccggaccgacgacatcatcaacgtcgcgggacaccggctgtcgacgggggccatggaagaggtttgcgccagccatccggacgtcgccgaatgcgccgtgatcggcatcgccgatcccctcaaggggcaggtgccggcgggcttcctggtcatcaacgccaatgtttcccgtgaaacggaagaaatcgagaaggaggttgtcggtctcgtgcgcgagcgcatcgggccggtcgccgccttcaggacggcggtctgcgtcaagcggctgccaaagacgcgatccggcaagattctgcgctcgacgatccagaagatcatcgaccgacagccatggacgatgccggcaacgatcgacgatccggcgatcctggacgagattaccgaactgctgcggtcaaaggggatcggcgtttag

SEQ ID NO: 996 - protein, 635 aa, Rhizobium meliloti
MASRYSEVYAAWKTDPHGFWADAASAIDWFKRPERIFEPAGGTYGHWFPDGVTNTCHNCLDRHVEAGRGEQLAFIYDSPVTGRIERISYADLLADVKAMAAIYRKLGVDKGDRIIIYMPMIPQAAIAMLAAARIGAVHSVVFGGFAANELAMRIDDCQAKIVVSASCGLEPGRTVAYKPLLDQAIETASHKPARCLIYQRDMLAAEMVSGRDIDFAEALAAARDAGEEASCTPVASTDPLYVLYTSGTTGQPKGVVRDNGGHMVALRWSMEHFFGVNAGDVFWAASDIGWVVGHSYIVYGPLLNGCTSVLFEGKPVGTPDPGTYWRVISERGVAVMFTAPTALRAIRKEDPEAAHAGRYDLSRFRALYLAGERADPDTIRWAERALKVPVIDHWWQTETGWPVAGNPLGLGLLPVKYGSPAVPLPGYDVQVVDDAGHPVETGTLGNVVIKLPLPPGCLPTLWNADHRFHAAYLEEYPGFYKTADAGYVDEDGYIFIMARTDDIINVAGHRLSTGAMEEVCASHPDVAECAVIGIADPLKGQVPAGFLVINANVSRETEEIEKEVVGLVRERIGPVAAFRTAVCVKRLPKTRSGKILRSTIQKIIDRQPWTMPATIDDPAILDEITELLRSKGIGV

SEQ ID NO: 997 - DNA, 1647 bp, Rhizobium meliloti
  CDS (1)..(1647)
atgctcccgaagatcgaagactacgacgaactctatcgcgaattccgctggcggatccctgagaggttcaatatcggcgtggccgtgagcgacgcctgggccgcgcgtgatccggagcgcatctgtcttcagcatttcagcccggacggcgcgcatcttgcgctgacctatggcgacttcgccgcgcgttcgtccgcctttgccggcgggcttgccgcgcatgacgtgagccccggcgaacgcgtcgccatcctgctgccgcagggtttcgaggcggcgatcgcccatgcggcgatctataaactcggcgccatcgcgctgccgctggcactgctcttcggcgtcgaggcgcttgcctatcggctgaaggatgcgggcgcggcagcagtcgtcaccaatcgcttcggctatgagcggcttgcggcgatccgcggcgagctgccggaacttcgtatggtcgtcctggccgaggaggacgagaagcccggcacggttcgtttccgcgatatcgcggcagggcagggccgcttcgaccccgcggagacgaagccggacgatccggcgctgatgatctacacctcgggaacgaccggaccgccgaagggggccttgcacgggcaccgcgtgctgctcggccatctgccgggatttcagttccatcatcatttcctgccacagccgggcgaccgcatgtggacgcccgccgactgggcctgggcaggcggtctcctgaacgctctgctgccgtcgcttttcttcggtgtgcccgtggtttcctcgcctgcgcagaaattcgatgcccatacggcgttccggatcatcgaagagatggaggtgcgcaacgccttcatcccgccgacggcgctcaggctcctcaaatccgtcgagcggccgcgcgatcgctgcgcgctcaagctccgcaccgtcggttcggcgggagaggcgctcgggcgggagaccttcgaatgggccagggcggcgctcggcgtcgaggtgagcgaattctacggccagacggaatgcaatatcgtcatctcctctgcgaccggtctcggcgtggcgaaggccggctcgatgggcaaggcggcaccgggtcatcaggtcgcgatcatcgacggcgaggggcgggtgctgccgcccggcacggtcgggcaggtggcgatcaggcgtcccgatccggtgatgttcctcggctattggcgcaacgaagaggcgaccgaggccaagtttatcggcgactggatgaccaccggcgaccagggcgtcatggacgaagagggctatttcacctttttcggccgtgacgacgacgtcatcacgtcgtcaggctatcgcatcggtccgagcgagatcgaggattgtctcgccgggcacccggacgtccagctcgccgcggccgtcggcaaaccggacccgctccggaccgagatcgtcaaggcctatgtcgtgctgaaacccggcgtcgctgccggcgacgagaccgcggcagggatccgcgactgggtgaagaacaggctgtcgatgcatgaatatccgcgcgagatcgctttcgtcgacagcctgcctttgaccacctcgggcaaggtgatccgccggcttctgcgggagaaggcggcggcagaggcgcgcgccgcgtccggcggctga

SEQ ID NO: 998 - protein, 548 aa, Rhizobium meliloti
MLPKIEDYDELYREFRWRIPERFNIGVAVSDAWAARDPERICLQHFSPDGAHLALTYGDFAARSSAFAGGLAAHDVSPGERVAILLPQGFEAAIAHAAIYKLGAIALPLALLFGVEALAYRLKDAGAAAVVTNRFGYERLAAIRGELPELRMVVLAEEDEKPGTVRFRDIAAGQGRFDPAETKPDDPALMIYTSGTTGPPKGALHGHRVLLGHLPGFQFHHHFLPQPGDRMWTPADWAWAGGLLNALLPSLFFGVPVVSSPAQKFDAHTAFRIIEEMEVRNAFIPPTALRLLKSVERPRDRCALKLRTVGSAGEALGRETFEWARAALGVEVSEFYGQTECNIVISSATGLGVAKAGSMGKAAPGHQVAIIDGEGRVLPPGTVGQVAIRRPDPVMFLGYWRNEEATEAKFIGDWMTTGDQGVMDEEGYFTFFGRDDDVITSSGYRIGPSEIEDCLAGHPDVQLAAAVGKPDPLRTEIVKAYVVLKPGVAAGDETAAGIRDWVKNRLSMHEYPREIAFVDSLPLTTSGKVIRRLLREKAAAEARAASGG

SEQ ID NO: 999 - DNA, 2028 bp, Zygosaccharomyces bailii
  CDS (1)..(2028)
atgacagtcaaagaacacaaggtagtgcacgaggcacaaaacgtagaagcgctgcatgcgccagagcatttttacaagtcacaaccaggccccagctacatcaaggacatgaagcagtacaaggagatgtacaaacaatctgtggaagacccagaaaacttctttggtgaaaaggctagggagctgctggattgggacagaccttttacgagaagcaagtacggttcgttggaaaatggcgatgtcacgtggtttttaaatggtgaattgaacgcagcctacaactgtgttgacaggcacgcttttgcaaacccagacaagcccgcattgatctacgaggctgacgaggaggctgacaacaggatgataaccttcagcgagctgctgagacaggtttcgcgggtcgctggggttctacaaagctggggagtgaaaaagggcgacactgtggcagtgtacttgcccatgattcctgaagcggtggtggccatgttggccattgcaagacttggtgccatccactctgtggtgttcgctggcttctctgctggctctttgaaagaccgtgtggtagatgctggttgtaaagtggtaatcacgtgcgacgaaggtaagagaggcggtaagacagttcacactaaaaagatcgtggacgaaggtttgaacggtatcagccttgtctctcacattcttgtcttccagagaaccgggagcgaaggtatccccatgaccgccggtagggattactggtggcatgaggagaccgccaagcagagaagttacttgcctcctgtgccttgcaattccgaagatccattgttcttgctatacacttctgggtctacgggctcccctaaaggtgttgtccattctaccgccggttaccttttgggtgccgctatgaccaccagatatgtcttcgacatccatccagaagacgttctctttaccgccggtgacgttggctggatcactggccacacctatgctctatatggcccattggttctcggtacggccagtatcatctttgaatctacccctgcctacccagattatggtaggtattggagaattatccagcgtcacaaggcaacacatttctatgtggctcctacagctttgagactcatcaaacgtgttggtgaagctgaaatccccaaatacgacatctcgtcgcttcgtgtgcttgggtctgttggtgagcccatctccccagagctttgggagtggtactatgaaaaagttggtaacaaaaactgtgtcatttgcgatacgatgtggcagacagaatctggctctcatttgatcgcccctcaagctggtgcagttccaacgaaaccaggttccgccactgtacctttctttggtgtggacgcttgcatcatcgatcctgttactggtattgagttgcaaggcaacgatgtggaaggtgtcctagcggtcaaatcttcctggccatcaatggctcgttctgtctggcaaaatcatcaccgttacgtcgacacatatttgaagccatacccaggttattactttacaggtgatggtgccgggagggaccacgatggctactactggattagaggcagagtggacgacgtggtaaatgtctcaggtcacagactttctacagctgagatcgaagcctctttgaccaatcatgataatgtctctgagtctgctgtagtcggcattgctgatgaattgacaggtcagtcagttattgcctttgtctctttgaaggacggttcttccagggaatcttctgccgtcgtagctatgcgtcgcgaattggttctccaggttagaggtgaaattggtcccttcgcagcccctaagtgtgtcattttggtcaaggacttgcccaaaaccagatcaggcaaaattatgagaagagttctaaggaaagtggcctctaacgaagcggaccagttgggtgatctatctaccatggcgaactccgaggttgttccatctatcattgccgctgtagatgaacaattctttgctgagaaaaagaaataa

SEQ ID NO: 1000 - protein, 675 aa, Zygosaccharomyces bailii
MTVKEHKVVHEAQNVEALHAPEHFYKSQPGPSYIKDMKQYKEMYKQSVEDPENFFGEKARELLDWDRPFTRSKYGSLENGDVTWFLNGELNAAYNCVDRHAFANPDKPALIYEADEEADNRMITFSELLRQVSRVAGVLQSWGVKKGDTVAVYLPMIPEAVVAMLAIARLGAIHSVVFAGFSAGSLKDRVVDAGCKVVITCDEGKRGGKTVHTKKIVDEGLNGISLVSHILVFQRTGSEGIPMTAGRDYWWHEETAKQRSYLPPVPCNSEDPLFLLYTSGSTGSPKGVVHSTAGYLLGAAMTTRYVFDIHPEDVLFTAGDVGWITGHTYALYGPLVLGTASIIFESTPAYPDYGRYWRIIQRHKATHFYVAPTALRLIKRVGEAEIPKYDISSLRVLGSVGEPISPELWEWYYEKVGNKNCVICDTMWQTESGSHLIAPQAGAVPTKPGSATVPFFGVDACIIDPVTGIELQGNDVEGVLAVKSSWPSMARSVWQNHHRYVDTYLKPYPGYYFTGDGAGRDHDGYYWIRGRVDDVVNVSGHRLSTAEIEASLTNHDNVSESAVVGIADELTGQSVIAFVSLKDGSSRESSAVVAMRRELVLQVRGEIGPFAAPKCVILVKDLPKTRSGKIMRRVLRKVASNEADQLGDLSTMANSEVVPSIIAAVDEQFFAEKKK

SEQ ID NO: 1001 - DNA, 1635 bp, Sulfolobus tokodaii
  CDS (1)..(1635)
atgtttgaaattgacctaagggaaaatagatttcataattatgatgaattaataaagacatttaagtggagtatcccttcttattttaatataggagaagcaatattagacagaaaaattagagaaggattaggagataatgtagctgtttactatgaagatgaagagggtaatcactctgtttatacgttctcacaattgaaaaaacttagtgattctttgataacacttttgaaagaaaatggagtgaaaaagggtgatgtgataggtgtttatttacaacctagagttgaaacaatcgtaagtattctgacaatatataggcttggaggtgtcactttatctatttccccgttaatgggagtagatgctgttgagtacagaataaagcaaagtggagcaaaagtcataataatggaaggttcaagaaaggaagtaagagagaggttaaaaaatgtaactaagatagtagttgatggtgaagctaatagagaaaatgagatagaattcgacgaggttaagaaagcttctggaatatacgacgctgtgaatactggaagtgaagatcctgcccaacttttttatacttcaggtagtactggtgcaccaaaaggggttcttcatgctcatagatttttattaggacatattccaacttatcaactttatttcgaaatggcaccaaaagaggaagacgtattttatacgccagcagactggggatggataggagctataggtgatgtactattacctagtttatatttcggaaagcctatagtagcatacagaagaacgggcaagttctctcctaaagatactcttgcagtaatgcaaaaatataaggttacatgcgcatttattcctcctactgctttgagaatgattagaagagaagttagtagccctacaaaggactacgatttaaagctaagggcaattagtagtgcaggagaagctgtaggagaggagttaatagaatgggcaatgaaagaattgtctcctaatgtcaatgaattttatggttgtactgaagctaatttagtaacagtaaacaattccttatggagaaaaataggttctgtgggcaaacctgcaccgggacatgaggtagcggttattgatgaacaaggaaataaactgataaatcagataggggaaatagcagtaaagtctggagatccagtactttttctaggatattataaaaacccggaagctactgcaaagaaatttagaggggattggtttttaattggagatttaggaataatggacgaatatggctacatttggtttaaaggtagggcagatgatgtaataaaagtatctggatataggttaggaccagaagagatagaaagcattatattacaacatcctgcggttcaagaggtagcggtaataggtaaggcagataaattgagaggaaatataatcaaggcattcatagtattaaaggaagggtatagtccctcagaggagttagtaactgaaatccagcagttggtaaagagtagactagcttcttatgcatatcctagggaaatagagttcgtaaaagaattacctaggacggaaacgggtaagttaaagagatttgaactaagaaaaagagaggaagaaaaaagttaa

SEQ ID NO: 1002 - protein, 544 aa, Sulfolobus tokodaii
MFEIDLRENRFHNYDELIKTFKWSIPSYFNIGEAILDRKIREGLGDNVAVYYEDEEGNHSVYTFSQLKKLSDSLITLLKENGVKKGDVIGVYLQPRVETIVSILTIYRLGGVTLSISPLMGVDAVEYRIKQSGAKVIIMEGSRKEVRERLKNVTKIVVDGEANRENEIEFDEVKKASGIYDAVNTGSEDPAQLFYTSGSTGAPKGVLHAHRFLLGHIPTYQLYFEMAPKEEDVFYTPADWGWIGAIGDVLLPSLYFGKPIVAYRRTGKFSPKDTLAVMQKYKVTCAFIPPTALRMIRREVSSPTKDYDLKLRAISSAGEAVGEELIEWAMKELSPNVNEFYGCTEANLVTVNNSLWRKIGSVGKPAPGHEVAVIDEQGNKLINQIGEIAVKSGDPVLFLGYYKNPEATAKKFRGDWFLIGDLGIMDEYGYIWFKGRADDVIKVSGYRLGPEEIESIILQHPAVQEVAVIGKADKLRGNIIKAFIVLKEGYSPSEELVTEIQQLVKSRLASYAYPREIEFVKELPRTETGKLKRFELRKREEEKS

SEQ ID NO: 1003 - DNA, 1731 bp, Sulfolobus tokodaii
  CDS (1)..(1731)
atgggttatgccaaaactagtagtagaatagatatggattatttcactctttatcaatattcaatagaaaacccagaaaaatattggagttcttttgctaataaattagaatggttttctaagtggaatagtgttataataagggacaaatacatcgcaaaatggtttgttaatggtaaaactaatatagcctataattccgtcaatacacatcaaggcaaggcactaatttggtatggagaagacggaaaaagaatagaaataacatatgatgaactaaataggctaagtaactctattgcaaacttacttaaaaagaggggaattaaaaaaggtatgaggattgctatttattcacccaattctatactaacattggcctcaattttaggaacagctaaaattggtgctatttatacccttatctttgctggactaggtattgaggctataaaatctaggcttaatgattttaatccagaccttgtcatatcatcaagaaagacctttaggagaggaaaagaaatacccctattaatagaaggggatattaattttgaaagaaatgatgaagatgaaatccgcaaacttttagatagcgatgaagtaaaagtggaagaaatagaagctaatgaaccattaaaagtgatgtacacttctggtactacgggtaagcctaaaggagtaattttgcctcatggtgcgtggatggtaggagattatacagtatttgatttactttttggactaaaacctggtgataaggtcctaactactacagatgtcggctggataactttctctagaataatgtatggtactttacttcatggttctacttttatatttatggaaggagctccagattatcctaaagatagattagttaaaataattgaagaagagcaacccaaagtactattcacttctcccactttaataagattgttgatgaaatatgatataaaacttccaagagtagaatatattgctactgcaggagagatatttgatgaaaaaagctggaattatgcattagaaattgcagataaagttactgatgtatatggacaaagcgaattgggctatgtagtaggaataccttattcactagagagcataaaaccgaagataggatatgcaggtgtaccttttcctggtatagtcttagatacattggatgatgaggggaaggcagtgagaaacaaacctggctatctagttgcaaaaactccttttccaactcaatttataggaatattaaataatgaaaagaaatttacagaatattttgagaaatttggtttccatgataccggagatttagcaatatttgatggaacttatataaagatagtaggaagagcagacgatatgattaaagttgcagggcatagaattacaagtggagaagttgaaagtataatagctagtattgatggagtgaaagatgtagcagtagtaggtattccagacgaaattagaggtgaaaagctggcaatctttgtagttggaaaagtagataaagaggaaattaaaagaaaagttcttgatgcattaggaccaatttatattattcatgatgtttatgtcgtagaaaagttacctaaatctagaagtggcaagactgtaagaagaattttaagagatatacttttaaataaggaaattgatgcttcaatacttgaagacccagaagtcgtaaaggagattaaggatgaaatttcatga

SEQ ID NO: 1004 - protein, 576 aa, Sulfolobus tokodaii
MGYAKTSSRIDMDYFTLYQYSIENPEKYWSSFANKLEWFSKWNSVIIRDKYIAKWFVNGKTNIAYNSVNTHQGKALIWYGEDGKRIEITYDELNRLSNSIANLLKKRGIKKGMRIAIYSPNSILTLASILGTAKIGAIYTLIFAGLGIEAIKSRLNDFNPDLVISSRKTFRRGKEIPLLIEGDINFERNDEDEIRKLLDSDEVKVEEIEANEPLKVMYTSGTTGKPKGVILPHGAWMVGDYTVFDLLFGLKPGDKVLTTTDVGWITFSRIMYGTLLHGSTFIFMEGAPDYPKDRLVKIIEEEQPKVLFTSPTLIRLLMKYDIKLPRVEYIATAGEIFDEKSWNYALEIADKVTDVYGQSELGYVVGIPYSLESIKPKIGYAGVPFPGIVLDTLDDEGKAVRNKPGYLVAKTPFPTQFIGILNNEKKFTEYFEKFGFHDTGDLAIFDGTYIKIVGRADDMIKVAGHRITSGEVESIIASIDGVKDVAVVGIPDEIRGEKLAIFVVGKVDKEEIKRKVLDALGPIYIIHDVYVVEKLPKSRSGKTVRRILRDILLNKEIDASILEDPEVVKEIKDEIS

SEQ ID NO: 1005 - DNA, 1986 bp, Sulfolobus tokodaii
  CDS (1)..(1986)
atgtcagtaaactggtctcttccatttgaagagaaaataataccaagtaagtatcagagcaaagtaatttcaccatcaatatataaagagttacacaagatagctactgaaaattacaaggagttttgggcatcaattgcctctcaattagagtggtttaagccttgggaaaaggtacttgatgattctaatccaccattttacaagtggtttgttagtggtgaaataaatgcttcatatttagctgtggatagacatgctaagagttggagaaaaaataaagtagcaataatttgggaaggagaaccggcagaaggtgataagccaaaggaggtaagatatattacatatggtgaattatatagagaagtaaatagagtggcttatattcttaaggaagtttatgggttaaagaagggtgatgctatatcattatatttaccaatgatacccgaattacctatatttatgttagccgctgctagattggggataatatttagtgtagtgttttctggatttagtgcccaagcattagcagatagaattaatgatgctagagctaaattattagtaacggctgatggaggttggagaagaggtaaaatagttccactaaaagatatagcagataaggcattagaaaatacatctactgtagagaaagtcttggttgtaaaaagaacgaataataatataactatgaaagaaggtagagatgaatttttcgataatgtatataagcaagttcctttgaatgcatatgtagagccagagagaacaaagagcgaagatcctctattcattctctatacctctggaaccactggcaagccaaagggaatagttcatgatactggcggatatttaactattcttcacgctacaatgaactgggtattcgatattaaagatagtgatataatgtggactactgctgatattggttggattactggtcattcatatatagtatttggtcctctattagaaggagtaacaacagtaatgtatgaaggagctctagattatccaaacccagataggtgggcatctataattgagagatatggtgttacgatactttatacttcacctacagcaataaggtctttcatgaaattaggagaggatgtatataaaggtagagatttctcttctgtgagattaatgcattctgtaggagagccaataaacccagaggcatttagatggttcttcagattggtaggaaaagaaagcataccatttggtagtacttggtggatgactgagactggtggtattatgattagtcacttacccggtctttatctaattccattgaaaccaggaactaatggaatgccgttaccgggaattgatgcagatgttgttaatgaaaatggtaatcctacaaaacctgaagaaagaggatatctagtgattagaaaaccatggcctggaatgccattaactatttggggagatccagatagatatgttaaagtatactggtctaaattcccgggtatattttatcccggcgatttcgctgttaaagattctgatggatacttctggatattaggtagggctgacgaggtaattaaagtagctgggcatagattaggaacatatgagttagagtctgctttaatacatcacccagccgttgctgaagcagcagttgtaggagtcccagatccattaaaaggtgaagtaccggtagcatttgtagtattaaaggtgggacaaaaagcaaatgaggagttgaaaaagagcttaaatgaatgggtaagagagcaagtaggacctatagcgtcattaagtagtatttactttgtatctaaacttccaaaaactaggagtggtaagattatgagaagagtagtaaaggctgttattactaatcagccagtaggcgatgtcacaacacttgaagatgaagcttcggtagaagaagttaaaaaggcatacgaagaattaaagaaggagatatcctaa

SEQ ID NO: 1006 - protein, 661 aa, Sulfolobus tokodaii
MSVNWSLPFEEKIIPSKYQSKVISPSIYKELHKIATENYKEFWASIASQLEWFKPWEKVLDDSNPPFYKWFVSGEINASYLAVDRHAKSWRKNKVAIIWEGEPAEGDKPKEVRYITYGELYREVNRVAYILKEVYGLKKGDAISLYLPMIPELPIFMLAAARLGIIFSVVFSGFSAQALADRINDARAKLLVTADGGWRRGKIVPLKDIADKALENTSTVEKVLVVKRTNNNITMKEGRDEFFDNVYKQVPLNAYVEPERTKSEDPLFILYTSGTTGKPKGIVHDTGGYLTILHATMNWVFDIKDSDIMWTTADIGWITGHSYIVFGPLLEGVTTVMYEGALDYPNPDRWASIIERYGVTILYTSPTAIRSFMKLGEDVYKGRDFSSVRLMHSVGEPINPEAFRWFFRLVGKESIPFGSTWWMTETGGIMISHLPGLYLIPLKPGTNGMPLPGIDADVVNENGNPTKPEERGYLVIRKPWPGMPLTIWGDPDRYVKVYWSKFPGIFYPGDFAVKDSDGYFWILGRADEVIKVAGHRLGTYELESALIHHPAVAEAAVVGVPDPLKGEVPVAFVVLKVGQKANEELKKSLNEWVREQVGPIASLSSIYFVSKLPKTRSGKIMRRVVKAVITNQPVGDVTTLEDEASVEEVKKAYEELKKEIS

SEQ ID NO: 1007 - DNA, 1866 bp, Sulfolobus tokodaii
  CDS (1)..(1866)
atggaagcggaattttatagtttacaaaaaattagaaaattaagtgaggaagcagtaaaagacccagaaagtttttggaaggataaaatgcatttgatctcatggtttaaagagccagaaaaaataagggaaggagaaccaccatttgagaaatggtttgttaatggttatactaatatttcttataacgcaattgatagacatttagataaatctgaaaaagtagctttctattggataaatgagaaattagatactaggagtataacttatagagatttatattgtgaggtaaatagggcttcttacgttttaaaagaactaggagtaaagaaaggtgacgtagtatctcttataatgcctagtattccagaggcagtctatatgtctttagctgtacataggctaggggcgacactagtaatacactatctaggtttaagtgaggagacattaacttataggctaaatgattgtaattctagggttttaatagttgctagcaagggtttcagaaacggaaatgaaataaggataaaagatttcgtggataagcttcttgattccagaaaaactccgatagagaaagttttagtagtgaaaagaggttatgacgattttaacgttacaaagagggacgttatatatgaagaagtaagacctaggggtagagtttatgttgaaccaatctgggtagaatctaatgagccttcaacaatttattatacttctggaaccactggtagacctaaaggcttatatcactctacagcaggatatgtaatagcattaaattatgcctttaaatcccttatgggtcctaaagagaatgatatatggtggacaatatctgaattaggctggccagtatggcctatggcaaatctttacacaataccattcatgggtcttactggagtactttttgagggatatataggatataaaccagatatgttctccagaataattgaaaggtttggagttaatttagtatggagttcaacaacaactttatatacattaaagagccttggagaagaatcggttaaatctggagatacttcaacactgagactcattttgaacactggagaaccattaaaccctggtgcatggaaatggttaagagaaaatatgcctcacgttactattgcagatgcgtattggatgactgaacatttattcccagttgctggaacaccttttggaataggagagattccttacaaagcggggtctgctggaattagatttcctggtagtgattttagagtagtggacgatgacgggaaagaattacaagttggaaagaagggatatattgtgttaaagcctattagcccagctttagcaaaaatgcacaatgatactaacggggaaaggattataaagacctactggtcgaggttccctggatatttttacactggtgattacggctatatggacgaggatggatacctttacgttttaggaagagctgatgatgtaataaagtctggtgaaagaataggtactttagaggtagaaagtgtagttgtaacacatccagcagtcgctgaggctgctgtagtaggctacccaaaggaagtaggagaaggaattttagttttagctgtgattaagaaaggttatccaatgagtgaggatttagctaatgatataaaatcatatctaagaaatagtggatatatagtagataaagtatatttagtaagaagactaccaaagactaagagtggcaagataatgaggagattaataagagcactggtaaggaatgaggagattggtgatatctctactttagatgacccaagcatattagaggagttaaagagtatattaagtgagaaagattga

SEQ ID NO: 1008 - protein, 621 aa, Sulfolobus tokodaii
MEAEFYSLQKIRKLSEEAVKDPESFWKDKMHLISWFKEPEKIREGEPPFEKWFVNGYTNISYNAIDRHLDKSEKVAFYWINEKLDTRSITYRDLYCEVNRASYVLKELGVKKGDVVSLIMPSIPEAVYMSLAVHRLGATLVIHYLGLSEETLTYRLNDCNSRVLIVASKGFRNGNEIRIKDFVDKLLDSRKTPIEKVLVVKRGYDDFNVTKRDVIYEEVRPRGRVYVEPIWVESNEPSTIYYTSGTTGRPKGLYHSTAGYVIALNYAFKSLMGPKENDIWWTISELGWPVWPMANLYTIPFMGLTGVLFEGYIGYKPDMFSRIIERFGVNLVWSSTTTLYTLKSLGEESVKSGDTSTLRLILNTGEPLNPGAWKWLRENMPHVTIADAYWMTEHLFPVAGTPFGIGEIPYKAGSAGIRFPGSDFRVVDDDGKELQVGKKGYIVLKPISPALAKMHNDTNGERIIKTYWSRFPGYFYTGDYGYMDEDGYLYVLGRADDVIKSGERIGTLEVESVVVTHPAVAEAAVVGYPKEVGEGILVLAVIKKGYPMSEDLANDIKSYLRNSGYIVDKVYLVRRLPKTKSGKIMRRLIRALVRNEEIGDISTLDDPSILEELKSILSEKD

SEQ ID NO: 1009 - DNA, 1494 bp, Sulfolobus tokodaii
  CDS (1)..(1494)
atggtaagttattatgaggttgtaagaagttttagctggaaggagatcgaaaaaacaatagatatttcatcactagtagaccatgagggggtagctgtaattagatttagtaaagaaggaaaagaacaaattactttccaagaacttaaagataaagcgttaaggcttgcttcttatctgaagcatatagctggtgttaagaagggagatgtaatatcagttttagcttctaagaaaattgagcaagttatagtcctcttagccagtctctatataggagctttgtatcagcccttatttacagcctttggacctaaggctatagaaattaggactagagataaaaaacctaaagtgttattttatcaagatgatcaaaaagagaaggtaagtgaaggagtaccactttcaaagcttgatgagttaacatcttacgggagattagaagagatagaaaggctaagctggaacgatccaattattttactttatacttctgggagtactggtttacctaaaggagcattaatatctaagaggcttttacttaacacatacgtatatatgaaatacggaattgggttaagagagaatgatattttctggaatggtgctgatcctggctgggcatatggtctctattatggaattataggcccattgcttttcggcaagactgtaatattcctagatgagcctttcgatgcagaaagaacaatggagtttcttgaagaaaacaaaataacaaatttcgcatgggcacctactacatataggattatatcgaggtctgtgaaaaggaagtacgatttaaggcttgaaagagctagctctgcaggagaaccccttaatccagaggtaataaagtggtttaaagataattataatgtgattgtgaaagaccattatggtcagactgaagtagggatggtagtgtataatggttggggttatgattatgagttaaagataggtagtatggggttaccagcaccaggttatgaggtggatattatagaagagaatatagctgtaaagaagacttctccaggatttcattttctaggatatttgaataatcctgagaaaacgcaagaagctttcagaggagattggtatttaactggtgatgtagcatctaaagatcaagacggatacttctggtttattggtagaaaggatgatgtaactaaggtgtctggatataggattggaccttttgaagtagagagtgtgctattagagcatccagctatccttgaatctgcagtagttgctgatgaagatcctattagggggcacgttctccacgcatatatagttcttaaacccggatatactccaagtgaagagctaaaaaaggagataatagagtttgttaagagtcgttactctaagactgtgcatttagagagggtggatttcatcgataaattaccgaaaaccgaaagtggaaaaatacaaaggtatttacttaagaaaaagataagttaa

SEQ ID NO: 1010 - protein, 497 aa, Sulfolobus tokodaii
MVSYYEVVRSFSWKEIEKTIDISSLVDHEGVAVIRFSKEGKEQITFQELKDKALRLASYLKHIAGVKKGDVISVLASKKIEQVIVLLASLYIGALYQPLFTAFGPKAIEIRTRDKKPKVLFYQDDQKEKVSEGVPLSKLDELTSYGRLEEIERLSWNDPIILLYTSGSTGLPKGALISKRLLLNTYVYMKYGIGLRENDIFWNGADPGWAYGLYYGIIGPLLFGKTVIFLDEPFDAERTMEFLEENKITNFAWAPTTYRIISRSVKRKYDLRLERASSAGEPLNPEVIKWFKDNYNVIVKDHYGQTEVGMVVYNGWGYDYELKIGSMGLPAPGYEVDIIEENIAVKKTSPGFHFLGYLNNPEKTQEAFRGDWYLTGDVASKDQDGYFWFIGRKDDVTKVSGYRIGPFEVESVLLEHPAILESAVVADEDPIRGHVLHAYIVLKPGYTPSEELKKEIIEFVKSRYSKTVHLERVDFIDKLPKTESGKIQRYLLKKKIS

SEQ ID NO: 1011 - DNA, 1980 bp, Sulfolobus tokodaii
  CDS (1)..(1980)
atgactgaaaaactctcagaacaattacaacaattgggtgaacaaaacttagaggagaaagcagactataatatgagatactataagtatttatacaaaaagagtattgaagagcctgataaattctggggcgaattagcagaagaattaattacttggtacgagccatggaaacaagcttttgtccaagaagaaggtttacttacaaagtggtttgttggtggaaaacttaatgcttcctataacgctgtagatagacatttaaattctcatagaaaatataaggctgcaatattttgggagagtgaaaaaggagaaaagaaggtagttacatatcaagacctattttatgaggttaataaatgggctaacgcattaagggaactcggagtaaagaagggcgatagagtaacaatttacatgcctttaacaccagaaggagtaatagctaagctagctgttgcaagattaggtgcaatacactcagttgtatttgcaggatttggtgcacaagcattagctgatagaattgcagatgctggagcaaaagttgtaattactgcagatgcatactataggagaggaaaactcgtggaattaaagaaaactgtagatgaggcattaaacattctcggtgataaaagcccggtacaaaaagttttagtttataagagaactggtactgaaatacccttcaaagagggtagagatgtttactttgatgaagtaggaaagtataagtacattgaaccagtaccagttgaagctacagaaccattattcattctatacacttccggaactacaggcaagcctaagggaatagttcacagtactggaggttatttagtaggaacagcagttatgttattatggagttatggtttaagccaagaaaatgatgtgttatttaatacttcagatatcggatggattgttgggcactcttacattacttattcaccgttagtaatgggtagaagtatcgtaatctatgagagtgccccagattatccttacccagataaatgggctgaaatgatagagaaatatagggcaacaacatttggtacttcagctacggcaataagaacattaatgaaatacggagaagattatgtaaagcaacatgatctatcatcattaaggataattgtaactaatggcgaaccattaaattatgctccatggaagtggggattagaagtagttggaggaggaaaagtatttatgtctcatcagtggtggcaaactgaaactggaggtcctaatattggttacatccccggtgtagtttacttaccaatgaagtctggaccagctgtaggtttcgctttgcccggtaataaggttactgtagttaatgaggaaggcaaagaaactaagcctagagagaggggttatttagttatgctacctccattcccaccaatgatgatgataggtatgtggaatgacccagataacgagaggttaaagaaaacatacttcagtaaattcccagggatttactatccaggagattatgcaatgattgatgaagatggttacatatgggtaatgggtagagctgatgaaacaattaaagttgctgctcatagaattggtgctggagaggttgaatcaatagtaacatctcatccagcagtagctgaagctgcagctgtaggaattccagatcctgttaaaggggaagctgttcatctatttgtagtactaaaagttggctataaaccctcacctcagctagctagagagatacaagagcatgtaaggaaatatatgggagcaatagtaactccagaggtacattttgtagataaattacctaagactagatctggtaaaattatgagaagagtaattaaagcagttatgatggggcaaagtgctggtgatataaccactcttgaagacgaggcatcaatggatgagattaagaaagcagtagaagagtttaagaaatcattaagccaatga

SEQ ID NO: 1012 - protein, 659 aa, Sulfolobus tokodaii
MTEKLSEQLQQLGEQNLEEKADYNMRYYKYLYKKSIEEPDKFWGELAEELITWYEPWKQAFVQEEGLLTKWFVGGKLNASYNAVDRHLNSHRKYKAAIFWESEKGEKKVVTYQDLFYEVNKWANALRELGVKKGDRVTIYMPLTPEGVIAKLAVARLGAIHSVVFAGFGAQALADRIADAGAKVVITADAYYRRGKLVELKKTVDEALNILGDKSPVQKVLVYKRTGTEIPFKEGRDVYFDEVGKYKYIEPVPVEATEPLFILYTSGTTGKPKGIVHSTGGYLVGTAVMLLWSYGLSQENDVLFNTSDIGWIVGHSYITYSPLVMGRSIVIYESAPDYPYPDKWAEMIEKYRATTFGTSATAIRTLMKYGEDYVKQHDLSSLRIIVTNGEPLNYAPWKWGLEVVGGGKVFMSHQWWQTETGGPNIGYIPGVVYLPMKSGPAVGFALPGNKVTVVNEEGKETKPRERGYLVMLPPFPPMMMIGMWNDPDNERLKKTYFSKFPGIYYPGDYAMIDEDGYIWVMGRADETIKVAAHRIGAGEVESIVTSHPAVAEAAAVGIPDPVKGEAVHLFVVLKVGYKPSPQLAREIQEHVRKYMGAIVTPEVHFVDKLPKTRSGKIMRRVIKAVMMGQSAGDITTLEDEASMDEIKKAVEEFKKSLSQ

SEQ ID NO: 1013 - DNA, 1989 bp, Sulfolobus tokodaii
  CDS (1)..(1989)
atgtcagtaaattgggcactaccatttaatactaaaattgtacctaagtcaaataaggtagttgacataaatacttacaaggaaatacatagcacgagtctgagagactataagggattttgggcttctgttgcatcagaattagactggtttaagccttgggaaaaggtacttgatgattctaatcctccattttataagtggtttgttggtggtgaaataaatgcttcatatttagctgtggataggcatgctaagagttggagaaaaaataaggtagcaataatttgggaaggagaaccagtagatgaaaatggaaaccctaaggaagtgagaaaattaacatattacgatttatacacagaggttaatagggtagcttacatacttagaaataaatacggtttaaagaaaggagatgcagtagctatttatctaccaatgataccagaattgccgatatttatgttagcattggctagaattggagttgtgtttactgtagtattttccggctttagtgctgatgcactagctacgagaatagatgatgcacaagctaaagtgttaattacagctgatgggggctggagaagaggtaagatagtaccgttaaaggatattgctgataaagctttagagaaagtttctacggtgaaagacgttatagttgttagaagaacaggacaaaaggtaaacatggtcgagggaagagataaatatctagatgatgtgttaagggaagttcctcaaggtgtttatgttgaaccagaaaggataaagagtgaagaccccttatatatactctacacttctggaacaactggtaagccaaaaggaatcgttcacgatactggaggataccttacattacttcatgcgacgatgaaatgggtgtttgatgttagagatgatgatatttactggtgcactgcagacataggatgggttaccgggcattcttatattgtgtttggaccattaatggaaggagttaccgaaataatgtatgaaggagctttagactatcctaaaccggatagatgggtttcaataattgaaagatacggcgttacgatattctatacatcaccaaccgcaataagatcattcatgaaatacggtgatgaatgggttaaggcacataagacagacaccatcagaattatacattctgtaggagaaccaataaatccagaagcttttgagtggttatggaagttaattggaagaggagaagtaccatttggtagtacttggtggatgactgagactggtggtatcatgattagtcacttacccggtctttatttaattcctttgaaacctgggactaacggaatgcctttacccggaatagaggcggatgttgttgatgataatggtaatcctacaaagcctgaagaaagaggatatctagtaataaagaatccatggcctggaatgccattaacaatacatagggatccggagaggtatattaaaatatattggtctaaattcccgggaatgttctatgctggagattatgcagttaaagactctgatggatacttctgggtattaggtagggctgatgaggtaattaaagtagctggacatagattaggaacatatgagttagagtctgcgattattgaacatccagccgttgctgaagcggcagttgtaggagttccagatccggtgaaaggtgaagtaccagtggcatttgttattcttaagcaaggtgtttcgccaagtaaaaatcttatggatgatatactgaagactgttagagataaggttggtcctattgctacattatccagtatttactttgtatctaaacttccaaaaactaggagtggtaagattatgagaagagtagttaaggctgttattactaatcaaccggtaggtgatattacaacgcttgaaaatgaggcttcagtagaagaagttaagaaggcttatgaggagtttaaggctgagataggtaaaagttaa

SEQ ID NO: 1014 - protein, 662 aa, Sulfolobus tokodaii
MSVNWALPFNTKIVPKSNKVVDINTYKEIHSTSLRDYKGFWASVASELDWFKPWEKVLDDSNPPFYKWFVGGEINASYLAVDRHAKSWRKNKVAIIWEGEPVDENGNPKEVRKLTYYDLYTEVNRVAYILRNKYGLKKGDAVAIYLPMIPELPIFMLALARIGVVFTVVFSGFSADALATRIDDAQAKVLITADGGWRRGKIVPLKDIADKALEKVSTVKDVIVVRRTGQKVNMVEGRDKYLDDVLREVPQGVYVEPERIKSEDPLYILYTSGTTGKPKGIVHDTGGYLTLLHATMKWVFDVRDDDIYWCTADIGWVTGHSYIVFGPLMEGVTEIMYEGALDYPKPDRWVSIIERYGVTIFYTSPTAIRSFMKYGDEWVKAHKTDTIRIIHSVGEPINPEAFEWLWKLIGRGEVPFGSTWWMTETGGIMISHLPGLYLIPLKPGTNGMPLPGIEADVVDDNGNPTKPEERGYLVIKNPWPGMPLTIHRDPERYIKIYWSKFPGMFYAGDYAVKDSDGYFWVLGRADEVIKVAGHRLGTYELESAIIEHPAVAEAAVVGVPDPVKGEVPVAFVILKQGVSPSKNLMDDILKTVRDKVGPIATLSSIYFVSKLPKTRSGKIMRRVVKAVITNQPVGDITTLENEASVEEVKKAYEEFKAEIGKS

SEQ ID NO: 1015 - DNA, 1689 bp, Sulfolobus tokodaii
  CDS (1)..(1689)
atggtagaaataataaaggataagaaaatagtagtaaagccaaatttaactgactacgatgaagtaagaagaaattttagttgggacagagtacgcaaggagctaaattattatggtgaagtaaatgcaggagaattagcaatacataataaaaatgataaacttgccttattatgggtgagtgaagaaggcagtataagaaagttaacatttaatgatttagagaaaaaaggtactatatttagagatgtattagaaaataatggggtaaaaagaggggatagagtagttataatgtctaaaaggacaccatcattatacttctcatttattgcaatagctatgataggtggtgtcatagttcctatcttttcaacattcggtgaagaggcaataaggtatagagtggaaaatagtggggctaaagtagctatagtgcatgaggagctaacagataaatttaagaatataagtgggattaaggttttaagaactactgatgatggaatagaaggagaaagtaataggttaggtaatatttcatatgaaaagagatcaattaacgatcctttcttaatactttatacttctggaaccactggaaagcctaaagggatttggcacgcccaggatattttaacgttctattacatttctgggaaatatcatttcgatatgcatccacaagatatattttggcatactggagatccagcgtgggtggcgggatttgcgggtgtatggacaccatgggttaatagtattcctcttgtttcatatgagggaagatttaaggctgaaacttggtattctattattgaagaatttaaagtttctgtaatttctactgcaccaacagccttaagattgttaaagaaagaaggtctggagcttagtaagaaatatgatctttcatcagttagatttatacatgcaggcggagaatatgtagatccagatactgttaaaataggtctccaaatatttggtgttccggttcatgatggatacggtcagaccgagactgcgacatatgtcatagctaacttcatctcaatgcccataaaagttggatccatgggtaaaccattaccgggagtcgaggctgtgattgttgatgaaaacggaaatcctcttccacctaacacaaggggtatattagctttcaaacctgattttccagctatggctagaggaatatggggagatgaggagagatggaagagtaactttaagaacggttattatttaactggtgatttagcgtatatggatgaagatggatatttctggtatttgggtagggcagatgatgtaattaaagtttctggctacagagttagtccaatagaaatagagagcgtaatatcaacccatccagctgtagccgaagttggtgttataggcatagaagaccctgttagagggcataagataaaggcatatatagtacttaaaaaagaatatgaacctacagaggagctaaaacaacaaatccaaaattatgttaaagagaaattagcttcacacatggttcccagagaaatagagtttgtaaaagaattaccgcacacattaagtggtaaaataatgaggagagttttgaaatccatagaaagtggtagtaatattggcgatataagtacattagaaaatccagaaattataaagaaattagaaaaacaataa

SEQ ID NO: 1016 - protein, 562 aa, Sulfolobus tokodaii
MVEIIKDKKIVVKPNLTDYDEVRRNFSWDRVRKELNYYGEVNAGELAIHNKNDKLALLWVSEEGSIRKLTFNDLEKKGTIFRDVLENNGVKRGDRVVIMSKRTPSLYFSFIAIAMIGGVIVPIFSTFGEEAIRYRVENSGAKVAIVHEELTDKFKNISGIKVLRTTDDGIEGESNRLGNISYEKRSINDPFLILYTSGTTGKPKGIWHAQDILTFYYISGKYHFDMHPQDIFWHTGDPAWVAGFAGVWTPWVNSIPLVSYEGRFKAETWYSIIEEFKVSVISTAPTALRLLKKEGLELSKKYDLSSVRFIHAGGEYVDPDTVKIGLQIFGVPVHDGYGQTETATYVIANFISMPIKVGSMGKPLPGVEAVIVDENGNPLPPNTRGILAFKPDFPAMARGIWGDEERWKSNFKNGYYLTGDLAYMDEDGYFWYLGRADDVIKVSGYRVSPIEIESVISTHPAVAEVGVIGIEDPVRGHKIKAYIVLKKEYEPTEELKQQIQNYVKEKLASHMVPREIEFVKELPHTLSGKIMRRVLKSIESGSNIGDISTLENPEIIKKLEKQ

SEQ ID NO: 1017 - DNA, 1860 bp, Thermoplasma volcanium
  CDS (1)..(1860)
atgtttgtttataagcctgatgaagcggagatagcatcaacgaatttggggatgtttgcttcttctgttggaatcactgtaaaggaactctacgataaagcagattcagacccagaatggttttggcctcaggtgattaaagatactggaattgaattcttttctccatacaaaaaagtttttgacaattcaggcgggccgcaacatacgaaatggtttactgaaggactcataaacatagagtataacgcagtctcaaggtataaggattcgtcaaagcctgcagtaatttaccagaatgaatatctcgaaagggaaacgctttcctattccggactcaatatatatgtatcttctgttgcctctactcttcttgatatggggatacggaaaggcgatagggttggcatctacatgccttttaacttaaagagtgcaatcgctttctattccatacttcgaattggagcagtagccgttcctatgttctcaggatacggctatgaagctgtaaaaacacgcgttgaagatgctggagtgaagcttctctttacatccaaaggatactccagaaaaggaaaatttgtcgacatgatgtctgtagccgagaaggttggcttgcccataatagctgaaggcggtagcaaaaaaggctatagtttcgaagatgctatgcatgggcagaagcggatagagacggagaaaacgggatcggaagacacagccataatgctttatacatctgggacaacaggaaagcctaagggaactgtacacgtccacggtggagccttgattaacatagccaaagaggtgaagtactatatggacttgaaggacggtgacgtgcttcactggataaccgatcttgggtggatgatgggcccgtgggccttaataggtacgaatgtactgcacgggacgatttatctgtatgacggtgctgtagattatccggatgcctctagactcttcaccatacttgaagataacaacgttacactgcttggtctatcgccaactctcgttcgcatgctgaggtataaaaatattgagagaagattcaatacagtaaggctctttggatctaccggcgaaccttgggacgacgagtcgtggagctacttgttcaatgttcttggtggaggcaaaacgcctatttcgaatatctctggaggcactgacattatcggctgcttccttgcatcgaacccggcaataccgattaaaccgaaatgcctctaccgcgggctcggaatgaacgcatccatatttgacgaaaacggaaaagaggtctatggaaaggtcggttatcttgtagcaaagaagccatcaccttctatgacgcggggtttgtggatggcagaggaccgctacctcgaaagctattggtctagatttcagggtgtttggtttcacggcgactttggagaaatggatgaagatggctatttttatctctatggaagggcggacgatgtgataaaggtagctggcaaaagggtcgggcccaacgaattggaagatattgtaatggcagtgaacggcgttatagaggcagctgtaatttccataccagataaaataaagggtgaagctctcgctgtgttttacgttggcgaaccggatctatcaggtaggataaaagacgctatagaatctaagatgggaaagccattctcgccgtcctatgtgctgcgattgagaaaactgccaaagacgaggaatggcaagaccatgaggcgtgttataagatcctcattccttggccaagaccccggagacttgagcaacactgaagacctagattccattaaagaaatagaagaactcggaaggaccatattcaacaacgattga

SEQ ID NO: 1018 - protein, 619 aa, Thermoplasma volcanium
MFVYKPDEAEIASTNLGMFASSVGITVKELYDKADSDPEWFWPQVIKDTGIEFFSPYKKVFDNSGGPQHTKWFTEGLINIEYNAVSRYKDSSKPAVIYQNEYLERETLSYSGLNIYVSSVASTLLDMGIRKGDRVGIYMPFNLKSAIAFYSILRIGAVAVPMFSGYGYEAVKTRVEDAGVKLLFTSKGYSRKGKFVDMMSVAEKVGLPIIAEGGSKKGYSFEDAMHGQKRIETEKTGSEDTAIMLYTSGTTGKPKGTVHVHGGALINIAKEVKYYMDLKDGDVLHWITDLGWMMGPWALIGTNVLHGTIYLYDGAVDYPDASRLFTILEDNNVTLLGLSPTLVRMLRYKNIERRFNTVRLFGSTGEPWDDESWSYLFNVLGGGKTPISNISGGTDIIGCFLASNPAIPIKPKCLYRGLGMNASIFDENGKEVYGKVGYLVAKKPSPSMTRGLWMAEDRYLESYWSRFQGVWFHGDFGEMDEDGYFYLYGRADDVIKVAGKRVGPNELEDIVMAVNGVIEAAVISIPDKIKGEALAVFYVGEPDLSGRIKDAIESKMGKPFSPSYVLRLRKLPKTRNGKTMRRVIRSSFLGQDPGDLSNTEDLDSIKEIEELGRTIFNND

SEQ ID NO: 1019 - DNA, 1926 bp, Thermoplasma volcanium
  CDS (1)..(1926)
atgacatatgatctaccgaattttgttttaaatagtaaggagatccttagaatagacgagaagaaaagggatgaatttaagcgtttgcttgaattctcgaagaacgatccaaatggcttttgggagagtattgcttctgatctagtttggagaaagaaatgggataccgtaatggaaggcagacttcctgaattttcctttttcaagggaggctatttaaacgttgctgaaaacctcatagatagacatatagaagctggggaagctaatagagctgctttgatatttgagagcgaaacagggcgaagcgctgtatatacatacgcaatgctgcaatctattgtaaacaaactttcaaatgctctaagaagcctaggcgtaaagaaaggtgacagagtctctatatttctgccaaacatacctgaaacattattcagtgtgctcgcgtgctacagggttggtgctgttttcaatacaatattttctggtttctctacgcaggcattggagaacaggttaaagcattttaaccctatgataataataactgcagacggaacatacagaagaggcaaactagtggagttaaagaaaaaagtggatgagattcgagattctaattttgaaaagatcatcgtagtaaaaaatgtagggctcaatctgaattttacagaaagagatttagacttttacagcctaatagcgaagtttaacgataaagacaaagggggagatgtcgaggcaaacgagcctggcatagtcttttatacatcaggtacaacaggtaagccaaaaggagtggtgctttcgggtgccggatttctggtgaacaactacgtgtatgcaaagcaccacctcgatttgagtaaatctgatgtactttggtgcacagctgacataggatggcttactatgcatatatggggtataattggggctcttgctaatggctctacgactctattttatgaaggggcaatcgattacccttctcaagatcgtttctacgaaatagtgcaaaaatacaaagtaacaaaaattttcacagctccaactttgataaggatgctgatgaagtacggctttccagagggcaagtatgatgtttcatccgttcgtgtaataggactagtgggcgagccgttgaatccagaagcgtggcactggatgaataaacacttcagatctgcatacattaataatacgtgggggcaaaccgaaactgctggaactccgcttgcaggatctgcctttgctactggcatgaagccaggatctagcggcatcgagttcctgggagcatccttggatgttgttgacgatgagggtaatccagtgcttgaacgtccaggaaatttagtaataaagaaaccgttccctatgatgatccgcgatctatggaacgaacacgaacgtttcttaaaagaatactatggaaagttagaaggattgtatttcacctatgatgttgctgtaaaggataaagatggccacttttgggttctcgggaggaatgatgatgtaatcaacgtttccggccatagactgagcacgatggagatggagagccttgtagctagcgtaaacggaatagctgaatgtgcagttgtaggaatccctgatgaaatcagaggtctcactcccgttgtattcgtttcattgaagaatgatatatcagcgacaggcattgaagaaactatatcaaagatgattgaggagggcattgggaagtttgcagcaccgtccgatgtaatcgttgttgaagagatgccgaagaccccaagtggaaaaatactcagaaggttccttagggagatctatgtttatggagacattgtcggagaccgtaccggccttgaaaatccggcgtctatagaaaaattgaaatcagtattgcgaaatagaatagaaagtaggaataagtga

SEQ ID NO: 1020 - protein, 641 aa, Thermoplasma volcanium
MTYDLPNFVLNSKEILRIDEKKRDEFKRLLEFSKNDPNGFWESIASDLVWRKKWDTVMEGRLPEFSFFKGGYLNVAENLIDRHIEAGEANRAALIFESETGRSAVYTYAMLQSIVNKLSNALRSLGVKKGDRVSIFLPNIPETLFSVLACYRVGAVFNTIFSGFSTQALENRLKHFNPMIIITADGTYRRGKLVELKKKVDEIRDSNFEKIIVVKNVGLNLNFTERDLDFYSLIAKFNDKDKGGDVEANEPGIVFYTSGTTGKPKGVVLSGAGFLVNNYVYAKHHLDLSKSDVLWCTADIGWLTMHIWGIIGALANGSTTLFYEGAIDYPSQDRFYEIVQKYKVTKIFTAPTLIRMLMKYGFPEGKYDVSSVRVIGLVGEPLNPEAWHWMNKHFRSAYINNTWGQTETAGTPLAGSAFATGMKPGSSGIEFLGASLDVVDDEGNPVLERPGNLVIKKPFPMMIRDLWNEHERFLKEYYGKLEGLYFTYDVAVKDKDGHFWVLGRNDDVINVSGHRLSTMEMESLVASVNGIAECAVVGIPDEIRGLTPVVFVSLKNDISATGIEETISKMIEEGIGKFAAPSDVIVVEEMPKTPSGKILRRFLREIYVYGDIVGDRTGLENPASIEKLKSVLRNRIESRNK

SEQ ID NO: 1021 - DNA, 1953 bp, Thermoplasma volcanium
  CDS (1)..(1953)
atggacatagaaggagaaaagtccgttcttccgacagaagaggtgtatcaccctgatatgaatttgtacaagagggcttacgatgattcgttcaaaaatatggaggctttttggtcgtttaatgctgaaatactaacttggtacaaaaaatgggatagggtgctagatgatacaaaaaagccattctataggtggtttgtaggcggtaaattaaacatgtcttacaactgcgttgacagacacatagagcaacacagaaggaataaggcggcatatatatgggttggtgagaaaggagatgaaaagatagtcacttacgatggattgtttcgcaggataaacaacttagctaaagctttaataaacttaggcataaaaaagggtgacaggattgtcctgtacatgccaatgataatcgaggcaccagttgctatgcttgccgcggctaggattggtgccgttttttctttcgtattcgccggttttggagctggtgctctggcagagaggataaatgattcaaaagctgtgctactcataaccgcagatggaagtttcagaaatggaaaggtggttgaactaaagaaaatagccgatgaagctctggaaatgacatctacgattagaaatgtcatagttgtaaagcacgcaggcaacaatgttgatatgaacgaagacagagacatatggtatcacgaggtagtaggggattcttacacatacgtagagccggtccaaatggatgccaacgatccgttgtttatactctacacgtcaggcacaacagggaagccaaaaggagctgtgcatagcacgggagggtatggtgtttgggttgcgaatactttgaagtgggcctttaatccagatgaagacgatagatggtggtgtgctgcggacatcggttggattacaggccacagttatatcgtatttgcacccttgatattaggtcttaccagcataatgtatgaaggatcaataacttatccggaacccgatagagtatgggaaattatagaaaaatacagaataaacatactctacacatcccctacagctataaggatgctcatgaagtttggcgataaatacccgaagaggcatgacttatcaacgctaaaggttctcggtaccgttggcgaacctataaacccttcagcatggagatggtattacgaaacgatagggaactctaagtgccccataatagatacgtactggcaaacagagactggaggctttatgattgctccacaaagggcgctagggcttcctcctttaaaacctggatcagcaacattcccgcttccaggcgtagatccagcgatactcaacgataggggtgaagaagttaaggataatgagaaagggtacatagtgtttagaaggccttggccaggaatgctgatgacagtaaacaatgacgatgagagatacgtgaagacgtatttttccaagttctatggctattacttttgcggagattacgccataaaggattccgacggttattactggctcctaggaagggctgatgaagtcctaaacgtagcaggacatcgcctcggtacaatagaagttgaagacgcattagtttcaacagggcttgccgttgaagcagcagcttttggtaaacctgatcctataaagggggaagttatagtggccttcattgtacccaaacaaattcaggctgaccgaagggaattaatttctgaaattagaaagcgaattagatctgatttagggccaatttacgtaccagacgagatacatattgtaaaactgcttccaaaaactagaagcggcaagataatgaggagagttgtaaaggctgttgcactggatcagataccaggagatctaaccactcttgaggactcaagctctgtcgatgagattagatcagcaatagaggcctttaggaaggaggcaaagggaggggagtga

SEQ ID NO: 1022 - protein, 650 aa, Thermoplasma volcanium
MDIEGEKSVLPTEEVYHPDMNLYKRAYDDSFKNMEAFWSFNAEILTWYKKWDRVLDDTKKPFYRWFVGGKLNMSYNCVDRHIEQHRRNKAAYIWVGEKGDEKIVTYDGLFRRINNLAKALINLGIKKGDRIVLYMPMIIEAPVAMLAAARIGAVFSFVFAGFGAGALAERINDSKAVLLITADGSFRNGKVVELKKIADEALEMTSTIRNVIVVKHAGNNVDMNEDRDIWYHEVVGDSYTYVEPVQMDANDPLFILYTSGTTGKPKGAVHSTGGYGVWVANTLKWAFNPDEDDRWWCAADIGWITGHSYIVFAPLILGLTSIMYEGSITYPEPDRVWEIIEKYRINILYTSPTAIRMLMKFGDKYPKRHDLSTLKVLGTVGEPINPSAWRWYYETIGNSKCPIIDTYWQTETGGFMIAPQRALGLPPLKPGSATFPLPGVDPAILNDRGEEVKDNEKGYIVFRRPWPGMLMTVNNDDERYVKTYFSKFYGYYFCGDYAIKDSDGYYWLLGRADEVLNVAGHRLGTIEVEDALVSTGLAVEAAAFGKPDPIKGEVIVAFIVPKQIQADRRELISEIRKRIRSDLGPIYVPDEIHIVKLLPKTRSGKIMRRVVKAVALDQIPGDLTTLEDSSSVDEIRSAIEAFRKEAKGGE

SEQ ID NO: 1023 - DNA, 1959 bp, Rhizobium loti
  CDS (1)..(1959)
atggctgccgaagtaccgctctggaccccgacgcaagaccggatcgacgcttcgccattgacggctttcctgaaggccgcggaggcgaaagccggcgccacattcgcctcttatgccgatcttcaccgctggtcggtcgaggatcgcgaggggttctggagcctggtctgggatttctgcggcatcgccggcgaaaagggcgagcgcctgctcgccgatggcgacaagatgccgggtgcctccttctttcccgacgcgacgttgaatttcgccgagaacctgttgaagaagaccggcgcgggcgaggcgatcgtcttccgcggcgaggacaaggtcgagcggcggctgtcctggaaccaactgcatggcctggtttcgcgcctgcagcagcttttcctgtcgctcaaggtcaagaagggcgaccgcattgccgcgatgatgcccaacatgcccgagacagtcgctgccatgctggccgccgcctccatcggcgcggtgtggtcatcctgctcgcccgacttcggcgagcagggcgtgctcgaccggttcggccagatcgagcccgtcatcttcatcgggcctgacggctattggtacaatggcaaggcgatcgaggtcgctgacaaggtcgccgcggtcgcggccaagctcggcagtgtccgcaaggtgctgcttgtcgattatctcggtacttcggccgatgtggcggcaaccatcgacaaggcggtggcgatggaagaggcgctgtcgcccttcgccgccaagccagtcagcttcgagcctctgccgttttcgcatccgctctacatcctgttttcatcaggaaccaccggcatccccaaatgcatcgtccattcggccggcgggacgctgatccagcatgtcaaggaacaccggctgcatgccggcctcgtcgacggcgaccgcttcttctacttcaccacgtgcggctggatgatgtggaactggctggtgtcgggcctggcttccggggcgacgctgctgctctacgacggctcgcccttctaccccgacggcaatgtgctgttcgacttcgtcgatgccgagaagatgaccttcttcggcacctcggccaagttcatcgattccgtgcgcaaggccggcctcaagccgatccgcagccatgacctgtcgaccgtgcgggcgatctcctccaccggttcgcccctgtcgcccgaggatttccgcttcgtctacgaaggcatcaagaaggatgtgcatctcgcctcggtttccggcggcaccgacatcgtctcctgcttcgtgctcggcgtgcccaaccagccggtgtggaccggcgagatccagggaccaggcctcggcctggccgtcgatgtctgggacgatgacggcaagccgatccggcaggaaaagggcgaactggtctgcaccaaggcgtttccgtcgatgccgatcggcttctggaacgatcccgaaggcaagaaataccaggcggcctatttcgagcgtttcgacaatgtctggtgccatggcgatttcgctgagtggacggcgcatggcggcatgatcatccatggccgctcggacgccaccctcaatccgggcggggtgcgcatcggcacggcggagatctacaaccaggtcgaacagatgccggaaatcctggaggcgctgtgcatcggccaggatttcgacaatgacgtgcgtgtcgtgctgttcgtgcggctggccgcgggcgtcgaactggacgaggatctggaaaaacgcatccgcgccaagatccgcagcggtgccagcccccgccatgtcccggccaggatcgtcgcggtcacggatattccgcgcaccaagtcgggcaagatcaccgaactcgccgtgcgcgacgtcgtgcatggccgcgccatcaagaacaaggaagcgctcgccaacccggaagcgctggagctgttcaggaacctgccgcagcttgccgaatga

SEQ ID NO: 1024 - protein, 652 aa, Rhizobium loti
MAAEVPLWTPTQDRIDASPLTAFLKAAEAKAGATFASYADLHRWSVEDREGFWSLVWDFCGIAGEKGERLLADGDKMPGASFFPDATLNFAENLLKKTGAGEAIVFRGEDKVERRLSWNQLHGLVSRLQQLFLSLKVKKGDRIAAMMPNMPETVAAMLAAASIGAVWSSCSPDFGEQGVLDRFGQIEPVIFIGPDGYWYNGKAIEVADKVAAVAAKLGSVRKVLLVDYLGTSADVAATIDKAVAMEEALSPFAAKPVSFEPLPFSHPLYILFSSGTTGIPKCIVHSAGGTLIQHVKEHRLHAGLVDGDRFFYFTTCGWMMWNWLVSGLASGATLLLYDGSPFYPDGNVLFDFVDAEKMTFFGTSAKFIDSVRKAGLKPIRSHDLSTVRAISSTGSPLSPEDFRFVYEGIKKDVHLASVSGGTDIVSCFVLGVPNQPVWTGEIQGPGLGLAVDVWDDDGKPIRQEKGELVCTKAFPSMPIGFWNDPEGKKYQAAYFERFDNVWCHGDFAEWTAHGGMIIHGRSDATLNPGGVRIGTAEIYNQVEQMPEILEALCIGQDFDNDVRVVLFVRLAAGVELDEDLEKRIRAKIRSGASPRHVPARIVAVTDIPRTKSGKITELAVRDVVHGRAIKNKEALANPEALELFRNLPQLAE

SEQ ID NO: 1025 - DNA, 1689 bp, Rhizobium loti
  CDS (1)..(1689)
atgcttttcgagaaggatagctttgaggaggtccgccgatcgtttcagtggtctattcctgagcggttcaatatcggcgtcgacatctgcgacaagtgggctgaggcagacccaactcgtctcgcgatagttgacgtcgatccggctggttttacgcgcgaatacacattttccgacctgcgcacgatgtcgaacagattagcgaatgcactttttgggcatggcgttggccgacaggtgggtgaaacgggcgaccgagtgggtgtgttgcttcctcaacgtgtcgagactgcggtagcccatatcgccgtgaccaaactcggatgtgtgtcgataccacttttcaccctgttcggtccggaggcgctcgagcaccgacttcgcgactcaggcgcgagggtagtcattaccgaccgtgccggcgccgaacgtgtcgcaagcatccggtctcgcgtgccttcgatagaactcgtcgtctgcgtggacggccggggggagggcgacgaagtctcattccaagagatgtgttctgagcagtcggacacgtttatccccgtcgatactcactccgatgacccggcgatcctcatctatacgtctggaacaaccggcaatcccaagggtgcgctacatgctcatcgcgtcctgctgggacatctgccaggtgtggagataagtcatgactttctgccgaagcccgacgaccgcttctggacacctgccgattgggcgtggattggaggactgctcgacgtactgatgcctgcgcttcatcatggtattccggtcgtcgcctgccgcttttcgaagttcacgaccgaggcggcgatcaccctgatccgctcgcagaggatcagaaacgtattcctcccacctaccgccctgaagatgctgaaactcaagcctgctgaggaatgctcggggctcgacctccgttccgtcgccagcgggggagagacgttgggcgccgagctgatccagtggggcaaggacgcgttaggcgtgacgatcaacgaattctacggccagacagaatgcaacatgatcgtctcgtcttgtgcggccctggagccgcccgcactaggatctatgggacggccggtccctggacatgatgtcgacgtcattgatccggtatcgagactgagacagcctgcaggcgtggagggggctattgcggcactcgctcccgaccccgtcatgttcctagggtactggaacaacccggatgccactcgggagaagttcattcatggacccgagggccgatggctggttaccggagaccgaggtgtcagggacaatgatggacgtttgcgctttgtcggacgagacgacgatgtcatcggctccgcggggtatcggatcggtcccgctgagatcgaagattgcctgctcggtcacccgtcagtgcgtctggccggtgcggtcggcaagccggatgaaatcaggggttccgtcgtggcggcgtacgtcgtcctgcgcgaaggattcagtccttcgcaaaaccttgcagaggacatcgcggcacacgtgaaatcgcgcctcgccgcgcatgaatatccgcgggtcgtcaggttcatagacgagatgccgatgaccaccaccggcaagatcatccggggagcgctcaggaagattgcgcaggaagaagccgctctcgaagcacgatccaggcagaaagattaa

SEQ ID NO: 1026 - protein, 562 aa, Rhizobium loti
MLFEKDSFEEVRRSFQWSIPERFNIGVDICDKWAEADPTRLAIVDVDPAGFTREYTFSDLRTMSNRLANALFGHGVGRQVGETGDRVGVLLPQRVETAVAHIAVTKLGCVSIPLFTLFGPEALEHRLRDSGARVVITDRAGAERVASIRSRVPSIELVVCVDGRGEGDEVSFQEMCSEQSDTFIPVDTHSDDPAILIYTSGTTGNPKGALHAHRVLLGHLPGVEISHDFLPKPDDRFWTPADWAWIGGLLDVLMPALHHGIPVVACRFSKFTTEAAITLIRSQRIRNVFLPPTALKMLKLKPAEECSGLDLRSVASGGETLGAELIQWGKDALGVTINEFYGQTECNMIVSSCAALEPPALGSMGRPVPGHDVDVIDPVSRLRQPAGVEGAIAALAPDPVMFLGYWNNPDATREKFIHGPEGRWLVTGDRGVRDNDGRLRFVGRDDDVIGSAGYRIGPAEIEDCLLGHPSVRLAGAVGKPDEIRGSVVAAYVVLREGFSPSQNLAEDIAAHVKSRLAAHEYPRVVRFIDEMPMTTTGKIIRGALRKIAQEEAALEARSRQKD

SEQ ID NO: 1027 - DNA, 1929 bp, Rhizobium loti
  CDS (1)..(1929)
atggttcctgggaggttgccgatggcttcacgctatcacgaggtctatgacggctggaaacgcgacccggaaaaattctgggcggacgccgccggcgccatcgactggtattcgccctgggacaaggtgttcgacgctgacgccggcgtctatggccgctggtttaccggcgcgacatgcaacacctgttacaacgccatcgaccggcatgtcgcccgcgggcgcgccgaccagatcgcactgatccatgacagcgccatcaccggaacggtgaaaaaattcacctatgccgaactcaagcgcgaggtggtggcgctgacctcggtgctgaagaaccggggcatcggcaagggcgaccgcgtcatcatctacatgccgatggtggcggaggcggccatcgccatgcttgcctgcgcccgcatcggcgccgtgcattcggtcgtcttcggcggctttgcctcgcatgaactggccacccgtatcgacgacgccaagccgaagctgatcatctcggcctcctgcggcctggagccgggccggatcgttgcctacaagccgctgctcgacaaggcgatcgagatgtccggccacaagccggacgcctgcctgatcctgcagcgcgaccagctgcgctgcgagctgaaggagcatttcgacatcgactatgccgacgccgtcgcgcgcgaacgggcggccggcgccaatgtcgactgcgtgccggtgctggccaccgacccgctctacatcatctacacgtcaggcacgaccggccagccgaagggcatcgtgcgtgacaatggcggccacatggtcgcgctgaaatggacgatggaaaacgagttcggcgtcaagccgggcgaagtgttctgggcagcgtccgatgtcggctgggtcgtcggccattcctacatcgtctacggaccgctgctgcatggcagcaccagcgtcctgttcgaaggcaagccgatcggcacgcccgacgccggcacctactggcgggtcatctcggaccatggcgtggtcgcgctgttcaccgcgccgacggcgttccgggcgatcaagggccaggaccccaagggcgagttcgttcccagatacgatctgtcgaaattccgcacgctgttcctcgccggcgagcgcgccgatcccgagaccatcaaatgggcggagcagaagcttaacgtgccggtgatcgaccactggtggcagaccgagaccggttcgccgatgaccatcaatcccgcgggacttggcctgctgccggtgaaatacggttcgcccggcgtaccgatgccgggctacgacatccgcgtgctggacgatgccggccacgaagtgccgcgcggcacactcggcaatgtcgtggtcaagctgccactgccggccggctgcctgccgacgctgtggaacgccgacgcccgcttccgccaagcctatctcgacgagtttcccggcttctacaagacggcggacgccggcatgatcgacgaggacggctatctctacgtgatggcccgcaccgacgacatcatcaatgtcgccggccaccggctgtcgaccggcgccatggaagaggtgctggccgctcatcccgatgtcgccgaatgcgccgtcgtcggcatcgccgatgctatgaaggggcaaattccgctcggcttcgtggtgctgaacgccggtgtcgcgcgcggcggcgacgtcatcgagaaggaggtcgtggcactggtgcgcgagcgcatcgggccggtcgccgctttcaaaacggtggtgacgatcaaacgcctgcccaagacgcggtcgggaaagattctgcgcggcaccatgcagaagatcgccgacaaggaggcgtggacgatgccggcgacgatagacgacccggccatcctcgacgagatcaccgcagcgatgaaggcgcgcgggatcgggatttga

SEQ ID NO: 1028 - protein, 642 aa, Rhizobium loti
MVPGRLPMASRYHEVYDGWKRDPEKFWADAAGAIDWYSPWDKVFDADAGVYGRWFTGATCNTCYNAIDRHVARGRADQIALIHDSAITGTVKKFTYAELKREVVALTSVLKNRGIGKGDRVIIYMPMVAEAAIAMLACARIGAVHSVVFGGFASHELATRIDDAKPKLIISASCGLEPGRIVAYKPLLDKAIEMSGHKPDACLILQRDQLRCELKEHFDIDYADAVARERAAGANVDCVPVLATDPLYIIYTSGTTGQPKGIVRDNGGHMVALKWTMENEFGVKPGEVFWAASDVGWVVGHSYIVYGPLLHGSTSVLFEGKPIGTPDAGTYWRVISDHGVVALFTAPTAFRAIKGQDPKGEFVPRYDLSKFRTLFLAGERADPETIKWAEQKLNVPVIDHWWQTETGSPMTINPAGLGLLPVKYGSPGVPMPGYDIRVLDDAGHEVPRGTLGNVVVKLPLPAGCLPTLWNADARFRQAYLDEFPGFYKTADAGMIDEDGYLYVMARTDDIINVAGHRLSTGAMEEVLAAHPDVAECAVVGIADAMKGQIPLGFVVLNAGVARGGDVIEKEVVALVRERIGPVAAFKTVVTIKRLPKTRSGKILRGTMQKIADKEAWTMPATIDDPAILDEITAAMKARGIGI

SEQ ID NO: 1029 - DNA, 1680 bp, Rhizobium loti
  CDS (1)..(1680)
atggggagatgggcgccaccagggaggactgacatgaccggcttgccacgctacgaggacgccgttgcgcgcttccgcatcgaggatgagatcgccaggctcgatggcgatcccctcaccggcatcaacggctatgtcgaatgctgcggccgccacaccgggcagaaccggctggcgctgcgcgcgatctcggccgggggcgaactccggctgttcagcttcgacgacctcgctgatatgtcgggccgcgtcggcaacctgctcaaggatgcaggcgtcgggcccggcgatgtcgtcgccggcatgctgccgcgcattcccgaactcatagcgctcatcctcggcacctggcgcatcggcgccatctaccagccgctgttcaccgctttcggcccgaaggcgatcgagcatcggctcggctatagcggcgcgaaattggtggtgaccaatccggccaatcgcggcaagctcgacgagatgaagacctgcccgccgatcgccaccattcttggccccggcgatcccctgcccgctggcgacatcgacttccgcgccgcgcttgccgccgcctcccctgactgcgaacccgtgatgcgcaaaggcgaggacctgttcatgatgatgtcgacctcgggcacgacgggcctgcccaagggcgtgccggtgccgctcaacgcgctgctctccttcggcgcctatatacgcgatgcgatcgggctgcgccccgacgacgtcttctggaatatcgccgatcccggctgggcctatggcctctactacgccatcactggcccgctgctgctcggcatcgccaccaccttcaacgagggcgccttcaacgctgggaacacctatgacgtcatcgagcggctcggcgtcaccagccttgccggctcgcccaccgccttccgcctgctgctcgccgaagggcctgaggccgctgcccgcatcaagggccggctgcgcgtggtgagcagcgccggcgagccgctcaacccggaagtgatccgctggttcgacgctcatctcgccgcgcccattcacgaccattacggccagaccgagaacggcatgatggtcaacaaccaccatggcctcgcgcatgccgtccgcgcgggctcggccggctttgccatgccgggttatcgcatggtggtgctggacgatgaaggcaacgagctcggcctcaatcagcccggcatcctcgccgtcgatgtcgccaattcgccgctgcgctggttcgacggctaccaccaggccgagacgccggcgatcgcaggcggctactaccgcaccggcgacacggtggaatacgagcccgacggctcggtctcctttatcggccgcgccgacgatgtcatcacctcgtcgggctaccgcatcggccccttcgacgtcgaaagcgcgctgatcgaacatcccgcggtcaacgaggcggcggtggtcggcgtgcccgacccgcagcgcaccgagatcgtcaaggccttcgtcatcctggcgccggcctaccagggcagcacggaactcgccgaagaactggcgcagcatgtccgcaagcggctctcggcccacgcctacccgcgcgagatcgatttcgtcgccgaattgccgaagacgccgagcggcaagatccagcggttcctgctgcggcaggcggaggtggagaagcggaaggggtag

SEQ ID NO: 1030 - protein, 559 aa, Rhizobium loti
MGRWAPPGRTDMTGLPRYEDAVARFRIEDEIARLDGDPLTGINGYVECCGRHTGQNRLALRAISAGGELRLFSFDDLADMSGRVGNLLKDAGVGPGDVVAGMLPRIPELIALILGTWRIGAIYQPLFTAFGPKAIEHRLGYSGAKLVVTNPANRGKLDEMKTCPPIATILGPGDPLPAGDIDFRAALAAASPDCEPVMRKGEDLFMMMSTSGTTGLPKGVPVPLNALLSFGAYIRDAIGLRPDDVFWNIADPGWAYGLYYAITGPLLLGIATTFNEGAFNAGNTYDVIERLGVTSLAGSPTAFRLLLAEGPEAAARIKGRLRVVSSAGEPLNPEVIRWFDAHLAAPIHDHYGQTENGMMVNNHHGLAHAVRAGSAGFAMPGYRMVVLDDEGNELGLNQPGILAVDVANSPLRWFDGYHQAETPAIAGGYYRTGDTVEYEPDGSVSFIGRADDVITSSGYRIGPFDVESALIEHPAVNEAAVVGVPDPQRTEIVKAFVILAPAYQGSTELAEELAQHVRKRLSAHAYPREIDFVAELPKTPSGKIQRFLLRQAEVEKRKG

SEQ ID NO: 1031 - DNA, 1686 bp, Pseudomonas putida
  CDS (1)..(1686)
atggttcaactccaaaaacaagaaaccaggagtccgacgatgcgtgattacgccgaggccgctcgagcgttcgaccctgcccaggccgctagcgcggcgctgcatggccacctcgaagccctcaatgcctgtgtcgaatgctgtgaccgccatgccggtgacggcaagctggcgctgatccacgaagaccgcgacgacaacagcgcacgctacagttttgatcagctcaaggcacaggcggcccgctttgccaatgtgctcaaggcgcagggcgtgggtgcaggggaccgggtggcgggcttgatgccgcgtactcccgagttgctggtcaccattctcgccacctggcgtctcggtgccgtgtaccagccgctgttcaccgcgttcggccccaaggccatcgaacaccgccttgaacagtcccacgcccgcgttatcgtcaccgacagccacaaccgtgccaagctggatgaggtgcaggcctgcccatcgatcatcacggtcagggcccgcagtggcgagctggattttcagcaatgcctggatgctgcctcgccggtatgtgaaccggtcatgcgctcgggcaacgacccgtttctgctgatgttcacctccggcaccaccggcccggcgaaacccctggaagtgccattgcatgccattgtcgcgttccagggttacatgcgggatgccatcgacctgcgccccgaggacaacttttggaacctggccgacccgggctgggcctacggcctgtattacgccgtcaccggcccattgtcgctgggccatgccaccaccttctacgatggcccgttcagcgttgaaagctgtgcccaggtaatcgacaagctgggtatcacaaacctggctggctcgcccacggcgtatcgtttgttgattgccgcgggcaaggcattttcggcaccggtcaaaggccggctgcgtgtggtcagcagcgccggagaacccctcaacccggaggtgatccgctggttcgccgaggaactggacgtgaccattcacgaccactacggccagaccgagttgggcatggtgctgtgcaatcatcatggtttgttgcatccggtgcacctgggctcggccggcttcgccatccccggccatcgcatcgtggtgctggatgcccaaggtaacgaactgccagctggccagccgggcatcctcgcggttgaccgcgagcagtcgccattgtgctggttcgccggctaccacggccaggcaaccaaggccttcgtcggcaagtaccacctcagcggcgacacggtggagctgaaccaggatggcagcatcagtttcgttggccgcagcgacgacgttatcactacctccggttaccgagtcggcccgttcgatgtggaaagtgcattgatcgagcacccggcggtgatcgaggcagcggtgattggcaagccggaccccgagcgtactgagctgatcaaggccttcgtggttttggccaacggccatgtgggcagcgtcgagctggaagaaaccttgcgccagcacgtgcgccagcgcctctacgcgcatgcctaccccagggaaatcgaattcgtcagcgagctgcccaagaccccgagcggcaagctgcaacgcttcatcctgcgcaaccaggaagtcgccaaacaacaagcgcaacaggccacccctgccagcgtctga

SEQ ID NO: 1032 - protein, 561 aa, Pseudomonas putida
MVQLQKQETRSPTMRDYAEAARAFDPAQAASAALHGHLEALNACVECCDRHAGDGKLALIHEDRDDNSARYSFDQLKAQAARFANVLKAQGVGAGDRVAGLMPRTPELLVTILATWRLGAVYQPLFTAFGPKAIEHRLEQSHARVIVTDSHNRAKLDEVQACPSIITVRARSGELDFQQCLDAASPVCEPVMRSGNDPFLLMFTSGTTGPAKPLEVPLHAIVAFQGYMRDAIDLRPEDNFWNLADPGWAYGLYYAVTGPLSLGHATTFYDGPFSVESCAQVIDKLGITNLAGSPTAYRLLIAAGKAFSAPVKGRLRVVSSAGEPLNPEVIRWFAEELDVTIHDHYGQTELGMVLCNHHGLLHPVHLGSAGFAIPGHRIVVLDAQGNELPAGQPGILAVDREQSPLCWFAGYHGQATKAFVGKYHLSGDTVELNQDGSISFVGRSDDVITTSGYRVGPFDVESALIEHPAVIEAAVIGKPDPERTELIKAFVVLANGHVGSVELEETLRQHVRQRLYAHAYPREIEFVSELPKTPSGKLQRFILRNQEVAKQQAQQATPASV

SEQ ID NO: 1033 - DNA, 2582 bp, Bos taurus
  CDS (1)..(2028)
atggcggcgcgctgcttgggccgcggcgtcgggcggctactgggcggcctccgcggggttggggtgcgggcgctggcggccccccggctctggagcagcgcctccgcctccgtagcgccacccagctcctaccaagagcgaatcgcgcttgcagctcgcgagcccgccgccttctgggggccactggcgcgggacgctctcgtgtgggacaccccttaccacacggtgagcgactgcgacttccgcagcggcaggatcagctggttcctgggaggccagttaaacgtgtctgtcaactgcttggatcagcacgttcagaagtccccagagagcatcgctttgatctgggagcgagatgagcctggaactgaagtgaagatcacctacagggagctactggagaccacgtgccgcctggccaacacactcaagaggtatggagtccgccgaggggaccgagtggccatctacatgcctgtctccccactggctgtggctgccatgctggcctgtgccaggatcggagccatccacaatgtcatctttgctggcttcagtgtggggtccttggctgggaggatcaacgatgcccaatgcaaggtggttattaccttcaaccaaggactccggggagggcgcgtggtgcagctgaagaagatcgtggacgaagccataaaggtctgcccatccgtccagcatgtcctggtggctcacaggacagacaacaaggtccacatggggcatctggatgtttcccttgagcaggagatggccaaggaggagccggtatgtgccccggagagcatgggcagtgaggatatactcttcctcctgtacacctcggggagcaccgggaagcccaaggggctcgtccacacccaggcgggttacctgctctatgctgccctgacgcaccggcttgtgtttgactaccggccaggtgacatcttcggctgcgtggctgatatcggctggatcacgggacacagctatgtggtgtacgggcccctctgcaatggagcgaccagtgtcctttttgagagcactccggtttaccctgatgcgggtcggtactgggagacggtgcagaggctgaagatcaatcagttctatggcgccccgacagcctaccggctgctgctgaagttcgaggactcctgggtgaagaagtatgaccgctcttctctgcggaccctgggctcagtgggagagccgatcaaccacgaggcctgggaatggctgcacagggtggtgggggacagccggtgcacgctggtagacacctggtggcagacagaaacggggggcatctgcatctctccacggccctcagaggagggggcagagatcctgccctgcatggcgatgaggcccctgtttggcattgttcccgttctcatggatgagaagggaaatgtcctggagggcggagacgtgtctggggctctgtgcctgtcccaggcctggccgggcatggcccggaccatctacggagaccaccagcgattcctggacgcctacttcgagacctaccctggctactacttcacaggagacggggcttacagaacagaggagggctactacgagatcactgggcgcatggacgacgttatcaacatcagtggccaccggctggggaccgcggagattgaggacgccatggctgaccaccccgcggtgcccgagaccgctgtcattggctacccgcatgacatcaagggagaagctgccttcgccttcgttgtgttgaaagatgatgtgggtgatgtggacgtggtggtgaaggagctccggtcagtggtggccgacaagatcgccaagtacgcagtgcccgatcaggtcctggtagtgaagcgtcttccaaaaactcggtctggaaaagtcatgcggaggctcctgaggaagattgtcatgggccgagctcaggacctgggggacaccaccaccctggaggaccctggcgtcatcacggagatcctgagtgcctaccaggagtacaaagacaagcggggaggtgccaagtgatggctctgctgagaccaggcccctaatgcgtgctcctagagcacagctcccgagtcggcttgttcctagacaccccagcagaacccaggctgccctcctcgcgaagcctgaagtccccgcctcccctcctggggacccacgacaggtcctcgcccagggcgagcttcctcccgcttgtcccgaatctggtttcctggtgaaaagtccatccccctgtccccttgacagcacaggaaggtggagcccctgtgtctgctcaggtggactgggagcaaacagcagtcatgtttcctccagatgtttctagaaacaaaaggtgaagattttatttttatacttttatattttagaagaaacatggtgcccacacacgtgcagtgtatgctgtacttgtacacactcttcttaacagttatgaaaagctccttttttgcctccgctcgtggggaagtgtggcgggctggagggtgcaatttgggttactgtttggcttgttggaaatttaagttggaaatgtttgtgcctctgtcttaacacagctatcttgaaacctc

SEQ ID NO: 1034 - protein, 675 aa, Bos taurus
MAARCLGRGVGRLLGGLRGVGVRALAAPRLWSSASASVAPPSSYQERIALAAREPAAFWGPLARDALVWDTPYHTVSDCDFRSGRISWFLGGQLNVSVNCLDQHVQKSPESIALIWERDEPGTEVKITYRELLETTCRLANTLKRYGVRRGDRVAIYMPVSPLAVAAMLACARIGAIHNVIFAGFSVGSLAGRINDAQCKVVITFNQGLRGGRVVQLKKIVDEAIKVCPSVQHVLVAHRTDNKVHMGHLDVSLEQEMAKEEPVCAPESMGSEDILFLLYTSGSTGKPKGLVHTQAGYLLYAALTHRLVFDYRPGDIFGCVADIGWITGHSYVVYGPLCNGATSVLFESTPVYPDAGRYWETVQRLKINQFYGAPTAYRLLLKFEDSWVKKYDRSSLRTLGSVGEPINHEAWEWLHRVVGDSRCTLVDTWWQTETGGICISPRPSEEGAEILPCMAMRPLFGIVPVLMDEKGNVLEGGDVSGALCLSQAWPGMARTIYGDHQRFLDAYFETYPGYYFTGDGAYRTEEGYYEITGRMDDVINISGHRLGTAEIEDAMADHPAVPETAVIGYPHDIKGEAAFAFVVLKDDVGDVDVVVKELRSVVADKIAKYAVPDQVLVVKRLPKTRSGKVMRRLLRKIVMGRAQDLGDTTTLEDPGVITEILSAYQEYKDKRGGAK

SEQ ID NO: 1035 - DNA, 1800 bp, Thermoplasma acidophilum
  CDS (1)..(1800)
atggcatctgaattggacgggttcaagaaatgggataaagatcttgaaggtgatcttggaaaattcgaatttttcgtcaatggatacagcaatgtcagttttaactgtattgacaggcatgcaatgaaaacacctcagaagactgctataatatggctgagtgaggacggtttacggcaatcgataacctacagagatctcatgctgcagaccgcgaaatttgcgaaaggattggcagatgaaggcgtaaaaatgggagatgtcgtgacgatctttctccccaatagaatagaggcattcatagctgcccatgcctgcttcagaattggggcgatatataacataatattttctgggttttctgctaaagcccttctggataggatgaaggaaactaacccaaaggtggtaataaccacagacagcagtctacgccggggaagaaaaatcaacctgaaggagaccctagactcaataatcagtgaagtgccgtccgtgaagaaagtcatcataatcaagagagacggcaagcacgatctgaatctgggtgaaagggaagtatactacgatgactttatgtcaggaataacgggatatgccgaaccggtgcctatcgaggctaatgcacctggttttgtcatatacacttctgggacaacggccaagcccaagggcgtggtccattccggcataggttttcttgttggatcctatcacaatgtaaaatatgcgcttgatcttgggcctgaagatatcttctggtgtaccgccgacgtgggatggctgacgttcccgatcttcgaactcgtgggcggcctggcacacggtgcaacggtcattgcatacgagggggcgctggattaccctgacataaggcatttctacagcattatacaggatttcaaggttacgaaattgttcacggcgccaacctttttgagaatgcttgccaggaatggatcggacgtggcttctggatatgacctgagcagcctgaggctgatatcgctggttggggaaccgctagacgtgaagacatggaaatgggtgtacaacgacctcgggcacgggaggatagagataaacaacacctacggccagacggaaacagggagcgcatggacttcctctcttgtgggcgttaccggtgcaaggcccggttcatgcgggcttccactcccaggtcactcatttgatatacttgacgaaggtggtcaaccagttgaaaatggaaggatagggacgctcgtattgagaaagccattcccttcacttgcaagaggaatatggaaagacccacagagatatttcaaggaatatctttctgttttcccggggaattattgtacctatgattctgccgtccgtgacaggtatggccatatatgggtactcggaagaactgacgatgtgataaatgtttccgggcacaggatctccacaatggagatggaagatgcaataatgtctataccggaggtttctgaggctgccgttgttggtgtcgatcatgctataaaaggcatgtcaactgcggtatttgtcaccctcggcaacggaattgatttgccagcagatctaggaaaaaggatacaggacgaaattgctagaaggataggtaattatgccaagcctgaaagtgtatacgtgatcccagagatgccaaagacgcgtagcggaaagataatgcgaagactgttgcgagagatcgtaatcagcaataaagtgagcggtgatctgacaggcctcgaggatcccggtgtgatttcgcgcatactgcaggagatgaagcaggcttaa

SEQ ID NO: 1036 - protein, 599 aa, Thermoplasma acidophilum
MASELDGFKKWDKDLEGDLGKFEFFVNGYSNVSFNCIDRHAMKTPQKTAIIWLSEDGLRQSITYRDLMLQTAKFAKGLADEGVKMGDVVTIFLPNRIEAFIAAHACFRIGAIYNIIFSGFSAKALLDRMKETNPKVVITTDSSLRRGRKINLKETLDSIISEVPSVKKVIIIKRDGKHDLNLGEREVYYDDFMSGITGYAEPVPIEANAPGFVIYTSGTTAKPKGVVHSGIGFLVGSYHNVKYALDLGPEDIFWCTADVGWLTFPIFELVGGLAHGATVIAYEGALDYPDIRHFYSIIQDFKVTKLFTAPTFLRMLARNGSDVASGYDLSSLRLISLVGEPLDVKTWKWVYNDLGHGRIEINNTYGQTETGSAWTSSLVGVTGARPGSCGLPLPGHSFDILDEGGQPVENGRIGTLVLRKPFPSLARGIWKDPQRYFKEYLSVFPGNYCTYDSAVRDRYGHIWVLGRTDDVINVSGHRISTMEMEDAIMSIPEVSEAAVVGVDHAIKGMSTAVFVTLGNGIDLPADLGKRIQDEIARRIGNYAKPESVYVIPEMPKTRSGKIMRRLLREIVISNKVSGDLTGLEDPGVISRILQEMKQA

SEQ ID NO: 1037 - DNA, 1944 bp, Thermoplasma acidophilum
  CDS (1)..(1944)
atggaaagcgaaaagggaacattacccatgaacgaggtctacaaccccggcatgaacgtgtacagcgagatatacaggaaatccctggaagatcctgagaatttctgggcaaaacaggccgagatactgacatggtattccaaatggaacaagatcctcgacgattcaaagaagccgttttacagatggtttgtgggcggaaagctcaacgtgtcgtacaacgcagttgacaggcacctggagcagcacaggaggaataaggccgcatacatatgggttggcgaaaatggtgaagaaaagatagtgacgtacgatggactttacaggaggataaacaacctggccaaagccctcctgaacctcggaataaagaagggagacaggatagtactgtacctgcccatgataatcgaagcgcccgttgccatgctggccgcggccaggataggtgcagtattctctttcgtcttcgcaggcttcggtgcaggtgcactggcagagaggataaacgattcaaaggccgtactgctgataactgcagatggaggtttcagaaacggcaaggtggtggagctaaagaagatagcggatgaggcccttgagatgacctccacggtcagaaacgtgatcgtcataaagcatgccaggaatgacgtgaacatggttgaggatcgggatatctggtatcatgagatcgttggtgattcgcatacgtacgttgagccggaacatatggacgcgaacgatccgctcttcatcctttacacctctggaaccactggaaaacccaaaggagctgtgcacagcaccgggggctattccgtatgggttgccagcacgctgaagtgggctttcaatcctgatgaggatgacagatggtggtgcgctgcagacataggctggataaccgggcacagctacatagtattcgctcccttgatccttggcctgacgagcatcatgtacgagggatcgataacctatcccgaacctgacaggctatgggagatcatagaaaaataccgcgtgaacatcctttacacctcccccacggctataaggacgctgatgaagttcggagagaagtacccgcagaggcatgatctgagcaccctgaaagttctcggaacggttggagaacccataaatccggctgcctggaaatggtactacgagatcatcggcaactccaggtgcccgataatcgatacgtactggcagacggagaccggaggtttcatgatcgcaccgcagaggggactcggcctgccaccattgaagcctggttctgcgacttttccgcttcctggcgtagatcctgcaatacttgatgacgcgggaaaggaggtgcgtaccggcgagaagggttacatagtcttcaggagaccgtggccaggtatgctgatgaccgtcaacaacgacgacgagagatacgtaaaaacatacttctccaagttccccggctactattactgcggcgactatgcggtgaaggacgaagatggctactactggctcctgggcagatccgacgaggtcatgaacgtatcagggcacaggcttggtacgatcgagatcgaggatgccatagtagccacaggccttgccgttgaagctgccgtcttcggaaagcccgatccggtaaagggcgaggcaatatcggcattcgttgtacccaaggacgcaaacgccgacaggcacgaactcatctcggagatacgcaagaggataagggctgatcttggcccgatatacgttccggacgagatcaggatcgtgaaactgttgccgaagacgaggagcggcaagataatgaggagggtcgtgaaagctgtggcgctgaaccagatacctggcgatctaacgactctggaggattccacctctgtggacgagatcaagagcgcaattgaagccttcaagggagaggccggaggtgagtga

SEQ ID NO: 1038 - protein, 647 aa, Thermoplasma acidophilum
MESEKGTLPMNEVYNPGMNVYSEIYRKSLEDPENFWAKQAEILTWYSKWNKILDDSKKPFYRWFVGGKLNVSYNAVDRHLEQHRRNKAAYIWVGENGEEKIVTYDGLYRRINNLAKALLNLGIKKGDRIVLYLPMIIEAPVAMLAAARIGAVFSFVFAGFGAGALAERINDSKAVLLITADGGFRNGKVVELKKIADEALEMTSTVRNVIVIKHARNDVNMVEDRDIWYHEIVGDSHTYVEPEHMDANDPLFILYTSGTTGKPKGAVHSTGGYSVWVASTLKWAFNPDEDDRWWCAADIGWITGHSYIVFAPLILGLTSIMYEGSITYPEPDRLWEIIEKYRVNILYTSPTAIRTLMKFGEKYPQRHDLSTLKVLGTVGEPINPAAWKWYYEIIGNSRCPIIDTYWQTETGGFMIAPQRGLGLPPLKPGSATFPLPGVDPAILDDAGKEVRTGEKGYIVFRRPWPGMLMTVNNDDERYVKTYFSKFPGYYYCGDYAVKDEDGYYWLLGRSDEVMNVSGHRLGTIEIEDAIVATGLAVEAAVFGKPDPVKGEAISAFVVPKDANADRHELISEIRKRIRADLGPIYVPDEIRIVKLLPKTRSGKIMRRVVKAVALNQIPGDLTTLEDSTSVDEIKSAIEAFKGEAGGE

SEQ ID NO: 1039 - DNA, 1860 bp, Thermoplasma acidophilum
  CDS (1)..(1860)
atgttctattataagccgtccgatgaagccatcgcggaaaccaatcttgggcgattcgcctcatcccttgggatgaccgtaaaggatctctacgccagggccgacagggatcctgagtggttctggccaagggttatagatgatctcggcctggaattcttcaaaaaattcgaccatgtaatggatctatccgaaggcgtaccgtgggcgaaatggttcaccggcggcagaatcaacatcgagtataatgcggtggaacgctactccgattccgaaaatactgccatagtgtatgaatctgaggatggctataaatcaaaaatgtcatactcggaactcaacagaaaggtctcggccttatcttcggccatccatgacatgggcataggcaggggggacagggtcgccatatacatgccattcaatgctaacagcgcaatagcgttctatgccgtcctccgcatcggtgccatagctgtgccgatgttctctggctacggagttgatgctgtcaggaacaggatcgaagattcaggatcgagcctcatgataacgtctgcatcgtacaggaggaagggaaaggccatcgatatgtccgcggtcgcaaggagcatcaatatgaaaacgataatggatgccgatcgcacagatttctacagatttgaagatgctgtcagcggcggcaaaaatgtgccagtggagcgtacatcgagcgaagaccctgccataatgctctacacatcaggaactactggaaagccaaagggcacggtacatgtgcatggcggcgcgctagtcaacatagccaaggaagtcaagtattacatggatctgaaagagaacgatgtgctgcactggataactgaccttggctggatgatgggcccatgggcgcttattggcacgaatgcgcttcacggcacgatattcctctacgacggcgcaatagactatcccgatcctgacaggatattcgatattgtgcacgataacggcgtaacgctccttggcctctctcccacggtggtcaggatgataaagttcaggggcacgagcaggacgttcgataccgtgagggtattcggatcaactggggagccatgggacgaggagtcatgggtatacctgttcagcatactcggccgcggccgtgcatcgatttcaaacatatccggcggcacagacataatagggtgcttccttgcctcaaatccggccataccgcagaaacccagatgcctctacaggggacttggcatgaacgcatcgatattcaacgaggagggaagggaggtatacaacacggtggggtaccttgtggcaaagtttccaagcccatcaatgacacgcgggctttggaataacagggagaagtacctcgaaacttactggtcgaaattcaaagatatatggttccatggagacttcggtgagatggatgaagaaggctacttctacctttacggtagatccgatgacgtgataaagatcgccgggaaacgcgttggccccaatgaagttgaggatatggtgatgcgtgtcagcggcgtgacggaatgcgcggtggtatcgatacctgacagcgtcaaaggggaggttctcgccgtcttctacgtcggcgaaccgggcctgagcgggagaattgcaaagcagatagaggttggcatgggaaagccattcacgcccgcccatgtggtgcgcatatccagaataccgaagacaaggaacggcaagatcatgaggagggtgataagatccgccttctgcggccttcccgttggcgatgtgagcaacaccgacgacggcgacgtgataagggaaatagatgaccttgggaaggttgcccttcgccaggcttag

SEQ ID NO: 1040 - protein, 619 aa, Thermoplasma acidophilum
MFYYKPSDEAIAETNLGRFASSLGMTVKDLYARADRDPEWFWPRVIDDLGLEFFKKFDHVMDLSEGVPWAKWFTGGRINIEYNAVERYSDSENTAIVYESEDGYKSKMSYSELNRKVSALSSAIHDMGIGRGDRVAIYMPFNANSAIAFYAVLRIGAIAVPMFSGYGVDAVRNRIEDSGSSLMITSASYRRKGKAIDMSAVARSINMKTIMDADRTDFYRFEDAVSGGKNVPVERTSSEDPAIMLYTSGTTGKPKGTVHVHGGALVNIAKEVKYYMDLKENDVLHWITDLGWMMGPWALIGTNALHGTIFLYDGAIDYPDPDRIFDIVHDNGVTLLGLSPTVVRMIKFRGTSRTFDTVRVFGSTGEPWDEESWVYLFSILGRGRASISNISGGTDIIGCFLASNPAIPQKPRCLYRGLGMNASIFNEEGREVYNTVGYLVAKFPSPSMTRGLWNNREKYLETYWSKFKDIWFHGDFGEMDEEGYFYLYGRSDDVIKIAGKRVGPNEVEDMVMRVSGVTECAVVSIPDSVKGEVLAVFYVGEPGLSGRIAKQIEVGMGKPFTPAHVVRISRIPKTRNGKIMRRVIRSAFCGLPVGDVSNTDDGDVIREIDDLGKVALRQA

SEQ ID NO: 1041 - DNA, 1977 bp, Streptomyces coelicolor
  CDS (1)..(1977)
atgtcgaccgagaacccacagccgctctggcagccagatgcgcaacgcatcgcccaggcacgcatcaccaggttccaggcctgggcggccgagcaccacggagcccccgccgagggcggatacgccgccctgcaccgctggtccgtcgacgagctggacaccttctggaaagccgtcacggagtggttcgacgtccgcttctccaccccctgcgcgcgcgtgctcggcgaccggaccatgcccggcgcccagtggtttcccggcgccacgctgaactacgccgaacacgccctgcgcgcggccggcacccgcccggacgaaccagccctcctgtacgtcgacgagacccacgaaccggcccccgtcacctgggcagagctgcgccgccaggtcgcctccctcgccgccgaactgcgcgccctcggcgtacgccccggcgaccgcgtcagcgggtacctccccaacatcccgcaggccgtggtcgcgctgctcgccacggccgccgtgggcggcgtctggacctcctgcgcgcccgacttcggcgcccgcagcgtcctcgaccgcttccagcaggtcgaacccgtcgtcctgttcaccgtcgacggctaccgctacgggggcaaggaacacgaccgccgcgacaccgtcgccgaactccgccgggaactgcccaccctccgcgcggtgatccacatcccgctcctcggcaccgaggccccggacggcgcgctggactgggagaccctcaccgccgcggacgccgagccggtgtacgagcaggtgcccttcgaccaccccctgtgggtgctctactcctccggcaccaccggcctgcccaaggccatcgtccagtcccagggcggcatcctcgtcgagcacctcaagcagctcggcctgcactgcgacctcggccccggggaccgcttcttctggtacacctcgaccggctggatgatgtggaacttcctcgtctccggcctgctcaccggcaccacgatcgtcctctacgacggcagccccggcttccccgccaccgacgcccagtggcgcatcgcggaacgcaccggcgccacccttttcggcacctccgccgcctacgtcatggcctgccgcaaggccggcgtccacccggcccgcgacctggacctctccgcgatccagtgcgtcgccaccaccggctccccgctcccgcccgacggcttccgctggctgcacgacgagttcgccgccggcggtgccgacctgtggatcgcctccgtcagcggcggcaccgacgtgtgctcctgcttcgcgggcgccgtccccaccctccccgtccacatcggcgaactccaggcccccggcctcggcaccgacctccagtcctgggacccgagcggcaaccccctgaccgacgaggtcggcgagctggtcgtcaccaacccgatgccctcgatgccgatccgcttctggaacgaccccgacggcagccgctaccacgacagctacttcgacacctaccccggcgtctggcggcacggcgactggatcaccctcacctcccgcggctccgtcgtcatccacggccgctccgactccaccctcaaccgccaaggcgtccgcatgggctccgccgacatctacgaggccgtcgagcggctccccgagatcagggaatccctcgtcatcggcatcgaacagcccgacggcggctactggatgcccctcttcgtgcacctggcacccggagccaccctcgacgacgcgctcctggaccgcatcaagcggaccatccgcgccaacctctccccgcgccacgtccccgacgaggtcatcgaggtccccggcatcccgcacaccctcaccggcaaacgcatcgaggtcccggtcaagcgcctcctccagggcaccccgctggacaaggcggtcaaccccggctccatcgacaacctcgacctgctccacttctacgaggaactcgcccgcaagcgctcctga

SEQ ID NO: 1042 - protein, 658 aa, Streptomyces coelicolor
MSTENPQPLWQPDAQRIAQARITRFQAWAAEHHGAPAEGGYAALHRWSVDELDTFWKAVTEWFDVRFSTPCARVLGDRTMPGAQWFPGATLNYAEHALRAAGTRPDEPALLYVDETHEPAPVTWAELRRQVASLAAELRALGVRPGDRVSGYLPNIPQAVVALLATAAVGGVWTSCAPDFGARSVLDRFQQVEPVVLFTVDGYRYGGKEHDRRDTVAELRRELPTLRAVIHIPLLGTEAPDGALDWETLTAADAEPVYEQVPFDHPLWVLYSSGTTGLPKAIVQSQGGILVEHLKQLGLHCDLGPGDRFFWYTSTGWMMWNFLVSGLLTGTTIVLYDGSPGFPATDAQWRIAERTGATLFGTSAAYVMACRKAGVHPARDLDLSAIQCVATTGSPLPPDGFRWLHDEFAAGGADLWIASVSGGTDVCSCFAGAVPTLPVHIGELQAPGLGTDLQSWDPSGNPLTDEVGELVVTNPMPSMPIRFWNDPDGSRYHDSYFDTYPGVWRHGDWITLTSRGSVVIHGRSDSTLNRQGVRMGSADIYEAVERLPEIRESLVIGIEQPDGGYWMPLFVHLAPGATLDDALLDRIKRTIRANLSPRHVPDEVIEVPGIPHTLTGKRIEVPVKRLLQGTPLDKAVNPGSIDNLDLLHFYEELARKRS

SEQ ID NO: 1043 - DNA, 2113 bp, Arabidopsis thaliana
  CDS (1)..(2082)
atgtcgtctaattccctgaggcatgtcgagtccatgtcccagctaccctcaggtgccggaaagatctctcaattaaacgccgtcgtgttaggagaatcccttgcatcggaggagaatgatctcgtctttcccagcaaggaattctccggccaggctcttgtttcctcccctcaacagtacatggaaatgcataagaggtcgatggatgaccctgctgctttttggtctgatattgcgtctgagttttactggaagcagaaatggggtgaccaagtgttttccgagaatctcgatgtcaggaagggtcctattagcatcgagtggtttaaagggggaatcaccaatatttgctacaactgtttggacaaaaacgttgaagctggtttgggtgataaaacagccatacactgggaaggaaatgaacttggggtagatgcttccttaacttattctgagttgctccaacgagtttgccagcttgctaattacttgaaagataatggagtgaagaagggtgatgctgttgtaatttatttacctatgttgatggaacttcccatcgctatgcttgcatgtgcaaggatcggagctgttcattcggtcgtttttgctggattttctgcggactctcttgcccaaagaatcgttgattgcaagccaaatgtaatactgacttgcaatgctgttaaaagaggccctaagaccataaaccttaaagctattgttgatgctgcacttgaccaatcttctaaagatggagtctctgtaggcatatgcttgacctatgacaactcattagcgacaacaagggaaaacactaaatggcagaatggaagagatgtgtggtggcaggatgttatttctcaatatccaacatcgtgtgaggtggaatgggttgatgcagaagatcccctgtttttgctctacaccagtggaagtactgggaagccaaagggtgtcctacacacaactggagggtatatgatctacactgctacaacgttcaaatatgcatttgactacaaatcaacagatgtatactggtgtacagcagattgtggttggataactggccatagctatgttacttatggaccaatgcttaatggagccactgttgttgtctttgagggggctccaaactaccctgaccctggacgctgttgggatattgttgacaaatacaaggtttcaatattttatactgccccaacattggtgaggtctctcatgcgcgatgacgataagtttgtaacacgtcactcgcgcaaatcgctgcgggtccttggaagtgttggtgagcccatcaatcctagtgcctggagatggttcttcaatgtagtcggtgattcaaggtgtcccatttcagatacgtggtggcaaactgaaactggtggcttcatgataaccccattgccaggtgcttggccccagaaacctggttcagccactttccctttctttggtgttcagcctgtcatagttgatgaaaagggcaatgaaatcgaaggcgagtgtagtggttatctttgtgtcaaaggttcatggcccggggcgtttcgaactctgtttggggatcatgaaagatacgaaaccacatactttaaaccttttgccggatattatttcagtggtgatggttgcagcagagacaaggatggttactactggcttacagggagggttgatgatgttatcaacgtcagtggccatcgaatcggaactgctgaagtagaatctgctctggttttacaccctcaatgtgcagaagcagctgttgtaggcatagaacatgaggtaaaaggtcagggaatttatgcgtttgtcactcttctggaaggtgttccttacagcgaggagcttcgtaaaagcctagtactaatggtccgaaatcagattggggcttttgcagcaccggacagaatacattgggcaccagggttgccaaagacgagaagcggaaagataatgaggagaatcttgagaaagattgcttcgaggcaattagaagaactcggagatactagcacactcgcggatcctagtgtagttgatcagcttattgcacttgccgatgtgtgatgactaaccatagcatatgagccaatggaga

SEQ ID NO: 1044 - protein, 693 aa, Arabidopsis thaliana
MSSNSLRHVESMSQLPSGAGKISQLNAVVLGESLASEENDLVFPSKEFSGQALVSSPQQYMEMHKRSMDDPAAFWSDIASEFYWKQKWGDQVFSENLDVRKGPISIEWFKGGITNICYNCLDKNVEAGLGDKTAIHWEGNELGVDASLTYSELLQRVCQLANYLKDNGVKKGDAVVIYLPMLMELPIAMLACARIGAVHSVVFAGFSADSLAQRIVDCKPNVILTCNAVKRGPKTINLKAIVDAALDQSSKDGVSVGICLTYDNSLATTRENTKWQNGRDVWWQDVISQYPTSCEVEWVDAEDPLFLLYTSGSTGKPKGVLHTTGGYMIYTATTFKYAFDYKSTDVYWCTADCGWITGHSYVTYGPMLNGATVVVFEGAPNYPDPGRCWDIVDKYKVSIFYTAPTLVRSLMRDDDKFVTRHSRKSLRVLGSVGEPINPSAWRWFFNVVGDSRCPISDTWWQTETGGFMITPLPGAWPQKPGSATFPFFGVQPVIVDEKGNEIEGECSGYLCVKGSWPGAFRTLFGDHERYETTYFKPFAGYYFSGDGCSRDKDGYYWLTGRVDDVINVSGHRIGTAEVESALVLHPQCAEAAVVGIEHEVKGQGIYAFVTLLEGVPYSEELRKSLVLMVRNQIGAFAAPDRIHWAPGLPKTRSGKIMRRILRKIASRQLEELGDTSTLADPSVVDQLIALADV

SEQ ID NO: 1045 - DNA, 2088 bp, Leishmania major
  CDS (1)..(2088)
atgagcagccaggtcgtctccagtccggtgactctgaagagtccgctgtcagtctcccagcatgtaggcgagtttaacagtgtgcgggacacgaacgttgtggagccgacggaggcaaaccggacaaagtcgcacgtcggcccccaccttggctcccgcatgcgcatctacgagtactccatcgagcacaatgacgtcttctgggccgaaattgcacggcgcgacttctactggaagacgacctggccggatgaccagcacgtcaagtcgtacaacttcgacaaatccaagggccccatctttgtgaaatggttcgagggcgccgtgacaaacatctgctacaacgcgttggaccgccacctgccggcgcacaaggatcgcgtgtgcttttactttgaaggcaacgacccgagtgtgacggaaaaggtcacgtacggcagcatgtacacgagggtggtggagctggcgaacgtgctgaagcaccagtacggtattacaaagggcgaccgcgttggcctgtatctacccatgatcccgttcgctgcagtggccatgctcgcctgcgcccgcatcggtgcggtggccagtgtcatctttggcggattttcggctcaggcgatcgtgactcgtgtcacggactgcagcccgaagctcatcatcactgctgacgcgtcctctcgcggtgataagccgattctgctcaagacgatcgcggaccaggccctggacgactgcagcgtcctggggtgcaacgtaccgtgcctcgtattcgaaaacatgaaccgtcaattctgcaagatgaaggaaggccgcgatacctggtacggcgatgccttagcgcggctgacgccggagcagcacgaggagtgcccggtggagtggatggacgcggaggatgtgctgttcctgctctacacctccggcagcaccgggaaacccaaggccatcgtgcacacgacggcgggctacatggtgtacgcctccaccaccttcatgtacagcttcgactaccacatggacgacgtgtacttctgcacggctgatattggctggatcacaggccacagctacgtcgtgtatggtccgatgatccactgcgccacgtcggtgctgttcgagggtgtgccgaactaccccgactactcgcgctggtggcagctcgtcgagaagtacaaggtgtccattctctacaccgcgcccaccgcaatccgctccctcatgcaggccggcgacgactacgtcaaggtgggcaaccgcagcaccctgcgtgtgctgggctccgtcggcgagccgatcaacgtggaggcgtggaagtggctgcgcgatgtcggcggcgagggccactgcgacgtgtcagacacgtggtggcagactgagacgggtggccacatgattacaccgatgccgggctgcacccccatgaagcccggtagtgcaacgctgccgttcttcggtgtccagccggttattctcgaccccatgaagctgaatgagaagcagggcccagcggagggcctgctcgccattcgtgcgccgtggccaggtatggcccgcaccatctacggcgaccacgcacgctttgagaagacctactttgacgtggacgggtactacatgacaggcgacggtgctcgccgcgactcggacggctattactggatcacgggccgcgtcgatgacgtgctgaacgtgagcgggcaccgcatcggcaccagcgagatcgaggacgccgtcaacacccacccggcagtggtggagagcgccgtggtcggcttccctcaaagcatcaagggtgagggcatctacgtcttccttacgttccaccaggggacggaggtgacgcccgagctgctggcggcggtaaaggcgactgtgcgcaaggtgattggtccgctggccacgccagatgtgcttcaccccacgcaggaaggtctgccgaaaacgcgctccggcaagattgtgcgccgcatcttgcgcaagatcgccactcacaacgacgacgacctgggcgacacctcgaccctggcagaccccaccgtcgtggaggcgctgaagcgctcgcgtgcaaagtgggtggataaaaagtag

SEQ ID NO: 1046 - protein, 695 aa, Leishmania major
MSSQVVSSPVTLKSPLSVSQHVGEFNSVRDTNVVEPTEANRTKSHVGPHLGSRMRIYEYSIEHNDVFWAEIARRDFYWKTTWPDDQHVKSYNFDKSKGPIFVKWFEGAVTNICYNALDRHLPAHKDRVCFYFEGNDPSVTEKVTYGSMYTRVVELANVLKHQYGITKGDRVGLYLPMIPFAAVAMLACARIGAVASVIFGGFSAQAIVTRVTDCSPKLIITADASSRGDKPILLKTIADQALDDCSVLGCNVPCLVFENMNRQFCKMKEGRDTWYGDALARLTPEQHEECPVEWMDAEDVLFLLYTSGSTGKPKAIVHTTAGYMVYASTTFMYSFDYHMDDVYFCTADIGWITGHSYVVYGPMIHCATSVLFEGVPNYPDYSRWWQLVEKYKVSILYTAPTAIRSLMQAGDDYVKVGNRSTLRVLGSVGEPINVEAWKWLRDVGGEGHCDVSDTWWQTETGGHMITPMPGCTPMKPGSATLPFFGVQPVILDPMKLNEKQGPAEGLLAIRAPWPGMARTIYGDHARFEKTYFDVDGYYMTGDGARRDSDGYYWITGRVDDVLNVSGHRIGTSEIEDAVNTHPAVVESAVVGFPQSIKGEGIYVFLTFHQGTEVTPELLAAVKATVRKVIGPLATPDVLHPTQEGLPKTRSGKIVRRILRKIATHNDDDLGDTSTLADPTVVEALKRSRAKWVDKK

SEQ ID NO: 1047 - DNA, 1956 bp, Tetrahymena pyriformis
  CDS (1)..(978)
atgagccaacataagaacgcttacgaaatagcttacgaaagagctaccaacgacaagactcgtgaagacttttggagagaccaaacctaccttgtagactggttcaagaagcctgaagttatcctcgacagaactcaccccaaccccggtttctggcgttggttcaaggatagcagagtcaacatgtgctacaatgctgttgatagtcacgttggagaactcggtaacaaacccgccatgcactgggtcagtggttatgaaggtgttgagaagacctacacttgggctgaattgcttgacaacgtctctagacttgctggtgttttgagaaagctcggtgtcgttaagggtgacagagtcatcatctacatgcccatggttcctgaagccgttttcggtatgcttgcctgtgccagacttggtgctatccactctgtcgtctttggtggttttgcagctaaggaattgtctggtcgtatccaagactgcaaacccgctctgatcttgggtgcttcttatggtttcgaacctaacaaagtcattaactacaagactattttagatgaagctattaccctctctggtgtccctggaattaaggttctccaattacaaagaggtgacaaaatgactggtcctgtcaaggttggaagagacttcgactatcactccttaatgctccaagctgaaagagtcgactgcgttcctgtcgaaggtgatcaccccttatacatcctctacacctccggtactactggtcaacctaagggtatcgttagagataccgctggtacctgcgtcgcttcatcctggaacatgcaacacattaatgatatccacaaaggagatgtctacttctctggtagtgatatcggttgggtcgtcggtcaccagttcatcgtctatggacctttactcagaggtgcaactactattttgtatgaaggaaagcccactggtactcccgaccctggttaattctggagactcattgaaaagtacaaagttaagggtctctacactgctcctactgctcttagagccatcagaaaggatgaccttaatggtgactggatcaagaaattcgacatttcttccttgaccaacatttctatggctggtgaaagatgtgatgttcccacttatgagtggattcaaaaggcagttcccgttctcatcaatgataactattggcaaaccgaaactggttggattatttcctgtaactataagaatctttacactcaccctgtcaagcctggtactgctatcaagcctgctcctggtttcgatgttcgtattcttgatcaaaacaataatgaaattcttgaacccaacaaactcggaagaatctgtatcaagcttcctatgccaccttccttcatgcttactttatacaacaacgatgaagctttcattgctaaatatttagctgattctcctggatactatctcgttggtgatagtggttatttcgatgaagatcgttacttgaacgttatggctagaatcgatgatatcattaacactgctggtcacagactctcaactgctgccatggaagaagctttgctcaagcatcctaacattgttgaagctgctgtcgttgccaaggttgacgatttcaagggagaaatccccattggtttcgttgttgccaagaccactggacctatcaaggatttgaaggcatttgaaaaggaatgcactgcagtagttagaaaggaaataggtcctgttgcttccttcaacaactgtattttagttgacaagttgcctaagactagaagtggtaagattttgagatagactcttaagaaaattgttgatggtgaaaagattgagaagattcctccaaccattgatgatgcctctgttatccctgctatcattactgatgttgacaactatggtcttttaaagaaaaaacctactctccctcaacccaagctttga

SEQ ID NO: 1048 - protein, 325 aa, Tetrahymena pyriformis
MSQHKNAYEIAYERATNDKTREDFWRDQTYLVDWFKKPEVILDRTHPNPGFWRWFKDSRVNMCYNAVDSHVGELGNKPAMHWVSGYEGVEKTYTWAELLDNVSRLAGVLRKLGVVKGDRVIIYMPMVPEAVFGMLACARLGAIHSVVFGGFAAKELSGRIQDCKPALILGASYGFEPNKVINYKTILDEAITLSGVPGIKVLQLQRGDKMTGPVKVGRDFDYHSLMLQAERVDCVPVEGDHPLYILYTSGTTGQPKGIVRDTAGTCVASSWNMQHINDIHKGDVYFSGSDIGWVVGHQFIVYGPLLRGATTILYEGKPTGTPDPG

SEQ ID NO: 1049 - DNA, 2267 bp, Drosophila melanogaster
  CDS (113)..(2137)
ttgtgctgagctcgtttgatccaaaaaattcaaaaagaatatatataataaatacatatatacattaacttgacttgaatatatacaagaacggaagttatacaaagttacaatggaacccggtcctagtgcagtgaactacgaaggcagtgaatctgtatgcggcatgccggtggaggctcacgatcctctctacttgaaggcctatcgccagagtgttcagaatccggctgcattttgggaggagcagggtaacctgctcgactgggatcggccatgggagaaggtactggacaacagtaatccgccattcaccaagtggtatgtgggtggctacctgaatgcctgctacaattccattgatcgccacatactggccggccgcggctccaatgtggccctaatccatgacagccccttgactggcacactgcgtcgggttacctatcaggagctgtatgaccagatcgttctgctggcaggcggcctggccaaattgggcgtggtcaaaggtgatcgcgtcgtgatctacatgcccctcatcccggagaccatcattgccatgctggcaattgtgcgtctgggtgcgattcactccgtggtcttcggtggcttcgctgcccgcgaactctgctcgcgcatcgaacatgtggaaccaaaactggtgatcgcctccaatgtgggcgtggagccgggcaaagtggtgccctacctggacatccttcattcagctattagcatgtcgcgatggcgaccaccgcagcgtaacataatctttcggcgtgataatgtttcgccagataccaccaaactggatcctctgacggatgtgctctggtcggatattcttaagatggcggagggcgagcggcccatagcctgtgttcccatcgaggccaacgatcctttgtatatcctctatacctctggaacgacggataagcccaagggagtacttcgcaccatcggaggtcacttggttgctctggtgtacacgctgagaactctctatggcatcaatcctggccacacctggtgggcggcctcagatatgggctgggtggtgggtcactcgtacatctgctacggtccactctgcctcggagccaccagtgttatgtacgagggtaaaccggaccgtactcctgacccgggtcagtactttaggatcatcgaccaataccaggtgcgctcgatcttctcggtacctacctccttccgtgttatccgtcgtgctgatccggacatcagctatgggcgacagtactccatgaagtcgctgcgtgccatcttcattgccggcgagcactgcgactacgagaccaagtcctggatcgagaagaccttcaaggtgcccgtgctcaaccactggtggcagacggagactggttccgcggtcaccgccacatgcctgggcttccagcagaacctcagtccgcccacttactccactggcttgccactcatgggctacgacgtcaagatcctgaaagcggacggcagcgaggcgcagacctcggagctgggcaggattgctcttaagctaccactgccacccggaaacatggccactctttacaaaaacgaagagctcttccgcacgctttactttcaaaagtttccgggttactatgatacaatggatgcgggctacaaggacgaacgtggctatatctttgtgacagctcgcgacgatgatgtaatcaatgtggctggccatcgcttgtccacctctagcctggaagacgccgtgcttcggcatccggacgtcgtggacgtggccgttttcggggtgcccgaggccaccaagggacaggtaccactgtgcctgtacattccggtggagaactgcaagaagaccgatgccaagctgtcgacggagatcatcaagctgatccgcgacgtcgtaggccccatagccgccttccggctggtcacgtccgtcaacaacctgccacgcactcgatccggtaagacgatgcgcaaggcgatggcggactttgcccgcaatgagcgcgttgtcctgccggcgactatcgatgatgccagcgtgttcatcgagatccggagggctctgaaccagttgggctatgccatgaccgcaccggatccgattgtggccaagttactcgactgatgggttgcaaggaccctcaaccttaaccttagcttgtacgatacgattcccaagaagtaaataaaatgtaagccagtttggctgggggttttcctccgcttatctgcgtaggccgcaaagtggcgaaaat

SEQ ID NO: 1050 - protein, 674 aa, Drosophila melanogaster
MEPGPSAVNYEGSESVCGMPVEAHDPLYLKAYRQSVQNPAAFWEEQGNLLDWDRPWEKVLDNSNPPFTKWYVGGYLNACYNSIDRHILAGRGSNVALIHDSPLTGTLRRVTYQELYDQIVLLAGGLAKLGVVKGDRVVIYMPLIPETIIAMLAIVRLGAIHSVVFGGFAARELCSRIEHVEPKLVIASNVGVEPGKVVPYLDILHSAISMSRWRPPQRNIIFRRDNVSPDTTKLDPLTDVLWSDILKMAEGERPIACVPIEANDPLYILYTSGTTDKPKGVLRTIGGHLVALVYTLRTLYGINPGHTWWAASDMGWVVGHSYICYGPLCLGATSVMYEGKPDRTPDPGQYFRIIDQYQVRSIFSVPTSFRVIRRADPDISYGRQYSMKSLRAIFIAGEHCDYETKSWIEKTFKVPVLNHWWQTETGSAVTATCLGFQQNLSPPTYSTGLPLMGYDVKILKADGSEAQTSELGRIALKLPLPPGNMATLYKNEELFRTLYFQKFPGYYDTMDAGYKDERGYIFVTARDDDVINVAGHRLSTSSLEDAVLRHPDVVDVAVFGVPEATKGQVPLCLYIPVENCKKTDAKLSTEIIKLIRDVVGPIAAFRLVTSVNNLPRTRSGKTMRKAMADFARNERVVLPATIDDASVFIEIRRALNQLGYAMTAPDPIVAKLLD

SEQ ID NO: 1051 - DNA, 2383 bp, Solanum tuberosum
  CDS (271)..(2166)
cgggggcagtcccttggtgaggatggaagacccgttcactgcttcattgtcgtcatcgattactgttagtccaaggaagaacttgacgacatccaatcacttgcgccatgtggaatccatggcccacttgccttccggagccggcagataaccagattgaatgctcttatcttaggcgaggcacttgcttccgaggaggatgatctcgtctttcccagcgaagatttctctagccagtctcatgtttcttctcctcagaagtatttggagatgtatcaaaggtcggtccacgatccctcaggattctggtctgacattgcatcagaattttactggagagagaaatggggccagcaggtttaccatgagaattttgatgttcgaaaggggaaaatcaagatcgagtggttcaagggtggaatgacaaatatctgctacaactgcttggatagaaacatcgagtctggaaagggtgacaaaacagcaatttactgggaaggaaatgaacctggtcttgatagttctatgacgtacaatcaactcttggctagagtttgccagctagcaaattatttgaaagatgttggagtccacaagggtgatgcagttgtcatctacttacccatgcttatggagctaccaattgcaatgcttgcttgtgctcgtattggtgccattcactcggttgtgtttgctggtttctcagctgaatctcttgctcaaaggatcatagattgcagaccgaaggttgtcataacatgcaatgctgttaggagggggtccaagattatttatctcaaagaaattgttgatagtgcccttctagaatctgctcagaagggcatcgttacagatgtgtgtttgacatatgaaaatgattcagcaatgaaaaaggaaatgactaaatggaccaaggggagagacatttggtggcaggatgttattctgaaatatccagtaacatgtgatgtggagtgggttgatgcagaagatccccttttcctgctttacactagtgggagtaccggaaagcctaagggtgtcttgcatacaacgggaggatatatggtgtacactgctactacattcaagtatgcatttgactacaagccgacagacatatattggtgtacagctgactgtggttggattactgggcatagttatgtaacctatggacctttgctaaatggagcaactgttgtggtttttgaaggggccccaaattatcccgatgtcgggcgttgttgggatattgttgataagtataaggtttcaatattttatacagctccaacactggtgagatctctgatgcgtgagggagacgagcatgtctctcgatattcacgcaaatctttacgggtgcttggaagtgtgggtgagcctatcaatccaagtgcatggaggtggtttttcaatgtgataggtgatgcaaggtgccccatatctgatacatggtggcaaacagaaaccggtggcttcatgattactcctttaccaggagcgtggccgcagaaacctggttctgctacttttcctttctttggagtccagccagtaatagtggatgagaaaggtgttgagattgaaggtgagtgcagtgggtatctgtgcgtgaaaagctcgtggcctggggcattccgaacacttcatggggatcatgagagatatgaaaccacatattttagtgccttcccgggctattatttcagtggtgatggctgcagcagggacaaagatggttactactggctcaccggaagagtagatgatgtgattaatgtgagtggacatcgtattggcacagctgaagtggaatctgctctagtttcacatcctcagtgtgctgaagcagctgtggttggtgtggagcatgaggttaaaggacaggggatatatgcatttgttactctagtcgaaggtgttccatacagcgatgacctgcgaaaaagtcttgtgatggttgttaggaatcagattggggcttttgcagcgccagacaagatacattgggcaccaggtcttccaaagacgagaagtgggaaaataatgagaagaattctgaggaaaatcgcttccaggcagttagatgagcttggggacactagtacccttgcagacccaactgtggttgatcagcttattgcacttgctgattgctaaagtaacaacttctaaatatagtgaagttagaggtttagctaactgtgttggtagagattggtattttgtttccgttttagtgtgagtacctttttcctccaaatttgaaacaacttatggttaacacacttttgaagatcaggttacatttaaaatcaagaaataaaataccaagatgtgattatcttttcaatgttaaaaaaaaaaaaaaaaaact

SEQ ID NO: 1052 - protein, 631 aa, Solanum tuberosum
MYQRSVHDPSGFWSDIASEFYWREKWGQQVYHENFDVRKGKIKIEWFKGGMTNICYNCLDRNIESGKGDKTAIYWEGNEPGLDSSMTYNQLLARVCQLANYLKDVGVHKGDAVVIYLPMLMELPIAMLACARIGAIHSVVFAGFSAESLAQRIIDCRPKVVITCNAVRRGSKIIYLKEIVDSALLESAQKGIVTDVCLTYENDSAMKKEMTKWTKGRDIWWQDVILKYPVTCDVEWVDAEDPLFLLYTSGSTGKPKGVLHTTGGYMVYTATTFKYAFDYKPTDIYWCTADCGWITGHSYVTYGPLLNGATVVVFEGAPNYPDVGRCWDIVDKYKVSIFYTAPTLVRSLMREGDEHVSRYSRKSLRVLGSVGEPINPSAWRWFFNVIGDARCPISDTWWQTETGGFMITPLPGAWPQKPGSATFPFFGVQPVIVDEKGVEIEGECSGYLCVKSSWPGAFRTLHGDHERYETTYFSAFPGYYFSGDGCSRDKDGYYWLTGRVDDVINVSGHRIGTAEVESALVSHPQCAEAAVVGVEHEVKGQGIYAFVTLVEGVPYSDDLRKSLVMVVRNQIGAFAAPDKIHWAPGLPKTRSGKIMRRILRKIASRQLDELGDTSTLADPTVVDQLIALADC

SEQ ID NO: 1053 - DNA, 3584 bp, Mus musculus
  CDS (33)..(2081)
ggctaccgcacccgcgtggggcgtcgggcgagatggcggcgcgcagcctcggcagcggtgtggggcgactgctgcgtggcctgcaagggcgctctggacaatcggggtggtcactgagcgtgtcccgctcgaccgccacccgactcccgggctgcgttcctgcagcagcgcaaccaggctcgtaccccgcgttgagcgctcaggcagcccaggagccggccgccttctgggggccgctggcccgtgacacactagtttgggacactccttaccatactgtctgggactgtgacttcaggacgggcaagatcggctggttcctgggaggccagttgaatgtgtctgtcaactgcctggatcagcatgtgcagaagtctcctgagaccatagctttgatctgggagagagatgaacctgggacagaagtgagaatcacttacagggagcttctggagaccacatgccgcctggccaatacactgaagagacatggagtgcaccgaggggaccgtgtggccatctacatgcctgtgtccccactggctgtggcagcaatgctggcctgtgccaggattggagctatccacacagtggtatttgctggctttagtgcagagtccttggctgggaggatcaatgatgccaaatgcaaggctgttatcaccttcaaccaaggactcaggggagggcgtgtggtggagctgaagaaaatagtggatgaagctgtgaagagctgcccaacagtccagcatgtcctggtggctcacaggacggacaccaaggttcccatggggagtctggatatcccccttgaacaggagatggccaaggaggcccctgtttgcacccctgagagcatgagcagtgaagacatgctctttatgctctacacctcagggagcaccgggacacccaagggactcgttcatacacaggcaggctatctactgtatgccgccatgacgcacaagctcgtgtttgactaccagccaggtgatgtctttggctgtgtggctgacatcggttggatcacaggacacagctatgtggtgtatggacccctctgcaatggagctaccacagtcctttttgagagcaccccagtttaccctgatgctggtcgttactgggagacagtgcagaggctaaagatcaaccagttctatggtgccccgacagctgtccggctgctgctgaagtatggggatgcctgggtgaaaaagtatgaccgctcttccctgcgcacactggggtcagtgggagagcctatcaaccacgaagcctgggagtggctccacaaagtcgtgggtgatggcagatgtacactggtggacacttggtggcaaacggaaactggaggcatctgcattgcaccacggccctcggaagatggggcagagatcctcccgggcatggccatgaggccgttttttggcatcgttcctgtactcatggatgagaagggcaatgttttggagggtggagatgtctctggggccttgtgtatttcccaagcttggccaggcatggcaaggaccatctatggtgaccaccagaggttcgtagatgcctacttcagagcgtacccaggttattacttcactggagacggagctcaccggacagagggtggctattaccagatcacggggcgcatggatgatgtcatcaatatcagtggtcatcgcctggggactgcagagattgaggatgcaatggctgaccatcccgctgttccagagactgctgtcattgggtaccctcatgatatcaaaggagaagctgcatttgccttcattgtgctgaaagataacatcagtgatgagaacatggtagtgaatgaactcaaattgtcggtggccaccaagatcgccaagtatgctgtgcctgaccagatcctggtggtgaagcgtctccccaaaaccagatctgggaaagtgatgaggagactactgaggaagatcatcaccagcaggggacaggatctaggggacaccactaccctggaggaccccagcgtcatcacagaaatcttgagtgccttccagaagtatgaagagcagcgggctgctaccaactgagaggtgtgcctctgtgttgttcagacaaggctgcacaggacccctggacgtcctcaggggaagcaacttcaaaagtggcttgtttcttccgaacacatgacccatctactgccctatttgaagctgaagcccctttttctttctcctggggctcagagggctgcttctggaggctgggggaaggcctttgtcatacatctggtttccagaatcaagtcataattggcactaagccagcacagggtgaccagaggtcttagctccaaaactgtcatgctttctccagatgtgtttagatacaaaacacaaattattttttttttgtactttttctatttggggagaatagcagaacatttgagtataatgtgaacatttagttacacacacacacacacacacacacacacacacacacaccgtgggaagaatctcccttcttacctccccaggggatgaagataacagaatgcgcttttttttaaaaattttattaccattcaatgtgcttaaagtccaaaccagacatgtttgtgcctctggcacataactctcctgctaatccaagtcaccatgtccaactcctgcgtctatttcatatttggttcatttggtttattttatgatcgaacaaactggacaattcttacattttgtatggtaggaattgcactcagggcctcctgcacactaggcaagcaagcgctctacctctgagctgcacaccacacctctaactcccaagaagacggagtgaatgtcctctcctttacttgtgaaatcatttgggttcgtttctctaagctgtgatctggaaggagtttctttccccaaggtgcctcatagtaggagatcatattgcttcaaacgtgtgaggttgttcatggtagccagtgaaaactcgggtgtctttactaagcctctggtcccatctgaactgagatcctgaagactctgcctgtcctttcttttgtggttggggcagcaagaactcactgtggtccaatgacgatgacacttggtgctcctgagcaaggtctcttttgatgtgccttaagttctctggacattggtgagtgatgcaaatagtgaagtcatgaaaagcttattttgcagctagattgtggctaagcatgggagggctgaaggggaggcagctctgtgagcagggcccctgggggcaaaggaagcctgttctgtctggtccacagaacttagctatatgggtgtttcagggtatcttagctactgcacacttactgtctgtcctgacgtcttgggtaatggggtaaacatgctgacgctcccaggaggcggagcggttgtagtatgaacaaatcttaatagtcctttgttacaatcagcagtgaagagccatgtgatggacgtggctgagtatagttactgtgccctttgaaatggcctaggtttctaggttactgatagaagctctcggaatgatttatagaaatatccaaataaagctttattttgttcactgtc

SEQ ID NO: 1054 - protein, 682 aa, Mus musculus
MAARSLGSGVGRLLRGLQGRSGQSGWSLSVSRSTATRLPGCVPAAAQPGSYPALSAQAAQEPAAFWGPLARDTLVWDTPYHTVWDCDFRTGKIGWFLGGQLNVSVNCLDQHVQKSPETIALIWERDEPGTEVRITYRELLETTCRLANTLKRHGVHRGDRVAIYMPVSPLAVAAMLACARIGAIHTVVFAGFSAESLAGRINDAKCKAVITFNQGLRGGRVVELKKIVDEAVKSCPTVQHVLVAHRTDTKVPMGSLDIPLEQEMAKEAPVCTPESMSSEDMLFMLYTSGSTGTPKGLVHTQAGYLLYAAMTHKLVFDYQPGDVFGCVADIGWITGHSYVVYGPLCNGATTVLFESTPVYPDAGRYWETVQRLKINQFYGAPTAVRLLLKYGDAWVKKYDRSSLRTLGSVGEPINHEAWEWLHKVVGDGRCTLVDTWWQTETGGICIAPRPSEDGAEILPGMAMRPFFGIVPVLMDEKGNVLEGGDVSGALCISQAWPGMARTIYGDHQRFVDAYFRAYPGYYFTGDGAHRTEGGYYQITGRMDDVINISGHRLGTAEIEDAMADHPAVPETAVIGYPHDIKGEAAFAFIVLKDNISDENMVVNELKLSVATKIAKYAVPDQILVVKRLPKTRSGKVMRRLLRKIITSRGQDLGDTTTLEDPSVITEILSAFQKYEEQRAATN

SEQ ID NO: 1055 - DNA, 2052 bp, Kluyveromyces lactis
  CDS (1)..(2052)
atgaaatctaacgcttcagctgccgctgcagaccaaattaagacccatgaatacgaacatttaacttctgtgcctatagtgcagcctctaccaattactgataggttgagcagcgaagcagctcaaaaatataaacctaatttgccaggtgggttcgaagagtacaagtctttgcacaaggaatcacttgaaaatccagccaagttttaccatgaacgtgctcagctgttgaattggttcaaaccatacgatcaagttttcatcccagataccgaaggtaaaccaacttttgagaacaacgcttggtttaccaacggtcaattgaacgcttgttacaatttggtagacagacatgccttcactcaaccaaacaaggttgccattctttatgaagctgatgaaccaggtcaaggttatagtctcacttatgcggaattgttagaacaagtctgtaaagttgctcaaatcttgcaatactcgatgaacgtcaagaaaggtgacacggtcgcagtttatatgccaatgatcccacaggctttgattaccttgttggcaattactcgtatcggtgccattcattccgttgtttttgctgggttctcttcgaattcattgcgtgatcgtattaacgatgcttactcaaagacagtcatcaccaccgatgaatctaagagaggtggtaagaccatcgaaaccaagcgtatcgtcgatgaagccttgaaggatacccctcaagtaacaaacgttttggtcttcaaacgtactcataacgaaaatatcaagtacattccaggtagggatttggactgggatgaggaagtcaagaagtacaaatcttacaccccatgcgaacctgttgactctgaacatcctttgttcttattgtatacttcgggttccaccggtgctccaaagggtgttcaacattctacagcaggttacttgctccaagcattattaagtatgaaatacacctttgacatccaaaacgatgacatcttcttcaccgcaggtgacattggttggatcactggtcacacatactgtgtttacggtccattgttacaaggttgtactactttggtgttcgaaggtacacctgcctatccaaacttttctcgttattgggaaattgttgacaagtaccaagtgactcaattctatgtagccccaactgcactacgtctattgaagagagctggtgattcctttactgaaggattctctctcaagtcattgcgctccttgggttccgttggtgaacctatcgctgctgaagtttgggaatggtactctgaaaagattggtaagaatgagctaccaatcgtagacacatactggcaaactgaatctggctcccacttggtcactccattggctggtggtgctactccaatgaaaccaggtgcagcggcattcccattctttggtattgatttggcagtgttggatccaaccacaggtatcgagcaaactggtgaacatgcagaaggtgttcttgccattaaaagaccttggccatctttcgcaagaaccatttggaagaataacgataggttcttagacacgtacttgaaaccatacccgggctattacttcactggtgatggtgttgcccgtgataaagatggattcttctggatcttgggtcgtgttgatgatgttgttaacgtctcaggtcacaggttgtctactgctgaaattgaagctgctatcattgaagatgatatggttgccgaatgtgcagttgttgggtttaacgacgaattgactggtcaagccgttgctgcctttgtagtattgaagaacaagtctagtttaactgctgcaagcgagtccgagttacaagacatcaaaaagcatttgatcatcaccgttagaaaggatattggtccattcgctgctcctaagttgatcgtcctagttgatgatctaccaaagactagatctggcaagattatgagacgtattttgagaaagatcctagccggtgaatctgatcaattggcgacgtctccacattatccaaccctggtatcgttaagcacttga

SEQ ID NO: 1056 - protein, 683 aa, Kluyveromyces lactis [sequence omitted]

SEQ ID NO: 1057 - DNA, 2492 bp, Saccharomyces cerevisiae
  CDS (162)..(2303)
aaatagttctcccttcattttgtatataaactgggcggctattctaagcatatttctcccttaggttatctggtagtacgttatatcttgttcttatattttctatctataagcaaaaccaaacatatcaaaactactagaaagacattgcccactgtgctatgtcgccctctgccgtacaatcatcaaaactagaagaacagtcaagtgaaattgacaagttgaaagcaaaaatgtcccagtctgccgccactgcgcagcgaaagaaggaacatgagtatgaacatttgacttcggtcaagatcgtgccacaacggcccatctcagatagactgcagcccgcaattgctacccactattctccacacttggacgggttgcaggactatcagcgcttgcacaaggagtctattgaagaccctgctaagttcttcggttctaaagctacccaatttttaaactggtctaagccattcgataaggtgttcatcccagaccctaaaacgggcaggccctccttccagaacaatgcatggttcctcaacggccaattaaacgcctgttacaactgtgttgacagacatgccttgaagactcctaacaagaaagccattattttcgaaggtgacgagcctggccaaggctattccattacctacaaggaactacttgaagaagtttgtcaagtggcacaagtgctgacttactctatgggcgttcgcaagggcgatactgttgccgtgtacatgcctatggtcccagaagcaatcataaccttgttggccatttcccgtatcggtgccattcactccgtagtctttgccgggttttcttccaactccttgagagatcgtatcaacgatggggactctaaagttgtcatcactacagatgaatccaacagaggtggtaaagtcattgagactaaaagaattgttgatgacgcgctaagagagaccccaggcgtgagacacgtcttggtttatagaaagaccaacaatccatctgttgctttccatgcccccagagatttggattgggcaacagaaaagaagaaatacaagacctactatccatgcacacccgttgattctgaggatccattattcttgttgtatacgtctggttctactggtgcccccaagggtgttcaacattctaccgcaggttacttgctgggagctttgttgaccatgcgctacacttttgacactcaccaagaagacgttttcttcacagctggagacattggctggattacaggccacacttatgtggtttatggtcccttactatatggttgtgccactttggtctttgaagggactcctgcgtacccaaattactcccgttattgggatattattgatgaacacaaagtcacccaattttatgttgcgccaactgctttgcgtttgttgaaaagagctggtgattcctacatcgaaaatcattccttaaaatctttgcgttgcttgggttcggtcggtgagccaattgctgctgaagtttgggagtggtactctgaaaaaataggtaaaaatgaaatccccattgtagacacctactggcaaacagaatctggttcgcatctggtcaccccgctggctggtggtgttacaccaatgaaaccgggttctgcctcattccccttcttcggtattgatgcagttgttcttgaccctaacactggtgaagaacttaacaccagccacgcagagggtgtccttgccgtcaaagctgcatggccatcatttgcaagaactatttggaaaaatcatgataggtatctagacacttatttgaacccttaccctggctactatttcactggtgatggtgctgcaaaggataaggatggttatatctggattttgggtcgtgtagacgatgtggtgaacgtctctggtcaccgtctgtctaccgctgaaattgaggctgctattatcgaagatccaattgtggccgagtgtgctgttgtcggattcaacgatgacttgactggtcaagcagttgctgcatttgtggtgttgaaaaacaaatctagttggtccaccgcaacagatgatgaattacaagatatcaagaagcatttggtctttactgttagaaaagacatcgggccatttgccgcaccaaaattgatcattttagtggatgacttgcccaagacaagatccggcaaaattatgagacgtattttaagaaaaatcctagcaggagaaagtgaccaactaggcgacgtttctacattgtcaaaccctggcattgttagacatctaattgattcggtcaagttgtaatgatgatttctttcctttttatattgacgactttttttttttcgtgtgtttttgttctcttataaccgagctgcttacttattattatttcaccttctctttttatttatacttataattatttattctttacatactgttacaagaaactcttttctacattaattgcataaagtgtcaatcagcaca

SEQ ID NO: 1058 - protein, 713 aa, Saccharomyces cerevisiae [sequence omitted]

SEQ ID NO: 1059 - DNA, 3543 bp, Kluyveromyces lactis
  CDS (817)..(2871)
ccaacgggagctgaacggtgcaacaatattattgccccgttaaactttatgatatgtttcttgatgctcctttactatatacagtctagatagtcacagtggcagcagtcgacggccatatgttgagtcatggtgattctttttctttttctttccttcacagtttgcttgcaacccgtagccaaaccctagagcgaaccggacctttgcaatggccattgtcgcctttcctaccttttttatatcttcaacccgatatatctttatttcttcaccagtgtcaccgcttagaagtcgccaaaactcatgagaaacagtaattttccaaccaaaaagtttggaatcgcaaaaggaaaaaaaaaatacctgaaaaactaaaatcatatatatataagatcaggcgaattaggaaaagttaggttcgaacgtttggtgaggcagaaagtttatatacacagaggttatttttattgattagacgaattgattcagaaaggattttttatttatatatgttttttttcttgtgtttattttagttgcaatccattgtagtctaagtcaattcttcagcggtacattcccagaactttattactgttagtgtctctcttttcggggtcttaactggttaattgtcatttctgaatcttcaagtttaacagaaaccttcattgttttcaagaatatcaactctggaccgtattcactaattagcagatttaatctctctacacatcttgaaaagaattataacgttaacgcgcaggaagcaaggttaacaaaggaaaaaaaaaacgattcattactatcactatgtcgtcggataaattgcataaggttgtgcatgaagctcacgatgttgaagctcgtcatgctccagaacatttctacaattctcaaccgggtaaatcgtactgtactgatgaagaacattaccgtgagatgtacactcagtccattgaggacccagcagggtttttcggtccattggccaaggaatatctagattgggatcgtccattcacccaagtccaaagcggttctttggaacacggtgacattgcctggttcttaaatggtgaactgaatgcttcttataactgtgttgacagacacgcttttgccaacccagacaagccagctttaatctacgaagccgacgatgaatctgaaaacaaggtgatcacttttggcgaattgttgagacaggtctctgaagtggctggtgtcttgcaatcttggggtgtcaagaaaggagacaccgtcgccgtttacttgccaatgattcctgctgcagttgttgctatgttggccgttgcaagattaggtgccattcattcggttatctttgccggtttctctgccggttccttgaaggaaagagttgtcgatgcaggctgtaaagtggtcatcacttgcgatgaaggtaagagaggtggtaagaccgttcataccaagaagattgtcgacgaaggtttggccggtgtcgattccgtttccaagatcttggttttccaaagaactggtactcaaggtatcccaatgaagccagctagagatttctggtggcacgaagagtgtgtcaagcaaagaggttacttgccacctgtcccagtcaactccgaagatccattgttcttgttgtacacctctggttccaccggttctccaaaaggtgtcgtgcactctactgctggttacttgttaggttctgctttgaccaccagattcgttttcgatattcatccagaagatgttttgttcactgctggtgacgtcggttggattaccggccacacttacgccttgtacggtccattgaccttaggtaccgctaccattattttcgaatctactccagcttacccagattatggtagatactggagaatcattgaacgtcatagagctacccacttctacgtcgccccaactgccctaagattgatcaaacgtgtcggtgaagaagaaattgccaagtatgatacctcctccttaagagtcttgggttctgtcggtgaaccaatctctccagatctatgggaatggtaccacgaaaaggttggtaagaataactgtgttatctgtgacaccatgtggcaaaccgaatccggttcacacttgattgccccattggctggtgctgtcccaaccaaaccaggttccgctaccgtcccattcttcggtattaacgcctgtatcatcgacccagtttctggtgaagaattgaagggtaacgatgttgaaggtgtcttggcagtgaagtccccatggccttctatggacagatctgtctggaacaaccatgctcgttacttcgaaacttatttgaagccatacccaggatactacttcacaggtgatggtgctggtagagatcacgacggttactactggatcagaggtagagttgacgatgtcgttaacgtttccggtcacagactttctactgctgaaatcgaagctgctctagctgaacacgaaggtgtttctgaagctgccgttgttggtatcactgatgaactaacaggtcaagctgtcattgcattcgtttccttgaaggacggctatctgtctgaaaatgcggtagagggtgacagtacccacatctctccagacaacttacgtcgtgagttgattctacaagtcagaggtgaaattggtccattcgctgcaccaaagaccgttgttgttgtcaacgatttgccaaaaactagatccggtaaaattatgagaagagtcttgagaaaggttgcatccaaggaagctgatcaattgggtgatctaagtaccttagccaatgcagacgttgtaccatctatcatttctgcagtagaaaatcaatttttcagtcagcagaagaaataagagttctttcaaatttaatcataaattctaaagccaactaaaaatatcgaaaaaggatagtatttcaaaacttaccatcaggatgatcagaaaaattccacagtgacgatccattcaatgtcctctgttgtatattatgctgcctttctcagaattcaaagataacaatgggactctcgtacttcgtgggtttgctccaacttaacactggaatcagtacactttcattcaattctcgaaaccactggagctttatcgattttaacaccgtagtttgtctttttaacgtcatggtcagatagagtgcttccattgcaaataatcaaataagcacggcccgctcacactattatatatttatatatattacatgtatgatattcactacatcatcctcctttaagagtaattattcaacgacgtgttttctctttgggcataaacaggagcaaatatctaccactttaggaagcgaagcgccagaaatctgacggaaattacttgctttgcgtaagattattctctgtttactgtgtgattactcaccaaacataatgtccttatgcttctttacttttttaccaataatcattcggcaaaagtgatgatccattcaaagaatgtttgcagcaaaagcagtgaaaagataaaagaatacacatatatatataa

SEQ ID NO: 1060 - protein, 684 aa, Kluyveromyces lactis
MSSDKLHKVVHEAHDVEARHAPEHFYNSQPGKSYCTDEEHYREMYTQSIEDPAGFFGPLAKEYLDWDRPFTQVQSGSLEHGDIAWFLNGELNASYNCVDRHAFANPDKPALIYEADDESENKVITFGELLRQVSEVAGVLQSWGVKKGDTVAVYLPMIPAAVVAMLAVARLGAIHSVIFAGFSAGSLKERVVDAGCKVVITCDEGKRGGKTVHTKKIVDEGLAGVDSVSKILVFQRTGTQGIPMKPARDFWWHEECVKQRGYLPPVPVNSEDPLFLLYTSGSTGSPKGVVHSTAGYLLGSALTTRFVFDIHPEDVLFTAGDVGWITGHTYALYGPLTLGTATIIFESTPAYPDYGRYWRIIERHRATHFYVAPTALRLIKRVGEEEIAKYDTSSLRVLGSVGEPISPDLWEWYHEKVGKNNCVICDTMWQTESGSHLIAPLAGAVPTKPGSATVPFFGINACIIDPVSGEELKGNDVEGVLAVKSPWPSMDRSVWNNHARYFETYLKPYPGYYFTGDGAGRDHDGYYWIRGRVDDVVNVSGHRLSTAEIEAALAEHEGVSEAAVVGITDELTGQAVIAFVSLKDGYLSENAVEGDSTHISPDNLRRELILQVRGEIGPFAAPKTVVVVNDLPKTRSGKIMRRVLRKVASKEADQLGDLSTLANADVVPSIISAVENQFFSQQKK

SEQ ID NO: 1061 - DNA, 1935 bp, Pseudomonas putida
  CDS (1)..(1935)
atgttcgatatccgcaaatacccccaggccctggccgtcagccagtccgccgccctcacccccgaagactaccgccgcctctaccgccagtcggtcgaagacccagacaccttctgggccgaacaggccaaacgcctggactggatcaaaccgtggtcaagcgtgcagcaatgcgacctgcataccggcaaggcccgctggttcgacggtgcgcaactcaacgtcagctacaactgcatcgaccgtcacctggcccagcgcggcgagcaaacggccctgctgtgggaaggcgacgatcccaaggactccaaggccatcacctaccgcgaactgcaccgtcaggtctgccgcctggccaatgcaatgaaagcgcgcggtgtgaagaaaggcgaccgggtaagcatctacatgccaatgattcccgaggccgccttcgccatgctcgcctgcacccgcatcggcgccatccactcggtggtgttcggcggtttctcccccgatgccttgcgagaccgcattctcgatgccgactgccgcaccgtgatcaccgccgatgaaggcgtgcgtggcggcaaacgcatcccgctgaaacagaacgtcgacaaggccctggccagctgcccagcggtcagtagcgtgttggtggtgcgccgcactggcggcgatgttgcctggaccgagggccgcgacctctggtatcacgaagcgacgaaggatgccggcgacgactgccccccagaaccgatggaggccgaagacccgctgttcatcctctacacctccggcagcaccggcaaacccaaaggggtgctgcataccaccggcggctacctgctgcaggcaacgatgaccttcaaggtggtgttcgattatcgtgacggcgaggtgttctggtgcaccgccgatgtcggctgggtgaccggccacagctacatcgtctatggcccgctggccaatggcgcaatctcgctgatgttcgaaggcgtgcccaactaccccgatacctcgcgcttctggcaggtggtggacaagcaccaggtgaacatcttctacaccgccccgaccgccctgcgcgcactgatgcgtgagggctccgcgccactgcagagcacctcacgcaaaagcctgcgtctgctgggcagcgtcggcgagccgatcaacccggaagcctgggaatggtacttcgaggaggtcgggcaaaagcgctgcccgattgtggatacctggtggcagaccgaaaccggcggcatcatgctcaccccactgcccggcacacagtcactcaaacccggctgcgccacccagccgatgttcggcgtgcaaccggtgctgctggacgaaaaaggcaaactgatcgaaggccccggcgccggcgtgctggcgatcaaagccagctggcccgggcagatccgcagcgtctacggcgaccaccagcggatggtcgacacctacttcaagcccctgcccggctactacttcactggcgacggtgcccgtcgcgatgccgacggcgactactggatcaccgggcgcatcgacgatgtgatcaacgtgtccgggcaccgcatcggcaccgctgaagtggaaagtgcactggtgctgcatgacagcgtggccgaagccgcggtggtcggctacccccacgacctcaagggccaaggcgtctacgccttcgtcacgaccatgaatggcgtgacaccagatgacacgctcaaggccgagctgctggccctggtcagcaaggaaatcggcagcttcgccaagcctgagctgattcagtgggcgccagcgctacccaagacgcgctcaggcaagatcatgcggcgtatactgcgcaaaatcgcctgcaatgagctggaaaacctgggcgatacctcgaccctggccgacccgagcgtggtacagggcctgatcgacaaacgcctcaaccagtaa

SEQ ID NO: 1062 - protein, 644 aa, Pseudomonas putida [sequence omitted]

SEQ ID NO: 1063 - DNA, 1950 bp, Rhizobium meliloti
  CDS (1)..(1950)
atggacgtcaagacctacccggtcctggaagcggccaagaaccgcacgctgctcgacaatgcgacctatctcgaatggtatcgcgagagcgttgccgatccggagaagttctggggcgagcacggcaagcggatcgaatggttcgagccctataccaaggtcaagaacacgtccttcgagggcgatgtctcgatcaagtggttcgaagacggactgaccaacgtctcctacaattgcatcgaccgccacctgaagacgcacggcgaaaagacggcgatcatctgggagggagacaatccctatctcgacaagaagatcacctataacgagctctacgacaaggtttgccgtcttgccaacgtcttgaaggagcagggcgtaaagaagggggaccgcgtcaccatctacatgccgatgatcccggaagcagcctatgcgatgctcgcctgtgcccgcatcggcgcgatccattcggtcgttttcggcggcttttcgcccgaggcgctcgccggccgcatcgtcgattgcgagtccaccttcgtgatcacctgcgacgagggcgtgcgcggcggcaagccggttgcgctcaaggagaacaccgataccgcgatcgacatcgctgccagacagcacgtcacggtcagcaaggtcctcgtcgtgcgccgcaccggcggcaaggtcggctgggcaccgggccgcgatctctggtatcaccaggagaccgcggcggcagagccgcattgcccgccggaaaagatgaatgcggaggacccgctcttcattctctatacttcgggttcgaccgggaagccgaaaggcgtgctgcacacgaccggcggctatctcgtctatgcttcgatgacgcatcaatacgtgttcgactaccaggacggcgacatctactggtgcacggccgatgtcggctgggtcaccggtcactcctacatcgtctacgggccgctcgccaatgcggcgacgacgctgatgttcgagggcgtgccgaacttccccgacgcgggacggttctgggaagtagtcgacaagcacaaggtcaacatcttctataccgcgccgaccgcgatccgctcgctgatgggagcgggcgacgatttcgtcaagcgctcctcgcgttcttcgctgcgcctgctcggaacggtcggcgagccgatcaatccggaagcctgggagtggtactatcacgtcgtcggcgacgagcgctgccctgtcgtcgatacctggtggcagaccgaaaccggcggcatactgatcacgccgctgccgggggctaccgatctcaaacccggctccgcgacgcggcccttcttcggcgtccagccgcagatcgtcgacagcgacggcaaggtcgtagatggcgcggccgacggcaacctttgcatcaccgatagctggcccggacagatgcggacggtctatggcgatcacgaacgcttcatccagacctacttctccacctacaagggcaagtatttcacgggcgacggctgccgccgcgacgaggacggctactattggatcaccggccgcgtcgacgacgtcctgaacgtttccggccaccggctcggcacggcggaggtggaatcggcgctcgtctcgcacaacctcgtttccgaggcggcggtcgtcggctacccgcatccgatcaagggtcagggcatctattgctacgtttcgctgatggccggcgaggtcggagacgacgaactgcgccaggcgctcgtcaagcacgtccgctcggaaatcggaccgatcgcgacaccggacaagatccagttcgcgcccggcctgccgaaaacacgctcaggcaagatcatgcgccggattctccgcaagatcgccgaggacgatttcggttcgctcggcgacacttcgacgctcgccgatccgggcgtcgtcgacgacctgatcgccaatcgtcagaaccgcgcttga

SEQ ID NO: 1064 - protein, 649 aa, Rhizobium meliloti [sequence omitted]

SEQ ID NO: 1065 - DNA, 1959 bp, Agrobacterium rhizogenes
  CDS (1)..(1959)
atgtcggaaaagatttatccggtcgccaagccggtggagagccatgcgttgatcaacaaggccgagtaccaggaatggtacgcggaaagcgtcgccgaccccgagcagttctggggcaagcacggcaagcgcattgactggttcaagccctacaccagcgtaaaggacacctcctttaccggcgacgtctcgatcaaatggttcgaggacggtgagaccaatgtctcctacaactgcatcgaccggcacctcgcgacaaacggcgaccaggtcgccatcatctgggaaggcgacgatccgtcgctcgacaggaagatcacctaccgcgagctctacgagcacgtctgtcgtatggcgaacgtcctgaagaagcacggggtcaagaagggcgaccgcgtcaccatctacatgccgatggtgccggaagcggcctatgcgatgctcgcctgcgcccgtatcggcgcgatccattcggtggtgttcggcggcttttcacccgaggcgctgggtggccgtatcgtcgattgccagtcgaccttcgtcatcacttgcgacgaaggcctgcgcggcggcaagccggttccgttgaaagccaatgtcgacaaggcgatcgatatcgccgcgcgcggtcacgtcatggtcaagaacgttctggtgatccgccgcaccggcagcccgctcagttgggcgccgggccgcgacctctggcatcacgaggaagcagccactgtttcggcggactgcccgcccgagccgatgaaagccgaggatccgctgttcatcctctatacgtcaggctcgaccggcaaaccgaagggcgttctacacaccaccggcggctatctcgtttacgcctcgatgacgcatgaatatgtgttcgactaccagcacggtgatatctactggtgcacggccgatgtcggctgggtcaccggacattcctatatcgtctatgggccgctcgccaactgcgcgacgacgctgatgttcgaggggatcccgaccttccccgatgctggccgtttctgggatgtgatcgacaagcacaaggtcaacatcttctacaccgcgccgaccgcaatccgctcgctgatgggcgccggcgatgatttcgtcaaacgatccagccgatccagcctgcgattgcttggctcggtcggcgagccgatcaatccggaagcctgggaatggtactatcatacggtcggcgacgggcgctgccctgttgtcgatacctggtggcagacggaaaccggcggcatcatgatcacgccgctgcctggcgcgaccgacctgaagcccggctcggctacacggcccttcttcggcatcagaccggagctcgtcgatgccgaaggcaagctcatcgaaggggccgccgacggtaatctttgcatcgccgacagctggccgggtcaggcgcgttcggtctatggcgaccacgagcgcttcatccagacctacttctccacctacgaggggaaatatttcaccggcgacggctgtcgccgcgacgccgatggctactactggatcaccggccgtgttgacgacgtgctcaacgtctccggccaccggctcgggacggcggaagtcgaatccgccctggtatcgcatcacctcgtctccgaggcagccgtcgtcggctatccgcacaacatcaagggccagggcatctattgctatgtcacgctgatggcgggcagcgaagggtccgaagagctccgccagcagctggtgaaacatgtccgcgcggaaatcgggccgatcgcctcgcctgataagatccagttcgcgccgggcctgccgaagacccgctcgggaaagatcatgcgccgcatcctgcgcaagatcgccgaggacgatttcgggtcgctgggcgacacctcgacgcttgccgatcccgctgtcgtcgacgacctgatcgccaaccggcagaacagagccgaggcggcctag

SEQ ID NO: 1066 - protein, 652 aa, Agrobacterium rhizogenes
MSEKIYPVAKPVESHALINKAEYQEWYAESVADPEQFWGKHGKRIDWFKPYTSVKDTSFTGDVSIKWFEDGETNVSYNCIDRHLATNGDQVAIIWEGDDPSLDRKITYRELYEHVCRMANVLKKHGVKKGDRVTIYMPMVPEAAYAMLACARIGAIHSVVFGGFSPEALGGRIVDCQSTFVITCDEGLRGGKPVPLKANVDKAIDIAARGHVMVKNVLVIRRTGSPLSWAPGRDLWHHEEAATVSADCPPEPMKAEDPLFILYTSGSTGKPKGVLHTTGGYLVYASMTHEYVFDYQHGDIYWCTADVGWVTGHSYIVYGPLANCATTLMFEGIPTFPDAGRFWDVIDKHKVNIFYTAPTAIRSLMGAGDDFVKRSSRSSLRLLGSVGEPINPEAWEWYYHTVGDGRCPVVDTWWQTETGGIMITPLPGATDLKPGSATRPFFGIRPELVDAEGKLIEGAADGNLCIADSWPGQARSVYGDHERFIQTYFSTYEGKYFTGDGCRRDADGYYWITGRVDDVLNVSGHRLGTAEVESALVSHHLVSEAAVVGYPHNIKGQGIYCYVTLMAGSEGSEELRQQLVKHVRAEIGPIASPDKIQFAPGLPKTRSGKIMRRILRKIAEDDFGSLGDTSTLADPAVVDDLIANRQNRAEAA

SEQ ID NO: 1067 - DNA, 1956 bp, Agrobacterium tumefaciens
  CDS (1)..(1956)
atgtctgccaaaatctacccggtgctcaaatcggcgaaagcccgcacgctcatcgacaatgagcgttaccagaaatggtatcaggagagcgtcgaggatccggaaaaattctgggacaagcacggccggcggatcgactggttcaagccctataccaaggtcaagaacacctcattcaaggggcgtgtgccgatcaaatggttcgaagacggcctgacgaacgtctcctataactgtatcgaccggcatttgaagacgcatggcgagcgcacggcgatcatctgggaaggcgacaatccctatatcgacaagaagatcacctataaccagctctatgattatgtctgccgtctggccaatgtgctgaagaagcacggcgttaagaagggtgaccgcgtcaccatctacatgccgatgattcccgaggcggcctatgccatgcttgcctgcgcccgcatcggtgccgtgcattccgtcgtctttggcggcttctcgcccgaagcgctggccggtcgtatcgttgactgcgaatcgaccttcgtcatcacctgcgatgaaggcgttcgcggcggcaagccgatcccgctcaaggaaaataccgacaaggcgatcgatatcgccgccaagcaatatgtcatcgtcaacaaggttctggtcgtgcgccgcaccggcggcaagaccggctgggcgccgggccgcgacatctggtatcatcaggaaattgcgaccgtgaagccggattgcccgccggtgaagatgcgggcggaagatccgctgttcatcctctacacttcaggctccaccggcaagcccaagggtgtgttgcacaccacgggcggctatctcgtctatacgtcgatgacgcatgaatatgtgttcgattacaaggatggtgaagtcttctggtgtacggccgatgttggctgggttaccggccattcctacatcgtctacgggccactcgccaattgtgcgacaacgctgatgttcgagggtgttcccaacttcccggatcaggggcgtttctgggaggtcatcgacaagcacaaggtcaatatcttctataccgcgccgacggcgctccgatcgctgatgggggcgggcgaccagttcgttcagcgctcgtcgcgcgaaagcctgcggcttctcggaacggtgggtgagccgatcaatccggaagcgtgggagtggtattaccatgtggtcggcgaggacaagagcccgatcgtagacacctggtggcagacggaaacgggcggcattctcatctcgccgttgccgggtgcgaccgatctgaagccagggtcggcaacaaggccgttcttcggcgtgcagccgcagcttgtcgatgccgagggcaatgtgctggaagggccggcggacggcaatctctgcatcatcgacagctggccgggccagtcgcggtccgtttatggggatcaccagcgattcgtcgacacctacttctcgacctacaagggcaagtacttcaccggtgacggctgccggcgcgacgaggacggttattactggatcacaggtcgcgtcgatgacgtgctcaacgtctccggccaccgcctaggcacggccgaggtagaatcggcactggtctcgcatcatcaggtttcggaagcggcggtggtcggttatccgcaccccatcaaggggcagggcatttattgttatgtcacgctgatggcggggcagagtggcgattatgcgctgcgcgaggagctggtaaagcatgtgcgcaacgagatcggaccggttgcgacgcccgacaagatccagtttgcgcccggcctgccgaagacccgctcaggcaagatcatgcggcgcattctgcgcaaaatcgccgaggacgatttcggtgcgcttggggatacgtcgacgcttgccgatccggcggtggtggaagatctcatcgccaaccgccagaaccgcacggcgtcctga

SEQ ID NO: 1068 - protein, 651 aa, Agrobacterium tumefaciens
MSAKIYPVLKSAKARTLIDNERYQKWYQESVEDPEKFWDKHGRRIDWFKPYTKVKNTSFKGRVPIKWFEDGLTNVSYNCIDRHLKTHGERTAIIWEGDNPYIDKKITYNQLYDYVCRLANVLKKHGVKKGDRVTIYMPMIPEAAYAMLACARIGAVHSVVFGGFSPEALAGRIVDCESTFVITCDEGVRGGKPIPLKENTDKAIDIAAKQYVIVNKVLVVRRTGGKTGWAPGRDIWYHQEIATVKPDCPPVKMRAEDPLFILYTSGSTGKPKGVLHTTGGYLVYTSMTHEYVFDYKDGEVFWCTADVGWVTGHSYIVYGPLANCATTLMFEGVPNFPDQGRFWEVIDKHKVNIFYTAPTALRSLMGAGDQFVQRSSRESLRLLGTVGEPINPEAWEWYYHVVGEDKSPIVDTWWQTETGGILISPLPGATDLKPGSATRPFFGVQPQLVDAEGNVLEGPADGNLCIIDSWPGQSRSVYGDHQRFVDTYFSTYKGKYFTGDGCRRDEDGYYWITGRVDDVLNVSGHRLGTAEVESALVSHHQVSEAAVVGYPHPIKGQGIYCYVTLMAGQSGDYALREELVKHVRNEIGPVATPDKIQFAPGLPKTRSGKIMRRILRKIAEDDFGALGDTSTLADPAVVEDLIANRQNRTAS

SEQ ID NO: 1069 - DNA, 1947 bp, Bradyrhizobium japonicum
  CDS (1)..(1947)
atgtccgagaagatttacgacgtgccggcggaatgggcaaagcgcgcctgggtcgaccaagccaagtacaaggaaatgtacgcccgctcgatctcggacccgaacggtttctgggccgaacaggccaagcgcatcgactggatgaaggcgccgacgaaaatcgagaacgtctccttcgcgccgggcaacgtctcgatcaaatggttcgaggacggcgtcctcaacgtcgcccataactgcatcgaccgtcatctgcacaagcgcgccaaccagaccgcaatcatctgggaaggtgacgatccctcgcagtcccgccacatcacctacaaggagctccacgacgaggtctgccggatggccaacatcctgcgtacccgcaacgtcaagaagggcgaccgcgtcaccatctacctgccgatgattccggaagcggcctacgcgatgctggcgtgcgcgcggatcggcgcgatccactccgtggtgttcgcgggcttctcgcccgacagcctcgcccaacgcatcaacgactgccagtccaaggtgatcatcaccgccgacgaaggcctgcgcggcggcaagaaggtgccgctgaaggccaatgtcgacgcggcgctcgccaaggccgacggcgtcgactgggtcgtcgtggtcaagcgcaccggcggcaagatcgacatgaacccgacccgcgacctctggtatcacgaggcggcggcgatggtgacgacggaatgcccggtcgagcatatgcacgccgaggatccgctgttcatcctctatacctcaggctcgaccggccagcccaagggcgtgctgcacacctccgccggctatctcgtctatgccgcgatgacgcatcaatacgtcttcgactatcacgacggcgacatctactggtgcaccgccgacgtcggctgggtcacgggccacagctacattctctacgggccgctcgccaacggcgcgaccacgctgatgttcgagggcgtgccgaattatccggacaattcccgcttctggaacgtcatcgacaagcacaaggtcaataccttctacaccgcgccgaccgcgatccgcgcgctgatgcagggtggcgacgagccggtgaagaagacctcgcgcgcctcgctgcgcctgctcggctcggtcggcgagcccatcaatccggaagcctgggagtggtatcaccgcgtcgtcggcgaggaccgctgcccgatcgtcgatacctggtggcagaccgagaccggcggcatcctgatcacgccgctgccgggcgccactaagctcaagccgggctcggcgacgcagcccttcttcggcgtggtgccggagatcgtcgatgccgacggcaaggttctggaaggcgagaccaccggcaatctctgtctcacccgggcatggccgggcatgatgcgcacggtctatggcgatcacgcgcggttcgagcagacctatttctcgacctacaagggcaagtattttacgggcgacggctgccggcgcgacgccgacggctattactggatcaccggccgcgtcgacgacgtcatcaacgtctccggccaccgcatgggcaccgcggaggtcgagagcgcgctggttgcgcatgagaaggtgtcggaagctgccgtcgtcggcttcccgcacgacatcaagggccagggcatctacgcctatgtcaccctgatggccggcgtccagccgaccgaggatctgcgcaaggagctcgtgacctgggtgcgcaaggagatcggcccgatcgcctcgcccgaccagatccagttcgcgccgggcctgcccaagacccgctccggcaagatcatgcgccgcatcctgcgcaagatcgccgaggacgagccgggcagcctgggcgacacctcgaccctggccgatcccgccgtggtcgacgacctcgtcaagaaccggcagaacaagaagtcggcgtaa

SEQ ID NO: 1070 - protein, 648 aa, Bradyrhizobium japonicum [sequence omitted]

SEQ ID NO: 1071 - DNA, 1956 bp, Brucella suis
  CDS (1)..(1956)
atgtcggaaaagctttaccccgtgctgccggaggcaaagaaaaacacgctcatcgacaacgagacttatctcgaatggtatgaggagagcgtgagcgacccggatggcttctgggccaagcacggccggcgtatcgactggttcaagcctttcaccaaggtcaagaacaccgatttcaacggcgatgtaacgatcaagtggtatgaggatggcgtcaccaacgtctcatataattgcatcgaccgccatctgaagagccgcggcgacaaggtcgccatcatctgggaaggcgacaacccctatatcgacaagaagatcacctatcgcgagctttacgagaatgtctgccgcatggcgaatgtgctcaagaagcatggggtgaagaagggcgaccgcgtcacgatctatctgccgatgatcccggaagccgcctatgccatgctcgcctgcgcgcgcatcggcgccgtgcattcggtcgtctttgccggtttctcgccggaggcgctcgctggccgcatcgttgactgcgaatccactttcgtcatcaccgccgatgaaggtgtgcgcggcggcaagcctgttgcgctgaaggaaaacaccgataccgccatcgacatcgccgccaagcaatatgtgatggtcaacaaggtgctggtcgtgcgccgcaccggcggcaaggtaagctggggccgcggccgcgatctgtggtaccatcaggaagtcgcaagcgtcgaaccgcattgcgaaccggaaccgatgaatgcggaagacccgcttttcattctctacacatccggttccaccggcaagccgaagggtgtgctgcataccaccggcggctacctcgtctatgcctcgatgacgcatcaatatgtcttcgattaccatgatggcgagatctactggtgcacggcggatgtgggttgggtaacgggccactcctatatcgtctacggaccgctggccaatggcgcgacaacgctgatgtttgaaggcgtgcccaacttccccgatcagggccgtttctgggaagtcgtcgacaagcaccatgtcaatatcttctacaccgcgccaaccgcgctgcgcgcgcttatgggcgcgggcgatgaattcgtaacccgctcatcgcgttcgacgctgcgcctgctgggctcggtcggcgagccgatcaatccagaggcctgggagtggtattacaatgtcgtgggcgaccagaaatgccccatcgtcgatacctggtggcagacggaaaatggcggcatcctcatcaccccacttcccggcgcgaccgatttgaaacccggttcggcaacacgcccgttcttcggcgtcaagccggtgctggtggacaatgaaggcaatgtgcaggagggcgtagccgacggcaacctgtgcatctccgactcctggccgggccagatgcgcaccgtctatggcgaccacaagcgtttcatcgaaacctacttctccacctataaggggatgtatttttcgggcgatggctgccgccgcgacgaggacggctattactggatcaccggccgcgtcgatgacgtgctgaatatttccggccatcgcctcggcacggcagaaatcgaatcggcacttgtctcgcatcactcggtttcggaagccgccgtggtcggctatccgcacccgatcaagggacagggcatctattgctatgtcacgctgatgaccggcgcagacgcgcaggacccggacgagttgcgcaaggaactggtccagcatgtgcgcaaggaaatcggccccatcgccacaccggacaagatccagtttgcgcccggactgccgaaaacccgttccggcaagatcatgcgccgcatcctgcgcaagatcgccgaagacgagttcggcgcattgggcgacacctcaacgctcgccgatccgggcgtggtggacgacctgatcgaaaatcgccagaacaagaaatga

SEQ ID NO: 1072 - protein, 651 aa, Brucella suis
MSEKLYPVLPEAKKNTLIDNETYLEWYEESVSDPDGFWAKHGRRIDWFKPFTKVKNTDFNGDVTIKWYEDGVTNVSYNCIDRHLKSRGDKVAIIWEGDNPYIDKKITYRELYENVCRMANVLKKHGVKKGDRVTIYLPMIPEAAYAMLACARIGAVHSVVFAGFSPEALAGRIVDCESTFVITADEGVRGGKPVALKENTDTAIDIAAKQYVMVNKVLVVRRTGGKVSWGRGRDLWYHQEVASVEPHCEPEPMNAEDPLFILYTSGSTGKPKGVLHTTGGYLVYASMTHQYVFDYHDGEIYWCTADVGWVTGHSYIVYGPLANGATTLMFEGVPNFPDQGRFWEVVDKHHVNIFYTAPTALRALMGAGDEFVTRSSRSTLRLLGSVGEPINPEAWEWYYNVVGDQKCPIVDTWWQTENGGILITPLPGATDLKPGSATRPFFGVKPVLVDNEGNVQEGVADGNLCISDSWPGQMRTVYGDHKRFIETYFSTYKGMYFSGDGCRRDEDGYYWITGRVDDVLNISGHRLGTAEIESALVSHHSVSEAAVVGYPHPIKGQGIYCYVTLMTGADAQDPDELRKELVQHVRKEIGPIATPDKIQFAPGLPKTRSGKIMRRILRKIAEDEFGALGDTSTLADPGVVDDLIENRQNKK

SEQ ID NO: 1073 - DNA, 2028 bp, Candida albicans
  CDS (1)..(2028)
atgccggaatctactcaacaatctcatctttctttggaccatgagaagatgcaacaacctcctaaagggttcactgaacgttctaaaacaaaaccaaacttagctgattttgaaacttatcaaaaattatataaacaatcaattgaaaaccccaatgaatttttcactcaacaagccaaagaaaatttggattggtttaaaccatttgatttagctagattccctgttgatcctaaagatgattacaaaaatggtgatttgccagcttggttcatcaatggacaattgaatgcttgttataatgctgttgatagatgggccattaaaaaccctgataaaccagcaattatttatgaaggtgatgaacctgaccaaggaagaattatcacttatggagaattattaaaacaagttagtaaattagctcaagccttaactaaattgggggttaaaaagggtgattcagttgctgtttatttaccaatgattcctgaagccattgtcactttattagccattgttagaattggtgctatgcattcagttgtttttgctgggttttcttctgcttcattaagagatagaattttggatgctgattcaagaattgttattactgctgatgaatctaaaagaggtggtaaaaccattgaaaccaaaaaaattgttgatgatgccttgaaagaatgtccaaaagttagaaatgtcattgttttcaaaagaactggtaattctcatgtcccattttctcctggtagagatttgtggtggcacgatgaaatggctaaatatggtccatacttcccaccagttcctgtcaattctgaagacccattgttcttgttgtatacttctggttctactggtaaaccaaagggggttcaacacaacactgctggttatttgttaggagcagttttaaccaccaaatacacttttgatgttcatgaagatgatattttgtttactgctggtgacattggttggatcacaggtcatacttattgtgtttatggtccattgttagctggtgccacatcagtggtttttgaaggtaccccagcttatccaaattattccagatattgggaaattgttgataaatataaagttaatcaattttatgttgctccaactgctttaagattattgaaaagagctggtaccaaatatgttgaaaaatacgatttatcatctttaagagtcttgggttccgttggtgaaccaattgctgctgaagtttggcattggtataatgataacattggtaggggtcaagctcatattgttgatacttattggcaaactgaatcaggatctcatttgttgactccgttagctggtatcacaccaactaaaccaggttcagcttcattaccattctttggagttgatccaaagattttagacccaaccactggtgaagaattacctgataatgatgttgaaggggttcttgccattaaatcagcttggccatcaattactagaggtatttacaatgattacaatagatttattgatacttatttggcaccatacgccaattattatttctccggtgatggtgctgctagagatagagatggtttttactggattttgggtagagttgatgatgttgttaatgtttctggtcacagattatcaactgctgaaattgaagctgccttgattgaacatccaattgtcggtgaatctgccgttgttggttatgccgatgaattgactggtcaagccgttgctgcatatgtttcgttaaagaaggataaagctgttggtgaagatgtagaaaacattaaaaaggaaatgattttaactgttagaaaagaaattggaccatttgctgctccgaaaatgattttattagttgatgatttacctaaaactagatctggtaagatcatgagaagaattttaagaaaagtattggcaggtgaagaagatcaattgggtgatatttctactttatctaatccaggtgttgttcaacaaatcattgatgttgttcatcatgcaaagaaataa

SEQ ID NO: 1074 - protein, 675 aa, Candida albicans [sequence omitted]

SEQ ID NO: 1075 - DNA, 1980 bp, Chlorobium tepidum
  CDS (1)..(1980)
atggctactgagcaaacgaaaggccagtcctctgaatcgatcagttcggttctctccgagcggaggaagtttcctccgccggaagcgttctcttcccagtcgcacatttcaagcatggagcagtacgaaaaactctatgccgatgcagccgcggatcccgacaagtactggggcgatctggcggaacagttccactggttcaagaaatgggactcggttcttgaatggaatgctccatatgccaaatggttcaatggcggcaccaccaacatcgcctacaactgccttgacgtgcacgtaggcagctggcgcaagaacaaggcggctatcatatgggaaggtgaagagggcaacgagcgcatcctcacctatggcgagctgcaccgccaggtcagcaaattcgccaacgtcctgaaaatcgccggcatcaaaccgggtgacaaggtggcgatctacatggggatggtgcctgagctggtcatcgccgtgctcgcctgcgcaagggtcggtgcggtgcacaacgtgatcttcgccggttttgccgcccacgccatcaccgaaagggtcaacgactcacgcgccaaaatagtcatctgcgccgacggcacccgccgccgtggtagcaccatcaacctcaaaaatatcgtcgacgaagcgatcatcaacactccttcggtcaaaaacgtcatcgtcctcaaagtgaccggcgaagagatccacatgcacgacggcatggatcactggtggcacgacctgatggggctagccgtggacgaatgcgaaccggcgcaggtcgattccgagcacccgctctttttgctctacaccagcggctcgaccggcaaaccgaaaggcattctgcacaccaccgccgggtacatggtgcacgccgccagctcgttcaaatatgtgttcgacatcaaggacgaggacatctacttctgcaccgccgacatcggctggatcaccggccacacctacataatctacggcccgctgctcaacggcgcaaccgtcttcatgtacgaaggcgctccgaactacccgcagtgggatcgtttctgggacatcatcaatcgccacaagatcacaatcctctacaccgctccgacggctatccgcgccttcatccgcgccggtaacgagtgggtcaccaagcacgacctcagctcgctcaggctgctcggcacggtcggcgaaccgatcaaccccgaggcctggatgtggtaccacaagtatgtcggtcaggaaaaatgcccgatcgtggacacctggtggcagaccgaaaccggcggcatcatgatttcgccgatgccgggcgcgaccccgaccaaaccgggcacagccacccgcccgctgccgggcattatggtcgatgtcgtccgcaaggatggcaccccgtgcaacgccaacgaaggtggctacctggtcgtcaaacgcccatggccctcgatgctccgcaccatctatggtgacaacgagcgttacgaaaagacctactggtctgaattccccggcatgtacttcaccggcgacggtgcaagaaaagatgatgacggctacatctggatcatgggccgcgtcgatgacgtggtcaacgtctcgggtcaccgcctcggcaccagcgaggtcgaaagcgcgctcgtttcacacgaggctgtcgccgaagccgccgtcgtcagccgtccggacgaaatcaagggcaacgccctcgtcgcattcgtgacgctgaaagacggctacgaaggcgacgccaaactgcgcgactcgctcggcaagcacgtcgccaaggagatcggcgctattgctaagcctgacgaaatccgctgggccaaaggtctgccgaaaacccgcagcggcaaaatcatgcgccgcctgcttcgcgaacttgccacttccaacgagatcaaaggcgacgtcaccaccctcgaagacctcggcgtcatcgagaacctccgcgaacaggaagacgaaggctga

SEQ ID NO: 1076 - protein, 659 aa, Chlorobium tepidum [sequence omitted]

SEQ ID NO: 1077 - DNA, 2041 bp, Coprinus cinereus
  CDS (20)..(2005)
caccgcctcgctctctgcaatgtccgaaggtccaatccgagtcgctccccaccccatcgccaagcgcgtcaagcatggctgcaagacgccccatgtctcccacattgacgattaccgaagccagcaccgggaaaccattggtcacgaatcggacaagtggtgggcaaagaaagctcatgagcttctctattgggatcgaccattccatactgtccgctcgggcagcttcgagaatggcgacattgcttggttccccgagggtggtttgaacgcctcctataactgcgttgaccgctgggcgttcaaacatccggaaaagaccgcgattatctacgaagcagatgaacctggcgagggaagggagatctcttacgcggaactcctccgggaagtctgcagcatcgcaaacgtgctcaagtcgttcggcgtcaagaagggcgacaccgtctccgtctacctccccatgacctggcaagccgtcgccgccttcctcgcctgtgcccgcatcggcgccatccactctgtcgtctttgctggcttctcggccgaagcattgcgtgatcgtatgcaagattgcaaatcgcgtgtgctcatcacgtccgatgaagggcggcgcggtgggaaggcgattgctaccaaggccatcgcggatgcggccctcaaggagtgcccggcggttgagaaggtgttggtgttgaagaggacgggtaacccggttccgtggactgagggtcgggatgtgtggtggcacgaggcggtcgccagggtaccgaggtactgccctcccgaggtcatggcatccgaggaccctctcttcatcctctacacttctggctcgactggcaaacccaagggtgtcgtgcacacgactggtggatatctactctgcgccgccttgactgtcaaatacgtcttcgatgtccaccccgacgacaggttcgcttgcatggccgacgttggctggatcacgggccacacttacatcgtctacggtcctctcgctattggcgctaccaccaccgtgttcgagtccactcccgtataccccactccttcacgatactgggaaaccgtcgagaagtacaagcttacccagttctactcggcccctaccgctatccgactcttgcgtcgcctcggacacgagcacgtcaacaagcacgatttgagcagtttgcgtgtgttgggaagcgttggagagcccatcaaccccgaggcttggcactggtacaacgagcacgtcggaaagaccgagtgcgccatcgttgataccttctggcaaactgagactggttccatcgtcgttactcctttccccggtgctatcgagaccaagcctggtgcggcgactgtacccttcttcggtattgagcccgccatcttggagcctaccactggaaaggtgctcgagggcaatgatgtcgagggtgttctcactatcgctcatccctggccttctatcgctcgaaccatctacggagaccatcagcgctacctcgagacttacatgaagccttatcccggctacttctacaccggtgatggcgctgctcgtgatgaggacggctacatctggatcaagggtcgtgttgatgatgtcattaacgtctctggccatcgtttgtccaccgccgaaatcgaatccgctctcatcacccacactggagttgctgagaccgccgtcatcggtaccgccgacgaactgaccggccaggccgtctacgccttcgtcactctcaagcctgaattcaagttcgacgccgagaacgaggctggcctctccaaggagctcatcctccaagtccgcaagatcatcggtccctttgctgcgcccaagcggatctatatcgtcagtgacctccccaagactcgctccggcaagatcatgcgacgtatcctccgcaagatcgtcgctggcgaggctgaccagctcggtgacctcagcaccttcgccgacccgggcatcgtcgaagtcatcaaggagaaggttgcctctgctgcgtaagcgcacgacagagtagactcatctagcacctgccca

SEQ ID NO: 1078 - protein, 661 aa, Coprinus cinereus [sequence omitted]

SEQ ID NO: 1079 - DNA, 2222 bp, Cryptosporidium parvum
  CDS (70)..(2154)
gaattcttcttgttactcttaagattttgcctcacattagtatattatattaataattattgaaaaaaaatgagtgataaaagacctagatcgccatgttctaacaataatgatgaattaaatgattcatcagtacttactgagaacatggataccgttgcaactcgttccaagaacttgccatttcacgaaacatacaaatcaaaaccaactcctgctgataagccttatagagtagatgggattgataaatataaagaactctacgaacaaagtattagagatcctgagggtttttggagccaaatggctagaaaagaacttcgatggctaagagattttactaaagtaaggagttctggtacttgtcttcaagatagacttgcttggtttttgaatggaaagttaaatgtatgcgataattgcgtagatagatgggctgaaatacaaccaaatactactgcattaatttgggaaggagatgatccatcatctattagacatattagctatattgaactgtttagaaacgtttgtaaaatggccaatgttttgaaacgatttggtatcaaaaaaggtgattctgttggtatttatatgccaatgatacctgaaactatatatactatgttagcttgcgctagaataggagctgtacatatggtagtttttgctggatttgcagctcagaatcttcttgagagacttgttaatgctagatgtaaaatagtagtaactgcagatcaaggatccagaggtaagaagattattaacttgaaagatgttgttgataaagctcttgaaaagattcctgagattaaaacatgcattgtttttagacacttgaatggacctattgaatttgtcaagggaagagattttgatggagaaactttaatgagatctgaaaaaccttattgtcctttagaagacatggatagtgaggatccactattttatttatatacctcaggtagtactggaactccaaaaggtgttcaacactctactgcaggatacttactttatgctgctgttacacaaaagtacttattcaacattcatcctggggatatttttggatgtgctggagatattggttggattactggccactcttacttggtatatgctcctctttgtaatggtataaccactttaatttttgagggagtaccgacttatcctaatgctgggagatactgggaaatggtggagagacacagaattactcatttttacgctgctccaactgcaatcagaactcttaaacgccttggagatgattttgttaaaaaacacgatagatcatcattgagagttctaggatcagttggagagcctattaatccctctgcatggagatggtaccattcagttgttggtgaagagagatgttctatagttgatacttattggcaaactgagacaggaggaattgttattgctccaattcctggttgttttgatactaaacctggttcagcaacatttcccttctttggtattgagcctgcgatacttgatcctgatacaggaaaagaaattgatggaccagggtctggagttctttgtataaaaaactcatggccaggtatgtttagaggtatttttggagctcattatcttcatgagatctatacaaaaccattccccaaatactattttactggggatggtgttttaagagatcaggatggatatctttggattactggtagaattgacgatacaattaatgtttctggtcatagactaagctctaaggaaattgaagatgctcttaccaaccattttggcattgcagaagctgcagctgttgcaattgatcatgatgttaaaggtaatgctcttgtttgctttgtagttttaaaggattctggtaatagaacttttgacttgaataattcaagtcctcatccttttgaatatgaacttaggatgtgtgtcaggacccaaatcggccctgtggcaacacctgatcatattattgttgttgagaatatccctaaaacaagatcaggaaaagttgtaagacgtcttcttagaaagattgctactggttgcaatgactatggagatatttcaacggttgcaaatcctgagtgtattaaatccattgagtcatcctgggcacaataccttaagagataatataaggagccctgtataagtaaatttaacaatattacaggattttgcattttgtatttttccaatgt

SEQ ID NO: 1080 - protein, 694 aa, Cryptosporidium parvum [sequence omitted]

SEQ ID NO: 1081 - DNA, 2874 bp, Drosophila melanogaster
  CDS (451)..(2463)
cacggcactcagccatcacctgatggattcgatgatggaccgatgacacacctacctctctggaaagttacgccgtgctctggcgataaggatgtccaagtcgcgccttgaaaatacatatgcccgatcaagttgataagccttacaaaaagcgccgcccatgtctcattgaacttgaagagcgtgttcgcggaagcttttccattcggaaagctatggcaacggaggcgaaaagcttggcagtagctcattcgaatggtcagtgctcaaaaagaactcattccgtgcggtgcgagaagcgcatgctgctcgagaaccaacccctgaaaataataaaaacaatcacacaaagctaaggataattgcaaaacaggataattgaaaacctaaagcaaggaaaaacagttgaaggacatacacaaataactaaaaccacaactcaataacaaaatgccagcggaaaaatcaatatacgatcccaacccggccatcagccaaaatgcctacatatccagcttcgaggagtaccagaagttctaccaggagtcactggacaatccggccgagttctggtcccgcgtggccaagcagttccactgggaaacgccagccgatcaggataagttcctcaagtacaacttcaacatctcgaagggacccatttcgatcaaatggatggagggtgcctccaccaatctgtgctacaatctcctagatcgcaacgttaggaacggcctgggcgaccagatagcctactactgggagggcaaccaccccgacgattattcccggggtctcacctatcgcaagttgctggaggaggtgtgccgcttcgccaacgtgctgaaggatcatggcattcgaaagggcgatcgtgtatccatttacatgcccatgattctggagctgcctatcgcgatgctggcctgcgctcgcattggagccgtgcactcgatcgtattcgccggattctcaccggactcactggcggagcggatgttcgattgcaaggccaagctgctgattacggcggatggagcctggcgtggagagaaacccctgtacctgaaggctctgtgcgacacggccttggagaaagtcgaggagatggggcactccgtggagaagtgcatcgtggtgtcgcatttgaagcgagtgactccgtgccagccggatcatgtcgaggaggaaatcccatggaccgatgaccgcgattactggtggcacgaggagatggaggacaaggagccggcctgctatccggagtggatggacgccgaggatccattgttcatgctctacaccagtggctccactggcaagcccaagggagtgctccacacgactgccggatatctgctgtatgcggccacgacctttaagatcgtatttgactataagccaggggatatctactggtgcaccgccgatgttggctggatcacgggacacacctacgtggtgtacggaccattggccaatggagccacttcagtgattttcgaaggcacaccattcttccctggaaacgatcggtactggagtgtcattgacaaatataaggtaactcagttctacacagctccaacggcgattcgtgccctcatgaagttcggcgagggtcccgttctaaagcacaacctgagcggactcaaagttttgggcagcgtgggtgagcccatcaacccggaggcctggctctggtattacaaatacattggaaaggagcagtgctccattgtggacaccttttggcaaacggaaaccggtggtcatgtcattacacctctgcctggagcgactcccatgaagccgggatctgcttcattccccttctttggagtgaagcccactttgctggatgagtgcggcattgaaattaagggggagggagagggctacttggtcttctcgcaaccttggccgggaatgatgcgcactttgtacaacaaccatgaacgcttcgaggacacttatttctccaagttcccaggctactactgcactggcgatggagcccgacgcgatgctgacggctatttgtggatcactggtcgtgtggacgacatgttaaacgtgtccgggcacctgatgtccactgccgaggtagagtcggttctcacagagcatcctcgcgtggctgagtccgccgtggtttcccgtccgcatcccgtcaagggcgagtgtctctactgcttcataacgccgaacgagaacgaggtattcgaccagaagctaatttcggacctgaagaagatggtgcgagaacgtatcggaccttttgccatgccggatgtcattcaaaacgctcccggactgcccaaaactcgttccggcaagattatgcgtcgtgtgctgcgcaagatcgcggttaacgatcgcaacgtgggcgacacatctaccttggccgatgagcaaattgtggagcaactgttcgccaaccggccagtggaggccaagtagatggtagctgttggaccaactggcagcagccaggatcccttaacccaaggctttctccggttgcactgaccactccactttgccatcgcatttccaccacttacgtatcgcgattacgtatcctgtaaatctccctctacttatatgaattacccactgcttaatgtttgttccgttccgggctacggcgtggttagcacctttcaaattctacttagctcgtaagcctaagcgtgtgcgtaagtaagtgactggatggtttccgatcccagttatatatcgtctatatgattttgtgtacttgcctgttcatcgtagttgacatgctcaccacgcacacattttccagttcttttgtttcttcgttgtagtcgtagtttaagttctcgctaattcgttgtgatacaaatt

SEQ ID NO: 1082 - protein, 670 aa, Drosophila melanogaster [sequence omitted]

SEQ ID NO: 1083 - DNA, 1986 bp, Leptospira interrogans
  CDS (1)..(1986)
atgccgaattcggaggaagttatggcaaaagaacgagtcgtttcaccgtccgcagaatttaaaaagaatgcgaacattagtcttaagaattataaatctctttataaagaatccatagaaaacccgaacaagttttgggcaagagaagccaaccgcttgatttggtttaaaaaatggactaaagttttaagccacgattttaaaaacgcaaaagtagaatggtttaaaggtggcaaactcaatgtttcttacaactgtttagatcgtcatatcagcactcccttaaaaaacaaagccgctttaatttgggaaggtgataatcccacagaatctagagtgcttacctattatgatgtttacagagaagtaaatcgttttgcgaacattcttaaaaaatttggagtaaaaaaaggggatcgggttttggtttatctacctatgattccagaattagctattacaattcttgcatgtactcgaatcggtgcgatccattctgtcgtgttcggaggattttccccggaagcccttcaaagtagaatcgacgattgtaaaccaaagttagttgtcactgcggacggaggttttagaggtggaaagccaatcgagttgaaaaaaaacgtggaccttgctctcgaaaagtccaaagaaaaagtaaaaaccgtaatcgtagttcgtcgtactggaaacgagtccggtcttacttggaaagacggtcaagactactggtatcattttttgatgaacgatccggaactttctgcatattgtaagccggaagagatggatgctgaagatcctctttttatcctttatacttccggttcgactggaaaaccaaagggagttttacatactaccggaggttatctcttaggagctaatttaacatttcattatgtatttgatattaaacccgaagacacgtattggtgtaccgctgatattggttgggtaactggtcattcttatttagtttatggcccgttgtccaacggagcttcttccgtaatgtttgaaggggttccttcttatccggacgctgggagattttgggacgttatcgataaatacggtgtaaatatattttatacggcaccgactgcaattcgagctttgatgagagagggactaaatcatattcaaaaaagagatttaagttctcttcgtcttttgggttctgttggagaaccgatcaatccagaagcttgggaatggtattttaaaaatataggaaaaggaaaatgtcctatcgtggatacttggtggcagacagaaacaggatcgattatgattacagctcttccgggagcgattcctcagaagccaggttctgcgacgttgccattttttggagtacagcctgttttagtggataacgatggtaaggagattactgataagggagaagtttctggaaatctatgtatcaaaggtccttggccttcaatgatgcgcggagtttacggagatcctaaacgattttttgaaacttacttttctcagtttaaaggatattattttacaggagacggagcgcgtagagataaagacggatatttttggatcactggaagagtggacgatgtgattaacgtttccggtcataggatcggaagcgcagaagtggaaagtgcactcgttgaaaataaatctgttgccgaagccgctgtagtaggttttccacacgacatcaaaggtcagggaatttacgcctacgttacggttaaagaaggtgttacgactaacgatgttttgaaaaaagagcttatctcaactgtggaaaaaatgatcggtaaaattgcaaggccggacgtgattcattgggctccaggtcttccaaaaacgcgttctggaaaaattatgagaaggattttaagaaaaattgtttctggagaatttgaaggtttaggagatacttctactcttgcagatccatctgtggttcaaaaattgatcgaagataaaaagaaatttcacagttaa

SEQ ID NO: 1084 - protein, 661 aa, Leptospira interrogans [sequence omitted]

SEQ ID NO: 1085 - DNA, 2535 bp, Mus musculus
  CDS (15)..(2120)
cggaacttgatgcgatggggcttcccgaggagcggcgcaagagcggcagtggaagccgggctcgtgaggagaccggcgccgagggccgggtgcggggttggtccccgccgccggaggtcagacgctcggcgcacgtcccctctctgcagcgctaccgcgagctgcaccggcgttctgtggaggagccacgggagttttggggaaacattgccaaggaattttactggaaaactgcatgccctggcccattcctccagtacaactttgatgtgactaaagggaaaatattcactgagtggatgaaaggagcaactacaaacatctgctacaacgtgctggatcgaaatgtccatgagaaaaaacttggcgacaaagttgctttttactgggagggcaatgagccaggggagaccaccaagatcacataccgtgaactcctggtccaggtgtgtcagttcagcaatgttctccgtaaacagggcattcagaagggtgaccgagtggccatctacatgcctatgatcttggaacttgtggtggctatgctggcatgtgctcgccttggagctttgcactccattgtgtttgcaggcttctctgcagagtctctctgtgaaaggatcttggattccagttgctgcctgctcatcactacagatgccttctacaggggggaaaaacttgtgaacctgaaggagctggctgatgagtccttggagaagtgccgagagaagggcttcccagtgagatgctgcattgtggtcaaacatctggggcgggcagagctgggcatgaatgactcccccagccagtccccaccagttaagaggccatgtccagatgtccagatctgctggaacgaaggggttgacttatggtggcatgaactcatgcagcaggcaggagacgagtgtgagcctgagtggtgtgatgctgaggacccactcttcatcttgtacaccagtggctccacaggcaaacctaagggtgtggtgcacacaattggaggctatatgctctatgtggctacaactttcaagtatgtgtttgatttccacccggaagatgtgttctggtgcacagcagacatcggctggatcactggtcattcctatgtcacctatgggccactggctaatggtgccactagtgttttgtttgaggggatccccacatacccagatgaagggcgcttgtggagcattgtggacaaatacaaggtgaccaagttctacacggcaccaacagccatccggatgctcatgaagtttggagatgatcctgtcaccaagcatagccgggcatccctgcaggtgctgggcacagtaggtgaacccatcaaccctgaagcctggttatggtaccaccgggtagtaggttcccagcgctgccccattgtagacaccttctggcaaacagaaacaggtggccatatgctgacccctctccctggcgccacacccatgaaacctggttctgcttctttcccattcttcggtgtagcgctgcaatccttgaatgagtccggggaggagctggaaggggaagctgaaggttatctggtgttcaagcagccctggccagggatcatgcgcacagtctatgggaaccacacacggtttgagaccacctactttaagaagttccctggctactatgtgaccggagatggctgccgacgggatcaggatggctattactggatcacgggcaggattgatgacatgctcaatgtgtctggacatctcctgagtacagcagaggtggaatcggcacttgtggaacacgaggctgtcgcagaggcagctgtggtgggccaccctcatcctgtgaagggcgaatgcctctactgctttgttaccttgtgtgatggccataccttcagccccacactcacagaggaactcaagaagcagattagagaaaagattggccccattgccacaccagactacatccagaatgcacctggcttgcttaaaccacgctcagggaaaatcatgaggcgagttctccggaagattgctcagaatgaccatgacctgggggatacatctacggtggctgacccatctgtcatcaaccatctcttcagtcaccgctgcctgaccacccagtgaacaagactcttgtccaggatttccctgtgcttggctctccaaatttctgcccatccatcctgcccctcacacagtagtactagttgacagtactagttggttgaaactagggagacagttacctagactaccaggtagaagggacaggggtcaggtcaacctcacactgatatgctcctcgactagagaggtctccaagcccagaacagagacttgaacaccatgtccttaaccaaagtcagctcttcagagtgtaaatgagggtctgactggaagcagggcagcagctgtaattcttccagctctctccaaaagcaccagttcttatcttgggcctcactaggctttagaaatgagtttgtgagtctatgaataattatttttaaaaaaactttgttgtctctgttctgagtct

SEQ ID NO: 1086 - protein, 701 aa, Mus musculus
MGLPEERRKSGSGSRAREETGAEGRVRGWSPPPEVRRSAHVPSLQRYRELHRRSVEEPREFWGNIAKEFYWKTACPGPFLQYNFDVTKGKIFTEWMKGATTNICYNVLDRNVHEKKLGDKVAFYWEGNEPGETTKITYRELLVQVCQFSNVLRKQGIQKGDRVAIYMPMILELVVAMLACARLGALHSIVFAGFSAESLCERILDSSCCLLITTDAFYRGEKLVNLKELADESLEKCREKGFPVRCCIVVKHLGRAELGMNDSPSQSPPVKRPCPDVQICWNEGVDLWWHELMQQAGDECEPEWCDAEDPLFILYTSGSTGKPKGVVHTIGGYMLYVATTFKYVFDFHPEDVFWCTADIGWITGHSYVTYGPLANGATSVLFEGIPTYPDEGRLWSIVDKYKVTKFYTAPTAIRMLMKFGDDPVTKHSRASLQVLGTVGEPINPEAWLWYHRVVGSQRCPIVDTFWQTETGGHMLTPLPGATPMKPGSASFPFFGVALQSLNESGEELEGEAEGYLVFKQPWPGIMRTVYGNHTRFETTYFKKFPGYYVTGDGCRRDQDGYYWITGRIDDMLNVSGHLLSTAEVESALVEHEAVAEAAVVGHPHPVKGECLYCFVTLCDGHTFSPTLTEELKKQIREKIGPIATPDYIQNAPGLLKPRSGKIMRRVLRKIAQNDHDLGDTSTVADPSVINHLFSHRCLTTQ

SEQ ID NO: 1087 - DNA, 1956 bp, Mycobacterium bovis
  CDS (1)..(1956)
atgagtgagtccacccccgaagtctcctcgtcatacccgccgccagcgcacttcgccgagcacgcgaacgcccgcgccgagctttaccgcgaggccgaggaagaccggctggctttttgggccaagcaggccaaccgactgtcctggacgacgccgttcaccgaggtgttggactggtcggaggcgccgttcgccaagtggttcgtgggcggcgagctcaacgtcgcctacaactgtgtggatcgtcacgtcgaggccggccatggagatcgggtcgccatccactgggaaggcgagccggtcggcgaccggcgcacgctgacctattccgatctgcttgccgaggtatccaaagccgcgaacgcgctcaccgacctcggtctggtggccggtgaccgcgtcgccatctacctgccgttgatccctgaggccgtgatcgccatgctggcctgtgcccggctaggcatcatgcatagcgttgttttcggcgggttcaccgctgcggccttgcaggcccggatcgtcgacgcccaagccaagctgctgatcaccgcggacgggcagtttcggcgcggcaagccatcgcccctcaaggcggccgctgacgaggcccttgcagcgatccccgactgctcggtcgagcacgttctggtggtgcggcgcacgggaattgagatggcctggagcgagggccgcgacctgtggtggcaccatgtcgtcggctcagcttcaccggcacacaccccggagcctttcgattccgagcacccgctgttcctgctgtacacgtcaggcaccaccggcaagcccaaaggcattatgcacaccagcggcggctatctcactcagtgttgctacacgatgcgcaccattttcgatgtcaagccggacagcgacgtgttctggtgcaccgccgacatcggctgggtcaccggccacacctacggcgtctacggcccgctgtgcaacggagtcaccgaggttctctacgagggcacgccggatacccccgaccgacaccggcatttccagatcatcgaaaaatacggcgtgacaatctattacaccgcccccaccctcatccggatgtttatgaagtggggccgtgagatccccgacagccacgacctgtccagcctgcggctgctggggtcggtcggcgaaccgatcaaccccgaggcttggcgttggtaccgcgatgtcatcggcggcggacgcaccccgctggtagacacctggtggcagaccgagaccggctccgcgatgatctccccgctgcccggaatcgctgcggccaaaccgggttcagcgatgacgccgctgcccgggatctcggccaagatcgtcgacgatcacggtgatccgttgccaccgcacaccgagggcgcccagcatgttaccgggtacctcgtcctagaccagccgtggccgtcgatgttgcgcggcatctggggcgaccccgcgcggtattggcactcttactggtccaaattttccgacaagggctactacttcgccggggacggcgctcgcatagaccccgacggcgcgatctgggtactaggccgcatcgacgacgtgatgaacgtgtccgggcaccggatctcgaccgccgaggtggaatcggcgctggtcgctcactctggcgtggccgaggcggcggtggtcggggttaccgacgagaccacgacccaggccatctgtgcgttcgtcgtgctacgcgccaactacgccccccatgaccgcacagccgaagagttgcgcaccgaagtggctcgagtgatctcgcccatcgcacggccacgcgacgtccacgtagtgcccgaactacccaagactcgtagcggcaaaatcatgcgtcgactgctgcgcgacgtcgcggaaaaccgtgagcttggcgacacgtcgacgctgctcgatcccaccgtattcgacgcgatccgggccgccaagtag

SEQ ID NO: 1088 - protein, 651 aa, Mycobacterium bovis [sequence omitted]

SEQ ID NO: 1089 - DNA, 1968 bp, Nitrosomonas europaea
  CDS (1)..(1968)
atggccacgatcgaatcaattttgcacgaaaaccggatattcccccctgccagtgaatttgtcaggaacgccaatctatccggaagggaagcctatgaaactctgcgccaggaagccgagcatgactataccggcttctgggcgaaactcgcacaacagtacattgcctggcacaaacctttcacacgggttctcaatgacgccaacccacccttttataaatggttcgacgatggcgaactgaatatctcgtggaattgtctggatcgacacctggcaacccaggctgacaaaactgccatcatctttgaatctgacgcaggagaagtgaatcactgcagttatcgtgagttacaccgccaggtctgtcattttgccaatggactgaaatcacttggaatccgtcagggtgaccgtgtcgtcatctatatgcccatgcggattgaagctgtagttgcgatgcaggcatgtgcacgcattggtgccatccattcggtagtgttcggcggtttttcagcaaaaagtgtatacgagcgcatcatcgatgccggtgcatccgctgtaatcactgcagatgaacagatccgcggaggcaggtaccatccactgaaagcaaccgtagacgaagcactggcgatgggtgacacagccacggtccacagtgtcatcgttttccggcacaccggtaccggaattacctggcagccggaacgagaccactggtggcatgatctcattgccggacaaccggatgaatgcgagccagcatggatcaatgctgaacaccccctgtttacactgtatacctcgggctctaccgggaaaccaaaaggcgtgcagcattcctcggccggttatctgctcggggcagtgaccagcatgcagtgggtattcgactatcatgcagatgatgtattctggtgtactgcggatgtaggctgggttaccggacacagctatgtcgcctatggcccgcttgccatcggtgcaactcaggtgatttttgaaggaactccgactcatccacatgccgggcgattctgggaaatcatccagaaacacaggatcacgactttttatactgcccccactgccatccgctcactgatcaaactgggatccgatctgcccgcaaaatatgatctttcttcattgcgcctgcttggatcagtaggtgaaccgatcaacccggaagcatggatgtggtattacacggtcgtcggccagtcacgctgcccggtagtcgatacctggtggcaaaccgaaaccggttgtcacatgatcgctcctgctcccggtgccatatcgaccaaacccggttcctgcactctcccgctacccggtatcgatgccgcagtggtagatgaaactggccacccggtagaacagggaaaaggtggatttctggtgatcaagcgtcccttcccttcgatgttacgcaccttgtggaatgatcctgaacgattcagaaaaacttactttccaacagatattgccggtggtcgttattatcttgccggcgattcagctcatcgggatcaggatggttatttctggatcatgggacgagttgatgacgttctgaatgtctccggccatcgtctgggtaccatggaaatcgaatctgcactggtggcgcatcctctggttgccgaagcagctgttgtagggaaaccgcacgaaatcaagggagaagtggtcgtagcatttgtcacactgagagaaaaactgcctgatgaccaacgggctgctgaaattgctgcaactttacgtgaatgggttgccagcgagattggtgcaattgctcgccccgaagaaatccggtttggtgaaaacctgcccaaaacgcgttccggcaaaattatgcgacgcctcctgcgcgccctggcaagaggtgagaccattactcaagatgtctcaacactggaaaatccggtgatcctcgaacaactcagccagacggtatga

SEQ ID NO: 1090 - protein, 655 aa, Nitrosomonas europaea [sequence omitted]

SEQ ID NO: 1091 - DNA, 1962 bp, Pasteurella multocida
  CDS (1)..(1962)
atgccgcataattcgatgttaaaagaaaatcgtcttttcaaaccaacagatgaatttcgtcgccaagccaatatttcgggcttagaaacctatcaagcgctttgggaatttgctgacaaagattatctcacctattggagtgatctggcgcgtgaattaatcacttggaaaaagccttttatgcacatctttgatgattcagaagcgcctttctataaatggttttccgatggcactttaaatgtgtcctataactgtttagatcgccacttaccagacaaagcagataaaaccgcgctgatttttgaatcagattttggtcaagtccaactctatacttatgccaaattacataatcgcgtttgccgttttgctaatgcattgcgtgaattagggatcaaaaaaggggatcgggtcattatttatttacccatgctcgtggaagctgtgattgcgatgcaagcctgtgcccgtatcggtgcggttcattcagtggtatttggtggtttttctgccagcgcactacgtgatcggattgaagatgctgaagccaaattagtgattaccgcgaatgctggattacgtggtggtaaaattattccacttaaagagaccgtggatgaagctttagaaatgggctgtaaaacaattgaaaatgttatcgtctttcaccgagtgaatattgataccccgtggaaaaaagggcgtgatctctggtggaatgaacttactgcaaaccaacccgctttctgtgagccagaatggatgaatgcggaagacccgctatttattttatacacctcgggatcaacgggtaaaccgaaaggcattgtacacagtaccggtggttatttattaggtgcattaaattcgtttcgcaatgtgtttgataataagccaaatgatattttctggtgtacggcagatgttggctggatcacgggacattcttatgtctgctatggtccgctcgccaatggcgcaacacaggtaatttttgaaggcgtaccgacttatccagatccgggacggatttggcgaatgatacaacgtcacaaaattaatgtattttacacttcaccgactttaattcgttcattgacacgcttaggcgaccatatccccaataagtatgatttatcttcactacgcttacttggcagcgtgggcgaaccaattaacccatcggcttggatgtggttttatgaagtggttggtaaaagtcgctgtccaattgttgatacctggtggcaaacagaaaccggctcgattatgctcgcaccgatacccggcgtaaccgcaaccaaaccaggttcttgtaccctaccattaccgggtattatggctgaggtgttagatgaaaatggtcaaaaatgtgcggtagaacaaggcggtgcgctcgctattaaacgtccattcccatcgatgttacgcacaatttggaatgatcctgaacgttataaatctacctatttccctgcggaatatggcggcaaatactacatcgcaggcgataatgcccatcgcgataaagacgggtatttttggattcttggacgcacagatgatgtgcttaatgtctcaggacatcgacttggtaccatggaaattgaatctgcgctcgtcgccagtccaaaagtggctgaagcggcagtggtcggtaagccagatgagatcaaaggggaagcaattgttgctttcgtagtgctgaatgatttccgtccagaaggtgaagaagcacgtcagctggcagaagaactcaaagcctgggtatccaatgaaattggtaaaattgcccgtcctgaagatatccgctttgccgataacttaccaaaaacacgctcaggcaagattatgcgtcgtttattgcgatctatcgccaaaaacgaaatgatcacacaagatatttccaccttagaaaatccacagatcatcggtcaattacaacaacaatggctttaa

SEQ ID NO: 1092 - protein, 653 aa, Pasteurella multocida [sequence omitted]

SEQ ID NO: 1093 - DNA, 1926 bp, Gamma
  CDS (1)..(1926)
atgcctcgaaagctttatagcccaaaacattcaagtaatccttatataaaagactttgatgaatacaaagaactttacaagcaatccatagaagatccttctaaattttttaaaaatctagcaaacgaaaacataagctggatggaagacttcaaaacaacattcaataatcaatttaataatgcgaagtggtttgagggtggtaaaacaaatattagcttaaactgcatcgataggcatttagaaaatgatccaaacaaaatagcattaatatgggaaggagatgaccctgctgattctaaagaattgacctacaaagagctccatgacgaagtatgtaagttcgctaatgttttaaaagacctgggtgttcaaaagggctcgagagtttgtatttatatgcctatgatcattgagactgcgttcgcaatgcttgcttgcacgcgaataggtgccgtgcactctgttgtctttggtggcttttctccagaatcactcaaagatagaattcttgatgctgattgtaaaattgttataactgctgatgaaggtttaaggggcggcaaaaaagtgccacttaaatctaatgtagatgaggctcttctgggctgtccagatgttaaaaatacactggttataaaaagaactggtggcgaaattaattgggatgataaaaaagatgtttggtatgaagatcttgttaaagatgtttctaataagtgtgctccagagcctatggattccgaagaccctcttttcattctctatacatcaggctctacaggcaagccaaagggtgttctacatactactgcaggttatctattaggcgctcatattagtttcaaatatctttttggaataaggccagaggacaaatactggtgtactgcagatgtgggatggataacaggacatacttatatcttgtacggacctctttcaaatggagcaacaacacttatgtttgaaggagtgccaacctacccttcagcatcaaggtgttgggagatatgcgataagcatgacattagtattttttatacagctccaactgccattagagctctgatggcccaaggcgatgatcctgttaaaaagacaaaaagagatagcctaagaattttaggtacagttggagagccaattaatccagaggcgtgggattggtactacagtgttgtcggtaaatctaattgcgaggttattgatacttggtggcaaaccgaaactggttctgtacttatctctccaatagcgggtattactccaacaaaacctgggtcagcaactctgcccttcttcggagttaagccatctctctatgacgagcatggaaatacgctagaaggctctaatgcaggtaatttagttattgagcaatcttggcctagtcaaattagaagtatttatggtgatcaccaaagaatgatcgacacctattttggtatgtataaagatatttactttactggtgatggagccaggcgagacgaggatggatacttctggataaccggaagagttgatgatgttcttaatgtttctggccacagactaggtacagctgaaattgaaagtgctcttgtgctccaccctaaaattgctgaagcagctgttgttggttttgatcatccaattaaggggcaaggaatatatgcttttgttactttaatgataaatgaatcatttgatgacaactttagttatgaattgaaacaatttgttgctaaagaaattggagctattgcaaaaccagatttaattcaaaatgctccaggcttgcctaaaacaagatcgggaaaaattatgcgcagaattcttagaaagattgctgagaatgatctatctaatttaggagacacgacaacccttgccgatccttcggttgttgagtctcttatagaaaacaaacaaagtttatga

SEQ ID NO: 1094 - protein, 641 aa, Gamma [sequence omitted]

SEQ ID NO: 1095 - DNA, 1983 bp, Ralstonia solanacearum
  CDS (1)..(1983)
atggctggcattgaatctgttctgcaggaaacgcgtgtcttcgagccgcccgcgtccttcgtcaaacaggccaacatcgccggcatggacgcctaccgcaccctgtgcgccgaggccgagcgcgactacgaaggcttctgggcgcgtctggcgcacgagcacctgctgtggcacaagcccttctccaaggtcctcgacgaatccagggcgccgttctacacctggttcgaggacggtgagctcaacgcctcgtacaactgcctcgagcgcaacctggagaacggcaacgccgacaaggtcgccgtgatcttcgaggccgacgatggctcggtcgcgcgcatcacctatcgcgagctgcatgcccgcgtgtgccgcttcgccaatggcctgaaggcactgggcatccgcaagggcgaccgcgtggtgatctacatgccgatgtcgatcgagggcgtcgtcgccatgcaggcctgcgcgcgcatcggggcgacgcactcggtggtgttcggcgggttctcggccaagtcgttgcaggagcggatcgtcgacgtgggggccgttgccgtcatcacggccgacgagcagatgcgcggcggcaaggcgctgccgctcaaggccatcgccgacgaggcgctggcgatggagggcagcgaggccgtccgccacgtgatcgtctatcggcgcaccggcgccggcgtgaactgggtcgagggccgcgaccgcgccatggacgaagtcgaagccggccagcccgacacctgcgaggtcaccccggtcggcgccgagcatccgctgttcatcctctacacctcgggctcgaccggcaagcccaagggcgtgcagcacagcaccggcggctacctgctgtgggcgctgctgacgatgcagtggaccttcgacctgaagcccgacgatgtcttctggtgcaccgccgacatcggctgggtcaccggccacacctatatcgcgtatggcccgctcgccgccggcgccacccaggtggtgttcgagggcgtgccgacctacccgaacgccggccgcttctgggacatgatccagaagcaccgggtcaacaccttctacactgcgccgacggcgatccgctcgctgatcaaggccgccgaggccgatgagacgagccacccgaagcggtacgacctgtccagcctgcgcctgctgggcaccgtgggcgagccgatcaacccggaagcctggatgtggtaccacacgaacatcggcggcggccgctgcccgatcgtcgacaccttctggcagaccgagaccggcggccacatgatctcgccgctgccgggcgcgacgccgctggtgccgggctcatgcacgctgccgctgccgggcatcatggccgccatcgtcgacgagaccgggcaggacctgccggacgggcagggcggcatcctcgtcgtcaagcggccgtggccggcgatgatccgcaccatctggggcgatccggagcgcttccgcaagagctacttcccggccgaactgggcggcaagctctacttggccggcgacggctcggtgcgcgacaaggaaaccggctacttcaccatcatgggccgcatcgacgacgtgctgaacgtctcgggccaccgcatgggcacgatggagatcgaatcggcgctggtggccaacccgctggtggccgaggccgccgtggtgggccgcccggacgacatgaccggcgaggccatctgcgccttcgtggtgctcaagcgcacgcgcccgaacggggacgaggcccggcagatcgccaccgacctgcgcaactgggtcggcaaggagatcggcccgatcgccaagccgaaggacatccgcttcggcgacaacctgcccaagacgcgctcgggcaagatcatgcggcgcctgctgcgctcgatcgccaagggcgaggacatcacgcaggacacctccacgctggagaacccggccatcctggagcagctcaaggaagcccgctga

SEQ ID NO: 1096 - protein, 660 aa, Ralstonia solanacearum
MAGIESVLQETRVFEPPASFVKQANIAGMDAYRTLCAEAERDYEGFWARLAHEHLLWHKPFSKVLDESRAPFYTWFEDGELNASYNCLERNLENGNADKVAVIFEADDGSVARITYRELHARVCRFANGLKALGIRKGDRVVIYMPMSIEGVVAMQACARIGATHSVVFGGFSAKSLQERIVDVGAVAVITADEQMRGGKALPLKAIADEALAMEGSEAVRHVIVYRRTGAGVNWVEGRDRAMDEVEAGQPDTCEVTPVGAEHPLFILYTSGSTGKPKGVQHSTGGYLLWALLTMQWTFDLKPDDVFWCTADIGWVTGHTYIAYGPLAAGATQVVFEGVPTYPNAGRFWDMIQKHRVNTFYTAPTAIRSLIKAAEADETSHPKRYDLSSLRLLGTVGEPINPEAWMWYHTNIGGGRCPIVDTFWQTETGGHMISPLPGATPLVPGSCTLPLPGIMAAIVDETGQDLPDGQGGILVVKRPWPAMIRTIWGDPERFRKSYFPAELGGKLYLAGDGSVRDKETGYFTIMGRIDDVLNVSGHRMGTMEIESALVANPLVAEAAVVGRPDDMTGEAICAFVVLKRTRPNGDEARQIATDLRNWVGKEIGPIAKPKDIRFGDNLPKTRSGKIMRRLLRSIAKGEDITQDTSTLENPAILEQLKEAR

SEQ ID NO: 1097 - DNA, 1956 bp, Rhizobium loti
  CDS (1)..(1956)
atgtccgaggttcatgtccatcgcgtccagccggcgtggaagaagaatgcgctgatcgacaacgacacgtacctgaaatggtatgccgacagcatcaagaacccggacaagttctggggcaagcacggcaagcgcatcgactggttcaagcccttcagcaaggtcaagaacacctccttcgacggcaaggtctcgatcaaatggttcgaggacgggctgaccaatgtttcctacaactgcatcgaccgccatctgaagaagcgcggcgaccagacggccatcatctgggaaggcgacaacccctacgacgacaagaagatcacctacaacgagctctacgagcgcgtttgccggctcgccaatgtgatgaagaagcacggcgtcaagaagggcgaccgcgtcaccatctacatgccgatgatcccggaagccgcctatgcgatgctggcctgcacgcgtatcggcgccatccattcgatcgtcttcggcggcttttcgcccgatgcgctggccggccgcatcgtcgactgcgaatcgaccttcgtcatcaccgccgatgaaggcctgcgcggcggcaagtcgattccgctgaaggagaacaccgacaaggcgatcgacatcgccgcgaagaacttcgtcatggtgaagaacgtcctcgtcgtgcgccgcaccggcggcaaggtcggctgggcgccgggccgcgacctctggtatcacgacgaggtcgcgacggtgaaggccgagtgcaagcccgagaagatgaaggcggaagacccgctgttcatcctttatacctcaggctcgaccggcaagccgaagggcgtgctgcacaccaccgccggctatctcgtctatgcctcgatgacgcaccaatatgtcttcgactaccatgacggcgatatctactggtgcaccgccgatgtcggctgggtgacgggccacagctacatcgtctatggcccgctcgcgaacggcgccaccacgctgatgttcgagggtgtgccgaattacccctcgcagtcgcgcttctgggaagtcatcgacaagcacaaggtcaacatcttctacaccgccccgacggcgctgcgcgcgctgatgggcgccggcaacgacccggtgaagaagacctcgcgcaaatcactgcgtgtgctcggctcagtcggcgagccgatcaatccggaagcctgggagtggtatttcaacgtcgtcggcaacggcaaggtgccgatcgtcgacacatggtggcagaccgagaccggcggcatcctgatcacgccgctgccaggcgccaccgacctcaaggcaggctcggcgacgcggcccttcttcggagtcaagccgcagctagtcgacggcgaaggcaaggtgctggaaggagccgccgacggcaatctttgcatcaccgattcctggccgggccagatgcgcaccgtctatggcgatcacgaccgcttcgtgcagacctatttctccacctacaagggcaagtacttcaccggcgacggctgccgccgcgacgccgacggctactactggatcaccggccgcgtcgacgacgtcatcaacgtctccggccaccgcatgggcacggccgaggtcgaatcggcgctggtgagccatgacaaggtctcggaggccgccgtcgtcggctacccccacgacattaagggccagggcatttacagctacgtcaccttgatgaagggcgaggaaccgaccgaggatctgcgcaaggagctcatcgcccatgtccgcaaggagatcggcgccatcgcctcgcccgacaagatccagttcgcccctggcctgcccaagacacgttccggcaagatcatgcgccgcatcctgcgcaagatcgccgaggacgatttttctacccttggcgacacctcgacgctcgccgatccggccgtcgtcgacgacctcatcgccaaccggcagaacaagaagggctga

SEQ ID NO: 1098 - protein, 651 aa, Rhizobium loti
MSEVHVHRVQPAWKKNALIDNDTYLKWYADSIKNPDKFWGKHGKRIDWFKPFSKVKNTSFDGKVSIKWFEDGLTNVSYNCIDRHLKKRGDQTAIIWEGDNPYDDKKITYNELYERVCRLANVMKKHGVKKGDRVTIYMPMIPEAAYAMLACTRIGAIHSIVFGGFSPDALAGRIVDCESTFVITADEGLRGGKSIPLKENTDKAIDIAAKNFVMVKNVLVVRRTGGKVGWAPGRDLWYHDEVATVKAECKPEKMKAEDPLFILYTSGSTGKPKGVLHTTAGYLVYASMTHQYVFDYHDGDIYWCTADVGWVTGHSYIVYGPLANGATTLMFEGVPNYPSQSRFWEVIDKHKVNIFYTAPTALRALMGAGNDPVKKTSRKSLRVLGSVGEPINPEAWEWYFNVVGNGKVPIVDTWWQTETGGILITPLPGATDLKAGSATRPFFGVKPQLVDGEGKVLEGAADGNLCITDSWPGQMRTVYGDHDRFVQTYFSTYKGKYFTGDGCRRDADGYYWITGRVDDVINVSGHRMGTAEVESALVSHDKVSEAAVVGYPHDIKGQGIYSYVTLMKGEEPTEDLRKELIAHVRKEIGAIASPDKIQFAPGLPKTRSGKIMRRILRKIAEDDFSTLGDTSTLADPAVVDDLIANRQNKKG

SEQ ID NO: 1099 - DNA, 2016 bp, Rhodopirellula baltica
  CDS (1)..(2016)
atgcccaccgcgtccgcgtctgaatccagttccaaccaacccgaatcctcaaatgcgtcgggatcaatcgatcacgtgttggtggaagaccgtctgtttcacccgtcggccgagtttacgtccaaggcggtgatctcgacggaagaacagtacgaaaagctggccaccgcagctcgcgaaaatccagatgagttctggcgggcggaggctctggaacatctgcattggttcgaaccgtttggcaccgtatgcgattggcagccgcctcacgcgaaatggtttgtgaacggcaaaaccaacgcgtgctacaacagcgtcgacgctcacgtggcagccggtcgtggtgatcggaccgcgattatttgggaaggcgaaccggtcgaagacggtcagccacgcgaccagcggacgttgacgtatgccgaattgcaaaccgaagtcgccaagtgtgccgaaggattgacgcagttgggcattggtgtcggcgacgtcgtgagcatctacatgccgatgacacctgaactcgccgtcgcgatgctggcgtgtgctcgaatcggtgcgattcactcggtgattttcgcgggattcagcgcagaatcgattgcggagcggaacaatgacgcatcggccaagttggtcatcacttccgacggtctgtatcgccgcggcaaagtgctgccgttgaaagcgaccgtggacgaagcactcgaaaagtcaccaacggttgaaaagtgcttggtgcttcgccgaaccggggatgatgcaccgatgcaggaaggtcgcgacgtttggtggcatgatgtcgttgaaaaccaacctggcgagatggcggccaagccactcgacagtgaaacgccgttgttcatcctctacacctccggcagcaccggcaaaccaaagggcattctgcacaccaccgcgggatacaacttgtgggctaaacggacctttgagtgggtgttcgatcatcgcgaaggcgatgtttattggtgcacggcagattgcggttggatcaccggtcacagctatgttgtgtacggacctttgtcggctggcgcgacgtgtttgatgtacgaaggggcgccgaacttccccgccgaagatcgtttttgggacatcgtcgagcgtcacaaggtcagcattctttacaccgctccgaccgccgttcgagcgttcatcaaatggggcgacgaacatgtcgacaagcatgatttgtcgagtctgcgattgctaggaagtgtcggcgaaggcatcaatccagaagcttggatgtggtaccacaaaaagatcggtggcgagaaatgtccgatcgtcgacacgtggtggcaaaccgaaacgggcggcatcatgatgagtcccctgccagggatcacgcctacgaaaccgggatcttgcacccgtccattgcctggcgtggtgcccagcattgtcgacgaacttggcaactcggtggacagtgagcacggcggaaaactttgtatttcgcaaccctggcccggaatgttacgtgggatctacggcgatgaagaacgcttcgttgaacagtattggtctgacgtgccggacaagtatctgacgggtgacaacgctcgctgcgataccgatggctattactggatcatgggacgcatcgacgatgtgatcaatgtttccggccaccgcttgagcacgatcgaggtggagtccgcgttggtttctcaccccgatgtatgcgaagccgccgttgtgggacgtccgcatgatttgaagggacaagccatcgcggcatttgtcacttccaatgaccgcgggcacgacgacgaattccgaaacgagttgaagcagcacgtgcgaaagcagatcggcgcgttggctcagcccgatgacattcgcttcacggcggcgcttcccaagacccgaagtggcaaaatcatgcggcgattgctgcgagatgttgccgcgggacgcgaattggtgggcgacacatcgacgctggaagacctttcctcgctcgcgaaactgcgtgaggaagactag

SEQ ID NO: 1100 - protein, 671 aa, Rhodopirellula baltica [sequence omitted]

SEQ ID NO: 1101 - DNA, 1959 bp, Salmonella typhimurium
  CDS (1)..(1959)
atgagccaaacacataaacacgccattcccgccaacattgcggatcgttgcctgataaatccagagcagtatgagactaaatataaacagtctattaacgaccccgatacgttttggggcgaacagggaaaaattctcgattggatcacgccgtaccaaaaagtgaaaaacacctcctttgcgccaggcaatgtgtcgattaaatggtacgaggacggcacgctgaatctggcggcgaactgtcttgaccgccatttgcaggaaaatggcgatcgcaccgccattatctgggaaggcgatgacacgtcgcagagtaaacatatctcttatcgcgaactgcatcgcgatgtctgccgtttcgcgaatacgctgctggatctgggcattaaaaaaggcgatgtggtagcgatttatatgccgatggtgccggaagcggcggtggcaatgttggcctgcgcccgcatcggtgcggtgcattcggtgatcttcgggggcttctcgccggaagccgtcgccggacgcattatcgactccagctcgcggctggtgatcaccgctgacgaaggtgtacgtgccggacgcagtatcccgctgaaaaagaatgtcgatgacgcgctgaaaaacccgaatgtcactagcgttgagcatgtgatcgtcctgaagcgcaccggcagcgacattgactggcaagaaggccgcgacctgtggtggcgcgatttgattgaaaaagccagccctgagcaccagcctgaagcgatgaatgccgaagatccgctgtttatcctttatacctccggctccaccggcaagccgaaaggcgtgctgcacaccaccggcggctatctggtctacgccgcgaccacctttaagtatgtctttgattatcaccctggcgatatttactggtgtaccgccgatgtgggttgggtgacggggcacagctatctgttgtatggcccgctggcctgcggcgcgaccaccttaatgtttgaaggcgtgccgaattggccaacgcccgctcgcatgtgccaggtggtcgacaaacaccaggtcaacattctctataccgccccgacggccatccgcgcgctgatggcggaaggcgataaagccattgaaggcaccgaccgttcttcactgcgcattctgggttccgtcggcgagccgatcaatcccgaagcgtgggaatggtactggaagaagatcggcaaggaaaaatgtccggtcgtcgacacctggtggcagactgaaacaggcggttttatgatcacgccgctaccaggcgctatcgaactgaaagccggttccgccacccgtcctttctttggcgtacagcctgcgctggtggataacgaaggccatccgcaagaaggcgcgacggaaggcaatctggtcatcaccgattcctggccgggccaggcgcgcactctgttcggcgatcatgaacgttttgagcagacctatttctctacctttaagaatatgtatttcagcggcgacggcgcgcgtcgcgatgaggacggctattactggatcaccggtcgcgtggacgacgtgttaaacgtctccggccaccgtctgggtacggcggaaatcgagtcagcgctggtggcgcatccgaagatcgccgaagcggcggtggtgggtattccacacgctatcaaaggccaggcgatttacgcttatgtgacgctcaaccacggcgaggagccgtcgccagaactgtacgcggaggtgcgcaactgggtacgtaaagagattggcccactggcgacgccggacgtgctgcactggaccgactcactgccaaaaacccgttccggcaaaattatgcgccgcattttgcgcaaaatcgcggcgggcgataccagcaatctgggcgatacctcgactctcgccgatcctggcgtggtggagaaactgctcgaagagaagcaggccatcgcgatgccgtcataa

SEQ ID NO: 1102 - protein, 652 aa, Salmonella typhimurium
MSQTHKHAIPANIADRCLINPEQYETKYKQSINDPDTFWGEQGKILDWITPYQKVKNTSFAPGNVSIKWYEDGTLNLAANCLDRHLQENGDRTAIIWEGDDTSQSKHISYRELHRDVCRFANTLLDLGIKKGDVVAIYMPMVPEAAVAMLACARIGAVHSVIFGGFSPEAVAGRIIDSSSRLVITADEGVRAGRSIPLKKNVDDALKNPNVTSVEHVIVLKRTGSDIDWQEGRDLWWRDLIEKASPEHQPEAMNAEDPLFILYTSGSTGKPKGVLHTTGGYLVYAATTFKYVFDYHPGDIYWCTADVGWVTGHSYLLYGPLACGATTLMFEGVPNWPTPARMCQVVDKHQVNILYTAPTAIRALMAEGDKAIEGTDRSSLRILGSVGEPINPEAWEWYWKKIGKEKCPVVDTWWQTETGGFMITPLPGAIELKAGSATRPFFGVQPALVDNEGHPQEGATEGNLVITDSWPGQARTLFGDHERFEQTYFSTFKNMYFSGDGARRDEDGYYWITGRVDDVLNVSGHRLGTAEIESALVAHPKIAEAAVVGIPHAIKGQAIYAYVTLNHGEEPSPELYAEVRNWVRKEIGPLATPDVLHWTDSLPKTRSGKIMRRILRKIAAGDTSNLGDTSTLADPGVVEKLLEEKQAIAMPS

SEQ ID NO: 1103 - DNA, 1953 bp, Shewanella oneidensis
  CDS (1)..(1953)
atgagctcgcagtctctctacaaagtctccggcaatatcgctgccaatgcacttgtaaataacgatcaatataaaacaatgtaccaagagtcgattgtcaatccagagggtttctggagagagcacggcaaacggatcgattggataaagccatacactaaaatcaaaaaaaccacttttgacgatcataacttatcgattaactggttctatgacggcaccctaaacgcctcagctaactgcttagatcgccatctagctgcgcacagcgatcgcgtcgccattatttgggaaggcgataacgccaacgaacaacgtaaaattacctacggtgagctgcacactcaagtatgtaagtttgccaacgcgttacgcagccaaggcgtacgccgtggcgatatcgtcacgatttatatgccgatggtgccagaagccgccgtcgcgatgctggcctgtgctcgcattggtgctgtgcattccgttgtttttggtggtttctcacccgattctatcgcctcacgggttatcgatggtaaatccaaaatcgtcatcacctccgatgaaggtatgcgtggtggccgcgccattccgctcaaacgcaacatcgacgatgcgttaaaacatcccgatgtaaccagtgttgagaaagtcattgtacttaaacgtactggcggcaagattgactgggtagaaggtcgggatgtgtggtggcattcactggttgaaaccgcatccgaacattgcgctgtcgaagaaatgggcgccgaagatccgctgttcttactctatacctcaggttcaacgggtaatccaaagggcgtattgcacactactggcggttatatggtgtatgcctccatgacccacgaatatgtgttcgattacaaacccggtgagatttactggtgtacggccgatgtaggttggatcaccggtcactcttacatggtttatggtcctcttgcgaacggcgcaactgtgcttatccacgaaggggtacccaatcacccaagcccagcgcgtttaggcgagatgattgaccgccataaagtcaatattctctatactgcacctacgcttattcgcgcactgatggccgaaggtaagcaacattttgataagtacaatggcagctcactgcgcatcatgggctctgtaggtgaaccaatcaacccagaagcttggcgttggtaccatgaagtcatcggccacgagcattgcccgattgtcgatacttggtggcaaaccgaaactggcggtattttgatcaccccactgccaggcgcaaccgataccaaaccaggctcggcgactcgccccttctttggcgtgcaacccgcgcttgtggacaacatgggtaacattttagaaggtgcaaccgaaggtaacttagtgctgctcgactcatggccaggccaaatgcgtaccgtgtatggcgaccatgaaagattcgtactcacctattttaaaaccttccgcggcatgtatttcactggtgacggcgctcgccgcgatgaagatggttattactggatcacaggccgtgtggacgatgtgattaacgtctctggccacagattaggtaccgccgaagtcgaaagtgcgctggtttcacacgagctggtcgctgaggccgcagttgtgggctatccccatgatattaaaggccaagggatttatgcctatgtcaccttaacccgcggcacagaagaaagtgaagaacttcgccaagaactgcgccaatgggttcgtaaggaaattggcgccttagccacaccggatcttatccagtgggcgacaggattgcctaagacccgttctggcaaaatcatgcgccgcttcctgcgtaagattgccgctaacgaagtgaccaatttaggggatgcatcaacactggcagacccagccgtgattgaaaccttgattgagactcgcttaaatcgcaacgagtaa

SEQ ID NO: 1104 - protein, 650 aa, Shewanella oneidensis [sequence omitted]

SEQ ID NO: 1105 - DNA, 1959 bp, Streptomyces avermitilis
  CDS (1)..(1959)
atgagcaacgaaagcctggccaacctgctgaaggaagagcgcaggttcgcgccgcccgccgacctggcggcgaacgccaatgtcaccgcggaggcgtatgagcaggccaaggctgacaggctcggcttctgggccgagcaggcccgccggctgacctgggccaccgagccgaccgaaacgctggactggtcgaacccgccgttcgccaagtggttcaaggacggcaagctcaatgtcgcgtacaactgcgtcgaccgccacgtcgaggcgggccacggcgaccgcgtcgcgatccacttcgagggcgaacccggcgacagccgtgccatcacctacgccgagctcaaggacgaggtctccaaggccgccaacgccctgaccgagctgggagttcagaagggcgaccgggtcgccgtctacctcccgatgatccccgaggcggtcgtcgcgatgctcgcgtgcgcccgcatcggcgccgcgcactccgtcgtcttcggcggattctcggccgacgcgatcgcggcccgtatcaaggacgccgacgccaagctggtcatcaccgccgacggtggctaccggcgcggcaagccctccgcgctcaagcccgccgtcgacgacgccgtcagccgcggggacggggtcgagaaggtgctcgtcgtgcggcgtacgggccaggaagtcgcctggaccgagggccgcgacgtctggtggcacgagatcacggccaagcagtccgccgaacacacgcccgaggccttcgacgccgagcaccccctgttcatcctctacacgtccgggaccacgggtaagccgaagggcatcctgcacacctccggcggctacctcacccagacgtcgtacacccaccacgccgtcttcgacctcaagccggagaccgacgtctactggtgcacggccgacatcggctgggtgaccggccactcgtacatcacgtacgggccgctctcgaacggcgcgacgcaggtcatgtacgagggcacgcccgacaccccgcaccagggccgcttctgggagatcgtccagaagtacggcgtcaccatcctctacaccgcgcccaccgcgatccgtacgttcatgaagtggggcgacgacatccccgcgaagttcgatctgtcctccctccgggttctggggtccgtcggcgagcccatcaaccccgaggcgtggatctggtatcgcaagcacatcggcggcgaccgcacgccgatcgtggacacctggtggcagaccgagaccggcgcgatgatgatctcgccgctgccgggcgtcaccgagaccaagccgggctccgcccagcgcccgctgccgggcatctcggcgacggtggtggacgacgaggcccgggaagtacccaacgggggcggtggctatctcgtcctcaccgaaccgtggccgtcgatgctgcgcaccatctggggcgacgaccagcggttcctcgacacgtactggtcgcgcttcgagggcaagtacttcgccggtgacggcgcgaagaaggacgaggacggcgacatctggctgctcggccgcgtcgacgacgtcatgctcgtgtccgggcacaacatctcgacgaccgaggtcgagtcggcgctcgtctcccacccgtcggtcgccgaggcggccgtggtcggtgccgccgacgagacgaccgggcaggccatcgtcgccttcgtgatcctgcgcgggacggcgaacgccgaggacgacaacctggtcgccgacctgcgcaaccacgtcggcaccacgctcggcccgatcgccaagcccaagcggatcctcccggtggccgagctgccgaagacccgctccggcaagatcatgcggcgcctgctgcgcgacgtcgccgagaaccgggccctcggagacgtcaccaccctgaccgattcctcggtgatggatctgatccagtccaagctcccggcggcgccgagcgaggactga

SEQ ID NO: 1106 - protein, 652 aa, Streptomyces avermitilis [sequence omitted]

SEQ ID NO: 1107 - DNA, 1971 bp, Synechococcus elongatus
  CDS (1)..(1971)
atgagtcatcccacgattgagtcgattcttcaggaaaaccgccttttttatccccccgatgattttgtggccaaggcgcggattcattcccttgaggcctacaatgccctctacgaaaaggcaaaagctgatcccgccgctttttggggagagcttgcccagcaggagctagagtggtttcaaccttgggagcaagtactggattggcagccgcccaatgccaagtggtttgtcaatggcaaaatcaacatcacctacaactgcttggatcgccacctcaaaacatggcgcaagaataaagccgccttaatctgggaaggcgaacccggtgatagccgcactctcacctatgcccaactgcaccgtgaggtgtgccaatttgccaatgttctcaagcaactaggggtgaaaaagggcgatcgcgttggtatttatatgccgatgattccagaggcagccattgccatgttggcctgtgcgcgcattggtgcgccccactcagtggtctttggcggttttagtgctgaagccttgcgcgatcgcctcattgatgcccaagccaaactggttgttaccgctgacggtggctggcgtaaagatgccattgtacccctgaaagatcaggtggataaagcccttgcccatcaaggcgttcccagcgttgaaaatgtcttggtggtgcagcgcacccagcagccagtaaccatggtgcccggtcgcgatcactggtggcacgatttgcaaaagggagtcagtgccgactgtcctgccgaacctatggacagcgaggatttactctttatcctttacacctccggctccaccggcaaacccaagggtgttgtccacaccaccgcaggatacaacctctacacccatatcaccactcaatgggtctttgacctccaagataccgatgtctattggtgtaccgccgatgttggctggattacgggtcacagctatattgtctatgggccgctgtccaatggtgccaccaccctcatgtatgaaggggcaccccgcccctccaaccccggttgcttctgggatgtgattgagaagtatggggtgacgattttttacacggctcccactgctattcgtgccttcatcaaaatgggtgaacacttgccgcgggcgcgcgacctctcctccctacgccttttgggaaccgtgggtgaacccatcaaccccgaagcatggatgtggtactaccgcgtcatcggcggtgagcgctgcccgattgtggatacctggtggcaaacggaaaccgggggtcacatgatcacctcactgccgggggcacttcctatgaagcccggctctgctagcaagccctttccggggattctcgccgatgtcgtggaccttgagggcaacccggtcggcgtcaatgagggtggctatctggtcattcgtcatccttggccggggatgatgcgcacggtgtatggggatcccgatcgcttccgccgcacctattgggagcacattccccctcgcgatggtcagtatttttactttgccggcgatggtgcccgcagggatgaagatggctacttttgggtgatgggacgggttgacgatgtgatcaatgtctcgggccaccgcctgggcaccatggaaattgaatcggcattggtctcccaccctgccgttgctgaagccgccgttgtgggtaaacccgacgaggtcaaaggggaagagatcgttgcttttgtgattcttgaaggatcggcgacccccagtgatgccctccaacaggaattaaagcaacacgttgtcaatgaaattggtgccttggcacgtccagcggagattcgctttaccgatgccctacccaagacacggtcaggcaaaatcatgcggcggctgctccgttccctagccgcaggtcaagaggtagttggcgatacttcaaccttggaggatcgctcagtcctcgataggctgcgccaagggagttga

SEQ ID NO: 1108 - protein, 656 aa, Synechococcus elongatus [sequence omitted]

SEQ ID NO: 1109 - DNA, 1950 bp, Vibrio cholerae
  CDS (1)..(1950)
atgagtgaagcccatatttatccggtcaaacagaacatcaaagcgcatacgcatgccgataacgacacctatctggcgatgtatcaacagtccatcaaagatccggaaggcttttggagcgaacacggcaaaatcgtcgactggattaaacctttcaccaaggtgaaacacacctcttttgacccagggcacatcgatatccgctggtttgaagatggcacgttaaacgtttctgccaactgtattgatcgccatttggcgacccgtggcgaccaagtcgcgatcatttgggaaggcgacgacccgactcaagacaaaactctgacgtataagcaactgcaccaagaagtgtgccgttttgccaatgcgctgaaagagcaaggcgtacgcaagggtgatgttgtctgtatctacatgcctatggtgccagaagcggcggttgctatgttggcttgtacccgtattggcgcagtgcacactatcgtctttggtggcttctcgccagaagcactggctggacgcattatcgactcgaacgccaaattagtgatcactgccgacgaaggtgttcgcggcggccgcgccgtccccctaaagaaaaacgtcgatgaagcactgtgcaatccagaagtcaaaaacatcagtaaagtgatggttcttaagcgtactggcggcaatgtcgcttggcatgaacaccgtgacatttggtggcatgaagcaaccgcaaaagcctccgataattgtccaccagaagagatgaaagccgaagatccgctgtttatcctctacacctctggctcaaccggtaaaccgaaaggcgtattgcacaccactggcggttatttggtttatgcgactatgaccttcaaatatgtattcgactatcagcccaatgaagtgttctggtgtaccgctgatgtgggttggataacgggtcactcctatctggtgtatggcccattggcgaatggcgcaaaaaccattctgtttgaaggcgtgccaaactaccccaccaccgcacgcatgagcgaggtggtagacaagcataaggtcaatatcctttacactgcgccaacggcgatccgtgcgctgatggccaaaggtgatgaagcgattaaaggcactagccgtgacagcttgcgcattatgggctctgtgggtgaaccgattaacccagaagcgtgggagtggtactaccgcacgatcggtaacgaaaaatcaccgattgtggatacttggtggcaaaccgaaaccggcggtatcttgatcacgccactgccgggggcaacggcgttgaaaccaggttcggccacacgcccgttctttggtgtgcagccagcgttagtcgataacatgggcgaaattgtggaaggcgcaactgaaggcaacttggtactgctcgattcatggccgggtcaaatgcgcactgtgtatggcgatcacgaccgctttgaacaaacctacttctctacctttaaaggcatgtactttaccggtgacggcgcgcgtcgcgatgaagacggttactactggatcacaggccgtgtcgatgacgtactcaacgtttcgggtcaccgtatgggaacggcagaaattgaatccgcactggtggcattcaataagattgcagaagccgccgtggtcggtgttccacacgatatcaaaggccaagcgatttacgcttacatcacactcaatgatggggtgtatccgagcgctgaactgcataaagaagtgaaagattgggtacgcaaagagattggcgctatcgcgacaccggatgtcctacactggaccgatgcgctaccgaaaacccgttcaggtaaaattatgcgccgtattttgcgtaaaattgccaccggcgataccagtaacttgggggatacctcaacgctggccgatccaagcgtggttgaccgcctgattgcggaaaaagcccaacttaaataa

SEQ ID NO: 1110 - protein, 649 aa, Vibrio cholerae [sequence omitted]

SEQ ID NO: 1111 - DNA, 1953 bp, Vibrio parahaemolyticus
  CDS (1)..(1953)
atgagcgaagcccacgtttatccggtaaaagaaaatattaaaactcatacacacgcggataatgatacctacctagccatgtatcagcagtcggtcaccgatccagagggcttctggaacgagcacggcaaaatcgttgattggatcaaacctttcaccaaagtaaaaagtacctcattcgacaccggccacgttgacattcgctggtttgaagatggcacactgaacgtatctgcaaactgtatcgaccgtcatctcgcagaacacggcgacgacgtagcgatcatctgggaaggcgatgatccagcagacgacaaaacgctgactttcaacgaactgcacaaagaagtgtgcaagttctctaacgcattaaaagaccaaggcgtgcgcaaaggcgacgtggtgtgtttatacatgccaatggtgccagaagcagctatcgctatgctggcgtgtacacgcatcggcgcggtgcataccgtggtgtttggtggtttctcaccagaagcactgtctggtcgtatcatcgactctgacgcgaaagttgtgatcactgcggacgaaggtgtgcgcggtggacgtgccgttccactgaaaaagaacgtggacgaagcactcactaacccagaagtaaaaactatcagcaaagttgtggtactaaaacgcacaggcggcaatgtagattggcatgggcatcgtgatgtttggtggcacgaagcaaccgcaaaagtatctgatgtttgtccaccagaagagatgaaagcggaagacccactgttcatcctctacacatctggctcgacaggcaaaccaaaaggcgtacttcacaccacaggtggctaccttgtttatgcggccatgacgtttaaatacgtcttcgattaccaaccaggtgaaaccttctggtgtaccgcagacgtaggctggattactggccacacgtaccttatctacggaccacttgcgaacggcgcgaaaaccatcctgttcgaaggtgtaccaaactacccgaacacaagccgtatgagcgaagtggtcgataagcatcaagtgaacattctgtacaccgcaccaacagctattcgtgcgctgatggcaaaaggcaacgaagcggttgctggcacgtctcgctcaagccttcgcatcatgggctcagtgggcgaaccaatcaacccagaggcatgggagtggtactacaaaacgatcggaaacgaaaattcacctatcgtcgacacttggtggcaaacggaaaccggcggcatcttgattgctccacttccgggagcgacagatctcaaaccaggttcagcaactcgcccattcttcggcgtacaacctgcgctggttgataacatgggtaatatccttgaagacaccgtggctgaaggtaacttggtaattcttgattcttggccaggtcaaatgcgtacggtttacggcgaccatgaacgcttcgaacaaacctacttctcaacctttaagggcatgtacttcaccagtgacggcgcgcgtcgtgacgaagacggctattactggatcactggccgcgtcgatgacgtactgaacgtgtctggacaccgtatgggcaccgctgaaattgaatctgcgctagtcgcgcatcataaaattgccgaagccgcgattgttggtattccacacgacattaaaggccaagcgatctacgcctacatcacgctcaacgatggcgagttcccatccgcagagctgcacaaagaagtgaaagattgggtgcgtaaagagattggtccaattgcaacgcctgacgtactgcactggacagactctctaccaaagactcgttcaggtaagatcatgcgtcgtattctgcgtaagattgcgacaggtgatacaagcaacctaggcgatacttcaacgcttgccgatccaagtgtagtagacaaactcatcgccgaaaaagcagaactggtataa

SEQ ID NO: 1112 - protein, 650 aa, Vibrio parahaemolyticus
MSEAHVYPVKENIKTHTHADNDTYLAMYQQSVTDPEGFWNEHGKIVDWIKPFTKVKSTSFDTGHVDIRWFEDGTLNVSANCIDRHLAEHGDDVAIIWEGDDPADDKTLTFNELHKEVCKFSNALKDQGVRKGDVVCLYMPMVPEAAIAMLACTRIGAVHTVVFGGFSPEALSGRIIDSDAKVVITADEGVRGGRAVPLKKNVDEALTNPEVKTISKVVVLKRTGGNVDWHGHRDVWWHEATAKVSDVCPPEEMKAEDPLFILYTSGSTGKPKGVLHTTGGYLVYAAMTFKYVFDYQPGETFWCTADVGWITGHTYLIYGPLANGAKTILFEGVPNYPNTSRMSEVVDKHQVNILYTAPTAIRALMAKGNEAVAGTSRSSLRIMGSVGEPINPEAWEWYYKTIGNENSPIVDTWWQTETGGILIAPLPGATDLKPGSATRPFFGVQPALVDNMGNILEDTVAEGNLVILDSWPGQMRTVYGDHERFEQTYFSTFKGMYFTSDGARRDEDGYYWITGRVDDVLNVSGHRMGTAEIESALVAHHKIAEAAIVGIPHDIKGQAIYAYITLNDGEFPSAELHKEVKDWVRKEIGPIATPDVLHWTDSLPKTRSGKIMRRILRKIATGDTSNLGDTSTLADPSVVDKLIAEKAELV

SEQ ID NO: 1113 - DNA, 1944 bp, Xanthomonas axonopodis
  CDS (1)..(1944)
atggctgatgtttatcccgtcgatcccgcgttcgccgccgatgcgcgcgtgacgcgcgagcagtacgccgcgctgtaccgcgaatcgatccaacaccccgagcagttctggggcaaggccgcgcagcggctcgagtggttcaagcaacccacccagatcaaggacgtcagctacgcgctggacgacttccatatccgctggttcggcgatggcgagctcaatgccagcgtcaactgcctggaccgccagctggccacgcgcggcgacaagaccgcgctgctgttcgaacccgacagcccggacgcagcgtcgtacccggtgacctaccgcgagttgtacgagcgcgtctgcaagctgggcaatgcgctgcgcaacctgggcgtcaagaagggcgaccgggtcaccatctatctgccgatgatcgtcgatgctgccgtggccatgctcgcctgcgcgcgcatcggtgcggtgcactcggtggtgttcggcggctttgccgccaactcgatcgccgaccgcgtgatcgattgccagagcaagctgatcatcaccgccgacgaaggcctgcgtggcggcaagaagattccgctcaaggccaatgtcgatgcagcgctgaagattcccggcaccaatacggtggaaaccgtgctggtggtgcgtcataccggcggcgcagtggagatgcaggcaccgcgcgaccgctggttccatgatgtggtcgacggccagccggccgcgtgcgaacccgagcgcatgaacgccgaagacccgctcttcatcctctacacctccggctccaccggcaaacccaagggcgtgctgcacaccaccgccggctatctgttgtttgccagttacacgcatgaagtagtgttcgacctgcgcgaggacgacatctattggtgcactgcggacgtgggctgggtcactggccacagctacatcgtctacggcccgctcgccaatggcgccaccgcggtgatgttcgaaggtgtgcccaattacccgaacgtgtcgcgcttctgggaagtgatcgacaagcatcaggtcaccatcttctacaccgcacctactgcgattcgcgcgttgatgcgcgacggtgcggacccggtcaaaaagacctcgcgcaagagcctgcgcctgctcggcagcgtcggcgagccgatcaatccggaagcctggcgctggtattacgaggtggtcggcgacagccgttgcccgatcgtggacacgtggtggcagaccgaaaccggcggcatcctgatctcgccgctggccggcgcggtcgatctcaagccgggctcggccaccttgccgttcttcggcgtgcagccggcgctggtcgatgccgaaggcaagattctggaaggcgccaccgaaggcaacctggtgctgctcgattcctggccgggccagatgcgtagcgtgtatggcgaccaccagcgtttcatcgacacctacttccgcacctatccgggcagctacttcaccggcgacggctgccgccgcgatgccgacggctactactggatcaccggccgcgtggacgatgtgatcaacgtctccgggcaccgcatcggcaccgccgaagtggaaagcgcgctggtctcgcaccccaaggtcgccgaagcggccgtggtgggcttcccgcatgacgtcaagggccagggcatctatgcctacgtcaccctgatcgcggggcagaccccgagcgaggacctgcacaaggaattggtcagctgggtgcgcaaggagatcggcccgatcgcctcgcccgatcacctgcagtgggcgcccggcctgcccaagacccgctcgggcaagatcatgcgccgcatcctgcgcaagatcgccgaaaacgcccctgaccagttgggcgatacctccacgctggcagatccgtcggtggtggattcgctggtcaatgagcgtctggcgcgctga

SEQ ID NO: 1114 - protein, 647 aa, Xanthomonas axonopodis [sequence omitted]

SEQ ID NO: 1115 - DNA, 1944 bp, Xanthomonas campestris
  CDS (1)..(1944)
atggctgatgtttatcccgtcgatcccgcgttcgccgctgatgcgcgcattacgcgcgagcagtacgcaacgctgtaccgcgaatcgatcgaacaccccgagcagttctggggcaaggccgcgcagcggctggactggttcaagcaacccacccagatcaaggacgtcagcttcgcgctggacgacttccacgtgcgctggttcggcgacggcgaactcaatgccagcgtcaactgcctggaccgccagctggccacccgcggcgacaagaccgcgctgctgttcgaacccgacagcccggattcgccgtcctacccggtcacctaccgcgagctctatgagcgcgtgtgcaagctgggcaacgcgctgcgcaacctgggcgtcaagaagggcgaccgggtcaccatctatctgccgatgatcgtcgatgcggccgtggcgatgctcgcctgcgcgcgcatcggtgcggtgcactcggtggtgtttggcggctttgcggccaactccatcgccgaccgcgtgatcgactgccagagcaagctgatcatcaccgccgacgaaggcctgcgcggcggcaagaagatcccgctcaaggcgaacgtggacgcggcgctgaagatccccggcaccaacacggtcgaaaccgtgctggtggtgcgccacaccggcggtgcagtggacatgcaggccccgcgcgaccgctggttccatgacgtggtcgatggccagccggccgagtgcgaacccgagcgcatgaacgcggaagacccgttgttcatcctctacacctccgggtccacaggcaagcccaagggcgtgctgcacaccaccgccggctacctgctgtttgccagctatacgcatgaagtggtgttcgacctgcgcgaggacgacatctactggtgcaccgccgacgtgggctgggttaccggccacagctacatcgtctacggcccgctggccaacggcgccaccgcggtgatgttcgaaggcgtgccgaattaccccaacgtctcgcgtttctgggaagtgatcgacaagcaccaggtcaccatcttctacaccgcgcccaccgccatccgcgcgctgatgcgcgaaggcgaagcaccggtcaagaagacctcgcgcagcagcctgcgcctgctcggcagcgttggcgagccgatcaatcccgaagcctggcgctggtactacgaggtggtcggcgacagccgttgcccgatcgtggacacctggtggcagaccgaaaccggcggcatcctgatctcgccgctggccggcgcggtggacctcaagcccggctcggccaccctgccgttcttcggcgtgcagccggccctggtcgatgccgaaggcaagatcctggaaggcgccaccgagggcaacctggtgctgctggattcgtggccgggccagatgcgcaccgtctacggcgaccaccagcgcttcatcgacacctacttccgcacctacccgggtagctacttcaccggtgacggctgccgccgcgacgccgatggctactactggatcaccggccgcgtggacgacgtgatcaacgtctccggccaccgcatcggcaccgccgaggtggaaagcgcgttggtgtcgcacccgaaggtggccgaagcggccgtggtcggcttcccgcacgacgtcaagggccagggcatctacgcctacgtgaccctgatcgccggcgagacgcccagcgaagagctgcacaaggaactggtgagctgggtgcgcaaggagatcggcccgatcgcctcgccggaccatctgcaatgggccccgggcctgccgaagacccgctcgggcaagatcatgcgccgcatcctgcgcaagatcgccgaaaacgccccggatcagctgggcgatacctccacgctggccgatccatcggtggtggattcgctggtcaatgagcggctgacgcgctga

SEQ ID NO: 1116 - protein, 647 aa, Xanthomonas campestris
MADVYPVDPAFAADARITREQYATLYRESIEHPEQFWGKAAQRLDWFKQPTQIKDVSFALDDFHVRWFGDGELNASVNCLDRQLATRGDKTALLFEPDSPDSPSYPVTYRELYERVCKLGNALRNLGVKKGDRVTIYLPMIVDAAVAMLACARIGAVHSVVFGGFAANSIADRVIDCQSKLIITADEGLRGGKKIPLKANVDAALKIPGTNTVETVLVVRHTGGAVDMQAPRDRWFHDVVDGQPAECEPERMNAEDPLFILYTSGSTGKPKGVLHTTAGYLLFASYTHEVVFDLREDDIYWCTADVGWVTGHSYIVYGPLANGATAVMFEGVPNYPNVSRFWEVIDKHQVTIFYTAPTAIRALMREGEAPVKKTSRSSLRLLGSVGEPINPEAWRWYYEVVGDSRCPIVDTWWQTETGGILISPLAGAVDLKPGSATLPFFGVQPALVDAEGKILEGATEGNLVLLDSWPGQMRTVYGDHQRFIDTYFRTYPGSYFTGDGCRRDADGYYWITGRVDDVINVSGHRIGTAEVESALVSHPKVAEAAVVGFPHDVKGQGIYAYVTLIAGETPSEELHKELVSWVRKEIGPIASPDHLQWAPGLPKTRSGKIMRRILRKIAENAPDQLGDTSTLADPSVVDSLVNERLTR

SEQ ID NO: 1117 - DNA, 1944 bp, Xylella fastidiosa
  CDS (1)..(1944)
atgtctgacctgtacaccattgatccgatgttggccaaagatgcgcacatagaccgtgcgcactacaaaacgctttaccacgaatccatcgaacaaccagaagcattctggaacaaagtctcacagcgcctggagtggtttaaagcgccgaccaaaatcaaaaatgtcagctaccaactggaagatgttcacatccgttggttcgaagacggtgaactcaatgccagcgtcaactgcctggaccgccatctcaccttacgtggcgacaaaacagcactcctgtttgaacctgacgccccagacgccccatcctcacgcatcacctaccgtgaactatacgagcgcgtctgccaactcggtaacgcactgcgtcacctcggcatcgaaaagggcgaccgcgtcaccatctacttaccaatgattccagatgcagtcgtcgccatcctcgcttgcgcacgcattggagcaatccactccgtcgtcttcggcggttttgcagcaaactccattgccgaccgagtgaatgactgcggtagcaaactcatcatcaccgcagatgaaggcctgcgtggtggcagaaaaattccattgaaagccaatgtcgatgccgcattaaaaatccacggaacccagtccgtcgaaaccgtactcgtcgtgcgtcacaccggcagtacgatcaacatgcataccccgcgcgaccgctggttccatgacctcgtcgacatccaagcaaccgaatgcgccccagaacgcatgaacgctgaagactcccttttcatcctctatacctccggctccacaggcaaacccaaaggagtcctgcacaccaccggcggctacctggtgtacaccagctacactcatgaaaccgtgtttgacctacgcgaaaacgacatctactggtgcactgccgacatcggctggattactggtcacagctacatcgtttacggccccctagccaatggcaccaccgtcttgctgtttgaaggcaccccccactacccaaccgtgtcgcgcttctgggaagtgatcgacaaacatcacgtcaccctcttctacaccgcgccgaccgcaatccgtgcattgatgcgcgaaggcgacactcctgtaaaaaaaacctcccgcaaaagcttgcggttacttggcagcgttggcgaacccatcaaccccgaagcctggcactggtactacaccatcgttggcaacggacgttgtcccattgtcgacacctggtggcaaaccgagacaggaggaatcctcatcaccccactgatcggtgcaaccgaccttaaaccaggctcagtcaccctccccttcttcggcatacgccccgccctagtggataccaacggacaaacactggatggccccgcagcaggtaacctagtcctgctcgattcctggccgggtcaaatgcgtaccctctacggtgaccaccaacgttttatagacacttactttcgcacctaccccaatacttacttcaccggcgacggctgccgccgcgatgccgacggctattactggatcactggacgtgttgatgacgtcatcaacatctccggccatcgcatcggcaccgccgaaatcgaaagcacactcgtcgctcaccccaaagtggctgaagccgcggtcgtcggcttccctcacccgatcaaaggccagggcatctacgcatacgtgacattaattaccggcgagacacccagcgaagcactgcaccaagaactgctcacctgggtacgcaaagaaatcggagcaatcgccatacccgatcacgtgcaatgggcatccaacctccccaaaacccgctccggaaagatcatgcgccgcatcctgcgcaaaattgcagaaaacgcaccagaccaactcggtgacacctccacactagctgatccgtctatcgtcgacttattgctcaacgaacgactgaaacactga

SEQ ID NO: 1118 - protein, 647 aa, Xylella fastidiosa
MSDLYTIDPMLAKDAHIDRAHYKTLYHESIEQPEAFWNKVSQRLEWFKAPTKIKNVSYQLEDVHIRWFEDGELNASVNCLDRHLTLRGDKTALLFEPDAPDAPSSRITYRELYERVCQLGNALRHLGIEKGDRVTIYLPMIPDAVVAILACARIGAIHSVVFGGFAANSIADRVNDCGSKLIITADEGLRGGRKIPLKANVDAALKIHGTQSVETVLVVRHTGSTINMHTPRDRWFHDLVDIQATECAPERMNAEDSLFILYTSGSTGKPKGVLHTTGGYLVYTSYTHETVFDLRENDIYWCTADIGWITGHSYIVYGPLANGTTVLLFEGTPHYPTVSRFWEVIDKHHVTLFYTAPTAIRALMREGDTPVKKTSRKSLRLLGSVGEPINPEAWHWYYTIVGNGRCPIVDTWWQTETGGILITPLIGATDLKPGSVTLPFFGIRPALVDTNGQTLDGPAAGNLVLLDSWPGQMRTLYGDHQRFIDTYFRTYPNTYFTGDGCRRDADGYYWITGRVDDVINISGHRIGTAEIESTLVAHPKVAEAAVVGFPHPIKGQGIYAYVTLITGETPSEALHQELLTWVRKEIGAIAIPDHVQWASNLPKTRSGKIMRRILRKIAENAPDQLGDTSTLADPSIVDLLLNERLKH

SEQ ID NO: 1119 - DNA, 26 bp, artificial sequence
  Primer
atgacaatcaaggaacataaagtagt

SEQ ID NO: 1120 - DNA, 28 bp, artificial sequence
  Primer
ttatttctttttttgagagaaaaattgg

SEQ ID NO: 1121 - DNA, 1164 bp, Saccharomyces cerevisiae
  CDS (1)..(1164)
atgactgaattcgaattgcctccaaaatatatcaccgctgctaacgacttgcggtcagacacattcaccactccaactgcagagatgatggaggccgctttagaggcctctatcggtgacgctgtctacggtgaagatgttgacaccgttaggctcgaacagaccgttgcccgcatggctggcaaagaagcaggtttgttctgtgtctctgggactttgtccaaccagattgccatcagaactcacttgatgcaacctccatactctattctatgtgattacagggctcacgtttacactcacgaagccgctggactggcgatcttgtctcaagcgatggtggttcctgtggttccttccaacggtgactacttgaccttggaagacatcaagtcacactacgtcccagacgacggtgatattcacggtgcccccaccagattgatttctctggaaaacactttacacggtattgtttatccattggaagaactggtccgcatcaaagcttggtgtatggaaaatggtctcaaactacattgtgacggtgccagaatctggaatgccgctgcacaatctggcgtgccattaaagcaatatggggaaatcttcgactccatctccatctgtctatccaagtctatgggtgctcctattgggtccgtcttggttgggaaccttaagtttgtcaagaaggccacccatttcagaaaacaacaaggtggtggtattagacaatctggtatgatggctagaatggctcttgtaaacatcaacaacgattggaagtcccaattgctgtactcgcactctttggctcatgaattagccgaatattgtgaggcaaagggcatcccgctagagtctccagcagacaccaactttgtctttattaacctgaaggccgctagaatggacccagatgtccttgttaagaagggtttgaagtacaacgttaagctaatgggtggtagagtctcgttccactatcaagtcaccagagatactttggaaaaagtcaaattggccatctccgaggccttcgactatgctaaagaacatcctttcgactgtaacggacctacccagatttaccgtagtgaatccaccgaggtcgacgttgatggcaacgctatccgcgaaataaaaacctacaaatactga

SEQ ID NO: 1122 - protein, 387 aa, Saccharomyces cerevisiae
MTEFELPPKYITAANDLRSDTFTTPTAEMMEAALEASIGDAVYGEDVDTVRLEQTVARMAGKEAGLFCVSGTLSNQIAIRTHLMQPPYSILCDYRAHVYTHEAAGLAILSQAMVVPVVPSNGDYLTLEDIKSHYVPDDGDIHGAPTRLISLENTLHGIVYPLEELVRIKAWCMENGLKLHCDGARIWNAAAQSGVPLKQYGEIFDSISICLSKSMGAPIGSVLVGNLKFVKKATHFRKQQGGGIRQSGMMARMALVNINNDWKSQLLYSHSLAHELAEYCEAKGIPLESPADTNFVFINLKAARMDPDVLVKKGLKYNVKLMGGRVSFHYQVTRDTLEKVKLAISEAFDYAKEHPFDCNGPTQIYRSESTEVDVDGNAIREIKTYKY

SEQ ID NO: 1123 - DNA, 1041 bp, Pseudomonas aeruginosa
  CDS (1)..(1041)
atgaccgatcacacccaacagttcgccagcgacaactattccggcatctgccccgaagcctgggcggcgatggccgaagccaaccgcggccacgaacgcgcctatggcgacgaccagtggaccgcgcgtgcttcggactacttccgccagttgttcgagaccgattgcgaagtgttcttcgccttcaacggcaccgccgccaactccctggccctggctgcgctgtgccagagctaccacagcgtgatctgctcggagaccgcccacgtcgagaccgacgagtgcggcgcgccggagttcttctccaatggctccaagctgctgctggcgcagaccgaggtcggcaagctgaccccggcgtcgatccgcgacatcgctctcaagcgccaggatatccactatccgaagccgcgcgtggtgactctcacccaggccaccgaggtcggcacggtgtaccgcccggacgagctgaaggcgatcagcgccacctgcaaggagctcggcctgcacctgcacatggacggcgcgcgcttctccaacgcctgcgccttcctcggctgctcgccggcggagctgagctggaaggccggggtcgacgtgctctgcttcggcggcaccaagaacggcatggcggtgggcgaggcgatcctgttcttcaaccgcgacctggccgaggacttcgactaccgctgcaagcaggccggccaactggcctcgaagatgcgcttcctcgccgcgccctgggtcggcgtactgcaggacgatgcttggctgcgctacgccgatcacgccaaccgctgcgcgcggctgttggccgaactggtggccgacgttcccggcgtcagcctgatgttcccggtagaagccaacggcgtgttcctgcagctttccgagccggcgatcgaagccttgcgcgcgcgcggctggcgcttctacaccttcatcggtgaaggtggcgcgcgtttcatgtgttcctgggataccgatatcgagcgggtccgcgaactggcgcgggacatccgcctggtgatgggcgcctga

SEQ ID NO: 1124 - protein, 346 aa, Pseudomonas aeruginosa
MTDHTQQFASDNYSGICPEAWAAMAEANRGHERAYGDDQWTARASDYFRQLFETDCEVFFAFNGTAANSLALAALCQSYHSVICSETAHVETDECGAPEFFSNGSKLLLAQTEVGKLTPASIRDIALKRQDIHYPKPRVVTLTQATEVGTVYRPDELKAISATCKELGLHLHMDGARFSNACAFLGCSPAELSWKAGVDVLCFGGTKNGMAVGEAILFFNRDLAEDFDYRCKQAGQLASKMRFLAAPWVGVLQDDAWLRYADHANRCARLLAELVADVPGVSLMFPVEANGVFLQLSEPAIEALRARGWRFYTFIGEGGARFMCSWDTDIERVRELARDIRLVMGA

SEQ ID NO: 1125 - DNA, 1077 bp, Listeria monocytogenes
  CDS (1)..(1077)
atgacaaacacactaaaaaccagttaccaaaaaacaccttataaactaggcgggaatggcccgcgcaatgtgggtgttttaacagaagcacttcaaaatatagatgataatttagaaagcgatatttacggaaacggtgcagttattgaagactttgaaacaaaaatcgcgaaaattctcgggaaacaatctgcggtatttttcccaagtgggacgatggcacaacaaatcgcgttaaggatttgggctgaccggaaagagaatcggcgcgtagcatatcatccgctctctcatttggagattcatgagcaagatgggctaaaagaattgcagcaaatcacgccactattacttggtacagcgaatcagcttttgacaattgacgatattaaaagtcttcgcgagccagtttctagtgtgcttatcgaacttcctcaacgagaaattggtgggcaactacctgcttttgaagagcttgagaagatttcagagtattgccatgaacagggtatttcgttgcatctggacggggcgcggttatgggaaattacgccgttttatcagaagtctgcggaagaaatttgtgcgctgtttgatagtgtgtatgtgtcgttttataaagggattggcgggattgctggggcgattttggctgggaatgatgattttgtgcaagaggcgaaaatctggaaacgacggtatggcggggatttgattagtctgtatccatatattttgtccgcggattattattttgaaaaacggattgggaaaatggcggagtattttgaagcggcgaaaggattggctgagcgatttaattcgtgttcgggcgtgaagactgtgccggaagtgccggtttctaatatgtttcatgtttattttgagaattcggctgatgagattggggcaattttgacgaagattcaggatgaaactggcgttgggatttcggggtatttgcaggagaaatcagcggatgtttgtgcgtttgaggtttcggttggggatgcgtttgcggaaataccagcaaaaaatttagaactagtttttagatgtttggaaaaggaactttga

SEQ ID NO: 1126 - protein, 358 aa, Listeria monocytogenes
MTNTLKTSYQKTPYKLGGNGPRNVGVLTEALQNIDDNLESDIYGNGAVIEDFETKIAKILGKQSAVFFPSGTMAQQIALRIWADRKENRRVAYHPLSHLEIHEQDGLKELQQITPLLLGTANQLLTIDDIKSLREPVSSVLIELPQREIGGQLPAFEELEKISEYCHEQGISLHLDGARLWEITPFYQKSAEEICALFDSVYVSFYKGIGGIAGAILAGNDDFVQEAKIWKRRYGGDLISLYPYILSADYYFEKRIGKMAEYFEAAKGLAERFNSCSGVKTVPEVPVSNMFHVYFENSADEIGAILTKIQDETGVGISGYLQEKSADVCAFEVSVGDAFAEIPAKNLELVFRCLEKEL

SEQ ID NO: 1127 - DNA, 1053 bp, Agrobacterium tumefaciens
  CDS (1)..(1053)
atgttttttgcttcagacaattgggctggcgcccatccggccgtcaatgaacggctgtcgcgggaatccacgcgttttgccgccgcttacggcaccagcgaactcgatctctccatcgaaaaacgcttcaacgaaatcttcgaacgcgaagtcgcggttttttttgtcgccaccggcacggcggccaattcgctttcgctggccagcatcgcccgtcccggcggcctgaccttctgtcattcggaagcgcatgtgatcgaggacgaatgtggcgcgccggatttcttttcaggcatgcgcatggtcgccgtcgaggggcctgatggcaagatgctgccggagaacctcatcgagcgcattgcgcgctatccgcaggatgccgtgcaccatgggcgcgccgcagccattaccatgacgcaggcgactgaagccggcaccgtctatacgcttgatgaaatcgacgctatatccaaaatcgccaaggaaaacggcctgccgttgcatatggatggcgcgcggtttgccaatgcacttgccgcactcggcacgacgccggctgaaatgacctggaaacgcggcgtcgatgtcctgtctttcggcggcacgaaaaacggctgctggtgcgcggaagcgatcgtgtttttcgatccttcgcttgcccgggacttctccttcctgcgcaagcgtaccgcccagcttttttcgaaatcgcgtttcatcgccgcgcaattcgaagcctacctgcaggacgacctgtggctcggtctcgccggccacgccaatgccatggccaaccggctgcgcgccggtttcggctcactgaacagcgcccgcctggcatggccgacacaggccaacgaggttttcgccattctgcccaaggcagccgctgaagcggcgacgcaaaaaggcgcgaagttctatgactggctggagccgcgcgacatgccggaaaatgtcggcaaggacgaagtactgatccgcatggtcacgagctttgcgacgaccgaagctgatgtggacgaattcctgtcgatctgcgctgccgtctga

SEQ ID NO: 1128 - protein, 350 aa, Agrobacterium tumefaciens
MFFASDNWAGAHPAVNERLSRESTRFAAAYGTSELDLSIEKRFNEIFEREVAVFFVATGTAANSLSLASIARPGGLTFCHSEAHVIEDECGAPDFFSGMRMVAVEGPDGKMLPENLIERIARYPQDAVHHGRAAAITMTQATEAGTVYTLDEIDAISKIAKENGLPLHMDGARFANALAALGTTPAEMTWKRGVDVLSFGGTKNGCWCAEAIVFFDPSLARDFSFLRKRTAQLFSKSRFIAAQFEAYLQDDLWLGLAGHANAMANRLRAGFGSLNSARLAWPTQANEVFAILPKAAAEAATQKGAKFYDWLEPRDMPENVGKDEVLIRMVTSFATTEADVDEFLSICAAV

SEQ ID NO: 1129 - DNA, 1002 bp, Salmonella enterica subsp. enterica serovar Typhi
  CDS (1)..(1002)
atgattgatttacgcagtgataccgttacccgaccgggccgcgccatgctcgaggcgatgatgaccgccccggtcggggacgacgtatacggcgatgcccctaccgttaacgcccttcagcgctacgccgccgacctttccggtaaagaagcggcgctttttttacccaccggcacccaggccaatctggtcgcgctgcttagccattgtgaacgcggcgaagagtatatcgtcggtcagggcgcacataattatctctatgaagctggcggcgctgcggtgctcggcagcattcagccgcagcctattgatgccgccgcggacggtacgctgccgctggagaacgtagcggcgaagattaaagcggatgacatccacttcgcgcgcacgcgcttgctcagtctggaaaatacgcataacgggaaagtgctgccgcgcgcgtatctgaaagacgcctggacgtttacccgcgaacgtgggctggcgctgcacgttgacggcgcccgaatttttaacgcggtggttgcctacggctgtgagttaaaagagattacgcagtattgcgactcttttaccatctgcctgtcaaaaggtctcgggacgccggtcggttcgctgctggtcggcaaccgcgattacattaaacgcgcgacgcgctggcgtaaaatggtcggcggcggaatgcgtcaggccgggattctggcagcggccggactgtatgcgctgaagcataacgtggcgcgtctgcaagaggatcatgacaacgccgcctggctggcgcagcagcttcgcgaagcgggcgcggatgtcatgcgccacgaaacgaatatgctgtttgttcgcgttggcgaagcacaggccgccgcgcttggcggctatttgcgggaacggaatatcctgattaacgccgcgccgattgtgcgtctggtgacgcatctggatgtctctcgcgaacagcttgccgacgtcgtcgcccactggcgcgcctttttagcccgctaa

SEQ ID NO: 1130 - protein, 333 aa, Salmonella enterica subsp. enterica serovar Typhi
MIDLRSDTVTRPGRAMLEAMMTAPVGDDVYGDAPTVNALQRYAADLSGKEAALFLPTGTQANLVALLSHCERGEEYIVGQGAHNYLYEAGGAAVLGSIQPQPIDAAADGTLPLENVAAKIKADDIHFARTRLLSLENTHNGKVLPRAYLKDAWTFTRERGLALHVDGARIFNAVVAYGCELKEITQYCDSFTICLSKGLGTPVGSLLVGNRDYIKRATRWRKMVGGGMRQAGILAAAGLYALKHNVARLQEDHDNAAWLAQQLREAGADVMRHETNMLFVRVGEAQAAALGGYLRERNILINAAPIVRLVTHLDVSREQLADVVAHWRAFLAR

SEQ ID NO: 1131 - DNA, 1038 bp, Nostoc sp. PCC 7120
  CDS (1)..(1038)
atgaatagcaacttagaacagtttgccagtgacaactacgctggtatttgtccagaagcaatgaactatatgattcaagctaatcaaggtagtgcgccagcttatggaaatgatgaatggacgcaaaaagcaacagactattttcgagaactttttgaaattgattgcgaagtattttttacttttaacggtacagcagcaaattcattatctttagctgcactttgtcagtcatatcacagcgttatttgtcatgaaacagcacatatagaaacagatgaatgtggcgcaccagagtttgcgtctaatggttctaagttgttacttgctaaaggagaaaatggtaagttaacaccacaagagatagagtctgtaatcacgaagcgagttgatattcattatcctaaaccaaaagtaattagtattactcaagctacagaattagggactttatattctatagaagaacttttagatattaaaaaagttgcccaaaagtatcaattaaaaattcacatggacggcgcacgctttgccaatgcagttgcagccatgaataaaagtccggcagagatgagttggaaaagtggcgtggatgtattgtgtttttgtgggacaaaaaatggtatggcattaggggaagccattatattttttaatcgagcattggcagaagattttgattatcgttgtaaacaagcaggacaattagcatcaaaaatgcggtttatttctgcgccgtggttaggtttgttagaaactggtgcgtggttgaaaaatgctcaacacgcgaatcaatgtgcggcttatttagagaatgaattgttaaaaatagaaggtgtggaaattatgtttccccgtgaagtaaatgcagtttttgtcaaactgccagagcaagttatcaatggcttaaaagcaaacaattggttgttttatacttttattggggtaggtggtgtacgctttatgtgttcttggaataccaccaaaagcagaattgatgaattagttggagatattaaaacaggattgggctaa

SEQ ID NO: 1132 - protein, 345 aa, Nostoc sp. PCC 7120
MNSNLEQFASDNYAGICPEAMNYMIQANQGSAPAYGNDEWTQKATDYFRELFEIDCEVFFTFNGTAANSLSLAALCQSYHSVICHETAHIETDECGAPEFASNGSKLLLAKGENGKLTPQEIESVITKRVDIHYPKPKVISITQATELGTLYSIEELLDIKKVAQKYQLKIHMDGARFANAVAAMNKSPAEMSWKSGVDVLCFCGTKNGMALGEAIIFFNRALAEDFDYRCKQAGQLASKMRFISAPWLGLLETGAWLKNAQHANQCAAYLENELLKIEGVEIMFPREVNAVFVKLPEQVINGLKANNWLFYTFIGVGGVRFMCSWNTTKSRIDELVGDIKTGLG

SEQ ID NO: 1133 - DNA, 1032 bp, Thermotoga maritima
  CDS (1)..(1032)
atgatcgatctcaggtccgacaccgttacaaaaccaacagaagagatgagaaaagccatggcacaggctgaggtgggagacgatgtgtacggagaagatccaaccatcaacgaactcgaaaggctcgccgcagagacctttggaaaggaagcggctctctttgtaccctccggcaccatgggaaatcaagtgagcataatggctcacacccagaggggcgatgaagtgatactggaggcagacagccacatcttctggtacgaggtcggagccatggcggttctctccggagtcatgccccatcctgtacctggaaaaaatggagccatggaccccgatgatgtgaggaaggccataagacccagaaacatacacttccccagaacttcgctcattgccatcgaaaacacacacaaccgttccggtggaagagtggtcccgcttgaaaacataaaagagatttgcacgatagccaaagaacacggcataaacgttcacatagatggtgcgaggatcttcaacgcctcaatcgcttcaggtgttcccgtgaaggagtacgccgggtacgccgattccgtgatgttctgtctttcaaaaggtctctgcgcacccgtcggttcggtggttgtaggagacagggacttcatagaaagagcgagaaaggcgagaaagatgctcggtggagggatgagacaggcaggtgttctcgctgccgctggaataatcgccttgacaaagatggtagatcgattgaaagaagatcatgaaaacgccagatttctcgccctgaagttgaaagaaatagggtactccgtgaatcccgaagatgtgaaaaccaacatggtgattctgaggaccgacaacctgaaggtgaacgcgcacgggttcatagaagcgctcagaaacagcggggtgctcgcgaacgccgtatccgacacggagatcagactggtaacccacaaagacgtttcaagaaacgacatagaagaggctctgaacatcttcgaaaaactcttcagaaaattctcctga

SEQ ID NO: 1134 - protein, 343 aa, Thermotoga maritima
MIDLRSDTVTKPTEEMRKAMAQAEVGDDVYGEDPTINELERLAAETFGKEAALFVPSGTMGNQVSIMAHTQRGDEVILEADSHIFWYEVGAMAVLSGVMPHPVPGKNGAMDPDDVRKAIRPRNIHFPRTSLIAIENTHNRSGGRVVPLENIKEICTIAKEHGINVHIDGARIFNASIASGVPVKEYAGYADSVMFCLSKGLCAPVGSVVVGDRDFIERARKARKMLGGGMRQAGVLAAAGIIALTKMVDRLKEDHENARFLALKLKEIGYSVNPEDVKTNMVILRTDNLKVNAHGFIEALRNSGVLANAVSDTEIRLVTHKDVSRNDIEEALNIFEKLFRKFS

SEQ ID NO: 1135 - DNA, 978 bp, Bacillus halodurans
  CDS (1)..(978)
atgagacaagcgatggcttcagcagaagtaggggatgatgtataccaagaggacccaagtgttcgcgcattagaagaacgagcagcggaattaacaggaaaagaagcagcgctgttcgtaacgagcggaacacaaggcaatcaggtggcagttgcgacacactgcgtccctggccaagaaatcattttagaagcggatgcccatctgttcctatatgaaggtggtgcagcttccgcttttgctggtgtacaaacatacgcgattaaagggacaaacggaatgttctctgccgagcaagtaaggagagctatacgtccagaagacgaccacgatcctgagacgggtttaatctgtttagaaaacacgcataatcgagcgggaggagccgttatttcaccagaacagatgaaggatgtctacgacgtggcaaaggcgtacaatgtacctgttcatctagatggagcgcgcctatttcacgcggctgttgccctaggtcagccactatcctccttcactcagtacacggacaccgttcaactgtgcctttcgaaagggcttggggcgccagtaggctccattcttgccggtgatgcttcatttattaaacgggcaagaaaatggcgaaaacgccttggtggcgggtggcgacaagccggtgtgttagctgcacctgcccttctcgccttaaatacaatggtcgagcgtttggcggaagaccacgagcatgctaaaatactcgcagacggtattcacgggttgcatggattaaccgtcattcacaaagttgaaacaaatatcattctcgttgacgtagaaaaaacaggccatacgagtgatacatttgtagaggcgttaaaagagcgcggcgtgcgagccgttgcctttgatccatacattgttcggtttgtcacccataaagacgtatctaaggacgatgtcatgcaaacattggctgttctttcctcgcttgtttcatga

SEQ ID NO: 1136 - protein, 325 aa, Bacillus halodurans
MRQAMASAEVGDDVYQEDPSVRALEERAAELTGKEAALFVTSGTQGNQVAVATHCVPGQEIILEADAHLFLYEGGAASAFAGVQTYAIKGTNGMFSAEQVRRAIRPEDDHDPETGLICLENTHNRAGGAVISPEQMKDVYDVAKAYNVPVHLDGARLFHAAVALGQPLSSFTQYTDTVQLCLSKGLGAPVGSILAGDASFIKRARKWRKRLGGGWRQAGVLAAPALLALNTMVERLAEDHEHAKILADGIHGLHGLTVIHKVETNIILVDVEKTGHTSDTFVEALKERGVRAVAFDPYIVRFVTHKDVSKDDVMQTLAVLSSLVS

SEQ ID NO: 1137 - DNA, 1032 bp, Caulobacter crescentus
  CDS (1)..(1032)
atgacccagaccgcgccccgctacgatttcgcctccgacaacgtcgccggcgccatgcccgaggtgatggaggcgttgatcgcggccaatgcggggacggcctcgggctacgggaccgaccatgtcagccgtgccgccgccgatcgcatccgcgcggcgctggacgccgacgcgcaggtgcggttcacagcctcgggcacggcggccaacgccttcgccctgaccctgctggcccagccgcacgaggcggtgctggcccacgagcacgcccacatctgcacggacgagaccggcgcgcccggcttctttggccagggcgtcggcctgatcggcttgccgggcgcatcgggcaagatggagttggcggccctggaggcggcgctggcccagccggacgtctcgtaccgccagccggcggcggccttgtcgctgaccaccgccaccgagtacggcacggtctattcggaagaccacctgcgggccctgatcgcgccggtgaaggccaagggctatggcgtccacctggacggcgcgcggctggccaatgcggtcgcggggggctttgacctgaaaagcatcgccaagatgggcgtcgacatcctggtgatgggcggcaccaaggccggctcgacgcccaccgaggccgtggtgttcctgaaccccgaccacgccaaacgcctggacgcgcgcctcaagcacgccggccagctgatctcgaagggacgcttcctggccgcgccgtggctgggcctgctgggcgagaacggtcagaccgccccctgggccgcccgcgccgcccacgccaacgccatggcgcagaagctggccgcgctgatgcccgtcccgatcaagcacccggtcgaggccaacggcatcttcgtcgagatggacgaacttgccctggaacgcctgcgcggcgaaggctggttcgtctatcgcttcctggacggcacggtgcgcttcatgtgctcgtgggccacgacgcccgagatggtcgaggatctgggcgcggcgctgaagcgagtggcttag

SEQ ID NO: 1138 - protein, 343 aa, Caulobacter crescentus
MTQTAPRYDFASDNVAGAMPEVMEALIAANAGTASGYGTDHVSRAAADRIRAALDADAQVRFTASGTAANAFALTLLAQPHEAVLAHEHAHICTDETGAPGFFGQGVGLIGLPGASGKMELAALEAALAQPDVSYRQPAAALSLTTATEYGTVYSEDHLRALIAPVKAKGYGVHLDGARLANAVAGGFDLKSIAKMGVDILVMGGTKAGSTPTEAVVFLNPDHAKRLDARLKHAGQLISKGRFLAAPWLGLLGENGQTAPWAARAAHANAMAQKLAALMPVPIKHPVEANGIFVEMDELALERLRGEGWFVYRFLDGTVRFMCSWATTPEMVEDLGAALKRVA

SEQ ID NO: 1139 - DNA, 1035 bp, Clostridium acetobutylicum
  CDS (1)..(1035)
atgttacgttttgattgtgattatactgagggggctcatcctaaaatattagaaaagcttactataacaaattatgagcaaacaataggctatggggaagatcaatattgtagggaagctgcaaatataataaaaaagaagtgccaacgtgaagacgtcgatgttcactttttagttggaggaactcaaacgaaccttacagtaatttcagctgccttgagacctcaccaaggagcaattactgtagtaactggccatgttaatactcatgaaactggtgctatagaagccactggtcacaaggtgcttactgtggaagataatgaaggtaagataactgctaaacaaatacaggatgtttatgatagtcattttaatgatgcatctcctgaacatactgtacaacctaagatggtttatatttcaaatccaactgaaataggaacaatatattcaaaagcagagcttacttctataagtgaaacctgcagaaaaaataatcttatactatacatagatggtgctagattaggttatgggctttgtgctgaaaataatgacttagatttaccaactatagctaagctttgtgatgctttctatattggaggtaccaaggtaggtgctttattcggagaagctttagttatatcaaatgaagctttaaaatctgattttcgttatttcattaaacaaaaaggtggtctattagcaaaaggaagacttcttggtatacaattcgcaactttatttgaagatgacttatattttgagatatcaagacatgcagacgaaatggcaacattaataaatgatgcctgcaataaaaagggatattcatttctatctccttcaactactaatcagcagttccctgtattacctgattctgtcattgaaaagttaaaacaagattatgccttttcttattgggaacgagttaataaaactcacagtgctgttcgcttctgtacaagttgggcaactaaaaaagaatccgtattaaaattagtagacgctatcgagaaggcttaa

SEQ ID NO: 1140 - protein, 344 aa, Clostridium acetobutylicum
MLRFDCDYTEGAHPKILEKLTITNYEQTIGYGEDQYCREAANIIKKKCQREDVDVHFLVGGTQTNLTVISAALRPHQGAITVVTGHVNTHETGAIEATGHKVLTVEDNEGKITAKQIQDVYDSHFNDASPEHTVQPKMVYISNPTEIGTIYSKAELTSISETCRKNNLILYIDGARLGYGLCAENNDLDLPTIAKLCDAFYIGGTKVGALFGEALVISNEALKSDFRYFIKQKGGLLAKGRLLGIQFATLFEDDLYFEISRHADEMATLINDACNKKGYSFLSPSTTNQQFPVLPDSVIEKLKQDYAFSYWERVNKTHSAVRFCTSWATKKESVLKLVDAIEKA

SEQ ID NO: 1141 - DNA, 1074 bp, Halobacterium sp. NRC-1
  CDS (1)..(1074)
atgtttcggaacgtaactggcaggatgacttttccccctgggggtggatgtcccgatatgatcgatcttcgcagcgacacggtcgccacgccgaccgaggcgatgcgggaggcggcggcccaggcgccggtcgagcacggcgagcacggcgacgacccggctgtggcagcggtggaggcgacggcggcggacgccgtgggcatggcggcggccgtgttcgtgccgagccggacgatggccaaccagatcggggcgcaggtacacaccgcccgcgggcagagcgtgctcgtcgagcgggccagccacagctacaggcgggggagtggcgggctggcacaacacgctggggtgcaggcgcgcgcgttcgacggcggcgaaaccggctgtccgaccgcggagcaggtggccgccgagatcacggcggggggtgggcaccggccggaggtcgggctggcgtgcgtggagatcgcacacggggcgaacggcggggtcgtggcgcccgtcgacgcgttcgcggctgccgtggagaccgcccacgagcacgacgtgccggtgcacgtcgacgggacgcgggtgttcagcgctgcgaccgcgctgggcgtcgatgcggcgacgctgctgtcgccggtggattcggtggcggtgtgtctgtcgacggggctgggcgcacccatgggggcagtgctggcgggaagcgagtcgttcgtggcgtcggcccgacgcgtgcaggagatgtacgggggtgggatgcagcaggcgggcatggtcgcggcggcgggcgtgtgcgccctggagaaccgccaccgagtccacgaggaccacgagaacgcgcgtcggttggccgaggacctcgacgcgctcccgggggtgacggcggccgaaccggacacgaacatcgtgctcgcggacacccgggacgcggacgtgaccgccgcggcgttcctggcgggctgtgaggaagagggcgtgctggggacggcggacggcgagtacacggtccggttctgcacgcaccgcgacatcgggggcgcggacatcgcggcggtggtgtcggcggcgggggaggtcgtctaa

SEQ ID NO: 1142 - protein, 357 aa, Halobacterium sp. NRC-1
MFRNVTGRMTFPPGGGCPDMIDLRSDTVATPTEAMREAAAQAPVEHGEHGDDPAVAAVEATAADAVGMAAAVFVPSRTMANQIGAQVHTARGQSVLVERASHSYRRGSGGLAQHAGVQARAFDGGETGCPTAEQVAAEITAGGGHRPEVGLACVEIAHGANGGVVAPVDAFAAAVETAHEHDVPVHVDGTRVFSAATALGVDAATLLSPVDSVAVCLSTGLGAPMGAVLAGSESFVASARRVQEMYGGGMQQAGMVAAAGVCALENRHRVHEDHENARRLAEDLDALPGVTAAEPDTNIVLADTRDADVTAAAFLAGCEEEGVLGTADGEYTVRFCTHRDIGGADIAAVVSAAGEVV

SEQ ID NO: 1143 - DNA, 1029 bp, Deinococcus radiodurans
  CDS (1)..(1029)
atggtgtgcgccatgacccgcccgccgctgatcgccgacctgcgctccgataccgtcaccaagcccactcccgccatgcgtgaggcgatggcgaccgccgaggtgggcgacgacgtgtacggcgaagaccccaacgtcaacgccctgcaaaacgaactcgcgcacctgaccggctttgaggcggggctgttcatgccgtcgggcagcatgacgaaccaggtggcgattgccgtgcacacccgccggggcgaggaagtcatctgcgccgagggcagccacatctacgagtgggaactggggatgatggcggccttttccggcgtggtcccgcgcttcgtgcccgcgccgctgggcgtgccgagtcccgaggacgtgcggctggcggtccgccgcagcgtccaccagtcacccaccggcctgatcagcctggaaaacacccacaacaaggccgggggcacggtgattccgctggcggtgctgcggcagatgcgggcagtggccgacgccgagggactgcctctgcacctcgacggagcgcgggtcttcaacgccgccgtgaagctgggcgtggacgtgcgcgaaatcacgcgctgcttcgacaccgtgagcgtgtgcctgagcaaggggctcggcgccccggtgggcagcgtgctgctcggctcggcgcaggcgattcggcaggcgcaccgctaccgcaagatgctcggcggcgggatgcggcaggccggaattctggcggcggcggcgcgggtggccctgcgcgaaggtccggcgcgactggccgacgaccacttgcggacccggcgattggcccgcgccctggtcgaagcgggctacgacgtggacctcgccgccgtgcagaccaacatcatctatgcccggctgcccgaggccgagcgccgcgccgctgcctgggccgaacagggcgtgctcgccagtgcgctggggcacgactcggtgcgcttcgtgctgcaccatcaggtggacgacgacgcgctcgaccaggccattcgcgtgctgaccgcctga

SEQ ID NO: 1144 - protein, 342 aa, Deinococcus radiodurans
MVCAMTRPPLIADLRSDTVTKPTPAMREAMATAEVGDDVYGEDPNVNALQNELAHLTGFEAGLFMPSGSMTNQVAIAVHTRRGEEVICAEGSHIYEWELGMMAAFSGVVPRFVPAPLGVPSPEDVRLAVRRSVHQSPTGLISLENTHNKAGGTVIPLAVLRQMRAVADAEGLPLHLDGARVFNAAVKLGVDVREITRCFDTVSVCLSKGLGAPVGSVLLGSAQAIRQAHRYRKMLGGGMRQAGILAAAARVALREGPARLADDHLRTRRLARALVEAGYDVDLAAVQTNIIYARLPEAERRAAAWAEQGVLASALGHDSVRFVLHHQVDDDALDQAIRVLTA

SEQ ID NO: 1145 - DNA, 1032 bp, Vibrio cholerae
  CDS (1)..(1032)
atgcggatatttgtaggagaaaatatggactttcgatcggataccgttacccaaccgaccgacgcgatgcgtcaagcgatggcacaagcccctgtgggtgacgatgtgtatggcgatgaccccaccgtcaacgagttagaacagtgggcggcagagcgccatggctttgaagccgcgctgtttaccacctcaggcactcaagccaatttgttaggtttactcgcccattgcgaacgcggcgacgaatatttgtgtggccagcaagcccataactatcgttatgaagctggcggtgctgccgtacttggctctatccagccacaaccgattgacaatgaaccggatggcacactcgatttcgccaaactcaaagccgcgatcaaaccggatgatgcacattttgcccgcaccaaactgctcagcttggaaaacaccatcaatggtaaagtgcttccactcagttatttggcgaaggcgcgcgagtttgttgatcaacatggtttgcaactgcaccttgatggggctcgggtctacaacgcggcggtcgcactggatgtggatgtcaaagagatcgcgcaatattttgattcgatcaccgtgtgtctatccaaaggcttagccgcgccagtcggttcgttactgctcggttccaaggactttattgccaaagcgagacgctggcgaaaaatggtcggtggcggtatgcgccaagcgggcattttagccgcagcggggaaattggcgctcaccgagcaagtcatgcagctcaagaccgatcatgataatgctcgtcatctggctttggggctgaatgctttaccggggttttcggttaataccgaatgggtacagaccaatattgtgtttgctaaattggactcgacagtcgatatccagtccatcgcccagcaacttcgccaagcaggcattatcatcaccgcgggtaatccagtgcgcttcgtgacacataaagacattacacgtcaggatattgataccctactcgccaaactgcgcaccttactggcttga

SEQ ID NO: 1146 - protein, 343 aa, Vibrio cholerae
MRIFVGENMDFRSDTVTQPTDAMRQAMAQAPVGDDVYGDDPTVNELEQWAAERHGFEAALFTTSGTQANLLGLLAHCERGDEYLCGQQAHNYRYEAGGAAVLGSIQPQPIDNEPDGTLDFAKLKAAIKPDDAHFARTKLLSLENTINGKVLPLSYLAKAREFVDQHGLQLHLDGARVYNAAVALDVDVKEIAQYFDSITVCLSKGLAAPVGSLLLGSKDFIAKARRWRKMVGGGMRQAGILAAAGKLALTEQVMQLKTDHDNARHLALGLNALPGFSVNTEWVQTNIVFAKLDSTVDIQSIAQQLRQAGIIITAGNPVRFVTHKDITRQDIDTLLAKLRTLLA

SEQ ID NO: 1147 - DNA, 1280 bp, Escherichia coli
  CDS (61)..(1062)
gcgaaaacaaactggctaaggtaaaaagggtggcatttcccgtcataataaggacatgccatgattgatttacgcagtgataccgttacccgaccaagccgcgccatgctcgaagcgatgatggccgccccggttggggacgacgtttacggagacgaccctaccgttaatgctctgcaggactacgcagcagagctttccggtaaagaagccgccatttttctgcctaccggcactcaggccaacctggtcgctctgctcagtcactgcgaacgcggcgaagagtatattgtcggtcaggccgcgcataactatctgtttgaagccggtggcgcggcggtgctgggcagtattcaaccgcaacccatagacgcggctgccgacggcacgctaccgctggataaagtggcgatgaaaatcaaacccgacgatatccatttcgcccgcaccaaattactcagtctggaaaacacccacaacggcaaagtgttgccgcgggaatacctgaaagaagcatgggaatttacccgcgagcgcaatctggcgctgcatgttgacggtgcgcgcatctttaatgccgtggtggcttacggctgcgaactgaaagagatcacgcaatattgtgattcgttcaccatttgcctgtcgaaaggtcttgggacgccagtcggttcattactcgtcggtaatcgtgattacattaaacgtgccattcgctggcggaaaatgacaggtggcgggatgcgccagtccggcattctggctgccgccgggatatatgccctgaaaaataacgttgcgcgcttgcaggaagaccacgacaacgctgcctggatggcggagcagctgcgtgaagcaggcgcggatgtgatgcgtcaggacaccaatatgctgtttgttcgcgtcggggaagaaaatgctgccgcgttaggcgaatacatgaaagcgagaaacgtgctgattaacgcctcgccgattgtccgcctggtgacgcatcttgacgtctcgcgcgaacaactggcggaagtcgccgcccactggcgtgcattcctggcgcgttaaggagagagacgtgccgcaacgcattttagttctcggtgccagtggctacattggtcagcatctggtgcgcacactcagccagcaagggcatcagatcctggcggcggcacgtcatgtcgacaggcttgcaaagctgcaactggcaaacgtcagttgccataaagtcgatctcagctggccggataacctaccggccctgttgcaggatatcgatacgg

SEQ ID NO: 1148 - protein, 333 aa, Escherichia coli
MIDLRSDTVTRPSRAMLEAMMAAPVGDDVYGDDPTVNALQDYAAELSGKEAAIFLPTGTQANLVALLSHCERGEEYIVGQAAHNYLFEAGGAAVLGSIQPQPIDAAADGTLPLDKVAMKIKPDDIHFARTKLLSLENTHNGKVLPREYLKEAWEFTRERNLALHVDGARIFNAVVAYGCELKEITQYCDSFTICLSKGLGTPVGSLLVGNRDYIKRAIRWRKMTGGGMRQSGILAAAGIYALKNNVARLQEDHDNAAWMAEQLREAGADVMRQDTNMLFVRVGEENAAALGEYMKARNVLINASPIVRLVTHLDVSREQLAEVAAHWRAFLAR

SEQ ID NO: 1149 - DNA, 1005 bp, Pseudomonas aeruginosa
  CDS (1)..(1005)
atgcctgtcatcgacctgcgcagcgacaccgtcacccagcccaccgccggcatgcgcgaagccatggccgcggccgaactgggcgacgacgtctatggcgaggaccccacggtcaaccgcctggaggccgaactggcggcgcgcctgggcttcgccgcggcgctcttcgtaccgaccgggaccatgagcaacctgctcggattgatggcccactgcgagcgcggcgacgaatacatcgtcggccagcaggcgcatacctacaaatacgagggcggcggtgccgcggtgctgggctcgatccagccgcagccgatcgacggcgaggccgacggatcgctccacctggacaaggtcgcggcggcgatcaaggccgacgatttccacttcgccaggacccgcctgctggccctggaaaacaccatgcagggcaaggtgctgccgctcgactacctggccgcggcgcgcgccttcactcgcgcgcgtggcctggccctgcacctggatggcgcgcgcctgtacaacgcggcggtgaagctgggcgtagacgccagcgagatcacccgacacttcgactcggtgtcggtgtgcctgtccaagggcctcggtgcgccggtgggctcggtgctttgcggcagcgtcgaactgatcggcaaggcccgccgctggcgcaaaatggtcggcggcgggatgcgccaggccggcctgttggcggctgccggactgtacgccctcgaccaccaggtggcacgcctggccgacgaccacgccaacgccgcgcgcctgggcgacgggctgcgcgaactgggctatgcggtggagccggtgcagaccaacatggtctacgtcgatgtcggcgagcgggcggtcgcgctgcgcgacttcctcgccgagcgcggggtgcggatcagcgcggcggcgcgtttgcgcctggtcacccacctggacgtttccgccgagtccataggacaagtactggatgccttcgcggcctttcgtcgctcataa

SEQ ID NO: 1150 - protein, 334 aa, Pseudomonas aeruginosa
MPVIDLRSDTVTQPTAGMREAMAAAELGDDVYGEDPTVNRLEAELAARLGFAAALFVPTGTMSNLLGLMAHCERGDEYIVGQQAHTYKYEGGGAAVLGSIQPQPIDGEADGSLHLDKVAAAIKADDFHFARTRLLALENTMQGKVLPLDYLAAARAFTRARGLALHLDGARLYNAAVKLGVDASEITRHFDSVSVCLSKGLGAPVGSVLCGSVELIGKARRWRKMVGGGMRQAGLLAAAGLYALDHQVARLADDHANAARLGDGLRELGYAVEPVQTNMVYVDVGERAVALRDFLAERGVRISAAARLRLVTHLDVSAESIGQVLDAFAAFRRS

SEQ ID NO: 1151 - DNA, 1080 bp, Leishmania major
  CDS (1)..(1080)
atgtcaacgccaaggacgacggcgacggcggccaagccgaagccgtacagctttgtgaatgactacagcgtgggtatgcatcccaagattttagatctgatggcgcgcgataacatgacgcagcacgcgggctacggacaggacagccactgcgcgaaggcggcacgcctgatcggcgagttgcttgagcggccggacgcggacgtccattttatttccggcggcacgcagacgaacctgatcgcctgcagtctggcgctacgcccgtgggaagctgtcatcgcaacgcagctgggccacatcagcacgcacgagacgggcgccattgaggcgacggggcacaaagtcgtcacggcgccgtgcccggacggtaagctgcgcgttgccgacatcgagagcgcactgcacgagaatcgctcggagcacatggtgatacccaaactcgtctacatctccaacacgacggaggtaggcacgcagtacacgaagcaggagttggaggacatctccgcctcatgcaaggagcacggcctgtacctcttcctcgacggcgcccgcctcgcctcggccctaagcagccctgtgaacgatctgacgttggcagatatcgctcgcctgacggacatgttctacattggcgccacgaaggccggtggcatgtttggcgaagcgctcatcatcttgaatgacgccctaaagccgaacgcgcgccacctcatcaagcagcgcggcgccctcatggcgaagggatggctgctcggcatccaattcgaggtgctcatgaaggacaacctcttcttcgagctcggcgcccactcgaacaagatggccgccatcctcaaggctggactggaggcgtgcggcatccgacttgcctggccatccgccagcaatcagctcttcccgatcctggaaaacaccatgatcgcagagctgaacaacgacttcgacatgtacaccgtcgagcccttgaaagatggcacgtgcatcatgcgactctgcacgtcgtgggcgacggaggagaaggagtgccatcgttttgtggaggtgctgaagcgcctcgtcgcgtcaacggcctaa

SEQ ID NO: 1152 - protein, 359 aa, Leishmania major
MSTPRTTATAAKPKPYSFVNDYSVGMHPKILDLMARDNMTQHAGYGQDSHCAKAARLIGELLERPDADVHFISGGTQTNLIACSLALRPWEAVIATQLGHISTHETGAIEATGHKVVTAPCPDGKLRVADIESALHENRSEHMVIPKLVYISNTTEVGTQYTKQELEDISASCKEHGLYLFLDGARLASALSSPVNDLTLADIARLTDMFYIGATKAGGMFGEALIILNDALKPNARHLIKQRGALMAKGWLLGIQFEVLMKDNLFFELGAHSNKMAAILKAGLEACGIRLAWPSASNQLFPILENTMIAELNNDFDMYTVEPLKDGTCIMRLCTSWATEEKECHRFVEVLKRLVASTA

SEQ ID NO: 1153 - DNA, 1302 bp, Caenorhabditis elegans
  CDS (1)..(1302)
atgatatctagacacttcactgtattaacagcactcaacttgcaaaccaagatcaaaatttgcattcgaaacttttcaattagaggagcaatgactaaagttaatggaaattcaaatggaaatggaatatctgcttccacagatcttcttgatacgccatctgcatatactcaaaagtccaataaaactcatacttcaatcgacttgagatcggatacggtcaccgttccatcggttgaaatgagaagagcaatggcagaagctattgttggtgatgatgtctatggagaagatacaacaactaatagacttgagcaaagatgtgccgagttatttggaaaagaagctggactgtttgttaccagtggaacaatgggaaatcttttggcaatcatggcacattgtcaacgtggcgaggagataatcgtcggacggtacaatcatattcatcgttgggaacagggaaattatgctcaatttgctgggatctctgccacgacattggaggtgaagcccgatggaacgatggatttgaatgacatcgaacaggcgatccgtgtcaagggaggttatgttcaaattaaagatgagagttgtgatgacttggaagtgacgagtatacccgattgtcacatgccagcttcaaagctgatttgcatcgagaacacccataattatactggaggaaaagcgcttccaattgagtggatgagatctgtaaagcagcttgctgaacgtcgtgatctcaaagttcatatggatggagctcggatctataatgcagcagttgcctccaactgttccgtcagcaaaatcgcctcgttcgccgacactgtccaaatgtgtttctccaaaggactcggtgctccagttggatcaattgttgtaggaccgaaagatttcattgatcgtgctagacacagtcgtaaggctttgggtggaggatggagacaaagtggaattctcgctgctgctgcacatattgctcttgatcatgccgatgcaacaattcgagctgatcatgaaagagctaaaacattggcaagaatgattaatgacgctactccagaagaatttagaacgaaggtctttgctgcggaaaaagacatcaccaacatggttcttgttcattgccaaaatggagttacagttcaacagctcactgatttcttccaaaaacacgatattctggcaatgacttttgacgcaagacgtattcgaatggttctcaactggaatgtgagcgatgagaatttggaaactatcgtcgaagtctacaagaagtttttgaaacaattgtga

SEQ ID NO: 1154 - protein, 433 aa, Caenorhabditis elegans
MISRHFTVLTALNLQTKIKICIRNFSIRGAMTKVNGNSNGNGISASTDLLDTPSAYTQKSNKTHTSIDLRSDTVTVPSVEMRRAMAEAIVGDDVYGEDTTTNRLEQRCAELFGKEAGLFVTSGTMGNLLAIMAHCQRGEEIIVGRYNHIHRWEQGNYAQFAGISATTLEVKPDGTMDLNDIEQAIRVKGGYVQIKDESCDDLEVTSIPDCHMPASKLICIENTHNYTGGKALPIEWMRSVKQLAERRDLKVHMDGARIYNAAVASNCSVSKIASFADTVQMCFSKGLGAPVGSIVVGPKDFIDRARHSRKALGGGWRQSGILAAAAHIALDHADATIRADHERAKTLARMINDATPEEFRTKVFAAEKDITNMVLVHCQNGVTVQQLTDFFQKHDILAMTFDARRIRMVLNWNVSDENLETIVEVYKKFLKQL

SEQ ID NO: 1155 - DNA, 1212 bp, Streptomyces coelicolor
  CDS (1)..(1212)
atgagcgacacggcagaacaggaagagcgggcggcaccggccagaccggaagcgccgccggcccaggacgagccggcggagcagcgcgacaggcgcagccgggagcggcgcgtggccgccctccgcggcgcgcggcgcgtactcgcccgccccggcttcgtcacgaccctgcgcgagcgcatcgccctgctcgacggggccgaggagctgtacgacctcgacgagccctccgacatgtacggcaacggcgtcgtcgaggccctggaggagaggaccgccgccctgctcggcacggaggccgccgccttcttcccgaccgggaccatggcccagcaggtggccctgcgctgctgggcgggccgcaccggcaacccggtcgtcgccctgcacggtctcggccatcccgagcagcacgagcgcaacgccttcagccgggtcggcggcctgcacccggtacggctgaccgacgcgcccaggccgccgaccgccgacgaggtgcgcggcttcgaggagccgttcggggcgctgatgctggaactgccgctcagggaggccggatacctgctgcccacctgggaggagctcaccgaggtcgtcgaggccgcccgggagcgcgacgcggtggtccatttcgacggggcccggctgtgggagtgcaccgtccacttcggccgccccctggccgagatcgcgggcctggcggacagcgtgtacgtctcgttctacaagtccctcaagggctacggcggcggcgccctggccggtccccggacgctggtcgaggaggcgaaggcctggcggcaccggtacggcggccaggtgttccagcagttccccacggcgctgtccgccctggcaggcctggagcgcgagctgccccgactgccctcgtacgtggcccacgcgcgcgtggtggcggccgcgctgcgcgcgtcactcgcggcggcgggactgccgtgggcgcgggtgcaccccgcggtgccgcacacgcacgagttccaggtctggctgccctgcgaccccgacgcggcgagtgaggccgcgctccggcaggccgaggagaccgggacgatgctgttctcccagccctgggacgcgggcggccccgggatcgccctcaccgaggtctcggtgggcgagtcgggactggagtggacggccgacgacgtgcgggcggcggtcgccgacttcgccgcccggctgacggcgtga

SEQ ID NO: 1156 - protein, 403 aa, Streptomyces coelicolor
MSDTAEQEERAAPARPEAPPAQDEPAEQRDRRSRERRVAALRGARRVLARPGFVTTLRERIALLDGAEELYDLDEPSDMYGNGVVEALEERTAALLGTEAAAFFPTGTMAQQVALRCWAGRTGNPVVALHGLGHPEQHERNAFSRVGGLHPVRLTDAPRPPTADEVRGFEEPFGALMLELPLREAGYLLPTWEELTEVVEAARERDAVVHFDGARLWECTVHFGRPLAEIAGLADSVYVSFYKSLKGYGGGALAGPRTLVEEAKAWRHRYGGQVFQQFPTALSALAGLERELPRLPSYVAHARVVAAALRASLAAAGLPWARVHPAVPHTHEFQVWLPCDPDAASEAALRQAEETGTMLFSQPWDAGGPGIALTEVSVGESGLEWTADDVRAAVADFAARLTA

SEQ ID NO: 1157 - DNA, 1131 bp, Schizosaccharomyces pombe
  CDS (1)..(1131)
atgagcggatccgttacttctacgactaccgaaacaagattatgcccttccaaccaagggagcgctaaaaagtatcgtccttggaatgatttccgtagtgacactttgactgttcctaccgatgaaatgcgtcgcatcatgtatgaggcctctgatggtgattgcgtttatgaggaagatgaggatactagaaagttggaagtttatgttgcaaagttgactggtaaggaagctgctttgttcgtaacatctggtactcaaggtaatcagttgtgtattcgtagtcatttgcatcaacctcctcatagtatcatttgtgatgatcgcgcccatatttataactgggaagcgggtgcaattggtttgtttacgcaagctattgttcgtcctatttctccaaaaaataatgtatatattactgccgaggaaattgagaacaagcttatcctgggaaatgatattcacttttcacccactgggttgatttgtttagaaaatactattaaaggtgctgtcgttccattggatgaagtggctcgtatatctggtttagctaaggctcacaagatccccctgcattgcgacggtgctcgcttatgggatgctgctgttgcttccaacgtttcaattaaggagtactgctcttactttgattccgttagtctttgcctaagcaaaggtcttgcggctcctgttggtagcattattgtgggaccacgagactttattgctaaagccaaatggttccgtaaggcttatggtggtggattgagacaatctggtatgcttgctgctgcaggattatactcaattcagcataactttcctttgttgaagcaggtccataaatatgctattgaagtcgccgaatacgcagaatctcttggaattgagcttgaagttcccactcaaagtaacatggtgacattggccaatatcaacgttgctattctttgcgatgaagccaaaaagtctggaatcattttaatgggacctcgtatcgtgtttcatattcagatcactcctgatgctgtcgagattttgaagaacgttttacgtcgcacagttgagcgtcaagcagttgaaacccatattgttgccaaacctggtgagttttgtgtcggctattaa

SEQ ID NO: 1158 - protein, 376 aa, Schizosaccharomyces pombe
MSGSVTSTTTETRLCPSNQGSAKKYRPWNDFRSDTLTVPTDEMRRIMYEASDGDCVYEEDEDTRKLEVYVAKLTGKEAALFVTSGTQGNQLCIRSHLHQPPHSIICDDRAHIYNWEAGAIGLFTQAIVRPISPKNNVYITAEEIENKLILGNDIHFSPTGLICLENTIKGAVVPLDEVARISGLAKAHKIPLHCDGARLWDAAVASNVSIKEYCSYFDSVSLCLSKGLAAPVGSIIVGPRDFIAKAKWFRKAYGGGLRQSGMLAAAGLYSIQHNFPLLKQVHKYAIEVAEYAESLGIELEVPTQSNMVTLANINVAILCDEAKKSGIILMGPRIVFHIQITPDAVEILKNVLRRTVERQAVETHIVAKPGEFCVGY

SEQ ID NO: 1159 - DNA, 1017 bp, Aeromonas jandaei
  CDS (1)..(1017)
atgcgctatatcgatttacgaagtgatacggtcacccagcccacggatgccatgcgtcagtgcatgctccatgccgaggtcggggatgatgtttatggggaggatccgggcgtcaacgcgttggaagcctatggcgccgacctgctgggaaaagaggctgcgctgttcgtgccatccggcaccatgtccaacttgctggcggtgatgagccattgccagcgtggggaaggggctgtgctgggctcggcagcccacatctatcgctatgaggcgcagggttctgctgtgctggggtctgtggccctgcaacctgtgcccatgcaggctgatggctcgctggcgctggcggatgtgcgggcggccatcgcccctgacgatgtccattttaccccgactcgcctcgtctgcctcgaaaacacccataacggcaaggtgctgcccttgccttatctgcgcgagatgcgcgaactggtcgatgagcatggtttgcagttgcatctggacggtgctcgtctgttcaatgccgtggtggcgagtggccatacggtgcgcgaactggtcgcgccgtttgacagtgtctccatctgcctctccaaggggctgggcgcgccggtgggatcgctgctggtgggttctcatgcctttattgcccgtgccagaaggctgcgcaagatggtggggggcggtatgcgtcaggcggggatcctggctcaggctggcctgtttgcgttgcagcagcatgtggtacgcctcgcggacgatcatcgccgtgccagacagttggccgaggggctggctgcgctgcctggcatcaggctggatctggcgcaggttcagaccaacatggtgttcctgcaactgacgagtggcgagagtgcacccttgctggccttcatgaaggcgcgggggatcctcttctccggttatggtgagctgcggttggtgacccatctgcagatccacgatgatgacattgaagaggtgattgacgcctttaccgagtatctcggggcgtga

SEQ ID NO: 1160 - protein, 338 aa, Aeromonas jandaei
MRYIDLRSDTVTQPTDAMRQCMLHAEVGDDVYGEDPGVNALEAYGADLLGKEAALFVPSGTMSNLLAVMSHCQRGEGAVLGSAAHIYRYEAQGSAVLGSVALQPVPMQADGSLALADVRAAIAPDDVHFTPTRLVCLENTHNGKVLPLPYLREMRELVDEHGLQLHLDGARLFNAVVASGHTVRELVAPFDSVSICLSKGLGAPVGSLLVGSHAFIARARRLRKMVGGGMRQAGILAQAGLFALQQHVVRLADDHRRARQLAEGLAALPGIRLDLAQVQTNMVFLQLTSGESAPLLAFMKARGILFSGYGELRLVTHLQIHDDDIEEVIDAFTEYLGA

SEQ ID NO: 1161 - DNA, 1152 bp, Tolypocladium inflatum
  CDS (1)..(1152)
atgaagatttgcccgatactgaattccaaggcaggtcattggggagatcccactctcactggctcagcctttgatttcaggagcgacgctattactacaccatcccatggaatgctggaagcaatcgccggggccacgctcaatgatgatgtctatggcgaggaccagctaacacggtccttcgaggagcacatggcgagcatctgtggcaaagaagcagctctgtttgttgtgtccgggaccatggccaaccagattgccttaggagcgctgtcacgacgatgcacaggtgtactagcagatgctacctctcatatcgtacattttgaggccggtggccttgccggtctctccggggcatccatccagcccgtgcggccggcgaatgggcattatctcacccttgatgatgtggaacgacacgcagtgaccaccaacatgatagaacggttgcccaccagcatcatcagcctcgagaacacagctcacggcagcgtaatcccactacaagagctccgcaagatgaaggcttgggctgacgagcaggagatcgccattcacatcgacggtgcgcggatatggcacgccgtggcaggcgggggcggtagtctaaaggagatcgcgggctgctgcgacgcgatgaccctctccttcggtaaagggctcgcagcaccgataggatcggccatcgtgggctcgagggaccttatagcaagggcgagaagactgcgccaaagcatcggcggcggcgtccgcaaggctggggccattgtggctgcagcttggcaggccatgatagagaactttggtcccggcgatgtcgacacacggggcatcatccagagaacacatgtgttggcgagagcggtggccaacatgtggacctcgaggggcggtctgcttcttcgcccggtgatgacgaaccttgtctggctcgacttgaagagcgctggtctcgacaagtccacactggacacggctgctcagcaccgtgacatacgcatcagggcaccacgcatcgttctgcatcaccagatatcaaccgatgctatgcgacgactggaggcggtgttcgaggaggtgttagagaaaaaggcaagtcaaagtcctttgcggtcaagagcggagcgagcaggtctagaacgcctttag

SEQ ID NO: 1162 - protein, 383 aa, Tolypocladium inflatum
MKICPILNSKAGHWGDPTLTGSAFDFRSDAITTPSHGMLEAIAGATLNDDVYGEDQLTRSFEEHMASICGKEAALFVVSGTMANQIALGALSRRCTGVLADATSHIVHFEAGGLAGLSGASIQPVRPANGHYLTLDDVERHAVTTNMIERLPTSIISLENTAHGSVIPLQELRKMKAWADEQEIAIHIDGARIWHAVAGGGGSLKEIAGCCDAMTLSFGKGLAAPIGSAIVGSRDLIARARRLRQSIGGGVRKAGAIVAAAWQAMIENFGPGDVDTRGIIQRTHVLARAVANMWTSRGGLLLRPVMTNLVWLDLKSAGLDKSTLDTAAQHRDIRIRAPRIVLHHQISTDAMRRLEAVFEEVLEKKASQSPLRSRAERAGLERL

SEQ ID NO: 1163 - DNA, 1104 bp, Debaryomyces hansenii
  CDS (1)..(1104)
atggatttctctaattattcagacctcagtccagcacacaatgagttcagaagtgatacatttacgaccccaacattatctatggttgcatcgctaacgaaggctactttaggagattctgtttataatgaagatgattctacaattcaattggaaaaaaaggttgctgacatgactgggaaggaagctggcctattctgtgtaagtgggacgttatctaatcagatctgtttacgtgttaatttaaaacagccaccatatagtatactatgcgattatagggcccatgtatacgtgaatgaagcaggggggatggcaacattatgtcaagcaatggcacaaccaattaaacctaagaatggtatttatttgactttagaagacgatatattgccaaacttcattccggacgatggagaaattcatggggctccaactaagcttatctccttagagaatactttacatggtatgcttttccccattgaagagattgctaaaatatccaaattttgcaaaaataacgatgtcaagcttcacttagatggtgccagattatggaatgcatcaattgccacagggatttctttaaaagagtattgttcgtattttgattctgtttccttatgtctttcaaagagtttgggggcacctatcggtacagtattaattgccgataaaaattttgttaagaaggccaatcacttcaagaagcaaagtggtggaggaattagacaatcgggtctcttggctactatggctatgaccgctattgacgaaaactttggaaagatacaaaggtcccatgatatggctaaagaattaggcaaactatgtgaagaaaatggaattgtcttagaacacccagttgacactaattttgtctttatcgactttgctaaaaacaaaatgagttctgacgttctaactaaattactgaaagaaaacggtatcaagctatatgctggcagagttgctttccactaccaggtatctctggaaagctttgagaaatgcaaaaaagtagtactcgaatgttataaagattcactacaaaacccttacattggtaagtcatcttcctcgtattaccaagccaagtaa

SEQ ID NO: 1164 - protein, 367 aa, Debaryomyces hansenii
MDFSNYSDLSPAHNEFRSDTFTTPTLSMVASLTKATLGDSVYNEDDSTIQLEKKVADMTGKEAGLFCVSGTLSNQICLRVNLKQPPYSILCDYRAHVYVNEAGGMATLCQAMAQPIKPKNGIYLTLEDDILPNFIPDDGEIHGAPTKLISLENTLHGMLFPIEEIAKISKFCKNNDVKLHLDGARLWNASIATGISLKEYCSYFDSVSLCLSKSLGAPIGTVLIADKNFVKKANHFKKQSGGGIRQSGLLATMAMTAIDENFGKIQRSHDMAKELGKLCEENGIVLEHPVDTNFVFIDFAKNKMSSDVLTKLLKENGIKLYAGRVAFHYQVSLESFEKCKKVVLECYKDSLQNPYIGKSSSSYYQAK

SEQ ID NO: 1165 - DNA, 1128 bp, Debaryomyces hansenii
  CDS (1)..(1128)
atgacagtagaaattgcaccagaatattctactcataatgaattcagaagtgatactttcaccgtgccaaccaagaccatgttggagtccatccgaaacagcacatttggagactccgtgtataacgaggataaaactacgttgatgttagagaagaagatgtgcgagttgacaggaaagccagccgctttattctgtgttagtggaacgttatccaaccaaattggattgagagccaacttgttccagccaccatattcgattttatgtgactatagagcacatgtattcattcacgaagccggtggattggctaccttgtcacaagccatggtacacccggtacatccttctaacggagtatacttgacgttggaagacattgctgaaaatatcactccagacgatggagacatccatgcggcacctactaagctcatctcattagaaaacaccttacacggaactatcatgcctatagaagagattgccaggatcagtgcttttgctaaggagaataatattaaattgcatttagatggggccagattgtggaattctgccgcggaaacgggtatttcgatcgagaaatattgctcatacttcgattcggtttcgttatgtctttcgaagtcgatcggagctccagtcggttctatcttggttggagagcctaccctcattgccaaggcaaaccatttcaagaaacaaaacggtggtggtatcagacaagccggtattttggcgtcgatggctatggtggctattgatgagaatttcgcaaaattgccttactcgcattccctcgctaaagatgtcgcgagcttctgcgaaggtcacggaatcgccttggaaagtccggctcataccaattttgttttcattgatctcgtcaaaaacaagatggacgactcattactcattgaattaggtaaaaagtacaatgttaagttgatgggtggtagaatcgcattccactaccagttatcggaagaaagtgtcgaaaatgtcaaaagggctatattggaatgttaccaagatgcattcaaaaacccatacaccaaaaccaagtgtaacaagaagatgtataattttgatgccatcaagaattcattagtttctaattaa

SEQ ID NO: 1166 - protein, 375 aa, Debaryomyces hansenii
MTVEIAPEYSTHNEFRSDTFTVPTKTMLESIRNSTFGDSVYNEDKTTLMLEKKMCELTGKPAALFCVSGTLSNQIGLRANLFQPPYSILCDYRAHVFIHEAGGLATLSQAMVHPVHPSNGVYLTLEDIAENITPDDGDIHAAPTKLISLENTLHGTIMPIEEIARISAFAKENNIKLHLDGARLWNSAAETGISIEKYCSYFDSVSLCLSKSIGAPVGSILVGEPTLIAKANHFKKQNGGGIRQAGILASMAMVAIDENFAKLPYSHSLAKDVASFCEGHGIALESPAHTNFVFIDLVKNKMDDSLLIELGKKYNVKLMGGRIAFHYQLSEESVENVKRAILECYQDAFKNPYTKTKCNKKMYNFDAIKNSLVSN

SEQ ID NO: 1167 - DNA, 1071 bp, Yarrowia lipolytica
  CDS (1)..(1071)
atgactgcctgctctcacgatttcagatcggatacgatcacaaatcccaccaaagagatgatggaagccatcaccaactcgtactctgctcttggcgacgcagtgtacgaggaggacaccatcaccaccaactttgagagccgaatcaaggagctcaccggccacgaggctgctgtcttcgccgtctccggtacgatgactaaccagctggccatcagatcccacctgttccagcctccacactcgatcctgtgtgatcatcgagcacatgtgtacacctgcgaagctggtggcatagccacactgtctcaggccatggtgacccccgtcatcccctccaatggcatttacatgactctggaggacatcaaggccaagatcattgtcggagaagatgttcatgtcgcacctaccaagctcatctgtctggaaaacacaatgggtggcgccatttaccccattgaggagattcgtcgcatttcaaagtttgcacgggacaatgacatccctatccatctggatggcgccagactgtggaatgcaagcattgctacaggcgtgtcaatgcgggagtatggttcactctttgactcgatctctttatgtctatcaaaaggcttatgtgcccctgtaggcagtgtgcttgtggggtcaaagaagctgatcaagaccgctacctggtttaagaagcaggccggaggaggaattcggcagtccggtatcctgacatctgcagctaacgttgcattggaccaagtctggccctcaatggcaaaaactcatgctactgcgaaggagttcgccaactttgttacttctgacctgggcctcaagctcctttttcccgctgataccaactttgtttacattgatgaaacggacaaatttgattctgatgtctttgtcaagcttggagcggagcggggcatcaagttgctcggaggcagaatcgtcttccactaccatacttcacccgaggccattgagaccttgaaggaggtgcttcaagaggctatcaaacagtattctggggtaaaggaagacaagcttaagactagtggctacatctaa

SEQ ID NO: 1168 - protein, 356 aa, Yarrowia lipolytica
MTACSHDFRSDTITNPTKEMMEAITNSYSALGDAVYEEDTITTNFESRIKELTGHEAAVFAVSGTMTNQLAIRSHLFQPPHSILCDHRAHVYTCEAGGIATLSQAMVTPVIPSNGIYMTLEDIKAKIIVGEDVHVAPTKLICLENTMGGAIYPIEEIRRISKFARDNDIPIHLDGARLWNASIATGVSMREYGSLFDSISLCLSKGLCAPVGSVLVGSKKLIKTATWFKKQAGGGIRQSGILTSAANVALDQVWPSMAKTHATAKEFANFVTSDLGLKLLFPADTNFVYIDETDKFDSDVFVKLGAERGIKLLGGRIVFHYHTSPEAIETLKEVLQEAIKQYSGVKEDKLKTSGYI

SEQ ID NO: 1169 - DNA, 1188 bp, Kluyveromyces lactis
  CDS (1)..(1188)
atgactgcttctgataagaaatctactgctgctgctccttcagagccagcttacacctcagctgccaatgaccttcggtctgatactttcaccactccaactaaggaaatgttggaagctgctttcaatgcttccatcggtgatgcagtctataacgaagacgtcgacaccattgagctagaaaccgtcgtagctcgtttagctggtaaagaagccgggttattctgtgtctctggtactttatcgaaccaaattggtttgagaacgcatctattccaacctccatactctatcttgtgtgattacagagctcatgtttatactcatgaagcagctgggttggcaatcttgtctcaagcgatggtcactccggtgatcccatctaacggtgattatatgactttggaagatatcaaggctcattacatcccggacgacggggatattcacggtgcgccaacaagagtgttatcgttggaaaacactttgcacggtatcgtttacccattggaagaattgatccgtatcaaagggtggtgtttggaaaacgatatcaaattacactgtgacggtgctagaatttggaacgcagttgtcgaatccggtgtctctttgaaacagtacggtgaaattttcgactctatctccatttgtctatctaagtccatgggtgctccaatggggtctgttcttgttggtagcaacaagtttgtcaagaaatgtaaccatttcagaaaacaacaaggtggtggtgttagacaatcaggtattatgtgcagaatggcactttgcgctgtgaacggtgactggaagactaagatgggatactctcaccagttggcccacgaattggctaaattctgtaaagataacggtattccattggagtctccagctgacaccaacttcgtcttcttggacttgcaaaaggcaaagatgaacccagacgttcttgtcaagaaaggtttgaaatatggggtcaaattgatgggtggtagagtttctttccactaccaagtcaccagagaaactttggaaaatgttaagtctgctgtcttggaaactttccaatacgcaaaggaaaacccattcgacactaacggtccaacaaaaatctaccgtagtgaatctactgattttgatatccatggtaaccctatcagtgatatcaagacttacaagtactga

SEQ ID NO: 1170 - protein, 395 aa, Kluyveromyces lactis
MTASDKKSTAAAPSEPAYTSAANDLRSDTFTTPTKEMLEAAFNASIGDAVYNEDVDTIELETVVARLAGKEAGLFCVSGTLSNQIGLRTHLFQPPYSILCDYRAHVYTHEAAGLAILSQAMVTPVIPSNGDYMTLEDIKAHYIPDDGDIHGAPTRVLSLENTLHGIVYPLEELIRIKGWCLENDIKLHCDGARIWNAVVESGVSLKQYGEIFDSISICLSKSMGAPMGSVLVGSNKFVKKCNHFRKQQGGGVRQSGIMCRMALCAVNGDWKTKMGYSHQLAHELAKFCKDNGIPLESPADTNFVFLDLQKAKMNPDVLVKKGLKYGVKLMGGRVSFHYQVTRETLENVKSAVLETFQYAKENPFDTNGPTKIYRSESTDFDIHGNPISDIKTYKY

SEQ ID NO: 1171 - DNA, 1182 bp, Kluyveromyces lactis
  CDS (1)..(1182)
atgcctattccacctttgtatacttcttctgcaggggatttcagatccgacacattcacgataccgacaaaagatttctggagccaagtgaccgatgcttcattgggagatactatcaatttagaagatacagatacgtgttcattggaagctagattatctgacgagattcttggtggcagggttcacagtggcgagaaatcagagggtttgttttgcatgtcaacaacattggcaaaccaaatagctgtccgctcccacttgaatttcgcaccaccttactctgtactttgtgataaacgagctcatatttttgttgatgaatgtgccgggattgcagtactttcccaagctttggtaatgcctaccatggcaagtaacggctgttacttaacattggaagatataaaggagaattatgtccctgacataggcgatatacacctagctccaacaagattaatatgcttggagaacaccttgcatggtatgttgtttcctctgactgaacttcaaagaatcagcgactgggctcattcccaagacattaaaattcatctcgatggagcaagattgtggaatgctgccgccgccaccgccgccgctaataattcctcttcggagtttgagactgaaatagaatacatgcaaaaagtgtcaaaattagtggactcagtctcgatctgtctttctaagtccatcggagcaccaattggttcagtgttagtggggtcgtctcaattcatcaagaaagctaggcacatacagaaacaacaaggtggcggtataagacaagccgggtttatcactaagattgctaattactgtattgatctcaacttcccgaacaggattgttgaagttaacaaggctaccagcaggttttggacagatttattccatacactaaaggaccagtatcagtttgaattggtcttacaacatcctgttgagacaaattttatatttgtggatttagctaagtcaaaaatatcattgaagctcttgttggaatttgcggaaaagaataatgttagattatgggatggcagactagcattccattaccagaatatcgaccaagaaggtttggatcgtttaaaacaaacctttattgacatcgcgaagtattacaaagagcatccatatgttgcagaagagagaagtgccagaatttattga

SEQ ID NO: 1172 - protein, 393 aa, Kluyveromyces lactis
MPIPPLYTSSAGDFRSDTFTIPTKDFWSQVTDASLGDTINLEDTDTCSLEARLSDEILGGRVHSGEKSEGLFCMSTTLANQIAVRSHLNFAPPYSVLCDKRAHIFVDECAGIAVLSQALVMPTMASNGCYLTLEDIKENYVPDIGDIHLAPTRLICLENTLHGMLFPLTELQRISDWAHSQDIKIHLDGARLWNAAAATAAANNSSSEFETEIEYMQKVSKLVDSVSICLSKSIGAPIGSVLVGSSQFIKKARHIQKQQGGGIRQAGFITKIANYCIDLNFPNRIVEVNKATSRFWTDLFHTLKDQYQFELVLQHPVETNFIFVDLAKSKISLKLLLEFAEKNNVRLWDGRLAFHYQNIDQEGLDRLKQTFIDIAKYYKEHPYVAEERSARIY

SEQ ID NO: 1173 - DNA, 1161 bp, Candida glabrata
  CDS (1)..(1161)
atgactactgaactaccaccacaatataccagtgcttccaatgacctgcgttccgacactttcaccactcctaccaggaagatgaaggaggctgctctggaggcttctattggtgacgctgtctacaacgaggacgtcgacaccatccgtctcgagcagcacgtcgcaaagctggccggtatggaggccggtctgttctgtgtctccggtacgctgtccaaccaaatcgctctgagagcgcacttgtaccagccaccttactccatcctgtgcgactacagagcgcacgtctacacacacgaggcagctggtctggccatcctgtcccaagccatggtcgtcccagtgatcccatccaatggcaactacatgaccctcgaggacatcaagagccactatgtcccagacgatggtgacatccacggtgccccaaccaaggtcatctccctggagaacaccttgcatggtatcatctacccgctagaagaactggtccgcatcaaggcctggtgtatggagaacggcctcaagctgcactgtgacggtgcccgtatctggaacgcagccgctgagtccggtgtcccactgaaacagttcggtgaactcttcgactccatctccatctgcctgtcaaagtccatgggtgccccaatgggctccatcctggtcggtaacaccaagttcatcaagaagtgtaaccacttcagaaagcagcaaggtggtggtgtaagacaatcaggtatgctatccagaatggccctctgcaacatcgacgccgactggaagtcaaacctactgtactcccacagactagcccacaacttggcagacttctgtaaagaaaagggtatccctctcgagtccccagccgacactaacttcgtcttcgtcgacttgagagcagcaaagatgaaccctgacgtcctggttaagaaaggtctgaaatacggtgtaaagctgatgggtggtagaatctccttccactaccaagtctcagaagaatccttggaaaaggtaaaactggctttgctcgaagccttcgaatactctaaggaacacccattcgatgaaaacggagctactaagatctaccgtagtgcctccaccgaagtcgacatcgaaggtaacgctatccaagagatcaagacttacaagtactaa

SEQ ID NO: 1174 - protein, 386 aa, Candida glabrata
MTTELPPQYTSASNDLRSDTFTTPTRKMKEAALEASIGDAVYNEDVDTIRLEQHVAKLAGMEAGLFCVSGTLSNQIALRAHLYQPPYSILCDYRAHVYTHEAAGLAILSQAMVVPVIPSNGNYMTLEDIKSHYVPDDGDIHGAPTKVISLENTLHGIIYPLEELVRIKAWCMENGLKLHCDGARIWNAAAESGVPLKQFGELFDSISICLSKSMGAPMGSILVGNTKFIKKCNHFRKQQGGGVRQSGMLSRMALCNIDADWKSNLLYSHRLAHNLADFCKEKGIPLESPADTNFVFVDLRAAKMNPDVLVKKGLKYGVKLMGGRISFHYQVSEESLEKVKLALLEAFEYSKEHPFDENGATKIYRSASTEVDIEGNAIQEIKTYKY

SEQ ID NO: 1175 - DNA, 1026 bp, Staphylococcus aureus subsp
  CDS (1)..(1026)
atgatttcattcgaaaatgattatttagaaggtgctcatgaaaaagtattaaaacgattagtagatacaaatcttgtacaagcttcgggatatggctttgatcaattcacagctcaggcaattgaaaagattaaagatacaattgactgtccaaatgctacaattcgttttttagtaggtggaacacaaaccaatcaggttgttattaattcaatgttagaaagttacgaaggggtcatttcagcagacactggtcatgttgctgtgcatgagggcggtgcaattgaatatagtggacataaagtaattactataccctctaaggaaggaaaagttagtgcttcagatgttgaaacttacatggagacatttaaaagtgattttaaaaaggaccatatggtattcccaggaatggtatatatttctcatcctactgaatatggcacattatactctaaatcagaattggaagagttatgcaaagtatgtaagcaatatcagcttccattatttatggatggtgcacgattagggtatggattgatgagtgatcaatcagatatgactattaaagacatcgctaaatattgtgatgtattttatataggtggtacgaagataggtgcattatgcggagaagcaattgtttttacgaagaataatgaaccgaaacaatttaccactcgaatcaaacatcacggtgcacttttagcaaaaggacggttaacaggcatacaatttttagaattatttacggataatttatattttaatataagcagacatgctatcgaaatggcaaataagatgaaagacgggtttataaataaaggctatcgtctttactttgattctccaaccaatcaacaattttttattttaagtaacgagaaaatagcagagttagaacaaaaagttaaatttgctgtttgggaaaaatacgatgatcaacatcgtgttgttagattcgcaaccagttgggcgacaaccgaagaaaatttaaataaactattagaattaatctaa

SEQ ID NO: 1176 - protein, 341 aa, Staphylococcus aureus subsp
MISFENDYLEGAHEKVLKRLVDTNLVQASGYGFDQFTAQAIEKIKDTIDCPNATIRFLVGGTQTNQVVINSMLESYEGVISADTGHVAVHEGGAIEYSGHKVITIPSKEGKVSASDVETYMETFKSDFKKDHMVFPGMVYISHPTEYGTLYSKSELEELCKVCKQYQLPLFMDGARLGYGLMSDQSDMTIKDIAKYCDVFYIGGTKIGALCGEAIVFTKNNEPKQFTTRIKHHGALLAKGRLTGIQFLELFTDNLYFNISRHAIEMANKMKDGFINKGYRLYFDSPTNQQFFILSNEKIAELEQKVKFAVWEKYDDQHRVVRFATSWATTEENLNKLLELI

SEQ ID NO: 1177 - DNA, 1008 bp, Photobacterium profundum
  CDS (1)..(1008)
atgattgattttcgctcagacacagtaacacgtccatccgattcaatgttggaaacaatgatgaaagcccctgtcggcgacgatgtatatggtgatgaccctacggtaaatgatttagaacagtggacagcagaacgccacggctttgaagcggctattttttgtagctcaggtacgcaagcaaacttgttaggtttaatggcacattgtgaacgtggtgatgagtacctttgcggccagcaagcacacaattataagtttgaaggcggtggtgcagcggtattaggttctattcaaccacaacctatcgaaaatgaaaaagacggttcaatttctattgataaactaaaagctgcaattaaaccaatagatcctcactttgcgcgcaccaccctactcagccttgaaaataccattaatggtaaagtactgccgttatcatatttgaaagaagcgcgtgaatttgtcaatcagcacggcttaaaattgcatttagatggcgctcgcgtatataacgcatcggtagcattagatgtagacatcaaagagatctcgcaacacttcgattcaatgacaatctgtttatcaaaagggttaggtgctcctattgggtcattgctactaggcaaccatgagctaatagccaaagcacgtcgttggagaaaagtattaggtggcggtatgcgtcaagctggtattttagcggcagcaggaaaaatagcccttactgaaaatgtaactcgtctggcagacgatcatgccaacgctcgttatcttgcacaagaattagcaaaagttgacggcttttcagttaatcttgaacatgttcaaacgaatatgctttttgccaaggttgactcaactatcaatcaacagcagttagttgataacttaaaagagcaaggtatcttatttagcgcaggtaaccctatgcgtttagtcactcatttagatataagccgagtagacatcgatacctttataacggcgttaaaatgcgctttataa

SEQ ID NO: 1178 - protein, 335 aa, Photobacterium profundum
MIDFRSDTVTRPSDSMLETMMKAPVGDDVYGDDPTVNDLEQWTAERHGFEAAIFCSSGTQANLLGLMAHCERGDEYLCGQQAHNYKFEGGGAAVLGSIQPQPIENEKDGSISIDKLKAAIKPIDPHFARTTLLSLENTINGKVLPLSYLKEAREFVNQHGLKLHLDGARVYNASVALDVDIKEISQHFDSMTICLSKGLGAPIGSLLLGNHELIAKARRWRKVLGGGMRQAGILAAAGKIALTENVTRLADDHANARYLAQELAKVDGFSVNLEHVQTNMLFAKVDSTINQQQLVDNLKEQGILFSAGNPMRLVTHLDISRVDIDTFITALKCAL

SEQ ID NO: 1179 - DNA, 1026 bp, Bdellovibrio bacteriovorus
  CDS (1)..(1026)
atgaaacgcggttttggcagcgacaatcatgccggtgtccacccacggattctgcaatctatcctggacgccaacaccgaacacgcccccgcctacggaaccgatgaatggaccgaacgcgcggtgggggaattcaaaaaccaattcggcaaagacgcccacgtgttcttcgtcttcaatggcacggccgccaacgtcacggccttaagagccatggcccgcccctggcaatcggtgttctgttcagacgtggcgcacatcaatgtggatgaatgcggctcgccggaatttttaagtggttgcaaactgctgccactgccctcccacaacggaaaactgtctgtggaagaacttgaaaaggccttcatccgccggggggaccagcatttttcccagactcaggtgctcagcctgactcagcctacagaactgggaaccacctattctttggatgagctcaaagccctgatcgcttgggccaaaagcaaaaaactgctggtgcacattgacggagccagactgagcaacgcggccttgtacttgaaaaagaccttgaaagaaatcaccaccgacctgggggtggatgtggtttctttcggtggcaccaaaaatggtttgatgatgggtgaagccgttgtgatcctgaataaggatctggcgcaggattttaaatacatccgcaaacaaagcgcgcagctgccttccaagacccgctttatcgcctgtcagtttgaagcttacttcaaagacggtctatggcagcagattgctgaacattcccaccagatggccctgtatctgtatgaacagtgcaaaggacttgccggggtgaccgtgcgcgaagtcccgcaaagcaatgcggtctttgcgacaattcccagccactgggtgaaacccttgcgggaacattattttttctatgtctgggacgaaaacacatttgaatgtcgctggatgacctcctgggacacgcaaaaatcggatatcgatggtttcgtcgcacttctaaaggagcaacgtctatga

SEQ ID NO: 1180 - protein, 341 aa, Bdellovibrio bacteriovorus
MKRGFGSDNHAGVHPRILQSILDANTEHAPAYGTDEWTERAVGEFKNQFGKDAHVFFVFNGTAANVTALRAMARPWQSVFCSDVAHINVDECGSPEFLSGCKLLPLPSHNGKLSVEELEKAFIRRGDQHFSQTQVLSLTQPTELGTTYSLDELKALIAWAKSKKLLVHIDGARLSNAALYLKKTLKEITTDLGVDVVSFGGTKNGLMMGEAVVILNKDLAQDFKYIRKQSAQLPSKTRFIACQFEAYFKDGLWQQIAEHSHQMALYLYEQCKGLAGVTVREVPQSNAVFATIPSHWVKPLREHYFFYVWDENTFECRWMTSWDTQKSDIDGFVALLKEQRL

SEQ ID NO: 1181 - DNA, 1101 bp, Rhodopseudomonas palustris
  CDS (1)..(1101)
atgatctacgcccccgcccctgacgatccgcgactgccgccggtgcggatcaatttgctgtcggacacccagactcagcccagtgcggcgatgcgggaggcgatggcgcgggcgccggtgggagacgaacagatcggtgccgatccgaccgtgaacgcgctgtgcgcccgtgtcgccgatctgctcggcaaggaggcggcggtgttcatggcgtccggcacgatctgcaacattgcggcgacgttggcgcattgccgagccggcgacgaaattctcgcgcacgagacgtcccatgtcgtctcgctggagggctgcacacacgcggctctcggcggctttcagatccacccgctgccgggcgcaggcggtcagttctccgctgaaacgctgcgatcggcgctgcatcggccagaccggcatcaggcgaggcagagcctggtgtgcgtcgagcagaccaccaatctcggcggcggcacggtgtggaacgctttgacgctccggcagatcgcggaattggctcgcgccaatggattagccacccatatggacggtgctcgcctgatgaacgccagcgtcgccagcggcatctcgccccggcagatcgccgccggctgggactcggtgtggatcgacttcagcaagggcctcggcgcgccactcggtgccgtgcttgcgggatcgcgcgatttcatcgacgaggtctggctgtggaagcagcggctcggcgggtcgctgcgtcaggccggcatttgcgccgccgcctgcctgtatgcgctcgaccacaatgtcgggcgcctcgctgaggatcacgccaatgcccgattgctcgcggcaggcttgtcgcagatcgacggcgtgagcgctgcaccgccggagaccaacctggtctatttcgacgtctccggcgccgcgtggtcaaagcaggcaattgtcgacgcgctgcgggcccgtggtgtgctgatctcgatcctcagcgaccggctacgcgcctgcacgcatctcgacgtcacgcccgcgatgatccaagaggcgctcgcagtgatccgcaacgtggtcgaaggcgatacgacggcccggatcggccgcagcgcacagatctga

SEQ ID NO: 1182 - protein, 366 aa, Rhodopseudomonas palustris
MIYAPAPDDPRLPPVRINLLSDTQTQPSAAMREAMARAPVGDEQIGADPTVNALCARVADLLGKEAAVFMASGTICNIAATLAHCRAGDEILAHETSHVVSLEGCTHAALGGFQIHPLPGAGGQFSAETLRSALHRPDRHQARQSLVCVEQTTNLGGGTVWNALTLRQIAELARANGLATHMDGARLMNASVASGISPRQIAAGWDSVWIDFSKGLGAPLGAVLAGSRDFIDEVWLWKQRLGGSLRQAGICAAACLYALDHNVGRLAEDHANARLLAAGLSQIDGVSAAPPETNLVYFDVSGAAWSKQAIVDALRARGVLISILSDRLRACTHLDVTPAMIQEALAVIRNVVEGDTTARIGRSAQI

SEQ ID NO: 1183 - DNA, 1083 bp, Rhodopseudomonas palustris
  CDS (1)..(1083)
atgttagcctcgggtatggcctacatcccttccctacccgatccgaacgcgccgccggtgcggatcaatctgctctccgacacccagacgcggccgacgccggcgatgcgcgaggcgatggcgctggccgaggtcggcgacgagcagaccggcgacgatccgaccaccaacctgttgcaggagcgcgtcgcggcgctgctcggcaaacaggccgcagtgttcctcccttcagggacgatgtgcaacgtcacgactacgctcgcgacctgccggcccggggacgagatcatcgcccatcgcaccgcgcatatcctgtcacgcgaaggcggtgcgcacgccgcgctcggcggcttccagatcaccggcctggacggcgacgacggccagttctcactcgagacgttccgcgccgcgctgcatccgaagacgcgctacgaaccgccacaagtgatggtcagcgccgaacagaccgccaatatcggcggcggcacaatctggccgcaggccacgctcgacgcggtcgccgcggccggcaaggacgccgggctgtggacgcatatcgacggcgcacggctgatgaacgcggtggtcgccacgggtatcagtgccaaggcgatgacggcgggttgggactcggcgtggatcgatttcagcaagggcctcggtgcaccggtcggcgccgtgctggccggcccgcgtgccttcatcgacgaggtgtggcgctggaagcagcggctcggaggcgcgatgcggcagtccggcgtgattgccgcggcgtgtctgtacgcgctcgatcatcacgtcgatcgccttgccgacgatcatgccaacgcgcgccgtcttgcctccgggctagcgcagatcgacggcatcgaggtgcagacgccgcagaccaatctggtgttcttcaaaccggaccgcaccggcgtctccggcgccgacatggtcgcacagctccgccggcgcggcgtggtgttggcgatgatggagggacggatccgcgcctgcacgcatctcgacgtcagcgcggacatgatcgagcaaacgctcgaccacgtccgcgagatcgtgcgggcagcctga

SEQ ID NO: 1184 - protein, 360 aa, Rhodopseudomonas palustris
MLASGMAYIPSLPDPNAPPVRINLLSDTQTRPTPAMREAMALAEVGDEQTGDDPTTNLLQERVAALLGKQAAVFLPSGTMCNVTTTLATCRPGDEIIAHRTAHILSREGGAHAALGGFQITGLDGDDGQFSLETFRAALHPKTRYEPPQVMVSAEQTANIGGGTIWPQATLDAVAAAGKDAGLWTHIDGARLMNAVVATGISAKAMTAGWDSAWIDFSKGLGAPVGAVLAGPRAFIDEVWRWKQRLGGAMRQSGVIAAACLYALDHHVDRLADDHANARRLASGLAQIDGIEVQTPQTNLVFFKPDRTGVSGADMVAQLRRRGVVLAMMEGRIRACTHLDVSADMIEQTLDHVREIVRAA

SEQ ID NO: 1185 - DNA, 1855 bp, Mus musculus
  CDS (128)..(1330)
atagtgccccgggcttgcccagttcaggtccgcgcggggtcagaagagtccagttacacgggttccccgctggcacggaagagactgtcctccgctcctgcggccgagaaagacgagtgccacagccatgctatgcagcctgttccgggccgccatgctacgcagcctgttccgggccacggtcccggggctcagggtgccctgggctcagtggtctaggaattgggcgggggtcccagcccacgtggtggacctacgcagcgacacggtgacccggccagggccggccatgaggcgcgctatggccgaagcggttgtaggagacgatgattacggcgaagaccctacggtccacgaactgcaggaaaaggctgcagagttgcttggggtagagaggacgctgtttgtgcccaccaacactatggccaacctcatctctgtgatgggtcactgccggcgccggggttcccaggtcctccttgggcaggaatgccacctccacgtctatgagcagggcggggtggcacagatcgctggggtgcattcccaccccctccccgacctgccctatggcaccttggacctgaatgagctagagagggcactcacgcggggctctgggagtccctaccatccagtctgtgagctcgtgtacctggagaacactcacagcagcgcgggaggccgggtcctccctgtcgactacctccgccaggtgtgcctcctggcccacgcccacggagcaagggtccacatggatggagctcggttgatgaatgcagcagtggctctgcgcataccccctgcccgccttgtagagcactgtgactctgtatccttctgtttctctaagggcctaggtgcaccagtgggagctctggttggcggatccaaagacttcattggagaagcatggcgcctccgcaaggccctgggtggaggcatgcgccaggctggagtgctggctgcggctgccctggtgggactagctgaggcagaggaggtgctaccaagggaccacgagaatgcccagagattcgctaaaggactccaagacctggcgtcacccatttgctctgtggatcctgccaccgtggagaccaacatggtgctggtgcaggtagctgggctgcctccctcggagctatgccagcgcctgcaggctgtgagtgcagaggaggtggctcagactggccgtgccgtgcgcgtgctgctgtttccctggacagaacagtctgtgcgggctgtgtggcaccgagatgtgtctgctcaggacacggaactggcactgaagaagtgggagtttgtgctgagacagttgcggccctgaggccaggggatccgggaccccgtgctacgattggagtgggcagtgagatgcctgaagctgttagcctggtgaaggctcatcctctctggaggatggtgacatcattccgtctctggtttgctccagtgacactcctgggatggccttacgcagtcaggaataaccaggcataaggtggggaaagctgtgactgcatatccagagaaggaagcgcatagaggaggcaggccctggggttggggttggccctggggtgtagcaggattgcctagtgtgcataagccctgggctccatccccagcactgtgggttcgaaccccagcagctcacagctcacaactgtaaccctaccatgctaggggattagaagctcaaggccactctcagctactcagagaatttgatgcaagcctgggctacacgagaccctgtcttcaagaaaatagatccttagtgactgacacagtggagttgtcagaggtggactgtgaaataaaatactgaaggcacaaaaaaaaaaaaaaa

SEQ ID NO: 1186 - protein, 400 aa, Mus musculus
MLCSLFRAAMLRSLFRATVPGLRVPWAQWSRNWAGVPAHVVDLRSDTVTRPGPAMRRAMAEAVVGDDDYGEDPTVHELQEKAAELLGVERTLFVPTNTMANLISVMGHCRRRGSQVLLGQECHLHVYEQGGVAQIAGVHSHPLPDLPYGTLDLNELERALTRGSGSPYHPVCELVYLENTHSSAGGRVLPVDYLRQVCLLAHAHGARVHMDGARLMNAAVALRIPPARLVEHCDSVSFCFSKGLGAPVGALVGGSKDFIGEAWRLRKALGGGMRQAGVLAAAALVGLAEAEEVLPRDHENAQRFAKGLQDLASPICSVDPATVETNMVLVQVAGLPPSELCQRLQAVSAEEVAQTGRAVRVLLFPWTEQSVRAVWHRDVSAQDTELALKKWEFVLRQLRP

SEQ ID NO: 1187 - DNA, 1080 bp, Listeria monocytogenes
  CDS (1)..(1080)
atgataaacacactaaaaaccagctaccaaaaaacaccatataaactaggcgggaacggtccgcgcaatgtaggtgttctgacagaagcacttcaaaatatagatgataacctagaaagcgatatttacggaaatggcgcagttattgaaaactttgaaacaaaaatcgcgaaaattctcgggaaacaatctgcggtattttttccaagtgggacgatggctcagcaaattgcgttaaggatttgggctgaccggaaagagaatcggtgcgtggcatatcatccactctctcatttggagattcacgagcaagatgggttaaaagaattgcaacaaatcacgcccatattacttggaacagctaatcgacttttgacaattgacgatattaaaagccttcgcgagccagtttctagtgtgcttatcgaacttccacaacgagaaattggtgggcagctgcctgcttttgaagagcttgaggagatttcggagtattgccatgaacagggtatttcgttgcatcttgacggggcacggttatgggaaatcacgccgttttatcagaagtctgcggaagaaatttgtgcgctgtttgatagtgtgtatgtgtcgttttacaaaggaattggcgggattgctggggcgattctggctgggaatgatgattttgtgcaagaggcgaaaatctggaaacgacggtatggcggagatttgattagtctgtatccgtatattttgtccgcggattactattttgaaaaacggattgggaaaatggcggaatattttgaagcggcgaaaggattggctgagcgatttaattcgtgttcgggcgtgaagactgtgccggaagtgccggtttctaatatgtttcatgtttattttgagaagtcggccgatgaggttggggcgattttgacgaagattcaggatgaaactggagttggaatttcggggtatttgcaggagaaatcggcggatgtttgcgcgtttgaggtttcggttggggatgcatttgcggagataccggtggagattttggatgatttatttaagaaacttgtaaattcagtaaaatag

SEQ ID NO: 1188 - protein, 359 aa, Listeria monocytogenes
MINTLKTSYQKTPYKLGGNGPRNVGVLTEALQNIDDNLESDIYGNGAVIENFETKIAKILGKQSAVFFPSGTMAQQIALRIWADRKENRCVAYHPLSHLEIHEQDGLKELQQITPILLGTANRLLTIDDIKSLREPVSSVLIELPQREIGGQLPAFEELEEISEYCHEQGISLHLDGARLWEITPFYQKSAEEICALFDSVYVSFYKGIGGIAGAILAGNDDFVQEAKIWKRRYGGDLISLYPYILSADYYFEKRIGKMAEYFEAAKGLAERFNSCSGVKTVPEVPVSNMFHVYFEKSADEVGAILTKIQDETGVGISGYLQEKSADVCAFEVSVGDAFAEIPVEILDDLFKKLVNSVK

SEQ ID NO: 1189 - DNA, 1023 bp, Desulfovibrio vulgaris
  CDS (1)..(1023)
atgctcaagagtttcgccagcgacaacacagcaggggtgcatccgcgcatcctcgccgccatggcctccgccaacgaaggccacgccaaggcctacggcatggacccgtggacaagtgaggctgcggatgtcttccgcggacacttcggtgatgacatcgacctgtatttcgtctttctgggcaccgctgcgaacgtgctgggactcaaatccgtcacgcgcccctggcattcggtggtctgcgccgatgtggcccatatcaatgtcgatgaatgcggcgcgccggagtcggtgaccgggtcgaagttgcaggtcatcccgtcgcacgacggtcgcatccgggtcatggacatcgtgcccctcatgcactcgctgggtaatttccaccacagccagccccgtgtcatctccatcacccagacgactgaactcggcacggtgtactcgccggcgcagatacgcgcgctggccgatttcgcccacgccaacggcatgctgctgcacatggatggtgcacggctgtgcaacgcggcggcggcactcgataccgggctggcggccctcacccgtgacacgggggtcgatgtgctctcgttcggcggcaccaagaacggcatgatgttcggtgaagccgtcatcttcttcaatcgtgaactggcaagcgaattcaagttcatccgcaagcaggggatgcaactggtctcgaagatgcgcttcatcgcggcgcagttcatcgaacttctgcgtgatggtctgtggcttgagaacgcccgtaacgccaacagcatggcacggctcatggctgaaagcctgcgcggtctgccccatgtgaccatcacccggcccgttgaggcaaacgccgtgttcgcccggctttcgccggaacatatcgcggcactgcagaaggacttctatttctatgagtgggacccggtgctgcacgaggtgcgctggatgaccagcttcgactccaccgaggaacaggtcatggagttcgtgcacgccatcaaacggctggcatag

SEQ ID NO: 1190 - protein, 340 aa, Desulfovibrio vulgaris
MLKSFASDNTAGVHPRILAAMASANEGHAKAYGMDPWTSEAADVFRGHFGDDIDLYFVFLGTAANVLGLKSVTRPWHSVVCADVAHINVDECGAPESVTGSKLQVIPSHDGRIRVMDIVPLMHSLGNFHHSQPRVISITQTTELGTVYSPAQIRALADFAHANGMLLHMDGARLCNAAAALDTGLAALTRDTGVDVLSFGGTKNGMMFGEAVIFFNRELASEFKFIRKQGMQLVSKMRFIAAQFIELLRDGLWLENARNANSMARLMAESLRGLPHVTITRPVEANAVFARLSPEHIAALQKDFYFYEWDPVLHEVRWMTSFDSTEEQVMEFVHAIKRLA

SEQ ID NO: 1191 - DNA, 1023 bp, Thermus thermophilus
  CDS (1)..(1023)
atgcgcctcgtggacctgaggagcgacaccctcacccgccccaccccggccatgcgcaaggccatggcggaggcggaggtgggggacgacgtctacggcgaagaccccacggtgaaccgcctcgaggccctggcggcggaaaggctcgggtttgaacgggccctcttcctgccctcgggcaccatggccaaccaggtggccctcctcctccacctgccccggggcggcgaggtcctggcccccgagggggcccacctctacgagtacgagctcggcgccccggccctcctcgccggggccctggtccgccccgtgcccgccccaggggggaggccggacctgaaggccctggaggaggccctaaggcggggccccttccaggcccccatcgggctactcgccctggagaacacccacaacctggccggggggcgggtggtgcccctggaggtccaaaggcgggtccaagacctggcccgcgcccggggcctccccacccacctggacggggcccgcctccacaacgccgccgtcttcttgggggtggaggcccgggaggtggcccggggcttcaccaccgccatggtctccctctccaaggggctcggggccccggtgggaagcctcctcctcctgcccaaggagctggaggccgaggcccggcgttaccgcaagctcctcgggggcgggtggcggcaggcgggggtcttggccgcggcggggatcctggccctagaggaaggccccaagcacctccggcgcgaccacgagatggcccgcgccctggcggaggggctttttcgcctggggctcgccgtggacctgggggcggtggagaccaacatggtctacctggaggtggaggaccccgagggctttctccagggtctaagggcccggggggtgctcgcggggcgcgtggggggaagggtgcggttcgtgacccaccgggacctcatggacgaggacatcccccttaccctggagagggtccaagacctccttcactccaggcccaggtag

SEQ ID NO: 1192 - protein, 340 aa, Thermus thermophilus
MRLVDLRSDTLTRPTPAMRKAMAEAEVGDDVYGEDPTVNRLEALAAERLGFERALFLPSGTMANQVALLLHLPRGGEVLAPEGAHLYEYELGAPALLAGALVRPVPAPGGRPDLKALEEALRRGPFQAPIGLLALENTHNLAGGRVVPLEVQRRVQDLARARGLPTHLDGARLHNAAVFLGVEAREVARGFTTAMVSLSKGLGAPVGSLLLLPKELEAEARRYRKLLGGGWRQAGVLAAAGILALEEGPKHLRRDHEMARALAEGLFRLGLAVDLGAVETNMVYLEVEDPEGFLQGLRARGVLAGRVGGRVRFVTHRDLMDEDIPLTLERVQDLLHSRPR

SEQ ID NO: 1193 - DNA, 1053 bp, Wolbachia pipientis wMel
  CDS (1)..(1053)
atgagagtaaaaatagatttctttagcgattcaaacactgacccttcagctaaaatgagggaagcgatggctaaagcaaaagttggaaacgaagctgcatgtgaagatccaactgtgaacgaattagtggcaaccgcatgtaaaatattaggtaaacctgcaggaatctttttgatttcaggaacgatgtccaatgtaattgcttataaagtacacattcaaagacctggtgattacttgctgcttgatgaaacttcacatccactcatagtacaatctggcttgatcgcagcccaggcacatgctactcctttgcccatcaaaggtacaagaggaatatttactggagaacaaattgttgagtttattactcgtcctagtttaagaaatattccgagagttgggcttgtttctatcgaacaaacgacaaattttggtggtggagctgtgtggcctttagaatatattcaagagatctcaagtctctgcaaagagaatgacgtattcactcatttagatggagcaagactgttcaacgcttgtgctcatactaaaatatctccaaaggagtatgcaagttattttgattcggtattcattgattttagtaaaggattaggtgctccaatgggtgcaatattgcttggaagtgaagattttattgaaaaagcttggtactataagtttcaaattggcggaggtatgcaccaagctggcattatttcagctgcatgtttatatgctctacgtaataatgtaaattctttagaagaagatcataaaaaaatgcagcaccttatagaaggcctagactccatagatcaagttataattgatatcgacctgtataaaactaatatagcgtatttttcattacgtactaattgtatatctactcaagaattaataaacgtactaatgacaaattatggaattagaatggctaacatcaaaggtaaaatcagagctataacacatagagatataagctatgaagatattaatactactgtatctgctataagaaagatactaagtaattttctgcactaa

SEQ ID NO: 1194 - protein, 350 aa, Wolbachia pipientis wMel
MRVKIDFFSDSNTDPSAKMREAMAKAKVGNEAACEDPTVNELVATACKILGKPAGIFLISGTMSNVIAYKVHIQRPGDYLLLDETSHPLIVQSGLIAAQAHATPLPIKGTRGIFTGEQIVEFITRPSLRNIPRVGLVSIEQTTNFGGGAVWPLEYIQEISSLCKENDVFTHLDGARLFNACAHTKISPKEYASYFDSVFIDFSKGLGAPMGAILLGSEDFIEKAWYYKFQIGGGMHQAGIISAACLYALRNNVNSLEEDHKKMQHLIEGLDSIDQVIIDIDLYKTNIAYFSLRTNCISTQELINVLMTNYGIRMANIKGKIRAITHRDISYEDINTTVSAIRKILSNFLH

SEQ ID NO: 1195 - DNA, 1050 bp, Wolbachia pipientis wMel
  CDS (1)..(1050)
atggaaaaaattattgatctgagaagtgacactacaactctgcagagctccaacgttatacatgcaataagtaatgcaactgttggagattttgcttatggtgaagacaaaagctgtaatgacttatcagaatattgcaaacaattattcaaagtagaagaagcattatttgcaaccagcggtatgcttgcaaatagattagccattgccagtcaaacaagtcctggtgatgaactaataactcattataattatcacgttaattttttcgatagcgcaggcaatgcaaaagtaaataatatcgtatttaattgtattagaaataatagcggaatcttagatgttgctgaagtagaatatgctattaattctaagccaaggtacaaaatttttgctcaggtgagtcttgtttctatagaaaatagtataaacgggtttaatggtaaaatttatccttttgaaaaacaagtcgagttatatcactttttaaaagctcacaatgtaaatcttcatttagacggtgcaagaatatttaatgctcatgtcgaaacaaatattgctttagcagattatgctaaatatgtggatacaatgagcttttcttttaccaaaggactgggagctccttttggttcaatgcttatgggtaaaagagagataattgaaagggctaaaaagctacaggtttggctaggtagtggttatcatcagatagggtattgtgctaatgcagcaaagtatgtactacagaacaatatttctaggcttaaagaagacaataaactcgccaaactgtttgcagacaagattaaggaaattccacacataaaactggtactaccttatccagaaactaatatagtaagctttagtataaaagcactaaatgtaactaatgaggttttcttgagtaagtgccaagcttatggtttattgctttttccttggctcgagtctcatataagagcagttacccatcttggcacaaaggaaacagacatcatgaaagctgctgaaattataaaggaggttgtgttaaatttaatatga

SEQ ID NO: 1196 - protein, 349 aa, Wolbachia pipientis wMel
MEKIIDLRSDTTTLQSSNVIHAISNATVGDFAYGEDKSCNDLSEYCKQLFKVEEALFATSGMLANRLAIASQTSPGDELITHYNYHVNFFDSAGNAKVNNIVFNCIRNNSGILDVAEVEYAINSKPRYKIFAQVSLVSIENSINGFNGKIYPFEKQVELYHFLKAHNVNLHLDGARIFNAHVETNIALADYAKYVDTMSFSFTKGLGAPFGSMLMGKREIIERAKKLQVWLGSGYHQIGYCANAAKYVLQNNISRLKEDNKLAKLFADKIKEIPHIKLVLPYPETNIVSFSIKALNVTNEVFLSKCQAYGLLLFPWLESHIRAVTHLGTKETDIMKAAEIIKEVVLNLI

SEQ ID NO: 1197 - DNA, 1056 bp, Treponema denticola
  CDS (1)..(1056)
atgtatttttttataaatgattacagtgaaggttgtcatccaaaaattcttaaagcattgacggaaacaaatgaagagcaaaccgtcggttacggctgtgacgaatattgtgcagaagctgcagaccttatcttaaaagaactggatgcacctcaaagtaaggtttatttcttttctggcggaacacaaaccaacctgaccatgatagcctcagtactaagaccccatcagggagttatcgccgccgatacagggcatataaacgtacatgagtcgggagccatcgaagcttgcggacacaaggttctaaccatcgaatcggcaaacggaaaaataacggcggagcaggctgaagctcttataagggcacattacgatgatcccacagccgagcacatggttcagcccggaatgatttatatttcaaatcctacggaactcggcaccatttattcaaaaaaagaattacaggctttaaagctgaccgctcaaaaatattccgtacccctctatgttgacggcgcccgcctagggacagccctcaccgctgacaataacgacttaagccttgcagacatggcaagatatacggatgccttttatataggcggaacaaagatgggcgctcttttcggtgaagcccttatcatcaacaaccaagatcttcaaaaagactttagatatatacaaaaacaaaaaggcggtctttttgcaaagggcagacttttaggccttcagtttaaaactctttttaaggataagctttacttcgaaataggaagaacaatgaacgaaacggcaaagatgatccgtaaaggtttttccgataggggcttttctttttttatgaaaagcgaaacaaaccagagctttccgataatagaaaatagtcttttagctaaaatagaaaaagaatttaaatgcgaattttgggcaaaaatttcagaaaaccaaacagcagttcgcttttgtacctcatgggcaacaacaaaagaggcggtaaaaaaactttttgaatacgtggacgagataaacagcaatgcgattaaaagataa

SEQ ID NO: 1198 - protein, 351 aa, Treponema denticola
MYFFINDYSEGCHPKILKALTETNEEQTVGYGCDEYCAEAADLILKELDAPQSKVYFFSGGTQTNLTMIASVLRPHQGVIAADTGHINVHESGAIEACGHKVLTIESANGKITAEQAEALIRAHYDDPTAEHMVQPGMIYISNPTELGTIYSKKELQALKLTAQKYSVPLYVDGARLGTALTADNNDLSLADMARYTDAFYIGGTKMGALFGEALIINNQDLQKDFRYIQKQKGGLFAKGRLLGLQFKTLFKDKLYFEIGRTMNETAKMIRKGFSDRGFSFFMKSETNQSFPIIENSLLAKIEKEFKCEFWAKISENQTAVRFCTSWATTKEAVKKLFEYVDEINSNAIKR

SEQ ID NO: 1199 - DNA, 1056 bp, Geobacter sulfurreducens
  CDS (1)..(1056)
atgaacaactgcacgaccaccgagcgccgcaaccagtttgccagtgacaactacgccggaatctgccccgaggcatggcaggccatggaagaggccaaccgtgggtatgcctgttcctacggcgacgacacctggacggagagggcgtgccgcctgctgcgcgacacctttgaaaccgactgcgaggtgttcttcgtcttcaacggcacggcggccaactcactggccctggcatccctctgccagtcgtaccacagcatcatctgccacgagacatcccatatcgaaaccgacgaatgcggggccgccgaatttttttccaacggcacaaaaatacttctggttcccggcccccacggcaaggtcgacccggacgcagttgagcacacggtcaaacggcgcctcgacattcattaccccaagcccaaggtcctcagcatcacccaggcaacggaattggggaccctctattcggtggatgaactgcgcgagctgggccatcttgctcgacgcctggatctacgcgtccacatggacggggcccgttttgcaaatgccgttgccgccctcggtgtccacccgagcgagatcacctggaaggccggggtcgacgtgctctgtttcggcgggaccaagaacggcatggccgtaggtgaagcagtcgtgtttttcaaccgggagcttgcccgcgagttcgactaccgctgcaagcaggcaggacagcttgcctcgaagatgcgctttctggccgctccctggatcggcatgctggaaagcggtgcctggttgacccgctcagcccatgcgaatgcctgcgcagccagacttgaagcccggcttcgcgatattcccggcgtcggcatccgctttccccgccaggcaaactcggtctttgccgatctcccgccgggggtcgtcgacgccctccatgggcttggttggcatttctacaccttcatcggctccggcggagcgcgcttcatgtgctcctgggagacgagcgatcaggacatcgacctactggcgactgacatagcaggttgctgtaataggtaa

SEQ ID NO: 1200 - protein, 351 aa, Geobacter sulfurreducens
MNNCTTTERRNQFASDNYAGICPEAWQAMEEANRGYACSYGDDTWTERACRLLRDTFETDCEVFFVFNGTAANSLALASLCQSYHSIICHETSHIETDECGAAEFFSNGTKILLVPGPHGKVDPDAVEHTVKRRLDIHYPKPKVLSITQATELGTLYSVDELRELGHLARRLDLRVHMDGARFANAVAALGVHPSEITWKAGVDVLCFGGTKNGMAVGEAVVFFNRELAREFDYRCKQAGQLASKMRFLAAPWIGMLESGAWLTRSAHANACAARLEARLRDIPGVGIRFPRQANSVFADLPPGVVDALHGLGWHFYTFIGSGGARFMCSWETSDQDIDLLATDIAGCCNR

SEQ ID NO: 1201 - DNA, 1047 bp, Geobacter sulfurreducens
  CDS (1)..(1047)
atgaacatcattgacctgcgcagcgacaccgttacccggccgagccctgccatgcgcgccgccatggcgggagccgaggtaggggacgacgtctatggcgaagacccgaccgtgaaccggctggaggaactgggcgccgccacgctcggcacggaagcggccctgttcaccgccagcggtacccaggccaatcttctggctctcctggcccactgccggcgtggtgacgaatacattgccggccagaccgcccactgctatcgctacgaagggggcggtgccgccgctttggggggcatccagccccagcccctggaggtggaacccgacgggaccctcgatctctcagccgtggccgccgccatcaagccggacgacctccacttcgcccgcacccggctcctctgcctggaaaacacccatgccgggcgggttcttcccctggactacctggcacgcgccagacggctctgcaacgagcagagccttggcctgcacatggacggtgcccgcatcttcaatgccgccgtaaagctcggcgtaccggtccgcgagatcgccggtcacgtggattcggtgtcggtctgcctctccaaggggctcggcgccccggtggggtcgctgctctgcgggggaagggagttcgtcgccacggcccgccggtggcgcaaggcggtcggaggaggcatgcgccaggccggcatcctggcggccgccggcatcctggcgctgaccgaaaacgttgaccggctcgccgaggaccatgccaacgcccgccgcttggccgaggggttggccgccatcccggggctgggccttgacccgtcccaggtccagaccaacatggtattcctgtgcctccctctccggacggcggaccggctcgcctcatttctcaacgaacagggaattctcatctccggccgggaaagtatccgtctcgtcacccaccttgacgtaacctcttcggacgtggaacgggttatcgcggcattcggcgcattcttcgccggccacggcgagatgcaaccgggagcatcgtcatga

SEQ ID NO: 1202 - protein, 348 aa, Geobacter sulfurreducens
MNIIDLRSDTVTRPSPAMRAAMAGAEVGDDVYGEDPTVNRLEELGAATLGTEAALFTASGTQANLLALLAHCRRGDEYIAGQTAHCYRYEGGGAAALGGIQPQPLEVEPDGTLDLSAVAAAIKPDDLHFARTRLLCLENTHAGRVLPLDYLARARRLCNEQSLGLHMDGARIFNAAVKLGVPVREIAGHVDSVSVCLSKGLGAPVGSLLCGGREFVATARRWRKAVGGGMRQAGILAAAGILALTENVDRLAEDHANARRLAEGLAAIPGLGLDPSQVQTNMVFLCLPLRTADRLASFLNEQGILISGRESIRLVTHLDVTSSDVERVIAAFGAFFAGHGEMQPGASS

SEQ ID NO: 1203 - DNA, 1056 bp, Yersinia pestis
  CDS (1)..(1056)
atgatgaaatctatttttctagccaatgagaagacgatgctgatcgatttacgcagtgacacagtaacgcaaccctgtgccgccatgcgcgccgcgatggcgaatgccgaggtcggtgatgatgtgtatggcgatgacccaaccgtcaatgcgcttgaagccaaagccgccagtttatccggtaaagaagccgcgctgtttctgccaacaggcactcaggcaaatttggtggcgctattgacccattgtcagcgtggtgaagagtatattgtcggccaaaaagcccataactatttgtatgaagccgggggtgccgccgttttgggcagtatccaaccacaacctattgatgccaacgatgacggcacactaccactggataacgttctggccgccatcaaacccgatgacattcactttgcccccacccggctgttaagtttggaaaatactcacaatggcaaagtcttgcctttgcgttatttacagcaagcctgggcgttgacccgcgaaaaaaaactggcgttacatattgatggcgcacgtgtttttaatgctgcggtggcgctgaatgtgccactgaacgatattagccagtattgcgataccctgacaatttgtctgtcaaaaggattagggacgcctgttggttccctgctctgtggcagcgcagaattcattcatcgcgcccggcgctggcgaaaaatgaccggtggtggtatgcgtcaggccggtattttagcggcagccgggttgtatgcgctgcaacataatgtggcgagactcaaagatgatcacgataacgcccagtggttggaacagcaattacgtgacttaggcattgagatagccgcccccggcgcgcaaacaaacgtgctgtacattacgcaatctgccgaatcagcgttgaaacttggcccctggatgcgtgaacgtggtgtgctgatcagtgccgggccgctcacccgcctgattactcaccttaacgtgagccgaaaagatctggaaaaagtcgtcgcgctgtggcgtgaatttattgccgagcaacattcatga

SEQ ID NO: 1204 - protein, 351 aa, Yersinia pestis
MMKSIFLANEKTMLIDLRSDTVTQPCAAMRAAMANAEVGDDVYGDDPTVNALEAKAASLSGKEAALFLPTGTQANLVALLTHCQRGEEYIVGQKAHNYLYEAGGAAVLGSIQPQPIDANDDGTLPLDNVLAAIKPDDIHFAPTRLLSLENTHNGKVLPLRYLQQAWALTREKKLALHIDGARVFNAAVALNVPLNDISQYCDTLTICLSKGLGTPVGSLLCGSAEFIHRARRWRKMTGGGMRQAGILAAAGLYALQHNVARLKDDHDNAQWLEQQLRDLGIEIAAPGAQTNVLYITQSAESALKLGPWMRERGVLISAGPLTRLITHLNVSRKDLEKVVALWREFIAEQHS

SEQ ID NO: 1205 - DNA, 1140 bp, Ashbya gossypii
  CDS (1)..(1140)
atgttgccggcgcggtatctgacatcgaggaacgacttccggtcggacacgttcacgctgccgacggcggaggtgtgggcggcgggcgcgggcgcgtcgctgggggacacggtctaccaggaggacacggacacgtgcgcgctggaggcgcgggtggcgcaggagttcgggggcgcgcgcggcggggacgcggcggggctgatgtgcgtgtcgacgacgatggcgaaccagctggcggtgcgtgcgctgctggaccgggcgccaccgtactcggtgctgtgcgaccggcgcgcgcatgtgtacgtggacgagtgcgcggggctggcggtgctgtcgcaggcgctggtgattcctgcggaagccgcgaacgggcggcacctgacgctggaggacgtgcagcgcgcgtacgtgccggacgacggcgacacgcacggcgcgccgacgcgcgtcgtggcgctggagaacacgctgcacgggatgtgctttccgctggaggagatgcggcgcatctgcgactgggcgcacgcgcaggggatgctagtgcacctcgacggcgcgcggctgtggaacgcggccgcggcgcagccgggcgacgcggcggcgtacatgcggcgcgtgtgcgcgctgttcgactccgtgtcgctgtgcctgtcgaagtccgtgggcgcgccggtgggctccgtgctggtgggcggccgcgacctgatccggcgcgcgcgccacctgcagaagcagcagggcggcggcatccgccaggccgggtttctggcgcgcatggcggactactgcatcacgaaaaacgtgcctgggctgggcgacgtcgctgcgcgcgcggcggcgttctggcgggatctgcacgacgacctgcgtgaccaccacggtatgcagctgcatctagcgcacccggtggagaccaacttttttttcatagacctggagcgctcgggcatcgagccctcgagtctgctggagttcggcgccaagaacgacgtgcggcttttcgacgggcggctggcgttccacttccagaatgtggaggacagctcgctggcgcagctcaagcaagtctttgtcgacctggccgcctattaccgagagcatccgtacgtggcccccgctggcccccaacgccgctactag

SEQ ID NO: 1206 - protein, 379 aa, Ashbya gossypii
MLPARYLTSRNDFRSDTFTLPTAEVWAAGAGASLGDTVYQEDTDTCALEARVAQEFGGARGGDAAGLMCVSTTMANQLAVRALLDRAPPYSVLCDRRAHVYVDECAGLAVLSQALVIPAEAANGRHLTLEDVQRAYVPDDGDTHGAPTRVVALENTLHGMCFPLEEMRRICDWAHAQGMLVHLDGARLWNAAAAQPGDAAAYMRRVCALFDSVSLCLSKSVGAPVGSVLVGGRDLIRRARHLQKQQGGGIRQAGFLARMADYCITKNVPGLGDVAARAAAFWRDLHDDLRDHHGMQLHLAHPVETNFFFIDLERSGIEPSSLLEFGAKNDVRLFDGRLAFHFQNVEDSSLAQLKQVFVDLAAYYREHPYVAPAGPQRRY

SEQ ID NO: 1207 - DNA, 1008 bp, Vibrio vulnificus
  CDS (1)..(1008)
atggattttcgttctgacaccgtaactcgccctactcccgccatgcgcgaagccatggctaacgccatcgtcggcgatgatgtttacggtgatgacccaaccgtaaatgaactggaagcctttgccgccaaagaagccggctttgaagcggcgctctttactacttcaggtacgcaagcaaacctgctaggtttgatggcgcattgtgaacgcggtgatgagtatctttgtggccaacaagcgcacaactatcgttacgaggctggcggcgcggcagtattaggttcaatccaacctcaaccggttgagaacaatcccgatggcactttaccgtttgacaagctagccgccgccatcaaacccgatgacagccactttgcgcgcactaagctgcttagccttgaaaataccatcaacggtaaagtgctgcctttgagctatttgcaggaggcgcgtgctttcgtcgataaacacaatctaaaactccatcttgatggtgctcgtgtttataacgcagcaacggcgttggatgttccagtaagagacatcgctcagtattttgattcaatgaccatttgtctttccaaaggattgggcgctccggtgggttctctgctgctgggttctaaagaatacatcgcaaaagcacgacgtttacgcaaaatggtcggtggcggtatgcgccaagcgggtattttagccgcggcaggtaagcttgctttgaccgaacaagtggctcagttgaaagtcgatcatgccaatgccaaagcattggcgcagggtttgtctgagttgccaggtgtgcatgtcaatcctgatttcgtgcaaacaaacattgtgtttgccaaactggatgacaatgtcgacatcaacgcgattgcgcaaaaattggcggaagaatcgatcatcattaccccgggaaatccgattcgttttgtgactcacaaagatatttctcgccaagatattgatctatttctagaaaagttgcgattcttcctcggctaa

SEQ ID NO: 1208 - protein, 335 aa, Vibrio vulnificus
MDFRSDTVTRPTPAMREAMANAIVGDDVYGDDPTVNELEAFAAKEAGFEAALFTTSGTQANLLGLMAHCERGDEYLCGQQAHNYRYEAGGAAVLGSIQPQPVENNPDGTLPFDKLAAAIKPDDSHFARTKLLSLENTINGKVLPLSYLQEARAFVDKHNLKLHLDGARVYNAATALDVPVRDIAQYFDSMTICLSKGLGAPVGSLLLGSKEYIAKARRLRKMVGGGMRQAGILAAAGKLALTEQVAQLKVDHANAKALAQGLSELPGVHVNPDFVQTNIVFAKLDDNVDINAIAQKLAEESIIITPGNPIRFVTHKDISRQDIDLFLEKLRFFLG

SEQ ID NO: 1209 - DNA, 1038 bp, Porphyromonas gingivalis
  CDS (1)..(1038)
atgagcaagatcagcttcaaaaacgactattctgaaggtgcgcatcctgacatactgcatgcgctgacagataccaacttcgttccacaagagggatacggctatgactcctattgcgaggaagcgcgtgcgatgatccgccgtgaatgcaataagcccgatgccgaggtccatttcgtatcgggtgggacacagaccaatctcttggcaatcagtcacctgctccgtccgcacgaagctgtcatagcagcacagtcagggcatatcaacgtacacgaaaccggtgccatcgaatccaccggacataaggtttgcacagtacctactccactcggcaaactcagtgtggagcatatccgcgaagtccttgcttttcatacggacgaacacatggtaaggccgtccatggtctatatctcccaatccacagagttgggcacactctattctcgtcatgagctgtcggatctgtccaccttttgccgtgcaaacggtctcctactctacctcgacggtgcccgtatcggttcggcgatcatggcagagacagaggacaatccgaccctgaccgatatagccaccctgaccgatgcgttctacatcggcggcaccaagaacggagcactccttggagaagccattgtcttccctcgtccacgtccggacgatgctttcctctatcaaatcaaacagcgtggagccatgttggccaaagggcgcgtgctgggtatccagtttgccacgcttttccgcgatgggctttactaccggcttgcagctcatgccaacagaatggcagcagatctggcgacagctatctccttctgcggttattccttcctctaccctccgcaaaccaaccagatcttcccgatcctccccaacgatctgatcgaaagactgaaaaccgtattcgacttctacgtgtggcaagccgtatcacccgacagctcagccattcgtctggtcacttcatgggctactccatcggagaatgtagccgcctttgccgaatacctttccacctctcacatctaa

SEQ ID NO: 1210 - protein, 345 aa, Porphyromonas gingivalis
MSKISFKNDYSEGAHPDILHALTDTNFVPQEGYGYDSYCEEARAMIRRECNKPDAEVHFVSGGTQTNLLAISHLLRPHEAVIAAQSGHINVHETGAIESTGHKVCTVPTPLGKLSVEHIREVLAFHTDEHMVRPSMVYISQSTELGTLYSRHELSDLSTFCRANGLLLYLDGARIGSAIMAETEDNPTLTDIATLTDAFYIGGTKNGALLGEAIVFPRPRPDDAFLYQIKQRGAMLAKGRVLGIQFATLFRDGLYYRLAAHANRMAADLATAISFCGYSFLYPPQTNQIFPILPNDLIERLKTVFDFYVWQAVSPDSSAIRLVTSWATPSENVAAFAEYLSTSHI

SEQ ID NO: 1211 - DNA, 1035 bp, Gloeobacter violaceus
  CDS (1)..(1035)
atgcccgacccggttgtcgatctgcgcagcgacacggtgacccgaccgacccgggcgatgcgcgccgccatgttcgaagccgaagtcggggacgatgtctacggcgaagatccgaccgtcaaccgcctccaggagcgtgtcgcccacctgctcggcaaagaaaaggggctattttttccgagcggcacgatgtgcaaccaggtggccatcgccacccatacccgccccggccaagaaatcatctgtgatcgcgactgccatgtgttcaattacgagcgggccggggcaagccacctgggcggcgtgcaactccatcccctcgacggccgccacggggtcctgagtgcccagcaggtgcgctccgccgtccgccccatcgagttgcacgaaccgcccacgggcttgattctgctcgagaatacccacaaccgcggcggcggcacggtctatccccaggacgtcatcgaacaaatcgccgccgtcgccggcgccgcgggcatccccatgcacctcgacggtgcccggctattgaacgccagcgtcgccggttcccacagtccggcgacgctggcggcaccctttgattcggtctacttttgtctttccaagggcctcgggtgtccggcgggctcggtgctcgccggcaaagccgatttcatcgcccaggcgacacgcctgcgtaaggcctttggcggaggcatgcgccaggtgggttttctggcggctgccggtctgtacgccctcgatcaccacatcgagcgcctcgcggacgatcatcgccgggcacggcagttggccgtccacctaaaagatctcaacgccttcgatgtcgagctcgacgctgtgcacaccaacatcgtgatggtggatgtgcacgcggattgcacggcggcggcggtggcggcggatctgaccgcccacggcgtgcgggtgagtgtctttggtccccggcgtctgcggttggtcacccaccttgatatcgatgacgcgggagtggagcggaccgtcgccgtcttcaagcggctctacggctag

SEQ ID NO: 1212 - protein, 344 aa, Gloeobacter violaceus
MPDPVVDLRSDTVTRPTRAMRAAMFEAEVGDDVYGEDPTVNRLQERVAHLLGKEKGLFFPSGTMCNQVAIATHTRPGQEIICDRDCHVFNYERAGASHLGGVQLHPLDGRHGVLSAQQVRSAVRPIELHEPPTGLILLENTHNRGGGTVYPQDVIEQIAAVAGAAGIPMHLDGARLLNASVAGSHSPATLAAPFDSVYFCLSKGLGCPAGSVLAGKADFIAQATRLRKAFGGGMRQVGFLAAAGLYALDHHIERLADDHRRARQLAVHLKDLNAFDVELDAVHTNIVMVDVHADCTAAAVAADLTAHGVRVSVFGPRRLRLVTHLDIDDAGVERTVAVFKRLYG

SEQ ID NO: 1213 - DNA, 1029 bp, Chromobacterium violaceum
  CDS (1)..(1029)
atgcagtggatagaccttcgcagcgataccgtcacccatccgaccccggcgatgcgccgcgcgatggccgaggccgaagtcggcgacgatgtctacggcgacgaccccaccgtgctgaagctggaggcgctggccgccgacaggctgggcaaggaggcggcgctgctcgtccccagcggcaccttcggcaaccagctggcgctgttcacccactgccgccgcggcgacgaggtgattgtcgaggacaacagccacatcgtctggcacgaggccggcgcggcggcggtgatcgccggcgcccacctgcggacgatagagggcgataacggcctgatggcggtggacgcgatcgagcggcgcatccgcgtcggcgacgacatccacgagcctcgcaccggtctgatctgcctggaaaacgcccatggcaacggccgcgtgctgccgttgtcggcgatggccgacaccgcggcgctggcgcgcgagcacggcgtgccggtgcacctggacggcgcgcgggtgttcaacgccgccgcccatctgggctgcgacgtgcgcgaggtcacccgccacgtcgacagcgtgatggcctgcctgtccaagggcctggccgcgccgatcggctccatcctggccggttccgccgatttcatcgatcaggcgcgccgcaagcgcaagctgctgggcggcggcctgcgccaggccggcgtgatcgccgcgcccggcatcctggcgctgaccgagatggccgcgcgtctggacgaggaccaccgcaatgcccgctacctggccgagggcctggccaagctgccgtgcgtggacttgaatccggccgatgtccacatcaacctggtgtggttccgcttcaacgccgacatcgacgccgctgaactgatggccgcgctgaagcaggccggcttcctcgccaatccgccgcatcagggcgcgatgcgcctggtgacccactggcaggtaggccgcgccgacatcgaccgcctgttggaggtgatgcagcgcgtgctctgcgactga

SEQ ID NO: 1214 - protein, 342 aa, Chromobacterium violaceum
MQWIDLRSDTVTHPTPAMRRAMAEAEVGDDVYGDDPTVLKLEALAADRLGKEAALLVPSGTFGNQLALFTHCRRGDEVIVEDNSHIVWHEAGAAAVIAGAHLRTIEGDNGLMAVDAIERRIRVGDDIHEPRTGLICLENAHGNGRVLPLSAMADTAALAREHGVPVHLDGARVFNAAAHLGCDVREVTRHVDSVMACLSKGLAAPIGSILAGSADFIDQARRKRKLLGGGLRQAGVIAAPGILALTEMAARLDEDHRNARYLAEGLAKLPCVDLNPADVHINLVWFRFNADIDAAELMAALKQAGFLANPPHQGAMRLVTHWQVGRADIDRLLEVMQRVLCD

SEQ ID NO: 1215 - DNA, 1047 bp, Fusobacterium nucleatum subsp
  CDS (1)..(1047)
atgagtataaggaggaaaattattatgttaaattttaaaaatgattatagtgaaggagcttgttcagaagtattagaagcacttgttaaaacaaattatgaacaaactgttggttatggagaagatgaatattgtgaagaagctagaaatttaattaaagaaaatattaattattctaatgcagatatttattttttagttggagggacacaggcaaatacaacagttatttctcactctttaaaaccttatgaagctgttattgcttgtaaaacaggtcatatatctatacatgaaacaggagctattgaagcaacaggacataaaataattgaagtagatggaattgatggaaaattaactcctgatttaattttaaatgaattaagaaaacatgaagatcatcatatggtaaaaccaaaaatggtttatatttcaaataccactgaaataggaactgtctacactaaaagtgaattagaaaatattagtaaagtttgtaaggataataatttatacttatatttagatggtgcaagacttgcatctgcacttacctctgaaaaatgtgatataaatttagaagattatccaaaatattgtgatgttttctatattggaggaacaaaatgtggcttattgtttggtgaagcagttgtaattataaatgatgaaataaaaaaagaatttcaattctctgttaaacaaaaaggtggattatttgcaaaaggaagattattaggagtacagtttgcaactttatttaaagatgatttatactatagaataggtgttcattcaaataaaatggcattaaagataaaaaatgcttttgcagaaaagggtattaagttagctactgattcttatactaatcaagtttttgtagatttaagtcaagaacaaataaaaaaattagaaaaagatgttgttttttcagtagaattttttggaataggagaaaatcaatcatcaagatttgtaacttcttgggcaactaaggaagaagatgttaataaacttgtggaactgataaaaaatctttaa

SEQ ID NO: 1216 - protein, 348 aa, Fusobacterium nucleatum subsp
MSIRRKIIMLNFKNDYSEGACSEVLEALVKTNYEQTVGYGEDEYCEEARNLIKENINYSNADIYFLVGGTQANTTVISHSLKPYEAVIACKTGHISIHETGAIEATGHKIIEVDGIDGKLTPDLILNELRKHEDHHMVKPKMVYISNTTEIGTVYTKSELENISKVCKDNNLYLYLDGARLASALTSEKCDINLEDYPKYCDVFYIGGTKCGLLFGEAVVIINDEIKKEFQFSVKQKGGLFAKGRLLGVQFATLFKDDLYYRIGVHSNKMALKIKNAFAEKGIKLATDSYTNQVFVDLSQEQIKKLEKDVVFSVEFFGIGENQSSRFVTSWATKEEDVNKLVELIKNL

SEQ ID NO: 1217 - DNA, 1083 bp, Neurospora crassa
  CDS (1)..(1083)
atgacaactcccacggcgtccatgcttgccgctatccagtcctgctctctgctcgacgatgtcatgcaagaagatcccaccaccagcgaccttgaggcccactgcgctgctttgtgcggcaaggaggccggcctcctcgttttgtcaggcaccatgggcaatcagctagctatgaggtccttgctcacccaaccgcctcacggtgtgctctgcgatgcccgctgccacattgtaaaatatgaggctggaggtgtctcatctctaacgggcgccatgctcaagcctgtcatgcctagcaacggcgtctaccttaccctcgaagacgtcaaggccaacattcatctcgatgacgacgtgcacacttgcccgactcgcgttctcgagctcgagaacacactcaatggcatgatcatgccgctctccgaggtgcgccgcatctccgcctttgctcgcgagcatgggatcaagatgcactgcgacggcgcgcgcttgtgggaggcggtggcctctggtgctggaagccttgccgaatttgcaaagtgctttgacacaatcagcctatgcttctccaagggccttggagcacccattggcagcatgctggtaggccccaaggacgtgatcaagcatgcccggtgggtaagaaagtcgattggcggtggactaagacagtcgggcgtcgtggcggctgctgcgagggttgccgttgacgaaacgtttggcaaggggcccagtggcgaaggcggcaagttgaagggagcgcatattttggccaaggagatcgagaggatatggacgggcttgggcggcaagcttcttcatcctgttgacaccaacatggtgtggctcgatttgaacgatgcgaagtgttcggcggagaggatgaatgagctcggcaaagaatcgggactcaagttatgggcacctcgcttggtcatcagctaccaggtttttgaaaaccgtgaccatgtaatacccaagctggagagcatcttcgagacgatcatgcaggagaagacaacaaagacgggagaaggttttcagaaggctgatggagagatatcgcaatatcggagcaaatag

SEQ ID NO: 1218 - protein, 360 aa, Neurospora crassa
MTTPTASMLAAIQSCSLLDDVMQEDPTTSDLEAHCAALCGKEAGLLVLSGTMGNQLAMRSLLTQPPHGVLCDARCHIVKYEAGGVSSLTGAMLKPVMPSNGVYLTLEDVKANIHLDDDVHTCPTRVLELENTLNGMIMPLSEVRRISAFAREHGIKMHCDGARLWEAVASGAGSLAEFAKCFDTISLCFSKGLGAPIGSMLVGPKDVIKHARWVRKSIGGGLRQSGVVAAAARVAVDETFGKGPSGEGGKLKGAHILAKEIERIWTGLGGKLLHPVDTNMVWLDLNDAKCSAERMNELGKESGLKLWAPRLVISYQVFENRDHVIPKLESIFETIMQEKTTKTGEGFQKADGEISQYRSK

SEQ ID NO: 1219 - DNA, 1020 bp, Bordetella pertussis
  CDS (1)..(1020)
atgatcgatctgcgcagcgataccgtgacccgtcccagcgccgccatgcggcaggccatggcggccgcgccggtgggtgacgatgtgatgggcgatgaccccagcgtacggcgcctgcaggacgaggttgccgcgcgggcgggcaaggaggccgggctgttcttcccgtcgggcacgcagagcaacctggccgcgctgatggcgcattgcgcccgcggcgacgagtatctggtggggcagcaggcccatacgtacaaattcgagggaggcggcgctgcggtgctgggcagcatccagccgcagcccgtcgaccatgccgccgacggcagcctgccgctggacaggctggcggccgcgctcaagccgggcggcgatccgcatttcgcccgtacccggctgttggcgctggaaaacaccttccagggccgggtcatgcccgccggctatgtcgcgcaggccacgggctgggcccgcgagcatggcctgtccacccatctggacggcgcgcgcgtcttcaatgcggccgtggccagcggcgtgccggtgcaacagctgtgcgagccgttcgatacggtttcgatctgtttttccaaggggctgggcgcgccggtcggatcggtgctggtcggcagccgcgccctgatcgagcaggcgcatcgctggcgcaagatgctgggcggcggcatgcggcaggccggcatactggctgccgcctgcctgcacgcgctgcaccaccacgtcgagcgcctggcgctagaccacgacaacgcggcgcggctggccgcgggcctggacggcatcgacggcgtgcgcgtgctggggcagcacaccaacatggtgttcgccgagttcgatccggcccggtgcgaatcgctgaccacggcgctgcgcgggcagggcattctgatgcgggcggtctatggcgggccgacccgcctggtgacgcacctggacgtggacgccgacggcatcgatcgcgtcgtcgacgcggtacgcgggcattgcgcggccgcgcgctga

SEQ ID NO: 1220 - protein, 339 aa, Bordetella pertussis
MIDLRSDTVTRPSAAMRQAMAAAPVGDDVMGDDPSVRRLQDEVAARAGKEAGLFFPSGTQSNLAALMAHCARGDEYLVGQQAHTYKFEGGGAAVLGSIQPQPVDHAADGSLPLDRLAAALKPGGDPHFARTRLLALENTFQGRVMPAGYVAQATGWAREHGLSTHLDGARVFNAAVASGVPVQQLCEPFDTVSICFSKGLGAPVGSVLVGSRALIEQAHRWRKMLGGGMRQAGILAAACLHALHHHVERLALDHDNAARLAAGLDGIDGVRVLGQHTNMVFAEFDPARCESLTTALRGQGILMRAVYGGPTRLVTHLDVDADGIDRVVDAVRGHCAAAR

SEQ ID NO: 1221 - DNA, 1376 bp, Oryza sativa
  CDS (115)..(1233)
ctgctgcggaccgcgcctcatcgcgtcccgtctccacccgcgcctctcctctcgtcccgcgcctcggccgccgtctgattccgtgcagttggaggctaggaggagctcctcaaaatggtgaccaacgtggtggacctacggtcggacacggtgacgaagccctccgacgcgatgcgcgccgccatggccgccgcggacgtggacgacgacgtccttggcgccgacccgaccgcgcaccgcttcgagatggagatggcgaggatcacgggcaaggaggccgcgctgttcgtgccgtccggcaccatggccaacctcatctccgtcctcgtccactgcgacaccaggggcagcgaggtcatcctcggcgacaactcccacatccatatctacgagaacggcgggatctccaccatcggcggcgtccaccccaagaccgtcaggaacaaccccgatggaaccatggacatcgacaagattgtcgtcgccatcaggcatccggatggggcgctgtattatccgaccacaaggctgatctgcctggagaatacccatgcaaactgtggtggaaagtgtctgtctgctgaatatactgacgaggttggtgaagttgccaagagtcatggtctgaagcttcacatagatggagctcgcatttttaatgcttctgtggcccttggagttcctgttcatcgacttgtgaaagctgcggattcagtctcggtgtgcatatctaaagggttaggcgctcctgttggatcagttattgttggttcgacggccttcatagaaaaggctaaaattcttaggaagacactaggtggtggaatgaggcaagtgggaattctttgtgcggctgcctatgttgccgttcgcgacactgtaggaaaacttgctgatgaccatagaagggctaaagttttagcagatggtctgaagaaaatcaagcattttagagttgatacaacttcagtggagaccaatatggtattctttgatattgtggattcacgcatatcacctgacaaactgtgtcaagtccttgaacaacgcaatgtgcttgccatgccagcaggctcgaagagcatgaggcttgtcatccactaccaaatttctgatagtgatgttcagtatgcactgacatgcgtggagaaagctgctgaagaaatactgacaggcagtaagaagtttgaacatctgacaaacggtactaccaggaattcatacgggcactagtagatcactcctttcgtgcccactgatgcatcagtccagcgtccagcttgcttgtcatctcatgactgatgtactcacaacttggcttaataataactgatgttcactctgttggaaaaaaaaaaaaaaaaaaaaaaaaaaaa

SEQ ID NO: 1222 - protein, 372 aa, Oryza sativa
MVTNVVDLRSDTVTKPSDAMRAAMAAADVDDDVLGADPTAHRFEMEMARITGKEAALFVPSGTMANLISVLVHCDTRGSEVILGDNSHIHIYENGGISTIGGVHPKTVRNNPDGTMDIDKIVVAIRHPDGALYYPTTRLICLENTHANCGGKCLSAEYTDEVGEVAKSHGLKLHIDGARIFNASVALGVPVHRLVKAADSVSVCISKGLGAPVGSVIVGSTAFIEKAKILRKTLGGGMRQVGILCAAAYVAVRDTVGKLADDHRRAKVLADGLKKIKHFRVDTTSVETNMVFFDIVDSRISPDKLCQVLEQRNVLAMPAGSKSMRLVIHYQISDSDVQYALTCVEKAAEEILTGSKKFEHLTNGTTRNSYGH

SEQ ID NO: 1223 - DNA, 1242 bp, Streptomyces avermitilis
  CDS (1)..(1242)
atgagcgatacggcggagcagggcgaggaacgggcggcggagcgggccggggaggcgtcggcggaggggaccggggagacatctgcggaggggaccggggaggcgtcggctcagctgcggcgcgcgcggcggacggcggcctaccggggggcccggcgcgtcctgtcgcgccccgggttccgggccaccatcagggagcggctggcgctcctggaggacgcgtcgcggctgtacgacctggacgagtccgtggacatgtacggggacgggatcgtcgcggccctggaggagcgggtcgccgggctgctgggcatggaggccgcggcgttcttccccaccgggacgatggcccagcaggtggccctgcgctgctgggcgggtcgtaccggcaacccgaccgtggcgctgcacgcgctgagccaccccgaagtgcacgaacggaacgcgctcggcacggtcggcggactgcgcccggtccgcgtgacggacgagccccggctgccgaccgccgacgaggtgcgcgacttcgaggagcccttcggggccctcatgctcgaactgcccctgcgggacgtcggctacgtcctgccctcctgggaggagctgtccgaggtcgtggcggccgcccgggaacgtgacgcggtggtccacttcgacggcgcacgcctgtgggagtgcacaccccacttcagccgccccctggacgagatcgcgggcctcgcggacagcgtctacgtgtcgttctacaaatcgctcggcgggttcagcggcgcggcactggccggcccgaaaaccctggtcgacgaggcgaagacctggcggcaccggtacggcggcatggtcgtccaacagttcccggcggtgctgtccgcgctggccgggctggaggaggagctgccccggctgccggagtacgtggcgcacgcgcgcgtggtcgccgcggcgctgcgcgaggggttcgcggcggcgggggtgccctggctgcgcgtgcaccccgaggagccgcacacccatgagttccagctctggctgccgtacgaccccgaggtggtgacggaagccgccacgcggcaggccgaggagaccgggaccttcctgttcgccaacgcctggacccgcggcgggccgggcctggcggtcaccgaggtctccgtacgggcgcacggccttcagtggacggccgaagacgtcaaggcggccgtccaggagttcgtgacgcgcctgcccggcgctgccgggtag

SEQ ID NO: 1224 - protein, 413 aa, Streptomyces avermitilis
MSDTAEQGEERAAERAGEASAEGTGETSAEGTGEASAQLRRARRTAAYRGARRVLSRPGFRATIRERLALLEDASRLYDLDESVDMYGDGIVAALEERVAGLLGMEAAAFFPTGTMAQQVALRCWAGRTGNPTVALHALSHPEVHERNALGTVGGLRPVRVTDEPRLPTADEVRDFEEPFGALMLELPLRDVGYVLPSWEELSEVVAAARERDAVVHFDGARLWECTPHFSRPLDEIAGLADSVYVSFYKSLGGFSGAALAGPKTLVDEAKTWRHRYGGMVVQQFPAVLSALAGLEEELPRLPEYVAHARVVAAALREGFAAAGVPWLRVHPEEPHTHEFQLWLPYDPEVVTEAATRQAEETGTFLFANAWTRGGPGLAVTEVSVRAHGLQWTAEDVKAAVQEFVTRLPGAAG

SEQ ID NO: 1225 - DNA, 1071 bp, Streptomyces avermitilis
  CDS (1)..(1071)
atgaaccctcctaagaccgacgcccggcggcatcacgacccggaggtacgtggcttcgccagcgacaactacgcgggggcccaccccgaggtgctcgccgccctggccctggccaacggcgggcaccagatcgcgtacggcgaggacgagtacacggacaacctccagcgcatcgtccgcagccacttcggcgccggcgccgaggcgttccccgtcttcaacggcaccggcgcaaacgtcgtcgccctccaggcggtcaccgaccgctggggcgcggtgatctgcgcggagagcgcgcacatcaacgtggacgagggcggcgcccccgagcgcatgggcggcctcaaactcctcaccgtgcccacgcccgacggcaagctcacgcccgagctgatcgaccggcaggcgtacggctgggacgacgagcaccgtgcgatgccgcaggtcgtctcgatcgcccagaacaccgaactgggcaccgtctacacgcccgacgagatccgcgcgatctgcgaccacgcccacgggcacggcatgaaggtgcacctcgacggcgcccggatagccaacgcggccgcctcgctgaacgtccccatgcggacgttcaccaacgcggtcggcgtcgacatcctctccctgggcgggacgaagaacggcgcgctgttcggcgaggccgtcgtggtcatcaaccaggacgccgtcagccacatgaagcacctgcgcaagctgtccatgcagctggcctcgaagatgcgtttcgtctcggtgcagctggaggcgctgctcgccaaggatctgtggctgcgcaacgcccggcacgccaacgagatggcccagcggctcgcggagggcgtgcgcgcggtccacggcgtggagatcctctacccggtgcaggccaacgcggtcttcgcgcgtctcccgcacgacgtgagtgagcgcctgcagaagcactaccgcttctacttctggaacgaggccgcgggcgacgtccgctggatgtgcgccttcgacacgaccgaggacgacgtcgacggattcgtggcggcgctcaaggaggagatggcccggtag

SEQ ID NO: 1226 - protein, 356 aa, Streptomyces avermitilis
MNPPKTDARRHHDPEVRGFASDNYAGAHPEVLAALALANGGHQIAYGEDEYTDNLQRIVRSHFGAGAEAFPVFNGTGANVVALQAVTDRWGAVICAESAHINVDEGGAPERMGGLKLLTVPTPDGKLTPELIDRQAYGWDDEHRAMPQVVSIAQNTELGTVYTPDEIRAICDHAHGHGMKVHLDGARIANAAASLNVPMRTFTNAVGVDILSLGGTKNGALFGEAVVVINQDAVSHMKHLRKLSMQLASKMRFVSVQLEALLAKDLWLRNARHANEMAQRLAEGVRAVHGVEILYPVQANAVFARLPHDVSERLQKHYRFYFWNEAAGDVRWMCAFDTTEDDVDGFVAALKEEMAR

SEQ ID NO: 1227 - DNA, 1005 bp, Vibrio parahaemolyticus
  CDS (1)..(1005)
atggattttcgttcagacacagtgactcaacccacccaagctatgcgcgaagtaatgttcagcgcccctgttggcgatgatgtttatggtgacgatcctaccgtaaacgagctagagcaattcgcggctgaattagcagggtttgaggcagcgttgtttaccacttctggcacacaagcaaaccttttaggattaatggcgcactgtgagcgtggcgatgaatatttatgcggccagcaagcgcacaattacaaatatgaagcaggtggcgcagcggtactgggttctatccagcctcaaccaatagaaaacaatccagatggcacgttgccatttgacaaattagaggcggcaattaaacctgatgacgcgcactttgctcgtactcgtctgctaagtttagaaaacaccatcaacggtaaagtgatcccactgtcttacttagcggaagctcgtgaattcgttaataaacacaatctgaaactgcatctcgacggtgcccgtgtgtttaacgcagctgttgcgctcgatgttcccgtcaaagatattggtcagtactttgattccatgacgatttgtttatcgaaaggtcttgcggcacccgttggttcactgctgcttggcagcaaggaatacatcgcgaaagctcgccgtttaagaaagatggtcggtggcggaatgcgtcaggcaggtattctagcggcagcaggtaaactggcgatcactgaacaagtcgcgcagttaaagcaagatcacatcaatgcaaaagcattggcggaaggtttagctgaactaccgggtttctcggtaaatcctgacttcgttcaaaccaacattgtgtttgctaagttggatgctaaagtcgatatccaaagcatcgcggaacaactcaagcaacaaaacatcatcatcagcccaggaaacccaattcgctttgtcacacacaaagacatctctgctgaagatattcaaaccttcctatcgagccttaaatctctgctttag

SEQ ID NO: 1228 - protein, 334 aa, Vibrio parahaemolyticus
MDFRSDTVTQPTQAMREVMFSAPVGDDVYGDDPTVNELEQFAAELAGFEAALFTTSGTQANLLGLMAHCERGDEYLCGQQAHNYKYEAGGAAVLGSIQPQPIENNPDGTLPFDKLEAAIKPDDAHFARTRLLSLENTINGKVIPLSYLAEAREFVNKHNLKLHLDGARVFNAAVALDVPVKDIGQYFDSMTICLSKGLAAPVGSLLLGSKEYIAKARRLRKMVGGGMRQAGILAAAGKLAITEQVAQLKQDHINAKALAEGLAELPGFSVNPDFVQTNIVFAKLDAKVDIQSIAEQLKQQNIIISPGNPIRFVTHKDISAEDIQTFLSSLKSLL

SEQ ID NO: 1229 - DNA, 1077 bp, Vibrio parahaemolyticus
  CDS (1)..(1077)
atgagtacccacctaaaacagctttgtcatacccacctcccaggtaataaagaagactctccagccgagcactttgcaaaaatggcaaagtggtgtgaagagaacaaagtgaatcacgatgtctatggcgagggagaaacgattcacgcattcgagcaaaaggttgccgatctgctgggttacgaggcgggcctttttgttgtcactgggacgatgacacagccaacggtgctagaaatcgtcacaagacaaaagcgtaatcctattgttgcgatgcatgcatctagccatatacctgaacatgaaaagcaaggctatcagcttcaacatcgctttagtgttttgccagtagggaacgtttaccaaacgtggaagcttgaggatctcactgcgtggccggatgaaatcgcagccgttttgtatgaactcccgatgcgagaaattggcggtcagttaccttcatggcaagaactggaagaaatcaaagcttactgcgccgaaaaagacattcatctccacatggagggtgcaaggctttgggaaaccgcagcgtattatcagaaagaataccgcgagatcgccgctggttttgatacgacgtatgtatcactctataaaggcattaacggcatgggcggatctatgctgcttggttcaaaggcgttcattgaactggcctcaatgtggatgaagcgacaaggtggcaacctgtaccacagaacaccttatgtagtgtctgcggcaatgcagttcgatgaaaggttggcgcagctaccggatctgtttgagcgaacaaaacaaatctacaagatcattgatgagttcccatctttggcggtaagaccaacccaaccgcaagcaaacatgttgcaccttatcctgcctttcagctgtgaaaagttgaaagaactccaacatattttcgctacagaaaagggcatttggtttggtaatccgcaagtcacggcacatccacatcaatccatcgttgagtggtatgtcggtgactacctgctcaaccttggtgacgaagaattaaggtcatttttcaaccagttactcggtggtaaggcataa

SEQ ID NO: 1230 - protein, 358 aa, Vibrio parahaemolyticus
MSTHLKQLCHTHLPGNKEDSPAEHFAKMAKWCEENKVNHDVYGEGETIHAFEQKVADLLGYEAGLFVVTGTMTQPTVLEIVTRQKRNPIVAMHASSHIPEHEKQGYQLQHRFSVLPVGNVYQTWKLEDLTAWPDEIAAVLYELPMREIGGQLPSWQELEEIKAYCAEKDIHLHMEGARLWETAAYYQKEYREIAAGFDTTYVSLYKGINGMGGSMLLGSKAFIELASMWMKRQGGNLYHRTPYVVSAAMQFDERLAQLPDLFERTKQIYKIIDEFPSLAVRPTQPQANMLHLILPFSCEKLKELQHIFATEKGIWFGNPQVTAHPHQSIVEWYVGDYLLNLGDEELRSFFNQLLGGKA

SEQ ID NO: 1231 - DNA, 1005 bp, Pseudomonas syringae
  CDS (1)..(1005)
atgacggtcatcgatctgcgcagcgacacagtgactctgcccaccgcaggcatgcttgacgccatggcacatgcgccggtgggcgatgatgtctacggtgaagaccctacggtcaatctgctcgaggccacgctcgccgagcgcctcgggttcgacgccgccttgttcgtgccctccggcaccatgagcaatctgctggcgttgatggcgcactgtgagcggggcgatgaatacatcgtcggtcagcaggcccacacctataaatacgaagggggtggcgcggcggtactgggctcgattcagcctcagccgctggacgtgcaggcggacggttcgctgagcctgcaacaggtgctcgacaccatcaagccggacgacttccactttgcccgcacacgcctgctggccctggaaaacaccatgcagggcaaggtgctgccgcttgagtacctggccgccgcgcgcaagctgaccctggaaaaaggcctcgcgctgcacctcgacggcgcgcggctgtacaacgcggcggtcaagctgggcgttgatgcccgggagatcacccggcacttcgattcagtctccatctgcctatccaaaggcctgggcgcccccattggctcggtgctgtgcggctcgcagccgctgatggtcaaggcgcggcgtctgcgcaagatgctcggcgggggcatgcgtcaggcaggcgggctggccgctgccgggctctatgcgctggatcatcaggtccagcggctggccgacgatcatgccaatgcggcgtttctggccgagagcttgagcgggctgggttacagtgtcgagcctgtgcagaccaacatggtctatgtgcagatcggtgatcgcgccgcagcgctcaaggcattctgcgccgagcgtggcatcgtgctcactgccgcgtcgcggctgcgcatggtcactcacctgaatgtttcgcgtgctcaggcagagcaagtgatcgcggcattcgcagcctttgaacacccatga

SEQ ID NO: 1232 - protein, 334 aa, Pseudomonas syringae
MTVIDLRSDTVTLPTAGMLDAMAHAPVGDDVYGEDPTVNLLEATLAERLGFDAALFVPSGTMSNLLALMAHCERGDEYIVGQQAHTYKYEGGGAAVLGSIQPQPLDVQADGSLSLQQVLDTIKPDDFHFARTRLLALENTMQGKVLPLEYLAAARKLTLEKGLALHLDGARLYNAAVKLGVDAREITRHFDSVSICLSKGLGAPIGSVLCGSQPLMVKARRLRKMLGGGMRQAGGLAAAGLYALDHQVQRLADDHANAAFLAESLSGLGYSVEPVQTNMVYVQIGDRAAALKAFCAERGIVLTAASRLRMVTHLNVSRAQAEQVIAAFAAFEHP

SEQ ID NO: 1233 - DNA, 1041 bp, Pseudomonas syringae
  CDS (1)..(1041)
atgacagaccaaagccaacagttcgccagtgacaactactccggtatctgccctgaagcgtgggccgcgatggagcaggcgaacaaaggccatcaacgtgcctatggggacgatcaatggactgcgcgcgcctcggatgatttccgccgtttgtttgaaaccgactgcgaagtgttttttgctttcaacggcacagcggccaactcgctggcgctgtcctcgctgtgccagagttaccacagtgtcatctgttcggaaacggctcacgtcgaaaccgatgaatgcggcgcgccggaatttttctccaacggctccaagctgctgaccgcccgcagcccgggcggcaagctgaccccggaatcgattcgtgaagtggcgctcaagcgtcaggacattcactaccccaagccgcgcgttgtaaccctgacccaggccacggaagtgggcggcgtctatcagccagaagagctcaaggccatcagcgccacctgcaaggaactgggcctgcacctgcacatggacggtgcgcgcttctccaatgcctgcgcgtttctggatgcatcgccggccgagctgacctggaagtccggcgttgatgtgctgtgctttggcggcaccaaaaacggcatggcggtgggcgaggcgatcctgtttttcgaccacgatctggccgtcgatttcgattatcgctgcaagcaagccgggcaactggcgtcgaaaatgcgcttcctgtccgcgccctgggttggcctgctggaaaacgacgcgtggctcaaacatgctcgccacgccaaccggtgcgcacagttgctggctgatctggtcaaggacattgccggcgtcgaactgatgttcccggtgcaggccaatggcgtgtttctgcaactgtcggagcctgccatcgcagccttgaccgccaggggctggcgcttctacaccttcatcggcaatggcggcgcgcgcttcatgtgctcgtgggataccgaagaagaccgcgtgcgtgaactcgccgcggacatccgcctggtgatgcagggctga

SEQ ID NO: 1234 - protein, 346 aa, Pseudomonas syringae
MTDQSQQFASDNYSGICPEAWAAMEQANKGHQRAYGDDQWTARASDDFRRLFETDCEVFFAFNGTAANSLALSSLCQSYHSVICSETAHVETDECGAPEFFSNGSKLLTARSPGGKLTPESIREVALKRQDIHYPKPRVVTLTQATEVGGVYQPEELKAISATCKELGLHLHMDGARFSNACAFLDASPAELTWKSGVDVLCFGGTKNGMAVGEAILFFDHDLAVDFDYRCKQAGQLASKMRFLSAPWVGLLENDAWLKHARHANRCAQLLADLVKDIAGVELMFPVQANGVFLQLSEPAIAALTARGWRFYTFIGNGGARFMCSWDTEEDRVRELAADIRLVMQG

SEQ ID NO: 1235 - DNA, 1041 bp, Pseudomonas putida
  CDS (1)..(1041)
atgacagacaagagccaacaattcgccagcgacaactattccggtatctgccccgaagcctgggtggcgatggagaaagccaaccgcggccacgaccgcgcctacggcgacgaccagtggaccgagcgtgcatcggagtacttccgcaatctgttcgaaaccgactgcgaggtgttctttgccttcaacggcaccgcggccaactccctggccctggcatccctgtgccagagctatcacagcgtgatctgctccgagaccgcccacgtcgaaaccgacgaatgcggtgcaccggagtttttctccaacggctccaagctgctgacggcggccagcgtcaacggcaagctgacgccacagtcgatccgcgaagtggcgctcaaacgccaggatatccactaccccaagccgcgcgtggtgaccattacccaggccaccgaagtgggcacggtgtaccgccccgacgagctgaaggcgatcagcgccacctgcaaggagctgggcctgaacctgcacatggacggcgcacgctttaccaatgcctgtgcgttcctgggctgcagcccggccgaactgacctggaaggccggtgtggatgtgctgtgctttggcggcaccaagaacggcatggcggtgggcgaagcgattctgttcttcaaccgccagctggccgaagacttcgattatcgctgcaagcaggccgggcaactggcgtcgaagatgcgcttcttgtcggcgccctgggtcgggctgctggaagatggcgcatggttacgccatggcaaccacgccaatcattgcgcgcaactgctggcatcgctggtcagtgacctgccgggggtagagctgatgttcccggtggaggccaacggggtgttcctgcagatgccagagcacgccatcgaggcgctgcggggcaagggctggcgcttctatacctttatcggcagcggtggcgcgcgcttcatgtgctcgtgggataccgaagaagcgcgggtgcgtgagctggcggcggatatccgcacgatcattggtggctga

SEQ ID NO: 1236 - protein, 346 aa, Pseudomonas putida
MTDKSQQFASDNYSGICPEAWVAMEKANRGHDRAYGDDQWTERASEYFRNLFETDCEVFFAFNGTAANSLALASLCQSYHSVICSETAHVETDECGAPEFFSNGSKLLTAASVNGKLTPQSIREVALKRQDIHYPKPRVVTITQATEVGTVYRPDELKAISATCKELGLNLHMDGARFTNACAFLGCSPAELTWKAGVDVLCFGGTKNGMAVGEAILFFNRQLAEDFDYRCKQAGQLASKMRFLSAPWVGLLEDGAWLRHGNHANHCAQLLASLVSDLPGVELMFPVEANGVFLQMPEHAIEALRGKGWRFYTFIGSGGARFMCSWDTEEARVRELAADIRTIIGG

SEQ ID NO: 1237 - DNA, 1026 bp, Clostridium tetani
  CDS (1)..(1026)
atggattttttagatttgagaagtgataccgtaacaaaaccaacagaaaatatgagaaaagctatgtttaaagctaatgttggtgatgatgtatatggtgatgaccctacagtaaatgaactagaagagtatgctgctaatttggtggggaaagaaacagccttatttgttccaagtggagtttttggtaatcaactgtccctttttactcattgcaaaagaggtgatgaagttattttaggagaggattgtcatataataatgcatgaaacgggagcacctgctgttatagctggtgtacaattaagacctataaaaagcgaaaatggattcatgtcattagatgatatacaaagtaaaattagaggtgaaaatattcatttccctgatacttctcttatatgcgtggaaaatgctcattcctgtggaagagttatctctttgaaacatatggagaaaatatataatatatcaaggcaacataatataccaatacatttagatggagctaggctatttaatgcagctgcatatttagatgtaggtgttaaagacataaccaaatactgtgattctgtaatgttttccatttctaaaggactttgtgctcctgttggatcaatacttgcaggtagcaaggattttattaaaaaagctagaaagaaaagaaaactcatgggtggcggcttaagacaagcaggggtgttagcagcacctggactagtagctttaaaggaaatgattcctcaattaaaaaaagactatgaaaatgcattattattaggaaaagaattaagtaaaataccaaatataaaagtaaatttagatgatataaatattaacatggtatttttttctatagaaaatatagattatgatgaagtagatataataaataaattttatagtaagggtataaaaattaatggtaccgaagacggtaaatttagatttgccacacattattggattaaagaagaggatatttcatatataatagaaaccatgaaaatttctctgcaataa

SEQ ID NO: 1238 - protein, 341 aa, Clostridium tetani
MDFLDLRSDTVTKPTENMRKAMFKANVGDDVYGDDPTVNELEEYAANLVGKETALFVPSGVFGNQLSLFTHCKRGDEVILGEDCHIIMHETGAPAVIAGVQLRPIKSENGFMSLDDIQSKIRGENIHFPDTSLICVENAHSCGRVISLKHMEKIYNISRQHNIPIHLDGARLFNAAAYLDVGVKDITKYCDSVMFSISKGLCAPVGSILAGSKDFIKKARKKRKLMGGGLRQAGVLAAPGLVALKEMIPQLKKDYENALLLGKELSKIPNIKVNLDDININMVFFSIENIDYDEVDIINKFYSKGIKINGTEDGKFRFATHYWIKEEDISYIIETMKISLQ

SEQ ID NO: 1239 - DNA, 1083 bp, Bradyrhizobium japonicum
  CDS (1)..(1083)
atgacgagaccagccatgctctacaccccgcccccgatcgatcccaaggcgccgccggtgcgcatcaatctgctgtcggacacccagaccaagccgacggctgcgatgcgcgaggcgatggcgcgcgccgaggtcggcgacgagcaggtcggcgacgatccgaccgtgaacgcgctgtgcgagcgcgttgcggatctgctcggcaaggaggccgccgtgtacatgccctcgggcacgatgtgcaacgtcaccgcgacgctggtgcattgccggcccggcgacgagattctcgcgcacgagaccgcgcacatcatcgcccgtgagggcggcgcgcatgccgcgatcggcggcttccaggttacgcagctcaagggccccgacggccagttcacgccggagacgttccggaaagctctgcacccgcgcacgcgctaccagccgccgcagaccgtcgtcagcgtcgagcagaccgccaatatcggcggcggcacgatctggaagaaggccgcactcgacgagatcgtcgagatcgccaggcagcacggcctcgtcacccacatggacggcgcgcggctgctcaacgccacggtggcgagcggcatctctccgcgcgacatgaccgctggctgggattcggcctggatcgacttctccaagggcctgggcgcgccgatcggcggcgtgctcgccggctcgcgcgccttcatcgacgcggtctggcagtggaagcagcgcctcggcggctcgatgcggcaggccggaatctgcgccgccgcctgcatctacgccctcgaccatcacgtcgatcgccttgccgacgatcatgcccatgcgcgcgcactcgcccgcggactgtcgcagatcgcaggcatcgaggtgcaggagcccgagaccaacctcgtgttcttcaagcccgatggcgccggcgtccccggcgacaagatggtcgccgcactgcgccagcgcggcgtgacgctcgcgatgatggacggccgcatccgcgcctgcacgcatctcgacgtcaatgcgagccagatcgaggaaacgatcggatacgtgcgcgagatcgtgcgcggggcgtaa

SEQ ID NO: 1240 - protein, 360 aa, Bradyrhizobium japonicum
MTRPAMLYTPPPIDPKAPPVRINLLSDTQTKPTAAMREAMARAEVGDEQVGDDPTVNALCERVADLLGKEAAVYMPSGTMCNVTATLVHCRPGDEILAHETAHIIAREGGAHAAIGGFQVTQLKGPDGQFTPETFRKALHPRTRYQPPQTVVSVEQTANIGGGTIWKKAALDEIVEIARQHGLVTHMDGARLLNATVASGISPRDMTAGWDSAWIDFSKGLGAPIGGVLAGSRAFIDAVWQWKQRLGGSMRQAGICAAACIYALDHHVDRLADDHAHARALARGLSQIAGIEVQEPETNLVFFKPDGAGVPGDKMVAALRQRGVTLAMMDGRIRACTHLDVNASQIEETIGYVREIVRGA

SEQ ID NO: 1241 - DNA, 1044 bp, Bradyrhizobium japonicum
  CDS (1)..(1044)
atggtcgcgcaagagagaggccgcgacggcgtcgtcgatctgcgcagcgacaccgtcacgctgccgacggccgcgatgctggagcgcatgcagcgggccccgctcggcgacgacggccgcgagggcgacccgaccgtccgcgcgctcgaagcgcggggcgccgcgttgaccggcaaggaagctgccctgttcgtgccgagcggcacgatgggcaatctcctggcgatgctcgcccatgccgagcgcggcggagaggtcttcgccgacgctggtgcgcacctgctcaactccgagctcggcagcgtcgtgacgatcgcggggctggtgcccaagcccatgccgagccgtcgcggtgcaatggacgaagcggcgcttgcagacgcgatccgcggctcggaacgtcccggcctgatcgcaatggagactgcgcataacggcgccggcggcgccgtgctgcccccgccgcacatgatgcgaattcacgcgctcggacagagcaacgggatccccgtgcatctggacggcgcccgcctgttcaatgcctcggtcgcgctcggcgtgccggcggcacggatcgccgagcatgccgacagcgtgatggtctgcctgtccaagggcctgagcgcgccggtcggcagcctgctgtgcggcggcgcggcgttcgtcgcacgggcgcgcacgttgcggaaactcgtcggcggcaccatgcgccagtccggtgtcgtcgcagccgcgggcctcgtcgcgctggagacgatgatcgagcgcctctccaaggatcacgcggcagcaaggcggctcgccgcggccttgagctggctcgacccggcactcgccgatcccgaccaggtgcaaaccaacatcctgcgcgtcgacgtctccgcaagcggacgcgaggccgccgcatgggccgagggcgtgaagcagcgcggcatcctggtgcaggccagcggcccctcgcagctccggctcgtcacccatcgccacatcgacggagcggcggtggaccgcaccattgccgccttcgcggcgctcggccgctag

SEQ ID NO: 1242 - protein, 347 aa, Bradyrhizobium japonicum
MVAQERGRDGVVDLRSDTVTLPTAAMLERMQRAPLGDDGREGDPTVRALEARGAALTGKEAALFVPSGTMGNLLAMLAHAERGGEVFADAGAHLLNSELGSVVTIAGLVPKPMPSRRGAMDEAALADAIRGSERPGLIAMETAHNGAGGAVLPPPHMMRIHALGQSNGIPVHLDGARLFNASVALGVPAARIAEHADSVMVCLSKGLSAPVGSLLCGGAAFVARARTLRKLVGGTMRQSGVVAAAGLVALETMIERLSKDHAAARRLAAALSWLDPALADPDQVQTNILRVDVSASGREAAAWAEGVKQRGILVQASGPSQLRLVTHRHIDGAAVDRTIAAFAALGR

SEQ ID NO: 1243 - DNA, 1014 bp, Bacteroides thetaiotaomicron
  CDS (1)..(1014)
atgagaagttttgcctctgataataattccggtgtgcatccgttggtgatggaagcattgagccgggcaaacgcagatcatgcgttgggttatggtgatgatcgatggacggaagaagccgtagccaagataaaagaaacctttacacaggactgtgtccctttgtttgtattcaatggcacgggcagcaatgtggtggctttgcaagtaatgacgcgtccgtatcattcaatcttctgtgcagaaactgcccatatttatgtagacgagtgcggctctcccgtgaaaatgacaggttgtcagattcggccgattgccacaaccgatggtaagttgactcccgaactgatgcagccttatctgcacggtttcggcgaccagcatcattcgcaaccccgtgcgctttacatctctcaatgcaccgaactcggaacgatttatacacccgaagaactgaaacgtctgactgactttgcccatctgaacggtatgtatgtccacatggacggagcaaggattgccaatgcctgtgccgctcttcatctttcgctcaaagaactgactgtagactgtggaattgacatccttagtttcggcggaacaaaaaacggactgatgatgggggaatgtgtgattatatttaataaggacctgcaacgggaagcccgttttgtccggaaacaatctgcccaactggcttccaagatgcgttacctttcctgtcagtttactacctacttgacggatgacctgtggctgaagaatgccgctcatgccaatgcgatggcaggcaagctctatcgggcacttaaggaactgcccgaagtcacctttacccaaaagccggagagcaaccagttatttctgaccatgccccgtccgactatcgaccggatgctggaatcttatttcttttatttctggaatgaggcgaatcacgaaatccgcctggtgacttcttttgacacaacggaagaggatgtaaatcaatttattcgacttttgagacgttaa

SEQ ID NO: 1244 - protein, 337 aa, Bacteroides thetaiotaomicron
MRSFASDNNSGVHPLVMEALSRANADHALGYGDDRWTEEAVAKIKETFTQDCVPLFVFNGTGSNVVALQVMTRPYHSIFCAETAHIYVDECGSPVKMTGCQIRPIATTDGKLTPELMQPYLHGFGDQHHSQPRALYISQCTELGTIYTPEELKRLTDFAHLNGMYVHMDGARIANACAALHLSLKELTVDCGIDILSFGGTKNGLMMGECVIIFNKDLQREARFVRKQSAQLASKMRYLSCQFTTYLTDDLWLKNAAHANAMAGKLYRALKELPEVTFTQKPESNQLFLTMPRPTIDRMLESYFFYFWNEANHEIRLVTSFDTTEEDVNQFIRLLRR

SEQ ID NO: 1245 - DNA, 1077 bp, Vibrio vulnificus
  CDS (1)..(1077)
atgaaaaaggatttacgtgcgcattgccacaccattattgcgggcaatcacgagcaaagcccggcagaacatttctacgcgatggcgaaatggtgtgaagaacaccaagtgaagcacgatgtgtatggtgatggggaattcatcaactcattccaacaaaaagtagccgaccttttaggctttgaagcgggtttgtttgttatcacgggcaccatgacgcaggccacggcccttgagttggtgtgccgtaaaaaacgcaatcctgtggtcgcgatgcatgaatccagtcatatttatcgttttgaacgtcagggttatcaactgcagaatcgtttttccatcttgcctctgggcgatatgttccgaccttggacagcaaaagatctcaacgcctggccagatgaaatttcagcggtcctgtatgagctgccaatgcgtgagttaggcgggcaattgccaagttgggacgaactcaatgacatcaaagccgagtgtgaacaccgcgacattcacctccatatggatggtgctcgtttatgggagtgcgccgcctattatcaaaagtcgtacaaagagattgccacgggttttcagtcggcttatgtctctctctataagggcatcaatggcttagggggatcattgctactcggggacaagcaattcatcgagcaggcgtcgatttggatgaagcgccaaggtggcaatgtgtatcatcgcacgccttacgtggtgtcggctgcaatgcagtttgatcagcaattggcgaaaatgccagcgctgtttgcgcgcactcagcagatctaccaaatcctccgcgagttcccacagctggctgtgagcccgtatgagccgcacgccaacatgctgcacttgattgtgccgctgagcgttgagaacgccatcgagttgcgtgatcgagtggcagagcaaaaaggcatttggttagggcatccacaaaccacgcaacaccccgatcaatcgatcttcgagtggtatgtgggcgataggttgctcaacatcgctgatgatcagttgcgtgaagtgttggcttacttagcaaatgcagagtgttga

SEQ ID NO: 1246 - protein, 358 aa, Vibrio vulnificus
MKKDLRAHCHTIIAGNHEQSPAEHFYAMAKWCEEHQVKHDVYGDGEFINSFQQKVADLLGFEAGLFVITGTMTQATALELVCRKKRNPVVAMHESSHIYRFERQGYQLQNRFSILPLGDMFRPWTAKDLNAWPDEISAVLYELPMRELGGQLPSWDELNDIKAECEHRDIHLHMDGARLWECAAYYQKSYKEIATGFQSAYVSLYKGINGLGGSLLLGDKQFIEQASIWMKRQGGNVYHRTPYVVSAAMQFDQQLAKMPALFARTQQIYQILREFPQLAVSPYEPHANMLHLIVPLSVENAIELRDRVAEQKGIWLGHPQTTQHPDQSIFEWYVGDRLLNIADDQLREVLAYLANAEC

SEQ ID NO: 1247 - DNA, 1026 bp, Streptococcus agalactiae
  CDS (1)..(1026)
atgttacattttgaaaatgattataataaaggagctcatccagagcttttgaatgcccttattgaaactaatgatcaaggtctatcgggatatgggacagatagttactgtcaacaagcggcagataaaattcgagaagtctgttcctgtccacaagctgaagttgagtttttagtgggtggtactcaaacaaatcaagtagttatcagtagtatgcttgcttcttatgaaggagttattgctgcagaaacaggtcatgtgagtagtcatgaagcaggagccatagaattttcaggtcataaggtattgactttaccttctcataatgggaaattactcgcaagcgaagttgcaacttatattgagactttttatgctgatggtaattaccaacacatggtttttccaggaatggtttatatatcacatccaacagaatatggaacactttatagtaaagcagaactagaagagttatcgaagatttgtaaacattatcaaatccccttatttattgacggtgctcgtctggggtatggtttggctgcgaaagatacagatgttgatttcccaacgattgcagccttatcagatgttttttacattggtggaaccaaaatgggggctcttgctggggaagcagttgttttcacaaagaaaaatcgtccaaaacagtttactacaattgtaaagcagcatggtgcgttattagccaagggaagattgctggggcttgcttttgatcgtttctttacggatgacctttacttaaagattggaaagcatgcgattgacttagcagaggaattaaaaatcattttagaagaaaaaggttactcgttctatttaaaatcaccaactaatcaacaatttgttattgtagaaaatacaaaactaacagatttagcaaagaatgtagcttatagtttttgggaaaaatatgatgaccatcatactgtaatacgtctagcaactagttggtcaactagtcgcgaagatgtaactgctttaagaaatgtcttgtga

SEQ ID NO: 1248 - protein, 341 aa, Streptococcus agalactiae
MLHFENDYNKGAHPELLNALIETNDQGLSGYGTDSYCQQAADKIREVCSCPQAEVEFLVGGTQTNQVVISSMLASYEGVIAAETGHVSSHEAGAIEFSGHKVLTLPSHNGKLLASEVATYIETFYADGNYQHMVFPGMVYISHPTEYGTLYSKAELEELSKICKHYQIPLFIDGARLGYGLAAKDTDVDFPTIAALSDVFYIGGTKMGALAGEAVVFTKKNRPKQFTTIVKQHGALLAKGRLLGLAFDRFFTDDLYLKIGKHAIDLAEELKIILEEKGYSFYLKSPTNQQFVIVENTKLTDLAKNVAYSFWEKYDDHHTVIRLATSWSTSREDVTALRNVL

SEQ ID NO: 1249 - DNA, 1014 bp, Shewanella oneidensis
  CDS (1)..(1014)
atgatcgatttgcgcagtgataccgtgacccagccaactgaggcgatgcgtttagccatgtctagggcagaagtgggcgacgatgtttatggtgatgatccgaccgtgaacagtttgcaggacatggccgccgagatgtttggttttgagagcgctctttttacggcatcgggcactcaagccaatttgctcgcactgatggcgcattgcgagcgtggggatgaatatttatgtggtcagcaggcccataactacaaatttgaaggtggtggcgcggcggtattgggtagcattcaaccacaaccgttgacgaatcaactggatggcactattgcccttactgatgttgaagcagccatcaagcccgatgatattcattttgcccgcacacgcttactgagtttagaaaatactattggggggaaagtgttgtcgcaggcctatcttgccaatgcgcaggcgttggcttttcaacgtggtttaaaaattcatttagatggtgcaagggtggccaatgctgcagtagcacaaggtattgctattgctgatatagcagcgcattttgattcagtttccatttgtttatcaaaaggattatgtgcgccagtagggtcgttactcttaggggatgaacgcctgattaaaaaagcgacacgttggcgaaaaatgcttggtggcggtatgcgtcaagcgggtattttagcggcggctggcaagttagccttaactgaacaagttgaaagacttgcagaagatcatgaaaatgcggcttatctggctcagcagttaagccagttggatgagtttgacattgacttagcctcagttcaaaccaatatggtgtttgcaacattggcatcccatgtcgatgaacaggccttagtgaaacgctgtcgtggcgagggcattctgattagtcctggacgtaccttacgttttgttacccataaagatgtctcgcgtcaggatattgataaggtattgcaggtatttaaattacatctgcaggcgtaa

SEQ ID NO: 1250 - protein, 337 aa, Shewanella oneidensis
MIDLRSDTVTQPTEAMRLAMSRAEVGDDVYGDDPTVNSLQDMAAEMFGFESALFTASGTQANLLALMAHCERGDEYLCGQQAHNYKFEGGGAAVLGSIQPQPLTNQLDGTIALTDVEAAIKPDDIHFARTRLLSLENTIGGKVLSQAYLANAQALAFQRGLKIHLDGARVANAAVAQGIAIADIAAHFDSVSICLSKGLCAPVGSLLLGDERLIKKATRWRKMLGGGMRQAGILAAAGKLALTEQVERLAEDHENAAYLAQQLSQLDEFDIDLASVQTNMVFATLASHVDEQALVKRCRGEGILISPGRTLRFVTHKDVSRQDIDKVLQVFKLHLQA

SEQ ID NO: 1251 - DNA, 1002 bp, Escherichia coli O6
  CDS (1)..(1002)
atgattgatttacgcagtgataccgttacccgaccgagccgcgccatgctcgaagcgatgatggccgccccggttggggacgacgtttacggagacgaccctaccgttaatgctctgcaggactatgcagccgagctttccggtaaagaagccgccatttttctgcctaccggcactcaggccaacctggtcgctctgctcagtcactgcgaacgcggcgaagagtatatcgtcggtcaggccgcgcataactatctgtttgaagccggtggcgcagcagtgctgggcagtattcagccgcaacccatcgacgcagctgccgacggcacgctaccgctggataaagtggcgatgaaaatcaaacccgacgatatccatttcgcccgcaccaaattactcagtctggaaaacacccacaacggcaaagtgctgccgcgtgaatacttaaaagaggtatgggaatttacccgcaagcgcaatctggcgctgcatgttgacggtgcgcgcatctttaatgccgtggtggcttacggctgcgaactgaaagagatcacacaatattgtgactcgttcaccatttgcctgtcgaaaggtcttgggacgccagtcggttcattactcgtcggtaatcgtgattacattaaacgtgccattcgctggcggaaaatgacaggtggcgggatgcgccagtccggcattctggctgccgccgggctgtatgcgctgaaaaataacgtcgcacgtttgcaggaagaccacgacaacgccgcctggatggcgaagcaactgcgtgaagcaggcgcggatgtgatgcgtcaggacaccaatatgctgtttgttcgcgtcggggaagaaaatgctgccgcgttaggcgaatacatgaaagcgagaaacgtactgattaacgcctcgccgattgtccgcctggtgacgcatcttgacgtctcgcgcgctcagctggcggaagtcgccgcccactggcgcgcattcctggcgcgttaa

SEQ ID NO: 1252 - protein, 333 aa, Escherichia coli O6
MIDLRSDTVTRPSRAMLEAMMAAPVGDDVYGDDPTVNALQDYAAELSGKEAAIFLPTGTQANLVALLSHCERGEEYIVGQAAHNYLFEAGGAAVLGSIQPQPIDAAADGTLPLDKVAMKIKPDDIHFARTKLLSLENTHNGKVLPREYLKEVWEFTRKRNLALHVDGARIFNAVVAYGCELKEITQYCDSFTICLSKGLGTPVGSLLVGNRDYIKRAIRWRKMTGGGMRQSGILAAAGLYALKNNVARLQEDHDNAAWMAKQLREAGADVMRQDTNMLFVRVGEENAAALGEYMKARNVLINASPIVRLVTHLDVSRAQLAEVAAHWRAFLAR

SEQ ID NO: 1253 - DNA, 1026 bp, Bifidobacterium longum
  CDS (1)..(1026)
atgctgtcttttgagaacgattactcccgcgccgcccatcccgcggtgcttgaagccgtggctgaagccaacaaccatctgtattcgggctacgggtccgacgaactgagcgatcaggccaaggccaagatccgcgaggcctgcggccagccggacgcggatgtgtggttcctcgtcggcggcacgcagaccaaccaggtcgtcatcgacaccatcaccccggcgtatgcaggcgtggtcgcggtcgcctccggccatccgaacgtgcacgaggccggcgccatcgagttctccgggcacaaggtgctcacgattccccagcacaacggcaaaatggacccgaccgaactggacgagttctgcaagaccttctatgcggacggcaactacgagcacatggtgttcccgggctccgtgtacgtctcgcaaagcaccgaatatggcaccatctactccaaggccgagttgcaggccatcgccgatgtggcgcacaagtacgacatgccgctgttcgtggatggcgcgcgactcggctacgcgctgaccgccaccggttcagacatgacgctcgcggatctggcgaccatcgccgacgtgttctacatcggcggtaccaaggtgggtgccctgttcggcgaggccgtggtgtttaccaagcacaacacgccgaagcacttcttgaccctcatcaagcagcacggtgccttgctggccaagggctttgtgctgggcgcgcagtttgacgctttgttcaccgacaacctgtatttcaagatcgcccgcaacgccaatgaggcggccgatcgtattcgcgaggccctgcgcgccaagggctacacgctcactttcgaagcgcccaccaaccagattttcgtgacgatggatcagccgaccatcgaccgtctggagcgcgagatcaagctcggctttaccgaaaaggccgacgacacgcacaccgtgatgcgcatctgcaccagctgggccaccacgcctgaagaggtcgatcaacttattgagttgttgtaa

SEQ ID NO: 1254 - protein, 341 aa, Bifidobacterium longum
MLSFENDYSRAAHPAVLEAVAEANNHLYSGYGSDELSDQAKAKIREACGQPDADVWFLVGGTQTNQVVIDTITPAYAGVVAVASGHPNVHEAGAIEFSGHKVLTIPQHNGKMDPTELDEFCKTFYADGNYEHMVFPGSVYVSQSTEYGTIYSKAELQAIADVAHKYDMPLFVDGARLGYALTATGSDMTLADLATIADVFYIGGTKVGALFGEAVVFTKHNTPKHFLTLIKQHGALLAKGFVLGAQFDALFTDNLYFKIARNANEAADRIREALRAKGYTLTFEAPTNQIFVTMDQPTIDRLEREIKLGFTEKADDTHTVMRICTSWATTPEEVDQLIELL

SEQ ID NO: 1255 - DNA, 1116 bp, Rhizobium loti
  CDS (1)..(1116)
atggatgaaacgagcgtcaagaccatgagcgacagcaagcagacccgcccccgcggcttcaccagcgacaacatcgccggcgtctcccccgaggtgatcgcagccatcaccgcgtgcgcgtcgggtcaggcgcttccctacggcaacgatgagctgacgcataccgtcgagcgccagctcgccgaggtgttcgagcatgcggtcgacgtgttcctcgtttcgacggggtcggcggcgaacgcgctggcgctcgcggcgattacgccgccatggggcagcatcctctcgcacgccgacgcacacatcaaccgcgacgagtgcggcgcgccggagttctacaccgccggtgcgaagttggtgcagcttccaggcgaggctggcaaaatcgccatcgacgccttggcggccaatgcaacgcgcatggtgggcgatatccactcggtccagccctccagcgtcagcatcacgcaggcgaccgagatgggatcggtctacgcgctcgacgaaatcagggcgatcggacatatctgccggtcagcgaacctgccgctccacatggacggtgctcgcttcgccaacgccctcgtcactctgcgctgctcgccggccgagatgacgtggaaggccggcgtcgacctagtgtcgtttggcgccaccaagaacggaacgtttggggtcgatgcggtcgtctcgtttcgcagagatctcgcgagcacgatcgcctttcgccgcaagcgggccggccagttgagttccaagatgcgcttcatggcggcgcaaatggacggttatctgagggacggtgtctggcttcgcaacgcggtccatgccaatgcgatggcatcggcgctcgcgcgggggttggccctggtgccaggcgtgaaaatccagcagcggcccgaggccaatatactgttctgccgacttcccacgtccctgatccgggggctgctcgacatgggattccgcttctaccatgatcgctgggagcccgggatcgtgaggttcgtcacctctttcgcgacgaccgaggccgacgtgtccgacttgatcggcgcggcgaccagcctctgcgcaccggtcggctcggctcgtgttccggctggcgccgaatga

SEQ ID NO: 1256 - protein, 371 aa, Rhizobium loti
MDETSVKTMSDSKQTRPRGFTSDNIAGVSPEVIAAITACASGQALPYGNDELTHTVERQLAEVFEHAVDVFLVSTGSAANALALAAITPPWGSILSHADAHINRDECGAPEFYTAGAKLVQLPGEAGKIAIDALAANATRMVGDIHSVQPSSVSITQATEMGSVYALDEIRAIGHICRSANLPLHMDGARFANALVTLRCSPAEMTWKAGVDLVSFGATKNGTFGVDAVVSFRRDLASTIAFRRKRAGQLSSKMRFMAAQMDGYLRDGVWLRNAVHANAMASALARGLALVPGVKIQQRPEANILFCRLPTSLIRGLLDMGFRFYHDRWEPGIVRFVTSFATTEADVSDLIGAATSLCAPVGSARVPAGAE

SEQ ID NO: 1257 - DNA, 1074 bp, Xanthomonas campestris
  CDS (1)..(1074)
atgatggacgggcagggcagcgctgcacgcatcagctttcgcaacgattacagcgagggcgcacatccgcgcgtcttgcaggcattggcgcaggccagtgacgagcaaaatggcggctacggcaccgatcggcatagcgaacgtgctgcggcattgatccgcaatgccatcgcgcaaccgcaggccgccgtgcatctgctggtcggtggcacgcagaccaacctgattgcgatcagcgcgtttttgcgcccgcatcaggcggtgattgcggtggaagcgggccacatcgccacgcacgaaaccggcgcgatcgaggccaccgggcacaaggtgctcaccgtccccgcgctgcacgacaagctgacgcctgcattgatcgcgccactgcttgcggtgcacagcaacgagcacatggtgcagccgcgcctggtttatctttccaacagcaccgagagcggcaccatctacacgcgtgccgaacttgaggcgctcgcgcagttctgccgcgcgcacgacttgctgctgtatctggatggcgcgcgcctgggcgcggcattgactgcccatggcaacgatctggatctaccgacgattgccgcgctcaccgatgcgttctacatcggcggcaccaagaatggcgccttgctcggcgaagcgctgatcatcgtgacgccggcgttgcaggccgatttccgctacctgatcaagcaacgcggcgcgctgctggccaagggcatggtgctgggtgcgcagttcgctgcgcttttcgaagaggggctgttctttgagttagccgcgcatgccaatgcaatggcgcagcggctgcgtgccggcttgctggccgccggcgccgaattcaccagcaactcgccgaccaaccagcaattcattgccgtgagcgcgcagcaggccgagcagatcgcgcagcgctacgacttcgaacgctgggaaacgcgcagcgacggccgcctggtgattcgcttcgtgacctcgtgggccaccacgcctgccgcagttgatcgtctgtgcgcgtatgttgcggcccttttgcagcatcctgcggtgcagtcatga

SEQ ID NO: 1258 - protein, 357 aa, Xanthomonas campestris
MMDGQGSAARISFRNDYSEGAHPRVLQALAQASDEQNGGYGTDRHSERAAALIRNAIAQPQAAVHLLVGGTQTNLIAISAFLRPHQAVIAVEAGHIATHETGAIEATGHKVLTVPALHDKLTPALIAPLLAVHSNEHMVQPRLVYLSNSTESGTIYTRAELEALAQFCRAHDLLLYLDGARLGAALTAHGNDLDLPTIAALTDAFYIGGTKNGALLGEALIIVTPALQADFRYLIKQRGALLAKGMVLGAQFAALFEEGLFFELAAHANAMAQRLRAGLLAAGAEFTSNSPTNQQFIAVSAQQAEQIAQRYDFERWETRSDGRLVIRFVTSWATTPAAVDRLCAYVAALLQHPAVQS

SEQ ID NO: 1259 - DNA, 1065 bp, Xanthomonas axonopodis
  CDS (1)..(1065)
atgatggacgggcagggtagcgctacgcgcatcagctttcgcaacgactacagcgaaggcgcgcatccgcggctgttgcaggcgttggcgcaggccagcgccgagcagcatgccggctatggcaccgatcggcacacagcgcgtgcggttgcgttgatccgcaccgcagtcgcgcagccgcaggccgacgtgcatctgctggtcggcggcacgcagaccaatctgattgcgatcagcgcgttcttgcgcccgcatcaggcagtcatcgcggtggacgcggcgcatatcgccacgcacgagaccggcgccatcgaagcgaccggccacaaggtgctcaccgtgccggcgctgcacgacaagctgacgcctgcgctgattcagccggtgctggctgtgcacagcaacgaacacatggtgcagccgcgtctggtctacatttccaacagcaccgaaagcggcaccatctatacgcgcgccgaactcgatgcgttgtcgcggttttgtcgcgcgaacgatttgctgctgtacctggatggcgcgcgtctgggtgcggcgctgaccgccgacggcaacgatctggatctgccggccattgccacgctgaccgacgcgttctatatcggtggcaccaagaatggtgcgctgctcggcgaagcgctggtcatcgtcaatcccgccctgcaggcggatttgcgttatctgatcaagcagcgcggcgcgctactggccaagggcatggtggttggtgcgcaatttgcggcgttgttcgaagacagtctgttcttcgaactggccgcgcatgccaatgccatggcgcaacgcttgcgcgccggcctgcttgcggccggcgcgcacttcaccagcgactcgccgaccaaccagcagttcatcgccgtcagcgcgcaacacgctgcgcagctcgtgcaacgctacgacttcgagcgctgggaagtgcgcaccgatggcagtcaggtaatccgcttcgtgacctcgtgggcgaccacagccgcgtcggtcgatcggctgtgtgcggatgttgccgcacttcatcgcggcgtgtcgtaa

SEQ ID NO: 1260 - protein, 354 aa, Xanthomonas axonopodis
MMDGQGSATRISFRNDYSEGAHPRLLQALAQASAEQHAGYGTDRHTARAVALIRTAVAQPQADVHLLVGGTQTNLIAISAFLRPHQAVIAVDAAHIATHETGAIEATGHKVLTVPALHDKLTPALIQPVLAVHSNEHMVQPRLVYISNSTESGTIYTRAELDALSRFCRANDLLLYLDGARLGAALTADGNDLDLPAIATLTDAFYIGGTKNGALLGEALVIVNPALQADLRYLIKQRGALLAKGMVVGAQFAALFEDSLFFELAAHANAMAQRLRAGLLAAGAHFTSDSPTNQQFIAVSAQHAAQLVQRYDFERWEVRTDGSQVIRFVTSWATTAASVDRLCADVAALHRGVS

SEQ ID NO: 1261 - DNA, 1041 bp, Thermoanaerobacter tengcongensis
  CDS (1)..(1041)
atgaaatatattgacctaagaagcgacacagtaacccagcccactcctgagatgagagaagccatgtacaaagctgaagtgggcgatgacgtatacggagaagaccctactgtgagaaaacttgaagaaatggcagcagaaatgctaggaaaagaagcagcaatgcttgtgaccagcggaactcaagggaaccaagtctcaataatgactcacactcatccaggagaagaaatcatactagaggaaaattcccacataataacctatgaagttggagggataggctatctcgctggagtacaggcaaaaactttgaagggcaataaaggagttttaaatccggaagatgtggaaaaagctataaggcctaaaaacatacactttcctgagacaagcctaatctgccttgaaaacacacacaatagagcaggtggcactgtgactccaattgaagtcatgaaaaagatatatgaaatcgcacaaaagcatggaatacctgtacatctggacggcgccagaatatttaacgccgcgacatatctcaaagtagatgtaaaagaaattgcgaaatatgctgacagcgtgatgttctgcctttcaaaagggttatgtgcccctatcgggtctatcgtcgtcggaacaaaagaatttattgaaagggcgaggaaataccgcaagatgctgggaggaggaatgaggcaggcaggtttcatcgctgctgctggcatcgtagcccttgaaaaaatgacaaaaaggcttcaagaagaccatgacaatgcaaggcttctggccgaaggtctgaaaaacatccccgggatagaccttgatatggaaacagtgcaaactaacatagtaatgactgatatttctggcactggaatgacaggaagggaattttctctaaagttaaaagaacacggcgttttagtaaatgggggagatgacttttcagtaagatttgtgactcactattacataactaaagaagacgtaaagaaggccttgagtgcaattgaaaaagtggtaagagaaaagcattaa

SEQ ID NO: 1262 - protein, 346 aa, Thermoanaerobacter tengcongensis
MKYIDLRSDTVTQPTPEMREAMYKAEVGDDVYGEDPTVRKLEEMAAEMLGKEAAMLVTSGTQGNQVSIMTHTHPGEEIILEENSHIITYEVGGIGYLAGVQAKTLKGNKGVLNPEDVEKAIRPKNIHFPETSLICLENTHNRAGGTVTPIEVMKKIYEIAQKHGIPVHLDGARIFNAATYLKVDVKEIAKYADSVMFCLSKGLCAPIGSIVVGTKEFIERARKYRKMLGGGMRQAGFIAAAGIVALEKMTKRLQEDHDNARLLAEGLKNIPGIDLDMETVQTNIVMTDISGTGMTGREFSLKLKEHGVLVNGGDDFSVRFVTHYYITKEDVKKALSAIEKVVREKH

SEQ ID NO: 1263 - DNA, 1023 bp, Fusobacterium nucleatum
  CDS (1)..(1023)
atgataaattttaaaaatgattatagtgaaggagcttgttcagaagtactggaagcattgataaaaactaattatgagcaaacagtaggttatggagaagatgaatactgtgaaaaggctaaaaatttaattaaagaaaatattaattatcctaatgcaaatatttattttttagttggtgggacacaagcaaatacaactgttatttctcactctctaagaccttatgaagctgttattgcttgtaagacaggacatatctctatacatgaaacaggagctattgaagctactggacataaaataattgaagtagatggaattgatgggaaattaactcctgatttaattttaaatgaattaagaaaacatgaagatcatcacatggtaaaacctaaaatggtttatatttcaaatactactgaaataggaactgtttatactaaaaaagaattagaaaatattagtaaagtttgtaaagataataatttatatttatatttagatggtgcaagacttgcatctgcacttacctctgaaaaatgtgatataaatttagaagattatccaagatattgtgatgttttctatattggtggaacaaaatgtggcttattatttggtgaagcagttgtgattataaatgatgagataaagaaagaatttaacttttctgttaaacaaaaaggtggattatttgcaaaaggaagattattaggaatacagtttgcaactttatttaaagatgatttatattatagaataggtgttcattcaaataaaatggcattaaaaataaaaaatgcttttatagaaaaaggtattaagttagctactgattcttatactaaccaagtttttgtagatttaagtcaagaacaaataaaaaaattagaaaaagatgttatattttcagtagaattttttggaataggagaaagtcaatcatcaagatttgtaacttcttgggcaacaaaagaagaagatattgataaacttgtagaactgattaaatctctttaa

SEQ ID NO: 1264 - protein, 340 aa, Fusobacterium nucleatum
MINFKNDYSEGACSEVLEALIKTNYEQTVGYGEDEYCEKAKNLIKENINYPNANIYFLVGGTQANTTVISHSLRPYEAVIACKTGHISIHETGAIEATGHKIIEVDGIDGKLTPDLILNELRKHEDHHMVKPKMVYISNTTEIGTVYTKKELENISKVCKDNNLYLYLDGARLASALTSEKCDINLEDYPRYCDVFYIGGTKCGLLFGEAVVIINDEIKKEFNFSVKQKGGLFAKGRLLGIQFATLFKDDLYYRIGVHSNKMALKIKNAFIEKGIKLATDSYTNQVFVDLSQEQIKKLEKDVIFSVEFFGIGESQSSRFVTSWATKEEDIDKLVELIKSL

SEQ ID NO: 1265 - DNA, 1533 bp, Arabidopsis thaliana
  CDS (303)..(1379)
gataatatttcattttcgtcgtttctttctttctaagtttcgatgtcagttcctaatctctatggcgttcatgatagccaaatggtaactttggtggcctaatgtatgtcacgtaaattatccacgtggcactcacttttttgcatctttctcaaaatatatcaaaggagacttcataaagaaagaatctttagtgtggagagactaaaaggacaccacaagcttatttcataagaaacttcaaattagaatcagaaacaagagcatccttcttcatttacacaggtaaattaggtgtaaaaatggtgatgagaagtgtggatctacgatcagataccgttactagaccgacagatgcgatgcgagaagcaatgtgtaacgcagaggtggatgatgacgtcctcggatatgacccaacggctagacgtcttgaagaggagatggctaagatgatggggaaagaggctgctctgttcgtgccatccgggacaatggggaatctgatcagcgtgatggttcactgcgacgtgagaggcagcgaggtgattcttggcgacaattgtcacatccatgtttacgagaatggagggatatcgactatcgggggagtgcatcctaagacagtcaagaatgaagaagacgggaccatggacttggaggccattgaagcagctattagagatcctaaaggaagcacgttttatccatcaacaaggttgatttgcttggagaacacacatgccaactctggtgggagatgtttgagcgtggaatacactgagaaagttggagagattgcgaagagacatggcgtgaagctccatatcgacggagcccgtcttttcaatgcttccattgcacttggagttccagtccataagcttgttaaggctgcggactccgttcaggtgtgtctctctaaaggtcttggagctccggtaggatctgtaatcgttggttcgcaaagcttcatagagaaggcgaaaacggttaggaaaacattaggtggaggaatgagacaaataggtgttctgtgcgcagccgctttggtcgcactccaagaaaacctcccaaagctacaacatgaccacaagaaggctaagttgttagctgaagggttgaatcaaatgaaagggattagagtaaatgttgcagccgtggagaccaacatgattttcatggatatggaggatggttcaagacttacggctgagaaactgcggaagaatctagaggagaatggcattctccttatccggggaaactcatcccggatcagaatagttatacaccaccagataacaacaagtgatgtgcattacacattgtcttgctttcagcaagcaatgctaacgatgcaggaaccaagccgaacctaatttggcgaaaccgaaatgcttcttcttttcttttcaacttattaaatattgttgtctaaagtacattttaattaaaactataagcatttcaatgaaattgtcaccctcattcctggatgtttgagtttttaatttataagttgttttacctttg

SEQ ID NO: 1266 - protein, 358 aa, Arabidopsis thaliana
MVMRSVDLRSDTVTRPTDAMREAMCNAEVDDDVLGYDPTARRLEEEMAKMMGKEAALFVPSGTMGNLISVMVHCDVRGSEVILGDNCHIHVYENGGISTIGGVHPKTVKNEEDGTMDLEAIEAAIRDPKGSTFYPSTRLICLENTHANSGGRCLSVEYTEKVGEIAKRHGVKLHIDGARLFNASIALGVPVHKLVKAADSVQVCLSKGLGAPVGSVIVGSQSFIEKAKTVRKTLGGGMRQIGVLCAAALVALQENLPKLQHDHKKAKLLAEGLNQMKGIRVNVAAVETNMIFMDMEDGSRLTAEKLRKNLEENGILLIRGNSSRIRIVIHHQITTSDVHYTLSCFQQAMLTMQEPSRT

SEQ ID NO: 1267 - DNA, 1098 bp, Ralstonia solanacearum
  CDS (1)..(1098)
atgaaccgcgatccgatgccgaccaccagaacacccgccctgggctttaccagcgacaacatcgaaggcgcgtcgcccgaggtgctcgatgccatccttgccgccaatgccggtcaggcggccccatacggcgcggatgactgcaccgcccgggtcgagcaaacgctgagcgagctgttcgagcgcgaagtcaaagtcttcctggtcccgaccggcaccgcggccaatgcgctctgcctgggcgcgatgacgccgccctggggcaacgtgtactgccacccgtcaagccacatcaacaacgacgagtgcggtgcccccgagttctatacgaacggcgcgaaactggtcgcagtggatgggccatccgccaagatcgatgtggagaagcttcgcgccgccacccgcgtgaaggtgggcgacgtgcattccacccagcccgcttgcgtcagcctgacgcaagcgacggaagtcgggagcctctacacgctgaatgagatcgaagcgatcggacagctctgcaaggacgcccgcatcaagctgcagatggatggctcgcgctttgccaacgcgctggtctccctgggctgctcgcccgcggcaatgacatggaaagcgggcgtcgatgcgctgtcgttcggcgcgaccaagaatggcgtcgtcgcggcggaagccattgtgctgtttgacctgtcgctcgcggccgagatgggctaccgccgcaagcgggccggccatctgttctcgaagatgcgttttctgtcggcccagatcgaagcctacctggccaacgatctctggttgcgcaacgcacgccaggcaaacgacatggccctgcgcctggcccgtggccttgaagggatgcatggggccagcgtgctgggcgccacggaagccaacatcgtcttctgccgcctcccctcgaccctcattgaaaacctgctccaggcgggattccgcttttatcacaatcgctgggagccgaacgtggtgcgctttgtgacgtccttcgccaccacggccgatgatgtcgacaacctgctgcggcatatgaaggccgcagccgccgggccatcggcagacacccatgccaccgcatga

SEQ ID NO: 1268 - protein, 365 aa, Ralstonia solanacearum
MNRDPMPTTRTPALGFTSDNIEGASPEVLDAILAANAGQAAPYGADDCTARVEQTLSELFEREVKVFLVPTGTAANALCLGAMTPPWGNVYCHPSSHINNDECGAPEFYTNGAKLVAVDGPSAKIDVEKLRAATRVKVGDVHSTQPACVSLTQATEVGSLYTLNEIEAIGQLCKDARIKLQMDGSRFANALVSLGCSPAAMTWKAGVDALSFGATKNGVVAAEAIVLFDLSLAAEMGYRRKRAGHLFSKMRFLSAQIEAYLANDLWLRNARQANDMALRLARGLEGMHGASVLGATEANIVFCRLPSTLIENLLQAGFRFYHNRWEPNVVRFVTSFATTADDVDNLLRHMKAAAAGPSADTHATA

SEQ ID NO: 1269 - DNA, 1038 bp, Ralstonia solanacearum
  CDS (1)..(1038)
atgcaacacttcgcctccgacaactacgccggcttctgcccggaatccctgaagtacttcctggaagcgaacggcagcggccacgagcccgcctacggcgacgactcctggacgcagcgcgtatgcgaccgcatccgcgatctgttcgagaccgattgcgaagtctttttcgtcttcaacggcaccgccgccaattcgctggcgctgtccgcgctgtgccagtcgtaccactccgtcatctgccatgagctggcgcacatcgagacggacgagtgcggcggccccgagttcttctccaacggctccaagctgctgaccgccgagggcgccgacggcaagctgacgcccgacgcggtggaggcgctggtcacgcgccgctccgacatccactaccccaagcccaaggtggtctcgctcacgcagtcgaccgaggtgggcacggtctacacggtggacgaggtgcgggcgattgccgctgtcgcccgccgccggcagctgcgcgtgcacatggacggcgcgcgcttcgccaacgcggtggcctcgctcggcgtgcatccgtccgagatcacctggcgcgcgggggtggacgtgctgtgcttcggcggcaccaagaatggcctgccggtgggcgaggcggtggtgttcttcaaccgccgcctggccgaggacttcgcctaccgcgtcaagcaggccgggcaactggcctccaagatgcgcttcatctccgcgccgtggctgggcctgctggagaacgacgtgtggctgcgcaacgcgcgccatgccaacgcgatggcgcaactgctgcaccagcgcatccgcgaggtgccgggcgtgcgcatcatgttcccgccgcaggccaatgccgtgttcgccgagctgccgctgcccgccatcgagacgctgcgcgcgcgcggctggcgcttctacaccttcatcggcgcaggcggctgccgcttcatgtgtgcgtgggacttgcagcccgagacggtggaggcgctcgccggcgacatccgcctggcctgcggacaggccgcatag

SEQ ID NO: 1270 - protein, 345 aa, Ralstonia solanacearum
MQHFASDNYAGFCPESLKYFLEANGSGHEPAYGDDSWTQRVCDRIRDLFETDCEVFFVFNGTAANSLALSALCQSYHSVICHELAHIETDECGGPEFFSNGSKLLTAEGADGKLTPDAVEALVTRRSDIHYPKPKVVSLTQSTEVGTVYTVDEVRAIAAVARRRQLRVHMDGARFANAVASLGVHPSEITWRAGVDVLCFGGTKNGLPVGEAVVFFNRRLAEDFAYRVKQAGQLASKMRFISAPWLGLLENDVWLRNARHANAMAQLLHQRIREVPGVRIMFPPQANAVFAELPLPAIETLRARGWRFYTFIGAGGCRFMCAWDLQPETVEALAGDIRLACGQAA

SEQ ID NO: 1271 - DNA, 1002 bp, Salmonella typhimurium
  CDS (1)..(1002)
atgattgatttacgcagtgataccgttacccgaccgggccgcgccatgctcgaggcgatgatgaccgccccggtcggggacgacgtatacggcgatgaccctactgttaacgcccttcagcgctacgccgccgacctttccggtaaagaagcggcgctttttttacccaccggcacccaggccaatctggtcgcgctgcttagccattgtgaacgcggcgaagagtatatcgtcggtcagggcgcgcataattatctctatgaagctggcggcgcggcggtgctcggcagcattcagccgcagcccatcgacgccgccgcggacggtacgctgccgctggagaacgtggcggcgaagattaaagcggatgacatccacttcgcgcgcacgcgcttgctcagtctggaaaatacgcataacgggaaagtgctgccgcgcgcgtatctgaaagacgcctggacatttacccgcgaacgtggactggcgctgcacgttgacggcgcccgaatttttaacgcggtggttgcctacggctgtgagttaaaagagattacgcagtattgcgactcttttaccatctgcctgtcaaaaggtctcggaacgccggtcggttcactgctggtcggcaaccgcgattacattaaacgcgcgacgcgctggcgtaaaatggtcggcggcggaatgcgtcaggccgggattctggcagcggccggactgtatgcgctgaagcataacgtggcgcgtctgcaagaggatcatgataacgccgcctggctggcgcagcagcttcgggaagcgggcgcggaggtcatacgccacgaaacgaatatgctgtttgttcgcgttggcgaagcacaggccgccgcgcttggcgactatttgcgggaacggaatatcctgattaacgccgcgccgattgtgcgtctggtgacgcatctggatgtctctcgcgaacagcttaccgacgtcgtcgcccactggcgcgcctttttagcccgctaa

SEQ ID NO: 1272 - protein, 333 aa, Salmonella typhimurium
MIDLRSDTVTRPGRAMLEAMMTAPVGDDVYGDDPTVNALQRYAADLSGKEAALFLPTGTQANLVALLSHCERGEEYIVGQGAHNYLYEAGGAAVLGSIQPQPIDAAADGTLPLENVAAKIKADDIHFARTRLLSLENTHNGKVLPRAYLKDAWTFTRERGLALHVDGARIFNAVVAYGCELKEITQYCDSFTICLSKGLGTPVGSLLVGNRDYIKRATRWRKMVGGGMRQAGILAAAGLYALKHNVARLQEDHDNAAWLAQQLREAGAEVIRHETNMLFVRVGEAQAAALGDYLRERNILINAAPIVRLVTHLDVSREQLTDVVAHWRAFLAR

SEQ ID NO: 1273 - DNA, 1047 bp, Rhizobium meliloti
  CDS (1)..(1047)
atgatcttctcctccgacaactgggccggcgcccatccggcgattgccgaaagtctggtcgcgaatgcgcagggctatgcttccgcctacggcacgagcgaactcgaccggagggtggaacagagattttcggagattttcgagagggacgtcgcggtattcttcgtgggcaccggaaccgccgcaaattcccttgcgctttcgagcgccaatcgggcgggcggaatcgctttctgccatcgcgaagcgcatgtgaacgtcgacgagtgcggcgcgccggagttcttctcgcacggcgcgaggctgtgcccggtcgagggcgcccgcggcaggatggagccggcgaagctcgaggccgaaattcggcggctcccgagggagaacgtccatggcggtcagccgatggcggtgacgctgacgcaggcgaccgagagcggcaccgtctattcgctcgaccagatcgaaacgatcggttcgatcgcccgctcccataaactgccgctgcacatggatggcgcccgtttcgccaatgccctggtcagccttggtacgacaccggccgagatgacctggaagcgtggcgtcgatctgctttcgttcggcggaaccaagaacggctgctggtgcgccgaggcgctggtgctcttcgacctttcgaaggcgcaggagatgcacttcctgcgcaagcgctcggctcaactcttctccaagtcgcgcttcgtcgccgcccagttcgacgcctatcttgccggcgatctctggctcgatcttgcgcgccacgccaacgcgatggcacagcgcctcgccgacggcatcaccgcttcggccgggagccggcttgcctgggcgcccgatgccaacgaggtcttcgtcgtgctgaaacgggaggccgcgggtcggctgcagcggcagggcgcgcttttctacgattgggaagtgccgcacgatctcgaaggcagcctcgcggaagacgaagggctctatcgcctggttaccagcttcgccacccgcgccgaggacgtcgaccgtttcgtcgccgcctgctga

SEQ ID NO: 1274 - protein, 348 aa, Rhizobium meliloti
MIFSSDNWAGAHPAIAESLVANAQGYASAYGTSELDRRVEQRFSEIFERDVAVFFVGTGTAANSLALSSANRAGGIAFCHREAHVNVDECGAPEFFSHGARLCPVEGARGRMEPAKLEAEIRRLPRENVHGGQPMAVTLTQATESGTVYSLDQIETIGSIARSHKLPLHMDGARFANALVSLGTTPAEMTWKRGVDLLSFGGTKNGCWCAEALVLFDLSKAQEMHFLRKRSAQLFSKSRFVAAQFDAYLAGDLWLDLARHANAMAQRLADGITASAGSRLAWAPDANEVFVVLKREAAGRLQRQGALFYDWEVPHDLEGSLAEDEGLYRLVTSFATRAEDVDRFVAAC

SEQ ID NO: 1275 - DNA, 1092 bp, Rhizobium loti
  CDS (1)..(1092)
atgaacgaaagcaagcagacccgcccccgcggctttaccagcgacaacatcgccggcgtctcccccgaggtgatcgcagccatcaccgcgtgcgcgtcaggtcaggcgcttccctacggcaacgatgagctgacgcataccgtcgagcaccagctcgccgaggtgttcgagcatgcggtcgacgtgttcctcgtttcgacggggtcggcggcgaacgcgctggcgctcgcggcgattacgccgccatggggcagcatcctctcgcacgccgacgcacacatcaaccgcgacgagtgcggcgcgccggagttctacaccgccggtgcgaagttggtgcagcttccaggcgaggctggcaaaatcgacatcgacgccttggcggccaatgccatgcgcatggtgggcgatatccactcggtccagccctccagcgtcagcatcacgcaggcgaccgagatgggatcggtctacgcgctcgacgagatcaaggccatcagccatatctgccggtcagcgaacctgccgctccacatggacggtgctcgcttcgccaacgccctcgtcactctgcgctgctcgccggccgagatgacgtggaaggccggcgtcgaccttgtgtcatttggcgccacgaagaatggaacgtttggggtcgatgcggtcgtctcgttccgcggagatctcgcgagcacgatcgcctttcgccaaaagcgggccggccagttgagttccaagatgcgcttcatggcggcgcaaatggacggttatctgagggacggtgtctggcttcgcaacgcggtccatgccaatgcgatggcatcggcgctcgcgcgggggttggccctggtgccaggcgtgaagatccagcagcgtcccgaggccaacatcctgttctgccgacttcccacgtccctgatccgggggctgctcgacatgggattccgcttctaccatgatcgctgggagcccgggatcgtgaggttcgtcacctctttcgcgacgaccgaggccgacgtgtccgacttgatcggcgcggcaaccagcctctgcgcaccggtcggctcggctcgtgttccggctggcgccgaatga

SEQ ID NO: 1276 - protein, 363 aa, Rhizobium loti
MNESKQTRPRGFTSDNIAGVSPEVIAAITACASGQALPYGNDELTHTVEHQLAEVFEHAVDVFLVSTGSAANALALAAITPPWGSILSHADAHINRDECGAPEFYTAGAKLVQLPGEAGKIDIDALAANAMRMVGDIHSVQPSSVSITQATEMGSVYALDEIKAISHICRSANLPLHMDGARFANALVTLRCSPAEMTWKAGVDLVSFGATKNGTFGVDAVVSFRGDLASTIAFRQKRAGQLSSKMRFMAAQMDGYLRDGVWLRNAVHANAMASALARGLALVPGVKIQQRPEANILFCRLPTSLIRGLLDMGFRFYHDRWEPGIVRFVTSFATTEADVSDLIGAATSLCAPVGSARVPAGAE

SEQ ID NO: 1277 - DNA, 1313 bp, Arabidopsis thaliana
  CDS (91)..(1158)
gagtcacccgaagcacatctctttttatctcttcgccaagaaaacaaaaagcatagcctaacagaacagaatctagtgagccaaatcaagatggtgacgccaactacaattagaaccgtcgatctccgctccgacacggtgactaaaccaacagagtcaatgcgttcagcaatggcaaacgcggaagtagacgacgacgttttgggaaacgatccaacggctctgcgtttggagaaagaggtggctgagatcgctggaaaagaggcggcgatgtttgttccgtcagggacaatggggaatctgataagcgtgttggtccattgtgatgagagagggagtgaagtgattcttggagacgactctcacattcatatatatgaaaacggcggcgtttcaagcctcggtggtgtgcatccgaggacggtgaagaatgaggaagacggtacgatggagattggtgctattgaagctgccgtgaggagtcccaaaggagatctccatcatccggttactaagcttatatgtcttgagaatactcaagcaaattgtggaggtagatgccttcctatagaatatatagacaaagtcggagaattagccaagaaacatggtttgaagcttcacattgacggagctaggattttcaacgcttctgtggcacttggagttcccgtgaagaggattgttcaagcagctgattctgtctcgatctgtttgtcgaaaggtattggtgcaccggtcggttcggtaatcgtgggaagcaagaagttcattactaaagcaaggtggttaaggaaaacattaggcggaggaatgagacagatcggcgtgctctgcgccgccgcattggtggctctccatgaaaacgtcgccaagctcgaagatgaccataagaaagccagggttttggcagaaggactgaaccggattgaacggttaagagtgaacgttgcagctgtggaaaccaacatcatatacgtagacataccagaagatccaaaatttggagcagaagaggcatgtaagagcttggaagatgtcggtgtgcttgtcataccccaagctacattcagaatcaggattgttctacaccaccaaatctcagacgtcgacgtggaatatgtactctcttgctttgagaaaatatttcactcgtgaagagaagagaaggcgttattattttaagtaatttcactcgttggacatgtgtaaggttgtatttgaatcttcattcagaataaggttgtatttgaatcgattttcttggtttacaaatgaaaacctttaaccaagaagtagaaaactctttcatc

SEQ ID NO: 1278 - protein, 355 aa, Arabidopsis thaliana
MVTPTTIRTVDLRSDTVTKPTESMRSAMANAEVDDDVLGNDPTALRLEKEVAEIAGKEAAMFVPSGTMGNLISVLVHCDERGSEVILGDDSHIHIYENGGVSSLGGVHPRTVKNEEDGTMEIGAIEAAVRSPKGDLHHPVTKLICLENTQANCGGRCLPIEYIDKVGELAKKHGLKLHIDGARIFNASVALGVPVKRIVQAADSVSICLSKGIGAPVGSVIVGSKKFITKARWLRKTLGGGMRQIGVLCAAALVALHENVAKLEDDHKKARVLAEGLNRIERLRVNVAAVETNIIYVDIPEDPKFGAEEACKSLEDVGVLVIPQATFRIRIVLHHQISDVDVEYVLSCFEKIFHS

SEQ ID NO: 1279 - DNA, 1059 bp, Arabidopsis thaliana
  CDS (1)..(1059)
atggtgatgagaagtgtggatctacgatcagataccgttactagaccgacagatgcgatgcgagaagcaatgtgtaacgcagaggtggatgatgacgtcctcggatatgacccaacggctagacgtcttgaagaggagatggctaagatgatggggaaagaggctgctctgttcgtgccatccgggacaatggggaatctgatcagcgtgatggttcactgcgacgtgagaggcagcgaggtgattcttggcgacaattgtcacatccatgtttacgagaatggagggatatcgactatcgggggagtgcatcctaagacagtcaagaatgaagaagacgggaccatggacttggaggccattgaagcagctattagagatcctaaaggaagcacgttttatccatcaacaaggttgatttgcttggagaacacacatgccaactctggtgggagatgtttgagcgtggaatacactgagaaagttggagagattgcgaagagacatggcgtgaagctccatatcgacggagcccgtcttttcaatgcttccattgcacttggagttccagtccataagcttgttaaggctgcggactccgttcaggtgtgtctctctaaaggtcttggagctccggtaggatctgtaatcgttggttcgcaaagcttcatagagaaggcgaaaacggttaggaaaacattaggtggaggaatgagacaaataggtgttctgtgcgcagccgctttggtcgcactccaagaaaacctcccaaagctacaacatgaccacaagaaggctaagttgttagctgaagggttgaatcaaatgaaagggattagagtaaatgttgcagccgtggagaccaacatggatggttcaagacttacggctgagaaactgcggaagaatctagaggagaatggcattctccttatccggggaaactcatcccggatcagaatagttatacaccaccagataacaacaagtgatgtgcattacacattgtcttgctttcagcaagcaatgctaacgatgcaggaaccaagccgaacctaa

SEQ ID NO: 1280 - protein, 352 aa, Arabidopsis thaliana
MVMRSVDLRSDTVTRPTDAMREAMCNAEVDDDVLGYDPTARRLEEEMAKMMGKEAALFVPSGTMGNLISVMVHCDVRGSEVILGDNCHIHVYENGGISTIGGVHPKTVKNEEDGTMDLEAIEAAIRDPKGSTFYPSTRLICLENTHANSGGRCLSVEYTEKVGEIAKRHGVKLHIDGARLFNASIALGVPVHKLVKAADSVQVCLSKGLGAPVGSVIVGSQSFIEKAKTVRKTLGGGMRQIGVLCAAALVALQENLPKLQHDHKKAKLLAEGLNQMKGIRVNVAAVETNMDGSRLTAEKLRKNLEENGILLIRGNSSRIRIVIHHQITTSDVHYTLSCFQQAMLTMQEPSRT

SEQ ID NO: 1281 - DNA, 1071 bp, Streptomyces coelicolor
  CDS (1)..(1071)
atgaacccaccgaagaccgacgcgcgtcgccatcacgaccccgaggtccgcggtttcgccagtgacaactacgccggggctcacccggaagtactcgccgcgctggcgctggccaacggcgggcaccaggtcgcgtacggcgaggacgactacaccgagaacctccagcgcgtgatccgcagccacttcggctccggcgccgaggcgttcccggtcttcaacggcaccggcgccaacgtcgtcgcgctccaggcggtcaccgaccgctggggcgcggtgatctgcgccgagagcgcgcacatcaacgtcgacgagggcggcgcccccgagcgcatgggcggcctcaagctgctcaccgtccccacccccgacggcaagctcacgcccgagctgatcgaccgccaggcctacggctgggacgacgagcaccgggcgatgccgcaggtcgtctcgatcacccagagcaccgagctgggcaccctctacacgcccgacgagatccgcgccgtctgcgagcacgcccacgcgcacggcatgaaggtgcacctggacggctcccggatagccaacgccgccgcctcgctggacgtgcccatgcgcacgttcaccaacgcggtcggcgtcgacctcctctccctcggcggcaccaagaacggcgcgctgttcggcgaggcggtcgtcgtcctgaaccaggacgccgtgcgccacatgaagcacctgcgcaagctgtccatgcagctggcctccaagatgcgcttcgtgtccgtgcagctggaggcgctgctggccaaggacctgtggctgcgcaacgcccggcactccaacgagatggcccagcgcctggccgagggcgtgcgcgccgtgcacggcgtggagatcctctacccggtgcaggccaacgcggtcttcgcccggctgccgcacgaggtgagcgagcgcctgcagaagcggttccgcttctacttctgggacgaggccgccggcgacgtgcgctggatgtgcgccttcgacaccaccgagaacgacgtcgacgctttcgtgtccgccctcaaggaagagatggcgcgctga

SEQ ID NO: 1282 - protein, 356 aa, Streptomyces coelicolor
MNPPKTDARRHHDPEVRGFASDNYAGAHPEVLAALALANGGHQVAYGEDDYTENLQRVIRSHFGSGAEAFPVFNGTGANVVALQAVTDRWGAVICAESAHINVDEGGAPERMGGLKLLTVPTPDGKLTPELIDRQAYGWDDEHRAMPQVVSITQSTELGTLYTPDEIRAVCEHAHAHGMKVHLDGSRIANAAASLDVPMRTFTNAVGVDLLSLGGTKNGALFGEAVVVLNQDAVRHMKHLRKLSMQLASKMRFVSVQLEALLAKDLWLRNARHSNEMAQRLAEGVRAVHGVEILYPVQANAVFARLPHEVSERLQKRFRFYFWDEAAGDVRWMCAFDTTENDVDAFVSALKEEMAR

SEQ ID NO: 1283 - DNA, 1113 bp, Arabidopsis thaliana
  CDS (1)..(1113)
atggtgacgccaactacaattagaaccgtcgatctccgctccgacacggtgactaaaccaacagagtcaatgcgttcagcaatggcaaacgcggaagtagacgacgacgttttgggaaacgatccaacggctctgcgtttggagaaagaggtggctgagatcgctggaaaagaggcggcgatgtttgttccgtcagggacaatggggaatctgataagcgtgttggtccattgtgatgagagagggagtgaagtgattcttggagacgactctcacattcatatatatgaaaacggcggcgtttcaagcctcggtggtgtgcatccgaggacggtgaagaatgaggaagacggtacgatggagattggtgctattgaagctgccgtgaggagtcccaaaggagatctccatcatccggttactaagcttatatgtcttgagaatactcaagcaaattgtggaggtagatgccttcctatagaatatatagacaaagtcggagaattagccaagaaacatggtttgaagcttcacattgacggagctaggattttcaacgcttctgtggcacttggagttcccgtgaagaggattgttcaagcagctgattctgtctcgatctgtttgtcgaaaggtattggtgcaccggtcggttcggtaatcgtgggaagcaagaagttcattactaaagcaaggtggttaaggaaaacattaggcggaggaatgagacagatcggcgtgctctgcgccgccgcattggtggctctccatgaaaacgtcgccaagctcgaagatgaccataagaaagccagggttttggcagaaggactgaaccggattgaacggttaagagtgaacgttgcagctgtggaaaccaacatcgtaaatccaaaatttggagcagaagaggcatgtaagagcttggaagatgtcggtgtgcttgtcataccccaagctacattcagaatcaggattgttctacaccaccaaatctcagacgtcgacgtggaatatgtactctcttgctttgaggtatgtagtttgctttcatctactgatatgtgctttgatatttttaatttctttgctacgctttattcattcattgattaa

SEQ ID NO: 1284 - protein, 370 aa, Arabidopsis thaliana
MVTPTTIRTVDLRSDTVTKPTESMRSAMANAEVDDDVLGNDPTALRLEKEVAEIAGKEAAMFVPSGTMGNLISVLVHCDERGSEVILGDDSHIHIYENGGVSSLGGVHPRTVKNEEDGTMEIGAIEAAVRSPKGDLHHPVTKLICLENTQANCGGRCLPIEYIDKVGELAKKHGLKLHIDGARIFNASVALGVPVKRIVQAADSVSICLSKGIGAPVGSVIVGSKKFITKARWLRKTLGGGMRQIGVLCAAALVALHENVAKLEDDHKKARVLAEGLNRIERLRVNVAAVETNIVNPKFGAEEACKSLEDVGVLVIPQATFRIRIVLHHQISDVDVEYVLSCFEVCSLLSSTDMCFDIFNFFATLYSFID

SEQ ID NO: 1285 - DNA, 1327 bp, Drosophila melanogaster
  CDS (79)..(1230)
agtttttcgctagctctgaacggagcacgttgtgtgatttttttcgcttagtttttttatcaattaggtttccaaaaaatgaccacccattccgttgttgacctgcgctcggacaccgtcagccagccgacggacaagatgcgggcccggatggccaccgccgtggtcggggatgacgtttatggcgaggatcccaccgtcaacgaactggaggcgcgaacagcggccattttcggcaaggaggcgggcctctttgtgcccagcggcaccatgggaaatctactggcaattatggttcactgccatcgtcgtggcacggaggccctggtcggcgatttatcgcacatctttctgtacgaacaaggtggcgcctcgcatttggccggagtccaattagccactctgaagaacgagcaggatggcacctttagtctgcaggatctgcgccgcaggatacgccacgaagactgccacgagcccatcacctcgctggtggtggtggagcagacccacaatatctgcggtggcaaagtggtgcctctggccttcttggatgagctagctgctctggtccgacagccgggcgtgggcactgggaacgcccgtatcgctctacacatggacggagcgagggtctttaatgcggccaccgccttgggcgtgggagtggagcgcatctgccgcgatttcgattcggtatctatctgcctcagcaagggcttatcggctcccgtgggatccgtgttagtcggctccaaggccttcatttcggaagcccatcgactgcgcaaagctttgggaggcggaatgcggcaggtgggagtgttagcagcagctggactggtagctttggatgaagtggtaccacttctgagcaaagatcacgagcggaccaataaaattgccaacgctatatatgaactgaaaagtcccaacattaccgtacacgtgtcgtctgtccagagcaatatccttctggtagagataacccaacccaaactgacggccagtgagttctccacccggttgagcatcgttgatgctggtgaagtggaagccggagtgaaggacaaaaacggagccggaatcgtggtgaaggctagtgcccgggattgggcatttgcgagacttgtgctctaccatcaggtggacgatgagcaagtggacctggccatcaggaagctgaagtacgtcatcggccagtacgacaagcaatttcccaggacctagacatttgtaattcttttgaatattactggaaagacaaacacaattagattttgcattttgtcgtttaattaaagacatagagggagcaaaagaagat

SEQ ID NO: 1286 - protein, 383 aa, Drosophila melanogaster
MTTHSVVDLRSDTVSQPTDKMRARMATAVVGDDVYGEDPTVNELEARTAAIFGKEAGLFVPSGTMGNLLAIMVHCHRRGTEALVGDLSHIFLYEQGGASHLAGVQLATLKNEQDGTFSLQDLRRRIRHEDCHEPITSLVVVEQTHNICGGKVVPLAFLDELAALVRQPGVGTGNARIALHMDGARVFNAATALGVGVERICRDFDSVSICLSKGLSAPVGSVLVGSKAFISEAHRLRKALGGGMRQVGVLAAAGLVALDEVVPLLSKDHERTNKIANAIYELKSPNITVHVSSVQSNILLVEITQPKLTASEFSTRLSIVDAGEVEAGVKDKNGAGIVVKASARDWAFARLVLYHQVDDEQVDLAIRKLKYVIGQYDKQFPRT

SEQ ID NO: 1287 - DNA, 1014 bp, Zymomonas mobilis
  CDS (1)..(1014)
atgcaaagtattcgtttcttttccgataacgctgccactgtcgcagcccccgtcatggatgctattatcgccgccaatcaaagcgacatggcttatgattccgataaatggagtcagaaacttgacgctattttctcggaattattcggaacagacgtaacggctcattgggcagtcaccggaacggcggccaatgccctgtctttatccgctatctgcccgccttttgggggtgttttatgcagtcaggatgcccatgtccaaacggatgaggggggcgctcctgaattttacaccggcggttccaaattgctgttggttccgggcgaaggcgctaaaattacgcccgaagccttaaagacaagagccgaagcgattgctgacagcgtccatatggtgcaacctcatgcggtgaccattaccaattcaactgaattaggtcaggtttacacgccagaagaaacagcggctattggtgccgttgcccgtgaaaaaggcttgcgtttccatctggatggcgcccgttttgctaatgcggttgctgctctcggctgcaatccggctgatctgacatggaaagccggtgttgatttgatgagcttcggctttaccaaaaatggtgccatggccgcagaagcgatcgttttcttcgatcgtgagcttgctgcccacaataaacgtcgccggaaacgggccggtcatttgctgtccaaaggtcgcttcattgccgcccaaatcgaagccatgttgaaaaatgatttatggcttgatctggcgcgttcttccaataccgttgccaaacggattgcagaagccgttgatcccaaaagacatgcctatccggtcaaagccaatgaagtcttcttattcatctcgatggaagaacgggcagaattgcggaaacagggctttgttttctatgactggggtcatgacaaaatccgtctggttgcctcatgggatcagccagaacatgaagtcgttgcattagaaaaagccttaaaggctttataa

SEQ ID NO: 1288 - protein, 337 aa, Zymomonas mobilis
MQSIRFFSDNAATVAAPVMDAIIAANQSDMAYDSDKWSQKLDAIFSELFGTDVTAHWAVTGTAANALSLSAICPPFGGVLCSQDAHVQTDEGGAPEFYTGGSKLLLVPGEGAKITPEALKTRAEAIADSVHMVQPHAVTITNSTELGQVYTPEETAAIGAVAREKGLRFHLDGARFANAVAALGCNPADLTWKAGVDLMSFGFTKNGAMAAEAIVFFDRELAAHNKRRRKRAGHLLSKGRFIAAQIEAMLKNDLWLDLARSSNTVAKRIAEAVDPKRHAYPVKANEVFLFISMEERAELRKQGFVFYDWGHDKIRLVASWDQPEHEVVALEKALKAL

SEQ ID NO: 1289 - DNA, 1149 bp, Ashbya gossypii
  CDS (1)..(1149)
atgaatcaggatatggaactaccagaggcgtacacgtcggtttcgaacgacttccgttcggacacgttcaccactccaacgcgcgaaatgatcgaggctgcgctaacggcgaccatcggtgacgccgtctaccaagaggacatcgacacgttgaagctagaacagcacgtcgccaagctggccggcatggaggccggtatgttctgcgtatctggtactttgtccaaccagattgctttgcggacccacctaactcagccaccatattcgattctttgcgactaccgtgcgcatgtgtacacgcacgaggctgcggggttggcaattttgtcccaggccatggtgacacctgtcattccttccaacggcaactacttgactttggaagacatcaagaagcactacattcctgatgatggcgacatccacggtgctccaacaaaggttatctcgttggaaaacaccttgcacggtatcattcacccactagaggagcttgttcggatcaaggcttggtgtatggagaacgacctcagactacactgcgatggtgcgagaatctggaacgcgtccgcagaatccggtgtgcctctaaaacagtacggagagctattcgactccatttccatctgcttgtccaagtccatgggtgccccaatgggctccattctcgtcgggtcgcacaagttcataaagaaggcgaaccacttcagaaagcagcaaggtggtggtgtcagacagtctggtatgatgtgcaagatggcgatggtggctatccagggtgactggaagggcaagatgaggcgttcgcacagaatggctcacgagctggccagattttgcgcagagcacggcatcccattggagtcgcctgctgacaccaactttgtctttttggacttgcagaagagcaagatgaaccctgacgtgctcgtcaagaagagtttgaagtacggctgcaagctaatgggcgggcgtgtctccttccactaccagatatctgaggagtcccttgagaagatcaagcaggccatcctagaggcgttcgagtactcgaagaagaacccttacgatgaaaacggccccacgaagatctacagaagtgagtccgctgacgctgtgggtgagatcaagacctacaagtattaa

SEQ ID NO: 1290 - protein, 382 aa, Ashbya gossypii
MNQDMELPEAYTSVSNDFRSDTFTTPTREMIEAALTATIGDAVYQEDIDTLKLEQHVAKLAGMEAGMFCVSGTLSNQIALRTHLTQPPYSILCDYRAHVYTHEAAGLAILSQAMVTPVIPSNGNYLTLEDIKKHYIPDDGDIHGAPTKVISLENTLHGIIHPLEELVRIKAWCMENDLRLHCDGARIWNASAESGVPLKQYGELFDSISICLSKSMGAPMGSILVGSHKFIKKANHFRKQQGGGVRQSGMMCKMAMVAIQGDWKGKMRRSHRMAHELARFCAEHGIPLESPADTNFVFLDLQKSKMNPDVLVKKSLKYGCKLMGGRVSFHYQISEESLEKIKQAILEAFEYSKKNPYDENGPTKIYRSESADAVGEIKTYKY

SEQ ID NO: 1291 - DNA, 1530 bp, Candida albicans
  CDS (117)..(1241)
aagcttttggtttgctattttggtttaatagattaataaccttttttcctttttcctttccttttcccttttttttgcatctatacgacacatattactcagcacaccacattaatatgacagcagacgaagaagaaacttttaccacctttaatgagttcagaagcgatacattcactgttccaactagggccatggttgaagatggatttatgaatgccacatttggtgattccgtataccaagaagacgaaaccacattacgtttggaaagtaaaatgtgtgagataactgggaaaccagcagctttattttgtgttagtggaaccatgtcaaatcaaattggattaagagctaatcttgttcaacctccatatagtatattatgtgactaccgtgctcatgtgtttttacatgaagctggtggattggctacattgagtcaagctatggtacatccagttcgaccatcaaatggaaattacttgacctttgaagatgttttgggcaatgtaacttatgatgatgatggagatattcatgctgctccaaccaaagtaatctcattggaaaataccttacacggaatcataattccaatagaagaaatacgtaaaatcagtgaattttgtcgtgaaaatgatatcaggttgcatttagacggggccagattatggaatgctagtgtggcaaccggaattagtattaaagaatactgttcatattttgacagtgtttcattgtgtttatccaagtcattgggagcaccaattggttcagtattggttggagatgaaaaattcattcgtaaagctaaccatttcaaaaaacaaagtggtggaggaataaggcaggccggtataatgtctgctatggccatacatgctattgattataatctttcaaaacttgaattatcacacaattatgctaaacaaattggcgacttttgccaagaacacggaatcaaattggaatcaccagtggataccagtcttgtgtttctcgatttgaaggccaataaaatggatccgaatagattagttgaattgggaagaacaaagtataacgtcaagcttatgggacaaagaatagcatgtcatttccaattgagtcaagaaagtgttgataatgtgaagaaatgtattttagagtgtttggaatatcatcaaaaacatcctcataaagatgatggtaggaataataagaagatgtatagtttggacgccattaaaaaataaatgaattgtaatgagtctattcttgtcgtagtattgtaaaactgtctcttgttgtttggttgcaattgcacgtggcaaatttaagttgtatgcttttttctttggggcaattgtcgtttttttttttgggtgacgcttcttggtgtaatttggtgtgtgtatctattgttgtttgttttttgggcaaatatatatttatcacttattattcatccatccatcgattaattagcaatcgtttattttactttatttcgagtttactttttcctttttttacttttctttt

SEQ ID NO: 1292 - protein, 374 aa, Candida albicans
MTADEEETFTTFNEFRSDTFTVPTRAMVEDGFMNATFGDSVYQEDETTLRLESKMCEITGKPAALFCVSGTMSNQIGLRANLVQPPYSILCDYRAHVFLHEAGGLATLSQAMVHPVRPSNGNYLTFEDVLGNVTYDDDGDIHAAPTKVISLENTLHGIIIPIEEIRKISEFCRENDIRLHLDGARLWNASVATGISIKEYCSYFDSVSLCLSKSLGAPIGSVLVGDEKFIRKANHFKKQSGGGIRQAGIMSAMAIHAIDYNLSKLELSHNYAKQIGDFCQEHGIKLESPVDTSLVFLDLKANKMDPNRLVELGRTKYNVKLMGQRIACHFQLSQESVDNVKKCILECLEYHQKHPHKDDGRNNKKMYSLDAIKK

SEQ ID NO: 1293 - DNA, 1041 bp, Pseudomonas sp
  CDS (1)..(1041)
atgaccgatcaaagccaacaattcgccagcgacaactattccggtatctgccccgaagcctgggccgccatggaaaaggccaaccacggccacgaacgtgcctatggcgacgaccaatggaccgcacgggcagccgatcactttcgcaagctgtttgaaaccgactgcgaagtgttctttgccttcaacggcaccgccgccaactcgctggcgctatcgtcgttgtgccagagctaccacagcgtgatctgctcggagaccgcccacgtcgaaaccgacgaatgcggcgcgccggagtttttctccaacggttccaagctgctgaccgcccgcagcgaaggcggcaagctgaccccggcttcgatccgcgaagtagcgctcaagcgccaggacatccactaccccaaaccccgggtagtgaccatcacccaggctaccgaggtgggcagcgtctaccgcccggatgaactcaaggcgatcagcgccacctgcaaggaactgggcctgaacctgcacatggacggtgctcgtttcagcaacgcctgcgccttcctcggctgcaccccggccgagctgacctggaaggccggtatcgacgtgctgtgctttggcggcaccaaaaacggcatggcggtgggtgaggcgatcctgttcttcaaccgcaaactggccgaggacttcgactaccgttgcaagcaggccgggcaactggcgtcgaaaatgcgcttcctctcggcgccctgggtaggcctgctggaggacggcgcctggctgcgccacgccgcccatgccaaccactgcgcacaattgctcagctcgctggtcgcggacatccccggcgttgaactgatgttcccggtggaggccaacggtgtattcctgcaaatgtcggaacccgccctggaagcattgcgcaacaagggctggcgtttttacaccttcatcggcagcggcggcgcccggttcatgtgctcctgggacaccgaggaagcccgggtacgcgaactggcggcagatatccgcgccgtgatgagcgcctga

SEQ ID NO: 1294 - protein, 346 aa, Pseudomonas sp
MTDQSQQFASDNYSGICPEAWAAMEKANHGHERAYGDDQWTARAADHFRKLFETDCEVFFAFNGTAANSLALSSLCQSYHSVICSETAHVETDECGAPEFFSNGSKLLTARSEGGKLTPASIREVALKRQDIHYPKPRVVTITQATEVGSVYRPDELKAISATCKELGLNLHMDGARFSNACAFLGCTPAELTWKAGIDVLCFGGTKNGMAVGEAILFFNRKLAEDFDYRCKQAGQLASKMRFLSAPWVGLLEDGAWLRHAAHANHCAQLLSSLVADIPGVELMFPVEANGVFLQMSEPALEALRNKGWRFYTFIGSGGARFMCSWDTEEARVRELAADIRAVMSA

SEQ ID NO: 1295 - DNA, 1170 bp, Cochliobolus carbonum
  CDS (1)..(1170)
atgtcgaacatggttttgaatggaaacattgacaaatccgataggaattccatactagacatacttcaatcgcttgagaatattgcatggggacaaccaggctctgcaaggtgcgattttaggagtgatgttattacacgccctagccttaggatgttgtccgcggtcctcaagactacactcggcgatgacgtatttcgagaagacctaacgactgcccacttcgaagcgcatgtggctgaaatcagcggccgagaagaaggcatgttcgtgatcacagggacgatggccaatcagctttgtttgcatgctctagtctcaactagaccgtgtgggattttacttagctcagagtcccatgccatacactatgaggcaggtggctcttcgatgcttagcggcgccatgcttcagcctgtgcagccgtcgaatggtaaatatctgagagtggaagatttggaggagcacgcaattctaaccgacgatgtccacaaatgccccacaagcattgtttctatggaaaatacagctggtggagcagtcgttcctgtccatgagctccgccgcatccgggattgggcaaagcaaaataacgtgaggactcacctggacggtgctagacttttcgaggctgttgctaccggtgctgggactctcaaagaatattgcagccttattgacctagtctccgtggattttagtaagaatcttggagccccaatgggcgcaatgattcttggtgacaaaaaattgattcagcagatgcgaagaactcgaaaagggattggaggaggaatgagacaaggaggggtaatcactgcagctgcacgggaggcactgtttgaaaactttggactgggagcggaaatcgaaagtcaaaccctattgcaagtgcacaaagtcgcaaagcgtctaggggaagaatggactagaaaaggtgggaagttgagcaaagagatcgagacaaatatcatatggctcgatcttgatgcggttggaattaagaaaagtcaatttattgataagggaagggaatatggggtgattctagacggctgtcgcattgtttgccatcaccagattgatatatatgcagtagaggctcttatcgacgtcttccatgatatactaaaagcagatcctatcaaaaacaagaatagcgatagatag

SEQ ID NO: 1296 - protein, 389 aa, Cochliobolus carbonum
MSNMVLNGNIDKSDRNSILDILQSLENIAWGQPGSARCDFRSDVITRPSLRMLSAVLKTTLGDDVFREDLTTAHFEAHVAEISGREEGMFVITGTMANQLCLHALVSTRPCGILLSSESHAIHYEAGGSSMLSGAMLQPVQPSNGKYLRVEDLEEHAILTDDVHKCPTSIVSMENTAGGAVVPVHELRRIRDWAKQNNVRTHLDGARLFEAVATGAGTLKEYCSLIDLVSVDFSKNLGAPMGAMILGDKKLIQQMRRTRKGIGGGMRQGGVITAAAREALFENFGLGAEIESQTLLQVHKVAKRLGEEWTRKGGKLSKEIETNIIWLDLDAVGIKKSQFIDKGREYGVILDGCRIVCHHQIDIYAVEALIDVFHDILKADPIKNKNSDR

SEQ ID NO: 1297 - DNA, 25 bp, artificial sequence
  Primer
atgactgaattcgaattgcctccaa

SEQ ID NO: 1298 - DNA, 26 bp, artificial sequence
  Primer
tcagtatttgtaggtttttatttcgc

SEQ ID NO: 1299 - protein, 66 aa, artificial sequence
  MISC_FEATURE (1)..(66): consensus for the disclosure of Xaa see table VIII
XXXXGXXXXGXXXXXXXXXXXXXXXXXXXXXXXXXXXXXXXXXXXXXXXXXXXXXXXXXXXXXXXX

SEQ ID NO: 1300 - protein, 65 aa, artificial sequence
  MISC_FEATURE (1)..(65): consensus for the disclosure of Xaa see table VIII
XXXXADGXXSXXXXXXXXXXXXXXXXXXXXXXXXXXXXXXXXXXXXXXXXXXXXXXXXXXXXXPX

SEQ ID NO: 1301 - protein, 105 aa, artificial sequence
  MISC_FEATURE (1)..(105): consensus for the disclosure of Xaa see table VIII
XXXXXXXXXXXXXXXXXGXXAXXXXPXXXXGXNXXXXXXXXXXXXXXXXXXXXXXXXXXXXXXXXXXXXXXXXXXXXXXXXXXXXXXXXXXXXXXXXXXXRXXXX

SEQ ID NO: 1302 - protein, 851 aa, artificial sequence
  MISC_FEATURE (1)..(851): consensus Xaa in all Positions is any amino acid
XXXXXXXXXXXXXXXXXXXXXXXXXXXXXXXXXXXXXXXXXXXXXXXXXXXXXXXXXXXXXXXXXXXXXXXXXXXXXXXXXGGGXXGXXXAXXXXXXXXXXXXXXXXXXXXXXXXXXXXXXXXXXXXXXXXXXXRXXAXXXXXXXXXXXXXXXWXXXXXXXXXXXXXXXXXXXXXXXXXXXXXXXXXXXXXXXXXXXXXXXXXXXXXXXXEXXXXXXXLXXXXXXXXXXXXXXXXXXXXXXXXXXXXXXXXXXXXXXXXXXXXXXXXXXXXXXXXXXXXXXXXLXXXXXXXXXXXXXXXXLXXXADGXXSXXRXXXXXXXXXXXXYXXXXXXXXXXXXXXXXXXXXXXXXXXXFXXXGXXAXLPXXXXXXXXXXXXXXXXXXXXXXXXXXXXXXXXXXXXXXVWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPLXXXXXXXXXXXXXXLXGXAAXXXHPXAGQGXNLGXXDXXXLXXXXXXXXXXXXXXXXXXXXXXLXXYXXXRXXXXXXXXXXXXXXXXXXXXXXXXXXXXRXXXLXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 1303 - protein, 266 aa, artificial sequence
  MISC_FEATURE (1)..(266): consensus for the disclosure of Xaa see table VIII
DAXEAXXXEXXMXLXXALXXYPKAAXWSXLVSTTLXXEGYDTAXLXXXYALPXFQXKXGXXNXXXGXXEIXXXWQIGLXXCXXXGEXXGLQXTXXXVXXMGNRYTXIXALXXLXAXXFILYXCXXLXMIAVGQXLXXXPWGCFQXLXVXYASEXCPLALRYYXTXYSNXCWXFGQXFAXGIMKNSQXXXXXSXLGYKLPFALQWIXPXPLXXGIFXAPESPWWLVXKXRXXXARXSLXRXLSGKGXEKXXXVXXXXXXIXXTIXKE

SEQ ID NO: 1304 - protein, 89 aa, artificial sequence
  MISC_FEATURE (1)..(89): consensus for the disclosure of Xaa see table VIII
NXRRTRXXCLXWXXQXXXGXXLXGXSTYFXEXAGXXTXXAFTFSXIQYCLGXXXTXXSWXXSXXXGRXXXXXXGLAXQXXXXFIIGGXG

SEQ ID NO: 1305 - protein, 125 aa, artificial sequence
  MISC_FEATURE (1)..(125): consensus for the disclosure of Xaa see table VIII
XXXGXGXLLXXXXFFYNXGIXXVVXCXVXEXPSXXLRTKXIXLARXXYNXXXXXXXXLXXYXLNXXXWNWGAKXGXXWGXXXXXTLXWXXXDLPETXGXTFXEINELFXXGVXARKFXSTXVDPF

SEQ ID NO: 1306 - protein, 622 aa, artificial sequence
  MISC_FEATURE (1)..(622): consensus Xaa in all Positions is any amino acid
MKXLSXLINRXKXXXXXXXXXXXXXXXXXXXXXXEXXXIEMXXQXKKXXXDXXHXEXXPXXXXPXDXNXXXXXXXDXXXXXXDAKEADESERGMPLXTALXTYPKAAAWSLLVSTTLIXEGYDTAILGAFYALPXFQXKXGSXNXXTGXXEISXSWQIGLXLCXXAGEIVGLQXTGPXVDXXGNRYTLIXALXXLAAFXFILYFCXSLGMIAVGQXLCGMPWGCFQCLTVSYASEICPLALRYYLTTYSNLCWXFGQLFAAGIMKNSQXKYXXSELGYKLPFALQWIXPXPLAXGIFFAPESPWWLVKKGRXDXARRSLXRXLSGKGPEKEXLVXXEXDXIKXTIXKEXXLXXXEGXYXDCXXDXXNRRRTRIXCLCWXGQXXCGXXLIGYSTYFYEKAGVXTXXXFTFSIIQYCLGIXATFXSWWASKYXGRXDLYAFGLAFQXXXXFIIGGLGCSXXHGXXMGSGXLLMXXXFFYNLGIAPVVFCLVSEXPSSRLRTKTIILARNXYNXXXXXXXVLIXYQLNSXKWNWGAKSGFFWGXXCXXTLXWAVXDLPETAGXTFXEINELFXLGVXARKFKSTKVDPFXXXKXXXXXXXXXXPXXXXXXXXXXXXXXXXXXXXX

SEQ ID NO: 1307 - protein, 65 aa, artificial sequence
  MISC_FEATURE (1)..(65): consensus for the disclosure of Xaa see table VIII
RHGXXXXXXXXXXXXXXXXXXLXXXXXXXXXXXXXXXXXXXXXXXXXXXXXXXXXXSXXXRXXXT

SEQ ID NO: 1308 - protein, 43 aa, artificial sequence
  MISC_FEATURE (1)..(43): consensus for the disclosure of Xaa see table VIII
XXXXXXXXXXXXXXXXXXXXXXXXGXXXXXXXXXXXXXXXXXX

SEQ ID NO: 1309 - protein, 14 aa, artificial sequence
  MISC_FEATURE (1)..(14): consensus for the disclosure of Xaa see table VIII
XXXXSGXTGXXKXX

SEQ ID NO: 1310 - protein, 55 aa, artificial sequence
  MISC_FEATURE (1)..(55): consensus for the disclosure of Xaa see table VIII
XXXXDXXXXXXXXXXXXXXXRXXXXXXXXGXXXXXXXXXXXXXXXXXXXXXXXXX

SEQ ID NO: 1311 - protein, 14 aa, artificial sequence
  MISC_FEATURE (1)..(14): consensus for the disclosure of Xaa see table VIII
XPXXXXXKXXXXXX

SEQ ID NO: 1312 - protein, 1077 aa, artificial sequence
  MISC_FEATURE (1)..(1077): consensus Xaa in all Positions is any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXXXXNXXXXXXXXXXXXXXXXXXXXXAXXXXXXXXXXXXXXXXXXXXXXXXLXXXXXXXXXXLXXXXXXXXGXXXGDXVXXXXPXXXXXXXXXLAXXXXGAXXXXXFXXFXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYTSGXTGXPKGXXXXXXXXXXXXXXXXXXXXXXXXXXXXXXXXXXXXXXXXDXGWXXXXXXXXXXXLXXGXXXXXXXGXXXXXXXXXXXXXXXXXXXXXXXXXXXXXPTXXRXXXXXXXXXXXXXXXXXXXXXXXLXXXXXXGEXXXXXXXXWXXXXXXXXXXXXXXXXXXXXXXXTEXXXXXXXXXXXXXXXXXXXXXXXXXXXXXXXXXXXGXXXXXXXXXGXXXXXXXXXXXXXXXXXXXXXXXXXXXGXXXXXXXXXXPXXXXXXXXXXXXXXXXXXXXXXXXXXXXXXXXXXXXXXXXGDXXXXDXXXGXXXXXGRXDDXXXXXGXRXXXXEXEXXXXXXXXXXEXAXXGXXXXXXGXXXXXXXXLXXXXXXXXXXXXXXXXXXXXXXXXXXXXXXXXXXXXXXXXXXXXXXXXXXXXXXXXXXLPKTXSGKIXRXXXXXXXXXXXXXXXXXXXXXXXXXXXXXXXXXXXXXXXXXXXXXXXXXXXXXXXXXX

SEQ ID NO: 1313 - protein, 94 aa, artificial sequence
  MISC_FEATURE (1)..(94): consensus for the disclosure of Xaa see table VIII
XXXXXXXXXXXXXXXXXXXXXXXXXXXXXXXXXXXXXXXXXXXXXXXXXXXXXXXXXXGXXXXXXXXXXXXXXXXXXXXXXXXXXHXXXXEXXX

SEQ ID NO: 1314 - protein, 89 aa, artificial sequence
  MISC_FEATURE (1)..(89): consensus for the disclosure of Xaa see table VIII
GXXXXXXXXXXXXXXXXXXXXXXXXDGXRXXXXXXXXXXXXXXXXXXXXXXXDXXXXXXXKXXXXXXXXXXXXXXXXXXXXXXXXXXXX

SEQ ID NO: 1315 - protein, 464 aa, artificial sequence
  MISC_FEATURE (1)..(464): consensus Xaa in all Positions is any amino acid
XXXXXXXXXXXXXXXXXXXXXXXXXXXXXXXXXXXXXXXXXXXXSDXXXXXXXXXXXXXXXXXXXXXXXXYGXDXXXXXXXXXXXXXXXXXXXXXXXXXFXXXGTXXNXXXXXXXXXXXXXXXXXXXXXXHXXXXEXGXXXXXXXXXXXXXXXXXXXXXXXXXXXXXXXXXXXXXXXXHXXXXXXXXXXXXXXXXXGXXXXXXXXXXXXXXXXXXXXXXXHXDGARXXXAXXXXXXXXXXXXXXXXXXXDXXXXXXXKXXXXXXXXXXXXXXXXXXXXXXXXKXXGXXXXXXXXXXXXXXXXXXXXXXXXXXXXXXXXXXXXXXAXXXXXXXXXXXXXXXXXXXXXXXXXXNXXXXXXXXXXXXXXXXXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXXXXX

SEQ ID NO: 1316 - protein, 122 aa, artificial sequence
  MISC_FEATURE (1)..(122): consensus for the disclosure of Xaa see table VIII
XXRSDXXTXPXXXXXXXXXXXXXXXXDXVXXEDXXTXXXEXXXXXXXGXXXXXXXXXXXXXXXTXXNQXXXXXXXXXXXXXXXXXXXXXHXXXXEXXXXXXXXXAXXXPXXXXNXXXXXXXX

SEQ ID NO: 1317 - protein, 50 aa, artificial sequence
  MISC_FEATURE (1)..(50): consensus for the disclosure of Xaa see table VIII
XXXXXPTXXXXXENTXXGXXXPXXEXXXXXXXXXXXXXXXHXDGARXXXX

SEQ ID NO: 1318 - protein, 62 aa, artificial sequence
  MISC_FEATURE (1)..(62): consensus for the disclosure of Xaa see table VIII
XXXXXXXXDXXXXXXXKXXXAPXGXXXXXXXXXXXXXXXXXXXXGGGXRXXGXXXXXXXXXX

SEQ ID NO: 1319 - protein, 65 aa, artificial sequence
  MISC_FEATURE (1)..(65): consensus for the disclosure of Xaa see table VIII
XXXLXXXXXXXXXXXXXXXXXXXXXXXXXXXXXXXXXXXXXXRXXXHXXXXXXXXXXXXXXXXXX

SEQ ID NO: 1320 - protein, 432 aa, artificial sequence
  MISC_FEATURE (1)..(432): consensus Xaa on all Positions is any amino acid
XXXXXXXXXXXXXXXXXXXXXXXXXXXXXXXXXXXXXXXXRSDTXTXPTXXMXXXXXXXXXXXGDXVYXEDXXTXXXEXXXXXXXGXXXXXXXAXXFXVSGTXXNQXXXRXXLXXXPPXSILCDXRAHXXXXEAXGXAXLSQAXXXPXXPXNGXYXTXEDXXXXXXXXXXXDXHXXPTXXXXLENTXXGXXXPXXEXXXIXXXXXXXXXXXHXDGARXWXAXXXXXXXXXXXXXXXXXXFDSXSXCLSKXXXAPXGSXXVGXXXXXXXXXXXXKXXGGGXRQXGXXXXXAXXXXXXXXXXXXXXXXXXXXXXHXXAXXXXXXXXXXGXXLXXPXXTNXVXXDXXXXXXXXXXXXXXXXXXXXXXLXXXRXXXHXQXXXXXXXXXXKXXXXXXXXXXXXXXXXXXXXXXXXXXXXXXXXXXXXXXXXXXXXXX

SEQ ID NO: 1321 - protein, 432 aa, artificial sequence
  MISC_FEATURE (1)..(432): consensus Xaa in all Positions is any amino acid
XXXXXXXXXXXXXXXXXXXXXXXXXXXXXXXXXXXXXXXXRSDXXTXPXXXXXXXXXXXXXXXXDXVXXEDXXTXXXEXXXXXXXGXXXXXXXXXXXXXXXTXXNQXXXXXXXXXXXXXXXXXXXXXHXXXXEXXXXXXXXXAXXXPXXXXNXXXXXXXXXXXXXXXXXXXXXXXXPTXXXXXENTXXGXXXPXXEXXXXXXXXXXXXXXXHXDGARXXXXXXXXXXXXXXXXXXXXXXXDXXXXXXXKXXXAPXGXXXXXXXXXXXXXXXXXXXXGGGXRXXGXXXXXXXXXXXXXXXXXXXXXXXXXXXXXXXXXXXXXXXXXXXXXLXXXXXXXXXXXXXXXXXXXXXXXXXXXXXXXXXXXXXXRXXXHXXXXXXXXXXXXXXXXXXXXXXXXXXXXXXXXXXXXXXXXXXXXXXXXXXXXXXXXXXX

SEQ ID NO: 1322 - protein, 101 aa, artificial sequence
  MISC_FEATURE (1)..(101): consensus for the disclosure of Xaa see table VIII
GXXXXXXXXXXXXXXXXXXXXXXXXXXXXXHXDGARXXXAXXXXXXXXXXXXXXXXXDXXXXCXSKXXXXPXGSXXXGXXXXXXXAXXXXKXXGGGXRQXG

SEQ ID NO: 1323 - DNA, 1047 bp, Escherichia coli K12
  CDS (1)..(1047)
atgaacagaactgacgaactccgtactgcgcgtattgagagcctggtaacgcccgccgaactcgcgctacggtatcccgtaacgcctggcgtcgccacccatgtcaccgactcccgccgcagaattgaaaaaatactgaatggtgaagataagcgactgttggtcattattggcccctgctcgatccacgatctcaccgctgcaatggagtacgccacccgtctgcagtcgctgcgcaaccagtaccagtcacggctggaaatcgtaatgcgcacctattttgaaaaaccacgaactgttgtcggctggaaaggactaatctccgatccagatttaaacggcagctatcgggtaaatcacggtctggagctggcgcgcaaattacttttacaggtaaatgagctgggcgtcccaaccgcgaccgagttcctcgatatggtgaccggtcagtttattgctgatttaatcagttggggcgcgattggcgcacgtactaccgaaagtcagatccaccgcgaaatggcttcggcactctcctgtccggtaggttttaaaaatggtaccgatggcaatacgcggattgctgtggatgctatccgcgcagcccgcgccagccatatgttcctctcgccagacaaaaatggtcagatgaccatctatcagaccagcggcaacccgtatggccacattattatgcgtggcggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggcgattgctggaattatggcggaaagtttcctgcgcgaaggaacgcaaaaaatcgtcggcagtcagccgctcacttacggtcaatccattaccgacccgtgtctgggctgggaggataccgaacgcctggtcgaaaaactcgcctctgcggtagatacccgcttctga

SEQ ID NO: 1324 - protein, 348 aa, Escherichia coli K12
MNRTDELRTARIESLVTPAELALRYPVTPGVATHVTDSRRRIEKILNGEDKRLLVIIGPCSIHDLTAAMEYATRLQSLRNQYQSRLEIVMRTYFEKPRTVVGWKGLISDPDLNGSYRVNHGLELARKLLLQVNELGVPTATEFLDMVTGQFIADLISWGAIGARTTESQIHREMASALSCPVGFKNGTDGNTRIAVDAIRAARASHMFLSPDKNGQMTIYQTSGNPYGHIIMRGGKKPNYHADDIAAACDTLHEFDLPEHLVVDFSHGNCQKQHRRQLEVCEDICQQIRNGSTAIAGIMAESFLREGTQKIVGSQPLTYGQSITDPCLGWEDTERLVEKLASAVDTRF

SEQ ID NO: 1325 - DNA, 1235 bp, Salmonella typhimurium
  CDS (165)..(1235)
gtgtaaagtttttgatacgaaatgagggagattaatcgacgattgcgcatggtgtaaagtttattttacgaaatatggattgaaatctttactttttgtggtatggtttaaacatcctcgtggaggatcaactatcgcaaacaagaaaagacaggatcgccatcatgcaaaaagacgcgctgaataacgtacgtatcaccgatgaacaggtattaatgacgccggagcagcttaaagcggcctttcccttgagcctggcgcaggaagcccagatagcgcagtcccggggaatcatttctgacattattgccgggcgcgatccgcgtctcttggtggtatgcggtccttgttctattcacgatcctgaaaccgctctggaatatgcccgtcgatttaaagcccttgccgcagaggtcagcgatagcctctatctggtaatgcgcgtctattttgaaaagccgcgaactaccgtcggctggaaagggctgattaacgatcctcacatggatggctcatttgatgtggaagccgggttgaaaatagcgcgtcagctactggtggaactggtgaatatggggttgccattggcgaccgaagcgttggatccgaacagcccgcaatacctgggcgatctgtttagctggtcggcgataggggcgcgcacaaccgaatcgcaaacccaccgcgaaatggcgtctggtctttctatgccggtcgcgtttaaaaacggcacggatggcagcctggcgacagcgattaacgccatgcgcgccgctgcgcaacctcatcgttttgttggcattaaccaggccggtcaggttgcgttattgcaaacccagggaaatccgcatggccatgtgattctgcgtggcggcaaagcgccgaactatagcccggcagatgtcgctcagtgtgaaaaagagatggaacaggcgggactacgtccttcgctgatggtagattgcagtcatggtaactccaataaagattatcgccgccagccagccgttgccgaatctgtggttgcgcagattaaagatggcaatcgttcaatcattggcttaatgattgaaagtaatattcatgagggtaaccagtcttccgaacagccgcgcagcgaaatgaagtatggcgtttccgtcaccgatgcttgtattagctgggagatgaccgatgccctgttacgtgaaattcataaagatttgagcggccagctggcggtgcgcgtcgcataa

SEQ ID NO: 1326 - protein, 356 aa, Salmonella typhimurium
MQKDALNNVRITDEQVLMTPEQLKAAFPLSLAQEAQIAQSRGIISDIIAGRDPRLLVVCGPCSIHDPETALEYARRFKALAAEVSDSLYLVMRVYFEKPRTTVGWKGLINDPHMDGSFDVEAGLKIARQLLVELVNMGLPLATEALDPNSPQYLGDLFSWSAIGARTTESQTHREMASGLSMPVAFKNGTDGSLATAINAMRAAAQPHRFVGINQAGQVALLQTQGNPHGHVILRGGKAPNYSPADVAQCEKEMEQAGLRPSLMVDCSHGNSNKDYRRQPAVAESVVAQIKDGNRSIIGLMIESNIHEGNQSSEQPRSEMKYGVSVTDACISWEMTDALLREIHKDLSGQLAVRVA

SEQ ID NO: 1327 - DNA, 1086 bp, Deinococcus radiodurans
  CDS (1)..(1086)
atgacccagccccccgccccctctaccaccgaaaacctcaacgtgaccggcttcacgccgctgatgaccccgcgtgaactcaaggccgaggtgccgctgaccgacgctgccgagcgcaccgtgctcgccggacgccgggcggcgcaggccatcctgagcggcgaggacgaccgcctactggtggttgtcgggccgtgcagcattcacgaccaggcgcaagcgctggagtacgccgggcggctcgcggcgctgcgtgagcgggtgaaagaccggctggaagtgcagatgcgcgtctacgtggacaaaccgcgcacgacggtgggctggcgcggctacctgctcgaccccgacatggacggcagcaacgacatgggcaagggcgtgcgccgcacccgcgagctgatggtggcggtgagcgaactcgggctgccggtggcgaccgaactgcttgaccccttcgcgccgcagtacctcttcgacgccgtagcctgggcctgcctgggcgcgcgcaccgccgagtcgcagacccaccgggtaatggcgagcgccgtcagtgccccgatgggcttcaagaacggcaccggcggcggtatcaagctcgcggtggacgcggtggtggccgccagtcacccgcacgcttttttcaccattgacgaagatgggcgcgccgcgattgtccacaccaagggcaacgcgcacgggcacgtcattttgcgcggcgggcgtgccggccccaactacgccccgcagttcgtgcaggaagcagcagacctgctgcgcgcggcgggccgcgaagaagccgtcatggtggactgctcgcacgccaactcggggtcggactggacccggcagcgcttggtgtggcgcgacgtgctgggccagcgcctcgccggacagcgcgccatccggggcgccatgctggagagcaacctgcaagccggcaaacagagcctgcctgccgacctcacgcagctcaagcccggcgtgagcgtcaccgacgcctgcgtgggctgggacgaaaccgaggccctgctgctggaggcccacgaacagctcagtggccgcgcggcactggcgacctgctga

SEQ ID NO: 1328 - protein, 361 aa, Deinococcus radiodurans
MTQPPAPSTTENLNVTGFTPLMTPRELKAEVPLTDAAERTVLAGRRAAQAILSGEDDRLLVVVGPCSIHDQAQALEYAGRLAALRERVKDRLEVQMRVYVDKPRTTVGWRGYLLDPDMDGSNDMGKGVRRTRELMVAVSELGLPVATELLDPFAPQYLFDAVAWACLGARTAESQTHRVMASAVSAPMGFKNGTGGGIKLAVDAVVAASHPHAFFTIDEDGRAAIVHTKGNAHGHVILRGGRAGPNYAPQFVQEAADLLRAAGREEAVMVDCSHANSGSDWTRQRLVWRDVLGQRLAGQRAIRGAMLESNLQAGKQSLPADLTQLKPGVSVTDACVGWDETEALLLEAHEQLSGRAALATC

SEQ ID NO: 1329 - DNA, 1056 bp, Neisseria meningitidis
  CDS (1)..(1056)
atgacacaccattaccccacagacgatattaagattaaagaagttaaagagttgttgccgccgattgcccatctttacgagctgccgatttccaaagaggcttcgggcttggttcaccgcacccgtcaggaaatttccgatttggttcacggcagggacaagcggctgttggttattatcgggccgtgttcgattcacgatccgaaagcggcgttggaatatgcggagcgtttgttgaaactccgcaagcagtatgaaaacgagcttttgattgtgatgcgcgtttatttcgagaagccgaggacgacggtgggttggaaaggtttgattaacgacccgcatttggacggtacgtttgacatcaatttcggtttgcgtcaggcacgcagcctgttgttgtcgctgaacaatatgggtatgcctgcctctaccgagtttttggatatgattacgccgcaatattatgcggacttgatttcttggggggcaatcggcgcgcggacgaccgaaagccaagttcaccgcgaattggcaagcgggctgtcctgccccgtcggctttaaaaacggtacggatggcaatttgaagattgccatcgacgcaatcggtgcggcgagccattcgcatcatttcctgtctgtaaccaaggccgggcattccgccattgtccataccggcggcaatcctgactgtcatgtcattttgcgcggcggaaaagagccgaattatgatgcgggacacgtcagcgaggcggcggaacaactgcgtgcggcaggcgtaaccgacaagctgatgattgattgcagccacgccaacagccgcaaggattacacccgacagatggaagtggcgcaagacattgccgcccaattggaacaggacggcggcaatattatgggcgtgatggtggaaagccatttggtcgaaggcaggcaggacaagccggaagtgtacggcaaaagcattaccgatgcgtgtattggttgggacgcgactgaagaactgttggcattgttggcaggtgcaaacaaaaaacgtatggcgcgcgccggttga

SEQ ID NO: 1330 - protein, 351 aa, Neisseria meningitidis
MTHHYPTDDIKIKEVKELLPPIAHLYELPISKEASGLVHRTRQEISDLVHGRDKRLLVIIGPCSIHDPKAALEYAERLLKLRKQYENELLIVMRVYFEKPRTTVGWKGLINDPHLDGTFDINFGLRQARSLLLSLNNMGMPASTEFLDMITPQYYADLISWGAIGARTTESQVHRELASGLSCPVGFKNGTDGNLKIAIDAIGAASHSHHFLSVTKAGHSAIVHTGGNPDCHVILRGGKEPNYDAGHVSEAAEQLRAAGVTDKLMIDCSHANSRKDYTRQMEVAQDIAAQLEQDGGNIMGVMVESHLVEGRQDKPEVYGKSITDACIGWDATEELLALLAGANKKRMARAG

SEQ ID NO: 1331 - DNA, 1047 bp, Yersinia pestis
  CDS (1)..(1047)
atgtacaagatagatgaactgcggaccgctcgcatcgatagcttgattacaccgcagcaactggctgaaaagttaccgatttctgaggttattgcagataacgtgacggcgtcacgtaaacgaatagagaaaatacttattggtgaagacccacgtctactcgtggtgattggcccctgctctattcacgaccttgatgcagccgttgattatgccacccggctcaaggtgctacgagaacgctatcaagaccggctggaaatcgtgatgcgcacctatttcgagaaaccacggactgtagtgggttggaaggggctgatttctgatccggcacttgacggctcatgccaggtgaacttgggtattgaactggcacgtaagctactgttagccgtgaatgaactcgggctgccgaccgctaccgagttcctcaatatggtaacaggccaatatattgccgacctcatcagttggggggcaataggcgcacgtaccaccgaaagccagatccaccgagagatggcctcggcactctcctgccccgtgggtttcaaaaatggtacagatggcaatgtgcgtattgctattgatgccattcgcgccgcacaagccagccatatgttcctttctccggataaaaccggccaaatgacgatttaccaaaccagtggtaacccctatgggcatattattatgcggggtggaaagcaacctaactatgatgcctctgatatcgcagccgcctgtgacagcttgcgggaatttgatttgccagaacatctggtggtagattttagccacggcaattgccagaagatgcatcgccgccagttggatgttgccgaaaatatcgggctacagatccgtgcgggttcaacagcgattgtcggtgttatggctgagagtttcctgattgagggcacacagaagattgttgccggacagcccttaacttatgggcaatccatcactgacccttgcctgaattgggatgatactgaacaactgttaagcctattggcagatgcagtagacagccggttttaa

SEQ ID NO: 1332 - protein, 348 aa, Yersinia pestis
MYKIDELRTARIDSLITPQQLAEKLPISEVIADNVTASRKRIEKILIGEDPRLLVVIGPCSIHDLDAAVDYATRLKVLRERYQDRLEIVMRTYFEKPRTVVGWKGLISDPALDGSCQVNLGIELARKLLLAVNELGLPTATEFLNMVTGQYIADLISWGAIGARTTESQIHREMASALSCPVGFKNGTDGNVRIAIDAIRAAQASHMFLSPDKTGQMTIYQTSGNPYGHIIMRGGKQPNYDASDIAAACDSLREFDLPEHLVVDFSHGNCQKMHRRQLDVAENIGLQIRAGSTAIVGVMAESFLIEGTQKIVAGQPLTYGQSITDPCLNWDDTEQLLSLLADAVDSRF

SEQ ID NO: 1333 - DNA, 1071 bp, Escherichia coli
  CDS (1)..(1071)
atgcaaaaagacgcgctgaataacgtacatattaccgacgaacaggttttaatgactccggaacaactgaaggccgcttttccattgagcctgcaacaagaagcccagattgctgactcgcgtaaaagcatttcagatattatcgccgggcgcgatcctcgtctgctggtagtatgtggtccttgttccattcatgatccggaaactgctctggaatatgctcgtcgatttaaagcccttgccgcagaggtcagcgatagcctctatctggtaatgcgcgtctattttgaaaaaccccgtaccactgtcggctggaaagggttaattaacgatccccatatggatggctcttttgatgtagaagccgggctgcagatcgcgcgtaaattgctgcttgagctggtgaatatgggactgccactggcgacggaagcgttagatccgaatagcccgcaatacctgggcgatctgtttagctggtcagcaattggtgctcgtacaacggaatcgcaaactcaccgtgaaatggcctccgggctttccatgccggttggttttaaaaacggcaccgacggcagtctggcaacagcaattaacgctatgcgcgccgccgcccagccgcaccgttttgttggcattaaccaggcagggcaggttgcgttgctacaaactcaggggaatccggacggccatgtgatcctgcgcggtggtaaagcgccgaactatagccctgcggatgttgcgcaatgtgaaaaagagatggaacaggcgggactgcgcccgtctctgatggtagattgcagccacggtaattccaataaagattatcgccgtcagcctgcggtggcagaatccgtggttgctcaaatcaaagatggcaatcgctcaattattggtctgatgatcgaaagtaatatccacgagggcaatcagtcttccgagcaaccgcgcagtgaaatgaaatacggtgtatccgtaaccgatgcctgcattagctgggaaatgaccgatgccttgctgcgtgaaattcatcaggatctgaacgggcagctgacggctcgcgtggcttaa

SEQ ID NO: 1334 - protein, 356 aa, Escherichia coli
MQKDALNNVHITDEQVLMTPEQLKAAFPLSLQQEAQIADSRKSISDIIAGRDPRLLVVCGPCSIHDPETALEYARRFKALAAEVSDSLYLVMRVYFEKPRTTVGWKGLINDPHMDGSFDVEAGLQIARKLLLELVNMGLPLATEALDPNSPQYLGDLFSWSAIGARTTESQTHREMASGLSMPVGFKNGTDGSLATAINAMRAAAQPHRFVGINQAGQVALLQTQGNPDGHVILRGGKAPNYSPADVAQCEKEMEQAGLRPSLMVDCSHGNSNKDYRRQPAVAESVVAQIKDGNRSIIGLMIESNIHEGNQSSEQPRSEMKYGVSVTDACISWEMTDALLREIHQDLNGQLTARVA

SEQ ID NO: 1335 - DNA, 1131 bp, Nostoc sp. PCC 7120
  CDS (1)..(1131)
atgatgaatttgtgttgtacatttcatctacaatatgtatacccaatctgcctaaaatcctacccagacaattcagagcaatcctccatgcacaataaattaactaacgcaaatattgaaaattatcacgttctcttaactccaaacgcagtaaaagaaaaattaccgttaacagaaactgcggcagaaatagttttacagtttagatgtgaaatagagaaaatcttagattttcaagatagacgcaaatttatagtagttgggccttgttccattcatgaccctaatgcagcattggaatacgcccataagttaaaaaaattagctgaacgtgtccaggataaactactgttgattatgcgggtgtattttgaaaagccccgcacaactgtaggctggaaaggattaattaatgatccagaaatggatgattcttttcatgtggaaaatggtttattgctagccagagatttactgatcaagctaacagagttagggctacccaccgctacagaagctctagaccctatcgtaccccaatatattggtgaattgatcacatgggcggcgatcggcgcacgcacaacagaatcccagactcacagggaaatggctagtggtctgtctatgcccgtgggctttaaaaatggcactgatggtaatattcaagtagctttaaatgctttacattctgccagaatgactcataattttttgggcattaatcctgagggacaggtcagtgtatttgaaacgaaaggtaatgcttacggtcatgtgattttgcgtgggggaaatcaacctaattttgatgttgcaagtgttaaacaagtagaagaaaaattaaaacaggctcagttacctccgagaattgtcattgattgtagtcatggtaatactaataagaattacaggttgcaatctgatgttttagaaaacgttgtacaacaaatagttgatggtaatacatcgattgtggggatgatgctggaatcaaatttatatgaaggtaatcaacccattaactgcaaacgggaagaattgaaatatggggtttctgtaactgacccctgtatcggttgggagcaaacggaaaaaattatcttggctgcttacgaaaaacttaattga

SEQ ID NO: 1336 - protein, 376 aa, Nostoc sp. PCC 7120
MMNLCCTFHLQYVYPICLKSYPDNSEQSSMHNKLTNANIENYHVLLTPNAVKEKLPLTETAAEIVLQFRCEIEKILDFQDRRKFIVVGPCSIHDPNAALEYAHKLKKLAERVQDKLLLIMRVYFEKPRTTVGWKGLINDPEMDDSFHVENGLLLARDLLIKLTELGLPTATEALDPIVPQYIGELITWAAIGARTTESQTHREMASGLSMPVGFKNGTDGNIQVALNALHSARMTHNFLGINPEGQVSVFETKGNAYGHVILRGGNQPNFDVASVKQVEEKLKQAQLPPRIVIDCSHGNTNKNYRLQSDVLENVVQQIVDGNTSIVGMMLESNLYEGNQPINCKREELKYGVSVTDPCIGWEQTEKIILAAYEKLN

SEQ ID NO: 1337 - DNA, 1053 bp, Salmonella enterica subsp. enterica serovar Typhi
  CDS (1)..(1053)
atgaattatcagaatgacgatttacgcattaaagaaatcaacgagttattacctccggtcgcgctgctggaaaagtttcccgccacggaaaatgcagcaaataccgttgctcacgcacgcaaagccatccataaaattctcaaaggcaatgacgatcgtctgctggtggtgatcggtccttgttcaattcatgatccggcagcggcgaaagagtatgccgcccgtttgctggcgctacgcgatgagcttcaaggcgagcttgaaattgtcatgcgcgtctattttgagaaaccgcgtactaccgtcggctggaaagggctgattaacgatccgcacatggataacagcttccagattaacgacggtctgcgtattgcgcgcaaactgctgctggatattaacgacagcggcctgcctgccgccggcgaattcctcgatatgatcacgccgcaatatctggccgatctgatgagctggggcgccattggcgcacggactactgaatcccaggttcatcgcgaactggcgtctggcctctcttgtccggtcggttttaaaaatggtactgatggcacgattaaagtcgccattgacgccatcaacgccgccggcgcgccgcattgcttcctctccgtcactaaatggggtcattcggcgattgtgaataccagcggcaacggcgactgccatatcattctgcgcggcggtaaagcgccaaactatagcgcgcaacatgttgctgaggtgaaagaaggcctcatcaaagcgggactgacgccgcaggtcatgatcgatttcagccatgccaactcctgtaagcaatttcaaaagcagatggaggtttgcgccgatgtctgtcagcagatagcgggcggtgaaaaagcgattattggcgtgatggtagagagtcatctggtagaaggaaaccagagtctggaaagcggtcagccgctgacctacggtaaaagcattactgacgcctgtattggctgggaagataccgatgcgctgcttcgtcagttgtcggcagcggtaaaagcccgtcgaggttaa

SEQ ID NO: 1338 - protein, 350 aa, Salmonella enterica subsp. enterica serovar Typhi
MNYQNDDLRIKEINELLPPVALLEKFPATENAANTVAHARKAIHKILKGNDDRLLVVIGPCSIHDPAAAKEYAARLLALRDELQGELEIVMRVYFEKPRTTVGWKGLINDPHMDNSFQINDGLRIARKLLLDINDSGLPAAGEFLDMITPQYLADLMSWGAIGARTTESQVHRELASGLSCPVGFKNGTDGTIKVAIDAINAAGAPHCFLSVTKWGHSAIVNTSGNGDCHIILRGGKAPNYSAQHVAEVKEGLIKAGLTPQVMIDFSHANSCKQFQKQMEVCADVCQQIAGGEKAIIGVMVESHLVEGNQSLESGQPLTYGKSITDACIGWEDTDALLRQLSAAVKARRG

SEQ ID NO: 1339 - DNA, 1077 bp, Pseudomonas aeruginosa
  CDS (1)..(1077)
atggctgatttacagatcgacgaccttaacgttgcctccaacgagaccctgatcacgccggagcagctcaagcgtgaaattcccctgaccgacaaggccctgcagaccgtggcccagggtcgccaggtggtgcgcgacatcctggatggcaaggaccaccgtctgttcgtggtgatcggcccctgctccatccacgacatcaaggccgcccacgaatacgccgaccgcctcaaggcgctcgcggccgaagtggcggatacgctgttcctggtgatgcgcgtgtacttcgagaagccgcgtaccacggtgggctggaaaggcctgatcaacgatccgtacctggacgactcgttcaagatccaggatggcctgcacatcggccgccaactgctccgcgaccttgccgagaaaggcttgcccaccgccaccgaagcgctcgacccgatttccccgcagtacctgcaggacctgatcagttggtcggcgatcggcgcccgtaccaccgaatcgcagactcaccgcgagatggcctccggcctgtcttccgcggtcggcttcaagaacggcaccgatggcagcctgaccgtggcgatcaatgccctgcagtcggtctccagcccgcatcgcttcctcggcatcaaccagcagggcggcgtgtccatcgtgaccaccaagggcaaccgctacggtcacgtggtgttgcgcggcggcaacggcaagccgaactacgattcggtcagcgtcgcgctctgcgagcaggacctgaacaaggcgaaaatcccgctgaacatcatggtcgactgcagccacgccaactccaacaaggacccggccctgcaaccgctggtgatggacaacgtcagcaaccagatcgtcgaaggcaacaactcgatcgtcggcctgatggtggaaagccacctgggctggggcagccagccgattccgaaggatctcgaccaacttcagtacggcgtctccatcaccgacgcctgcatcgactgggcgaccaccgagaagagcatccgcagcatgcacgccaagctcaaggacgtgctgccgaaacgccagcgcggctga

SEQ ID NO: 1340 - protein, 358 aa, Pseudomonas aeruginosa
MADLQIDDLNVASNETLITPEQLKREIPLTDKALQTVAQGRQVVRDILDGKDHRLFVVIGPCSIHDIKAAHEYADRLKALAAEVADTLFLVMRVYFEKPRTTVGWKGLINDPYLDDSFKIQDGLHIGRQLLRDLAEKGLPTATEALDPISPQYLQDLISWSAIGARTTESQTHREMASGLSSAVGFKNGTDGSLTVAINALQSVSSPHRFLGINQQGGVSIVTTKGNRYGHVVLRGGNGKPNYDSVSVALCEQDLNKAKIPLNIMVDCSHANSNKDPALQPLVMDNVSNQIVEGNNSIVGLMVESHLGWGSQPIPKDLDQLQYGVSITDACIDWATTEKSIRSMHAKLKDVLPKRQRG

SEQ ID NO: 1341 - DNA, 1047 bp, Buchnera sp
  CDS (1)..(1047)
atgaaaaaaacagatgaactacgtacaatacgaattgatccattaataactccagctgaattagcaaggcagtacgcgatcacttcagacatcatggacactgttatcgcaacaagacaaaatattgctcgtattatgactggacaagatgcgcgactacttgttgtaataggaccatgttcagttcatgatcctatcgcagcagtagaatatgcacatcgattgtatgaattacgagtaaaatataaagatcgtcttgaaattataatgcgtacatattttgaaaaaccaagaacagttgttggatggaaagggctgatttctgatccagatttaaatggtagttttcgagttaatcatggattagccgtagcacgtaaattattattagatattaatgcattaggaatgcctgcagcaacagagtttctcgatatagttataggacaatttatagcagatttaattagttggggtgctattggagcaagaactactgaaagtcaaattcatagagaaatggcttccgctctttcctgtccagtaggttttaaaaatggaactgacggtaatatacgcattgcaattgatgctattcgcgcagctaaagttagacatttatttttcgcgcctaataaagatggtcaaatgacgattaatcataccagtggcaatccatatgggcatataatcatgcgaggtggtcgtgcgccgaattaccatcctgatgatattaactcagcagtaaagcatttacgtgaatttgatctattagaacatttaatgattgattttagtcacggtaattgtttaaaagaacatcttcgtcaaaaaaatgtttctaagtctgtttcatatcaaatttctcatggttcgaaagctatttttggtgttatgattgaaagctttttagaagaaggttttcaaacagtaacgaataatcaaccattaatatatggtaaatcgattactgatgcctgtttaaattggaaagacagtgttttaattatcgaacaattagcagatgccgtagatgctcgtttttaa

SEQ ID NO: 1342 - protein, 348 aa, Buchnera sp
MKKTDELRTIRIDPLITPAELARQYAITSDIMDTVIATRQNIARIMTGQDARLLVVIGPCSVHDPIAAVEYAHRLYELRVKYKDRLEIIMRTYFEKPRTVVGWKGLISDPDLNGSFRVNHGLAVARKLLLDINALGMPAATEFLDIVIGQFIADLISWGAIGARTTESQIHREMASALSCPVGFKNGTDGNIRIAIDAIRAAKVRHLFFAPNKDGQMTINHTSGNPYGHIIMRGGRAPNYHPDDINSAVKHLREFDLLEHLMIDFSHGNCLKEHLRQKNVSKSVSYQISHGSKAIFGVMIESFLEEGFQTVTNNQPLIYGKSITDACLNWKDSVLIIEQLADAVDARF

SEQ ID NO: 1343 - DNA, 1074 bp, Vibrio cholerae
  CDS (1)..(1074)
atgaaaaaaagtgaattgagtgatgtgaatatcagtaatgaacagatattgatcaccccagatgccttaaaagccaagattccactcagtgacaaggcgcgtaagtttattcgtgagtcacgtcagacggtggcggacattatccacaaacgcgatcctcgcttgctgatcgtctgtggtccttgctcaattcatgatgtggatgcggcgaaagagtacgccaaaaaactcaaagcactctcggcgcagctgagcgaccagctctacatcgtaatgcgcgtgtactttgaaaaaccgcgtactacggtcggttggaaagggctgattaacgatccgcatcttgatggcagttttgatatcgaacacggtctgcatgttgggcgtcaactcttggtcgatttggccgaaatggaaattccactggcaaccgaagcgttggacccgattagcccgcaatacttggcggatacttttagttgggcggcgattggtgcgcgtaccacggaatcacaaactcaccgcgagatggcaagtggcctttccatgccaatcggctttaaaaatggcacggatggtaacttggcaacggcgattaatgccatgcaggccgcttcatccagtcaccgctttatgggaattaaccgcgaaggacaagtggcactgctcacgacacaaggcaacccgaatgggcatgtgattttacgtggtggcaaacagaccaactacgattcggtttctgtcgcggaatgtgaagaagagatgcaaaaagcgcgtttggaaccctctttgatggtggattgcagccatgcgaactcacgtaaagattaccgccgtcagccgttggtggcagaagatgtgattcatcaaatccgtgaaggcaatcgctcgatcattggcctgatgattgaaagccatctcaatgaaggaaatcagtcttcggatctgcctcgtgaaaagatgcaatacggagtctcgatcactgacggctgtataaattggtcaacgactgaggcattattacgtcgtgcgcatcaggaacttattccctttttgcacaatcgtttgcaaggataa

SEQ ID NO: 1344 - protein, 357 aa, Vibrio cholerae
MKKSELSDVNISNEQILITPDALKAKIPLSDKARKFIRESRQTVADIIHKRDPRLLIVCGPCSIHDVDAAKEYAKKLKALSAQLSDQLYIVMRVYFEKPRTTVGWKGLINDPHLDGSFDIEHGLHVGRQLLVDLAEMEIPLATEALDPISPQYLADTFSWAAIGARTTESQTHREMASGLSMPIGFKNGTDGNLATAINAMQAASSSHRFMGINREGQVALLTTQGNPNGHVILRGGKQTNYDSVSVAECEEEMQKARLEPSLMVDCSHANSRKDYRRQPLVAEDVIHQIREGNRSIIGLMIESHLNEGNQSSDLPREKMQYGVSITDGCINWSTTEALLRRAHQELIPFLHNRLQG

SEQ ID NO: 1345 - DNA, 1038 bp, Lactococcus lactis subsp. lactis
  CDS (1)..(1038)
atgagttttaaagaaataagtcctaagataaatattgatgcaattaagatgttgggacatctcaacagtgagcaacaagaaaaaaaattgcaacgagataaagaacttgaagcaattataaaaggtgaagatgaccgtttactcttgattattgggccatgttcgtcagacaatgaagaagcagttttagaatatgctcgccgtttagctaaacttcaagaagcagttaaagataaaatttttatggtcatgcgtgtctatactgcaaaacctcgtacaaatggcgatggctataaaggattgattcacgaaccagatgctgatggtcataccgatttaatcaatggaatcaaaatggttcgtgacttacattacaaggtcatcactgaaactggtttaacaactgctgatgaaatgctttacccagaaaatcttccaatggtagatgatttggtcagctaccatgcgattggtgcacgttctgttgaaaatcaacaacaccgttttgttgcttctgggattgatgtgccaactggtttgaaaaatccaacatcaggaaatttgaaagtgatgtttaatggaatttacgcggctcaacaatcacaagatttcctctttggtcgtgcagaagttcaaacatcaggaaatcctttagcacatgcgattttgcgtggtggacaagatgaaaatggaaaataccatccaaactactacactgataacttgcttgatacaattgaaatttatgaaaaaatgggcttgaaaaatccttttattgtcattgatacaaaccatgataactctggtaagaaatttatggaacaaatccgtattgttcgtcaaaccttagttaatcgtgactgggatgataaaattcgccaaaatgttcgtggcttcatgattgaatcttacctagaagatggtcgccaagataaaccagaagtatttggtaaatcaattactgacccatgtttaggttgggataaaacagaagcacttgttcaagaaatttacgaagctgaaaacaaaaataactaa

SEQ ID NO: 1346 - protein, 345 aa, Lactococcus lactis subsp. lactis
MSFKEISPKINIDAIKMLGHLNSEQQEKKLQRDKELEAIIKGEDDRLLLIIGPCSSDNEEAVLEYARRLAKLQEAVKDKIFMVMRVYTAKPRTNGDGYKGLIHEPDADGHTDLINGIKMVRDLHYKVITETGLTTADEMLYPENLPMVDDLVSYHAIGARSVENQQHRFVASGIDVPTGLKNPTSGNLKVMFNGIYAAQQSQDFLFGRAEVQTSGNPLAHAILRGGQDENGKYHPNYYTDNLLDTIEIYEKMGLKNPFIVIDTNHDNSGKKFMEQIRIVRQTLVNRDWDDKIRQNVRGFMIESYLEDGRQDKPEVFGKSITDPCLGWDKTEALVQEIYEAENKNN

SEQ ID NO: 1347 - DNA, 1023 bp, Lactococcus lactis subsp. lactis
  CDS (1)..(1023)
atgacttttaaagaactcagtaacaaaattaacattaaagatgtaagagagctaaatcatttaaatgatgagcaacaagaaaagaaagaaaaacgtgataaggaacttgaagcgataattaagggtgaagacgatagaatcctcttagtcattggcccctgctcatcggataatgaagctgcagttctagaatatgctcacagattgttaaaacttcaaaaagaagtagaagataaaatttttattgtgatgcgtgtttatactgcaaaaccgcggacaaacggagatggctataaaggcctcattcacgaacctgatgcagatggacatacagaccttatcaatgggataaaaatggttcgtgaccttcactataaagtaattactgaaactggtctgactacagcagatgagatgctatacccagaaaatctaccattagttgatgacttagtaagttactatgcagttggcgctcgctcagttgaaaatcaacaacatcgctttgttgcctcaggaatagatgccccaacaggaatgaaaaacccgacatcagggaatttaaaagttatgtttaatggaatgtatgcagcccaacaatctcaagattttctatttgggaatgctgaagtagaaacatcaggaaatccattagctcatgccatccttcgtggtggacaagatgaaaatggtaaaaaccatccaaattactatacagataatcttcttgaaagtatcgaaatatacgaaaaaatgggtttacaaaatccatttattgttattgatactaatcatgataactctgggaagaagtatatggaacaaataagaattgttcgtcaaacattagtcaatcgtaattgggatgaacaaattcataaatatgtcagaggatttatgattgaatcatatcttgaagacggtcgtcaagacaaaccagaagtatttggaaaatcaatcactgacccatgtttgggttgggataaaacagaagaacttattaatgaaatttataattcgtga

SEQ ID NO: 1348 - protein, 340 aa, Lactococcus lactis subsp. lactis
MTFKELSNKINIKDVRELNHLNDEQQEKKEKRDKELEAIIKGEDDRILLVIGPCSSDNEAAVLEYAHRLLKLQKEVEDKIFIVMRVYTAKPRTNGDGYKGLIHEPDADGHTDLINGIKMVRDLHYKVITETGLTTADEMLYPENLPLVDDLVSYYAVGARSVENQQHRFVASGIDAPTGMKNPTSGNLKVMFNGMYAAQQSQDFLFGNAEVETSGNPLAHAILRGGQDENGKNHPNYYTDNLLESIEIYEKMGLQNPFIVIDTNHDNSGKKYMEQIRIVRQTLVNRNWDEQIHKYVRGFMIESYLEDGRQDKPEVFGKSITDPCLGWDKTEELINEIYNS

SEQ ID NO: 1349 - DNA, 1032 bp, Streptococcus pneumoniae
  CDS (1)..(1032)
atggcatttattgaaaaaggtcaagaaatcgatatggaagtcatcaaggctgaaacccaattgtctgcggaagccttgagactcaaggaaagccgtgacagggaattggcagatattatttcaggggaagatgaccgtattctcttggtgattggtccttgctcttctgataatgaagaggcggtcttggaatatgctcgccgtttatctgccttgcaaaagaaggtagcggataagattttcatggtcatgcgcgtgtatactgctaagcctcgtaccaatggagacggctataaaggattagttcaccagccagatacttctaaggctccaagcctgattaatggcttgcaggctgtgcgccagttgcactaccgcgtgattacagagactggtttgacaacggcagatgagatgctttatccgtcaaatctgatcttggtggatgacttggtcagctaccatgccgttggagctcgttctgtggaagaccaagagcaccgctttgtggcttctgggattgatgcaccagtagggatgaaaaatccaacctcaggaaatttgggtgttatgtttaacgccatctatgctgctcaaaacaagcaaaccttcctttatcatgggcaggaagttgagacatcaggtaatcctttggcccatgttatcctccgtggagcagtcaacgagtatggcaattatatgccgaattactactatgaaaatctactccaagccattgaacgctatgaaaccatgggacttgaaaatccttttatcctcattgacaccaaccatgataactcaggcaagcaatatatggagcagattcgaattgttcgccagaccttgcagaatcgtgattggaatgagaaaattaaaaagacggttcgaggatttatgattgaatcttacctagcagatggtcgtcaaaaccaaccagagatctttggttgctctattactgacccttgcctaggttgggaaaatacagaggccttggtagaagagatttatgttaccttgacaaaataa

SEQ ID NO: 1350 - protein, 343 aa, Streptococcus pneumoniae
MAFIEKGQEIDMEVIKAETQLSAEALRLKESRDRELADIISGEDDRILLVIGPCSSDNEEAVLEYARRLSALQKKVADKIFMVMRVYTAKPRTNGDGYKGLVHQPDTSKAPSLINGLQAVRQLHYRVITETGLTTADEMLYPSNLILVDDLVSYHAVGARSVEDQEHRFVASGIDAPVGMKNPTSGNLGVMFNAIYAAQNKQTFLYHGQEVETSGNPLAHVILRGAVNEYGNYMPNYYYENLLQAIERYETMGLENPFILIDTNHDNSGKQYMEQIRIVRQTLQNRDWNEKIKKTVRGFMIESYLADGRQNQPEIFGCSITDPCLGWENTEALVEEIYVTLTK

SEQ ID NO: 1351 - DNA, 1095 bp, Pseudomonas aeruginosa
  CDS (1)..(1095)
atgaactcatccgtatccgcactgaccaccctttcgccgaacgtccaggccgtcgccctgcccagcgccaccgcccgtaccgccctggaacgcctgcccagcccgctcgaactcaaggcccgccagccgttgccgctggagctggccagccaggtcgccgccagccgcgacgccatccgcgccatcctcgacggcgacgacccgcgcctgctggtggtagtcggtccctgttcgatccacgatccccgctccgccctcgaatacgccgaacgcctcgccgcgctgagcgacgaactcgacggccagttgctcctggtgatgcgcgcctacgtggaaaagccacgcaccacggtgggctggaagggcctcgcctacgatccgcacctggatggcagcgacgacatggccgccggcctggcgctgtcccggcaactgatgctggacatgctgcgcctcggcctgccgctggccaccgaactcctgcaaccgctggccgccggctacttcgacgacctgctgagctgggcggcgatcggcgcgcgcaccagcgaatcgcagatccaccgcgagctggtcagcggcctcggcctgccggtgggcttcaagaacggcaccgacggcggcgtcggcatcgcctgcgacgcgatccgttcggcggcccacggccaccgccatttcggcctcgacccgcacggtcacccggcgctgatcgagacccgcggcaatccggacacccatgtggtgctgcgcggcggccgccacggttcgaactacggccccgagcaggtgcaggccgtgcgccaggccctggaaagccagggcatcgccacgcggatgatggtcgattgcagtcacgccaacagcggcaagaacccgctgaaccagcccggcgtcctcgccagcgtgctggaccagcgcctggccggtgccagcgacctggtcggggtaatgctggaaagccacctgttcgacggttgccaggcgctcggcggcgaactgcgctacggcgtctcgatcaccgacggctgcctcggctgggaaggcaccgagcggattctccgcgacgccgcccggcggctcgccgagcggcgctga

SEQ ID NO: 1352 - protein, 364 aa, Pseudomonas aeruginosa
MNSSVSALTTLSPNVQAVALPSATARTALERLPSPLELKARQPLPLELASQVAASRDAIRAILDGDDPRLLVVVGPCSIHDPRSALEYAERLAALSDELDGQLLLVMRAYVEKPRTTVGWKGLAYDPHLDGSDDMAAGLALSRQLMLDMLRLGLPLATELLQPLAAGYFDDLLSWAAIGARTSESQIHRELVSGLGLPVGFKNGTDGGVGIACDAIRSAAHGHRHFGLDPHGHPALIETRGNPDTHVVLRGGRHGSNYGPEQVQAVRQALESQGIATRMMVDCSHANSGKNPLNQPGVLASVLDQRLAGASDLVGVMLESHLFDGCQALGGELRYGVSITDGCLGWEGTERILRDAARRLAERR

SEQ ID NO: 1353 - DNA, 1110 bp, Caulobacter crescentus
  CDS (1)..(1110)
atgccgtccacgtccaccgctcacctcgtcaccctgcccgttccgaccgatgatctgcggatcgagaaactccagaccctgagcccgccggctcaggtcatcggagaagctcccgccacctcgtcagtggccgagatcgtcggcggggcgcgtcaggcggttcatcagatcctgcacggccaggacgaccgcctcgtcgtggtcatcggcccctgctccattcacgaccccaaggcggcgatcgactacgcccggcgcctcgccgccgagcgcgagcgccacgcgggcgaactggaagtgatcatgcgggtctatttcgagaagccgcgcacgaccgtgggctggaagggcctgatcaacgatccgggcctcgacggcggcttccggatcaatgacggcctgcgtctggcgcgacgggttctgctggacgtcagcgcgcagggcctgccggccgcctgcgagttcctggacgtgaccaccccgcagtacatcgctgacctggtatcctggggcgcgatcggcgcccgcaccaccgagagccagattcaccgcgaactggcctcgggcctttcctgccccgtcggtttcaagaacggcaccaatggcgatgtgaagatcgccgtcgacgccgtaatggccgcgtcccagccgcaccacttcctggccgtcaccaaagagggccgcgcggcgatcgccaccacgacgggcaatggtgactgtcacctcgtgctgcgcggcggcaagaccccgaactacgacgccgccagcgtcgccgccgccgcagaggttctgagcaaggccggactgccgcagcgcctgatggtcgatgtcagccacgccaacagcggcaagaaccatgagaaccaacccgccgtgatcgccgacgtctgcgcccaggtcgcgaccggcgcctcgccggtcatgggcgtgatgatcgagagcaatctcgtggccggccgccaggatatcgtccaaggccagggcctgacctatggtcagtcggtcaccgacgcctgcgtcgactgggaaacctcggtgcggctgctggacgacctggcgggcgcagttcgcgcgggtcgcctggcgcggggctctaaatcaagcacttag

SEQ ID NO: 1354 - protein, 369 aa, Caulobacter crescentus
MPSTSTAHLVTLPVPTDDLRIEKLQTLSPPAQVIGEAPATSSVAEIVGGARQAVHQILHGQDDRLVVVIGPCSIHDPKAAIDYARRLAAERERHAGELEVIMRVYFEKPRTTVGWKGLINDPGLDGGFRINDGLRLARRVLLDVSAQGLPAACEFLDVTTPQYIADLVSWGAIGARTTESQIHRELASGLSCPVGFKNGTNGDVKIAVDAVMAASQPHHFLAVTKEGRAAIATTTGNGDCHLVLRGGKTPNYDAASVAAAAEVLSKAGLPQRLMVDVSHANSGKNHENQPAVIADVCAQVATGASPVMGVMIESNLVAGRQDIVQGQGLTYGQSVTDACVDWETSVRLLDDLAGAVRAGRLARGSKSST

SEQ ID NO: 1355 - DNA, 1032 bp, Streptococcus pneumoniae
  CDS (1)..(1032)
atggtatttacagcaaaaagctctaaaataaatatagaagaagttcgtgccttgtcaaaattagaaggtcaggctttggagaggaaatcacagcgagatcaagagctagaagccattatacgtggagaagaccagcgaattctcttggtaatcgggccatgctcatctgacaacgaagaagctgtccttgaatacgctaatcgtttggcagtcctacaagaagaagtggcagatcgtatctttatggttatgcgtgtttatactgccaaaccccgtaccaacggagatggctataagggtttgattcaccagcctaacgcgacagaagcgcctagtcttatcaatggaatcaaagccgttcgccatcttcactatcgtgtcatcacagaaacagggatgacaactgctgatgaaatgctttatcctgaaaaccttccgcttgtagatgatttgatttcttacatggcagttggtgcccgttcagttgaagaccagcaacaccgctttgtggcaagtggggcaggattttctactggttttaaaaatccaacctctggaaatctcaatgtcatgtttaatgggatttatgctgctcaaaacaaacaaagtttccttttcttaggaaaagaagtagaaacaactgggaacccgctttcacacgctattcttcgtggtgctcttaatgagtatggaaaaaatattcccaactactattatgacaatttaattgataccattgcccagtatgagaaaatgggcttggaaaatccttttatcatcattgataccaatcatgacaattctggtaagcagtatattgaacagatccgaattgtccgccagaccttgattaaccgtgcttggaatgaaaaaattaagcagttcgttcgtggttttatgattgagtcttatctggaagatggtcgacaaaatgagccagaagtatttggtaagtctatcacagacccttgcctgggttgggataacacagaagctcttgtcagagaaatttacaaaacgttaggagaataa

SEQ ID NO: 1356 - protein, 343 aa, Streptococcus pneumoniae
MVFTAKSSKINIEEVRALSKLEGQALERKSQRDQELEAIIRGEDQRILLVIGPCSSDNEEAVLEYANRLAVLQEEVADRIFMVMRVYTAKPRTNGDGYKGLIHQPNATEAPSLINGIKAVRHLHYRVITETGMTTADEMLYPENLPLVDDLISYMAVGARSVEDQQHRFVASGAGFSTGFKNPTSGNLNVMFNGIYAAQNKQSFLFLGKEVETTGNPLSHAILRGALNEYGKNIPNYYYDNLIDTIAQYEKMGLENPFIIIDTNHDNSGKQYIEQIRIVRQTLINRAWNEKIKQFVRGFMIESYLEDGRQNEPEVFGKSITDPCLGWDNTEALVREIYKTLGE

SEQ ID NO: 1357 - DNA, 1047 bp, Buchnera aphidicola
  CDS (1)..(1047)
atgaaaaaaacagatgaactacgtacaatacgaattgatccattgataacaccatctgaattagcaaaaaaatatgctattacttcagaaatcatggataatgttattataacgagacaaaatatagctcgaattatgactggagaagatttgcgtttgcttgttgtaataggtccatgttcagtacatgatccaattgcagcagttgaatatgctcatcgattatatgaactacgtaaaaaatatcaagatcgtcttgaaattataatgcgtacatattttgaaaaaccaagaacagtagttggttggaagggattaatttcagatccagatttaaatggtagtttcagagttaatcatggtttagctgttgcacgtaaattattattagatatcaatgaactaggatgcctgcagcaacagagttttttagatatggtaatagggcaatttattgcggatttaattagctggggtgcgattggagctagaactactgaaagtcaaattcatagagaaatggcttcagctctttcttgtccagtaggttttaaaaatggaacagatggaaatatacgtattgcaattgatgctattagagcagcacaagcacgtcatttgttttttgctccgaataaagatggacaaatgactattaatcataccagtggaaatccttatggacatataattatgagaggtggtcgaactcctaattatcatgctcacgatattaattcagcaatagaacatttacgtgaatttaatttgttagaacatttaatgattgattttagtcatggtaattgtttaaaggaacatattcgtcaaaaagatgttgctaaatctgtttcaaaacaaatttctcaaggttcaaaaactatatttggtgtaatgattgaaagttttttagaagaaggttttcaaacagttaaagaaaatcaaccactaatatatggaaaatcaattactgatgcatgtttaaattggaaagacagtgtccttattattaagcaattagcagatgcggtagatactcgtttttaa

SEQ ID NO: 1358 - protein, 348 aa, Buchnera aphidicola
MKKTDELRTIRIDPLITPSELAKKYAITSEIMDNVIITRQNIARIMTGEDLRLLVVIGPCSVHDPIAAVEYAHRLYELRKKYQDRLEIIMRTYFEKPRTVVGWKGLISDPDLNGSFRVNHGLAVARKLLLDINELGCLQQQSFLDMVIGQFIADLISWGAIGARTTESQIHREMASALSCPVGFKNGTDGNIRIAIDAIRAAQARHLFFAPNKDGQMTINHTSGNPYGHIIMRGGRTPNYHAHDINSAIEHLREFNLLEHLMIDFSHGNCLKEHIRQKDVAKSVSKQISQGSKTIFGVMIESFLEEGFQTVKENQPLIYGKSITDACLNWKDSVLIIKQLADAVDTRF

SEQ ID NO: 1359 - DNA, 1089 bp, Haemophilus influenzae
  CDS (1)..(1089)
atggctaaagagaaaattgaaattgtcgtggcaaacgacgatacgcgaattgaaaaagtcgatcaggtgttaccacccattgccttattagaaaaatacccagcaagtgaacaggctgcggcgttagtgaagcaaactcgtcatgaggcacataatattattcatggtaaagatgatcgtttattagtcgtgattgggccttgctctattcatgatccgaaagcagccattgaatatgcgactcgtttaaaaccattacgtgaaaaatacaaagatagccttgaaattattatgcgtgtgtattttgagaaaccgcgtacaacggtgggttggaaaggtttaattaatgaaccatatttgaatgatacttatcgtttaaatgatgggttacgtattgcacggaaattactttcagatattaatgatcttggtgtgcctgcagcgggcgagtttttagatatgattacacctcagtatttggcagattttatgagctggggggcgattggggctagaacaacagaatcacaagttcatcgtgagttggcttcaggtttatcttgtgctgttgggtttaaaaatgccactaatggtggtgtgaaagtcgctttagatgcaattggtgcagcggaagctcctcactatttcttatctgtcactaaatttggtcattctgcaattgtttctacaaaagggaatgaagattgccatattattttacgaggtggagataaaggccctaactatagtgctgaagatgtagaaaaagtttgtgctgatattgaaaaaacagggcgtattccacacgttatggttgattttagccatgcaaacagcagtaaacaatataaaaagcaaatggatgtttgccaagacgtatgtaatcagattgcatttggttctaaacaaatctttggcgtaatggtggaaagccatttagtggaaggtcgtcaagatttagttgatggcaaagcacagacttatggacaaagtattacggatgcgtgcattggatgggaagattctgaaagattattgcaacaactttctgatgcagttattgctagacgtaaagcgacgagtaattaa

SEQ ID NO: 1360 - protein, 362 aa, Haemophilus influenzae
MAKEKIEIVVANDDTRIEKVDQVLPPIALLEKYPASEQAAALVKQTRHEAHNIIHGKDDRLLVVIGPCSIHDPKAAIEYATRLKPLREKYKDSLEIIMRVYFEKPRTTVGWKGLINEPYLNDTYRLNDGLRIARKLLSDINDLGVPAAGEFLDMITPQYLADFMSWGAIGARTTESQVHRELASGLSCAVGFKNATNGGVKVALDAIGAAEAPHYFLSVTKFGHSAIVSTKGNEDCHIILRGGDKGPNYSAEDVEKVCADIEKTGRIPHVMVDFSHANSSKQYKKQMDVCQDVCNQIAFGSKQIFGVMVESHLVEGRQDLVDGKAQTYGQSITDACIGWEDSERLLQQLSDAVIARRKATSN

SEQ ID NO: 1361 - DNA, 1502 bp, Candida albicans
  CDS (336)..(1442)
acactgactaatcattaggccgcagagagagcaaggtactcaccaactcaccatgaattgtagattaattattagacattagtacacacactacaaactataaactataggcacgcactccctaatgactaacaattgtacagtttttgtgtcattgactaattgttctaatttttttttttcagtttaaatatcccgaaccaattttccaaatttttcatatctgtttttcctttttcttttttaattcctttctagatatcttgtatatatactcaatcctcatagatatattccatatatatatatatattaattcattacattaacacacaatgtttattacaaacgaacacgttggtgacagaagtcgtatggaagattggagaatccgtggttacgatccattaactcctccagatcttttacaacatgaatacccattaactcctgaatcacagaagattatcgttgaaggtagaaatgctgcttgtgatattttgaacggcaaagaccgaagattgattggaccttgttcgattcatgatcctcaagctgccttggattactgtgaaagattatatcaagcttctgaaaaacacaagggtgaattattgattgttatgagagcatacttggaaaaaccaagaaccacagttggttggaaaggtttaattaacgacccagatatcgatggtaccttccatataaataaggggttgagaattgctagaaagttgtttgttcaattaacttcaaaattaccaattgctggtgaaatgttggatacaatctcacctcaatttttatctgatttattctcagtgggggctattggtgcaagaaccaccgaatcgcaattgcacagagagttggcatctggttatcattcccagttggattcaaaaacggtaccgatggtactttgggtgttgccattgacgcctttgagagctgcttctcatccacatcatttcctttcagtcacaaaacctggtgttgttgctattgttgggactgatgggaaccaagactgttttgttatattaagaggtggtaagaagggtacaaactatgatgccaaatccgtacaagaaacacaagaagaattaatcaaatcaaaagttgttaccgaaatgaaacctggtccaagaattatggttgattgttctcatggtaattctaataaagatcatagaaaccaaccgaaagttgcccaagttgttgctgaacaagtggccggtggtgataaatccatatgtggattaatgattgagagtaatataaatgatggaagacaagatgttccaccaaaggaacaaggtggtaaagatgctttgaaatacggtgtttctattaccgatgcttgtattggttgggaaaccacagaagaagttttggaggttttagccaatgctgtcaaaaccagaagatctttatagttgattatgtaatcctatttttattaatttgaacaaacaatgatattaaaaaaaaaaaaa

SEQ ID NO: 1362 - protein, 368 aa, Candida albicans
MFITNEHVGDRSRMEDWRIRGYDPLTPPDLLQHEYPLTPESQKIIVEGRNAACDILNGKDRRLIGPCSIHDPQAALDYCERLYQASEKHKGELLIVMRAYLEKPRTTVGWKGLINDPDIDGTFHINKGLRIARKLFVQLTSKLPIAGEMLDTISPQFLSDLFSVGAIGARTTESQLHRELASGYHSQLDSKTVPMVLWVLPLTPLRAASHPHHFLSVTKPGVVAIVGTDGNQDCFVILRGGKKGTNYDAKSVQETQEELIKSKVVTEMKPGPRIMVDCSHGNSNKDHRNQPKVAQVVAEQVAGGDKSICGLMIESNINDGRQDVPPKEQGGKDALKYGVSITDACIGWETTEEVLEVLANAVKTRRSL

SEQ ID NO: 1363 - DNA, 1113 bp, Saccharomyces cerevisiae
  CDS (1)..(1113)
atgttcattaaaaacgatcacgccggtgacaggaaacgcttggaagactggagaatcaaaggttatgatccattaacccctccagatctgcttcaacatgaatttccaatttcagccaaaggtgaggaaaacattatcaaggcaagagactccgtctgtgatattttgaatggtaaagatgatcgtttagttatcgtgatcgggccatgttccctacatgaccccaaagccgcttacgattacgctgacagattggctaaaatttcagaaaagttgtcaaaagacttattgattattatgagagcgtatttagaaaaaccaaggactactgttggctggaaagggttgattaacgaccctgatatgaataactcttttcaaatcaataaaggtctacggatttcgagagaaatgttcataaaactggttgaaaaattacccattgctggtgagatgttggataccatttctccgcagtttttgagtgattgtttctccttgggtgccatcggcgccagaactactgaatcccaactgcacagagaattagcatccggtctatctttccctattggatttaagaacggtactgatggtggtttgcaagtcgccatcgacgctatgagagccgctgcacatgaacattacttcctttctgtcacaaagccaggtgtcactgctatcgtgggcactgaaggtaacaaggataccttcctgatcttgagaggtggtaagaacggtactaactttgacaaagaaagtgttcaaaatactaagaaacagttagaaaaggccggtttgactgatgattcccagaaaagaattatgatcgattgttcccacggcaacagtaataaagatttcaagaaccaaccaaaggttgccaaatgtatttatgaccagctgacggagggtgagaatagtctctgtggtgttatgattgagtccaacataaatgaaggtagacaagatattcccaaagaaggtggcagagagggattgaagtatggttgttctgttacggatgcttgtattggctgggagtccaccgaacaggtattggagctattggcagaaggtgttagaaacagaagaaaggccttgaaaaaatag

SEQ ID NO: 1364 - protein, 370 aa, Saccharomyces cerevisiae
MFIKNDHAGDRKRLEDWRIKGYDPLTPPDLLQHEFPISAKGEENIIKARDSVCDILNGKDDRLVIVIGPCSLHDPKAAYDYADRLAKISEKLSKDLLIIMRAYLEKPRTTVGWKGLINDPDMNNSFQINKGLRISREMFIKLVEKLPIAGEMLDTISPQFLSDCFSLGAIGARTTESQLHRELASGLSFPIGFKNGTDGGLQVAIDAMRAAAHEHYFLSVTKPGVTAIVGTEGNKDTFLILRGGKNGTNFDKESVQNTKKQLEKAGLTDDSQKRIMIDCSHGNSNKDFKNQPKVAKCIYDQLTEGENSLCGVMIESNINEGRQDIPKEGGREGLKYGCSVTDACIGWESTEQVLELLAEGVRNRRKALKK

SEQ ID NO: 1365 - DNA, 2048 bp, Saccharomyces cerevisiae
  CDS (619)..(1731)
gtatacagctagccttgaaagtgatggaaaacattgtcatcggcacataaataaaaaaattatgaatcacgtgatcaacagcaaattatgtactcgtatatatgcaagcgcattccttatattgacactctttcattgggcatgaggctgtgtaaacataagctgtaacggtctcacggaacactgtgtagttgcattactgtcaggcagttatgttgcttaatataaaggcaaaggcatggcagaatcactttaaaacgtggccccacccgctgcaccctgtgcattttgtacgttactgcgaaatgactcaacgatgaaatgaaaaaattttgcttgaaattttgaaaaaaagatgtgcgggacgcattgttagctcattgaatacatcgtgatcgaatccaatcaatgtttaatttcatattaatacagaaactttttctcatactttcttcttcttttcattggtatattatctatatatcgtgttaattcctctttcgtcatttttagcatcgttataagagtaattaagaataactagaagagtctctctttatattcgtttattttatatatttaaccgctaaatttagtaaacaaaagaatctatcagaaatgagtgaatctccaatgttcgctgccaacggcatgccaaaggtaaatcaaggtgctgaagaagatgtcagaattttaggttacgacccattagcttctccagctctccttcaagtgcaaatcccagccacaccaacttctttggaaactgccaagagaggtagaagagaagctatagatattattaccggtaaagacgacagagttcttgtcattgtcggtccttgttccatccatgatctagaagccgctcaagaatacgctttgagattaaagaaattgtcagatgaattaaaaggtgatttatccatcattatgagagcatacttggagaagccaagaacaaccgtcggctggaaaggtctaattaatgaccctgatgttaacaacactttcaacatcaacaagggtttgcaatccgctagacaattgtttgtcaacttgacaaatatcggtttgccaattggttctgaaatgcttgataccatttctcctcaatacttggctgatttggtctccttcggtgccattggtgccagaaccaccgaatctcaactgcacagagaattggcctccggtttgtctttcccagttggtttcaagaacggtaccgatggtaccttaaatgttgctgtggatgcttgtcaagccgctgctcattctcaccatttcatgggtgttactaagcatggtgttgctgctatcaccactactaagggtaacgaacactgcttcgttattctaagaggtggtaaaaagggtaccaactacgacgctaagtccgttgcagaagctaaggctcaattgcctgccggttccaacggtctaatgattgactactctcacggtaactccaataaggatttcagaaaccaaccaaaggtcaatgacgttgtttgtgagcaaatcgctaacggtgaaaacgccattaccggtgtcatgattgaatcaaacatcaacgaaggtaaccaaggcatcccagccgaaggtaaagccggcttgaaatatggtgtttccatcactgatgcttgtataggttgggaaactactgaagacgtcttgaggaaattggctgctgctgtcagacaaagaagagaagttaacaagaaatagatgtttttttaatgatatatgtaacgtacattctttcctctaccactgccaattcggtattatttaattgtgtttagcgctatttactaattaactagaaactcaatttttaaaggcaaagctcgctgacctttcactgatttcgtggatgttatactatcagttactcttctgcaaaaaaaaattgagtcatatcgtagctttgggattatttttctctctctccacggctaattaggtgatcatgaaaaaatgaaaaattcatgagaaaagagtcagacatcgaaacatacataagttgatattcctttgatatc

SEQ ID NO: 1366 - protein, 370 aa, Saccharomyces cerevisiae
MSESPMFAANGMPKVNQGAEEDVRILGYDPLASPALLQVQIPATPTSLETAKRGRREAIDIITGKDDRVLVIVGPCSIHDLEAAQEYALRLKKLSDELKGDLSIIMRAYLEKPRTTVGWKGLINDPDVNNTFNINKGLQSARQLFVNLTNIGLPIGSEMLDTISPQYLADLVSFGAIGARTTESQLHRELASGLSFPVGFKNGTDGTLNVAVDACQAAAHSHHFMGVTKHGVAAITTTKGNEHCFVILRGGKKGTNYDAKSVAEAKAQLPAGSNGLMIDYSHGNSNKDFRNQPKVNDVVCEQIANGENAITGVMIESNINEGNQGIPAEGKAGLKYGVSITDACIGWETTEDVLRKLAAAVRQRREVNKK

SEQ ID NO: 1367 - DNA, 1107 bp, Schizosaccharomyces pombe
  CDS (1)..(1107)
atggacaagcacactcctcttcttcctggcgacagtgttttttcacgttgtaaaactgaagatagtcgtatcaaaggctatgatccagtaatttcacctgctttaattcaatcagaattagcagcctctgatgaaacacttgcttttgtgtcggatcaaagacgccaagccgccgatatcattgcgggacgtgatgatagacttcttctaatcgttggaccctgttctttacacgatcctgttgccgccaaggagtatgccattcgcttgcaaaaggaggctattaagcacaagaaggacttgcatattattatgcgcgcctatcttgaaaagcctcgtacaactgttggatggaaagggttgattaatgatcccgatttggatggatcttataacattaataagggtattcgtgtcgctcgacgcatttttctggagcttctggaaactggtgtcggtatagcgtcagagatgctggacactataagtccccaatatttagctgatctaatttgctggggcgctattggtgctcgtaccactgagtcccaattgcatcgagaacttgcttcagggctttcttttccaataggttttaagaatgctactgacggtaacattggtattgctatagatgctatgaattcttctgccaaccctcatcatttcttgtctgtcacaaagcagggtgttgtagccattgttactactacaggtaaccctgatacacacattattttgcgtggtggtaaaagtgggactaacttcgatgctgattcagtggctggtgccaaggctaaactcgaagaatgcaacaagctacctagtatcatgatcgactgttctcatggaaactcatctaaaaaccataagaatcaacccaaggttgctgcttgtattgctgagcaggtggcaaacggtcagaaagcaattactggtgtcatgatcgaatctcaccttaacgaaggtaagcaagctatacctgaggatgatttgtcaagtatgaaatatggagtcagtgtcaccgatgcttgcattggttgggacgacactaccgccgtttttgaacagttggctgctgccgtccgttctcgtcgttctcattaa

SEQ ID NO: 1368 - protein, 368 aa, Schizosaccharomyces pombe
MDKHTPLLPGDSVFSRCKTEDSRIKGYDPVISPALIQSELAASDETLAFVSDQRRQAADIIAGRDDRLLLIVGPCSLHDPVAAKEYAIRLQKEAIKHKKDLHIIMRAYLEKPRTTVGWKGLINDPDLDGSYNINKGIRVARRIFLELLETGVGIASEMLDTISPQYLADLICWGAIGARTTESQLHRELASGLSFPIGFKNATDGNIGIAIDAMNSSANPHHFLSVTKQGVVAIVTTTGNPDTHIILRGGKSGTNFDADSVAGAKAKLEECNKLPSIMIDCSHGNSSKNHKNQPKVAACIAEQVANGQKAITGVMIESHLNEGKQAIPEDDLSSMKYGVSVTDACIGWDDTTAVFEQLAAAVRSRRSH

SEQ ID NO: 1369 - DNA, 1089 bp, Amycolatopsis orientalis
  CDS (1)..(1089)
atgacaacatctactcccgccgccgcggtcgacctcgacaaccagaggatcgaccgcatagtcccattggtgacaccggccctgctgcaccatgaactgccgctcagcgccaaggcagccgacaccgtgcgacgaggtcgtgagaacgtccttcgcgtcctcgacggtacggatgaccggctgctcgtgatcactggaccgtgctccatccacgacccggccgcggccctcgactacgccgaccacctcgccacgatggccggccggttcactgacgacctcctgatcgtcatgcgcgtgtacttcgagaaaccgcgaacggtcggtggctggaaagggctcatcaacgacccccacctcgacggcaccggcgacgtgaaccacggcctgcgaatcgcccggcacctgttgctggagctcgccgaacgcggcctgcccgtcgcgtgcgagtggctggacacgaccatcccggcctacctcgccgacaccgtttcctggggcgcgatcggtgcccgcaccgtggaaagccaaaaccaccgcatgctcgccagcggtctgtccatgccggtcggcttcaagaaccgccgcgacggcgacatcaccgtggccatcgacgcgatccgcgctgcggcggcccgtcacgtcgttcctggcgtcgaccccggcggcttgcccgccatcctgcacaccgccggcaaccccgactgccatcttgttctgcgcggcggcaattccgcgcccaaccacgacgcctcgtctgtccacacagcactcaccgcgctgcaggacgccggtcttccccgccgggtcgtgatcgatgccagccatgacaacagccgcaaggaccaccaccggcaacctgttgtcgccgggcagatcgccgaccaggtcaagggcggccaacgcggcattgttggcgtgatgctcgaatccaacctccgcgccggccgccaggacctccgccccggccagcctctgacctacggccagtccatcacggacgcctgcatcgacatccccacgacgcagaccgttctgcagaccctcgccacggcaaccgcggctcggcggcgtctcagccagaactga

SEQ ID NO: 1370 - protein, 362 aa, Amycolatopsis orientalis
MTTSTPAAAVDLDNQRIDRIVPLVTPALLHHELPLSAKAADTVRRGRENVLRVLDGTDDRLLVITGPCSIHDPAAALDYADHLATMAGRFTDDLLIVMRVYFEKPRTVGGWKGLINDPHLDGTGDVNHGLRIARHLLLELAERGLPVACEWLDTTIPAYLADTVSWGAIGARTVESQNHRMLASGLSMPVGFKNRRDGDITVAIDAIRAAAARHVVPGVDPGGLPAILHTAGNPDCHLVLRGGNSAPNHDASSVHTALTALQDAGLPRRVVIDASHDNSRKDHHRQPVVAGQIADQVKGGQRGIVGVMLESNLRAGRQDLRPGQPLTYGQSITDACIDIPTTQTVLQTLATATAARRRLSQN

SEQ ID NO: 1371 - DNA, 1119 bp, Schizosaccharomyces pombe
  CDS (1)..(1119)
atgtctccggtttttttacccagcggtgaaacttacgatcaagagcatcttgatgacaaccgtgtcttaggttacaaccctttggttcctgccgctttggttcaacaagagattcctgtttctgaaacttctcgcaaagtcatcactgactccagaaaggagattcaagctattctcaacaaacaagatgacagaattatcgttgttgtcggtccttgctccattcatgaccctaaattggccatggactatgctaagttgctgaagcccaaagctgacgagcttcaggatgctttgtgcgttgtcatgcgttgttatttggagaagccccgtactactatcggatggaagggtttggtcaacgaccctaacttggatggttcttttgctatcaacaagggtattaggatggctcgtcaaatgtattgcgacgttaccaattttggcattcctttggccagtgagatgttggacaacatttctccccaattcttcgccgacttactcagttttggtgctatcggtgctcgtactaccgagtctcaattacatcgtgaattggcttctgccctttccttccctgttggtttcaagaatggtactgatggtactgttggtgtggcgattgatgccattggtgctaccgcccatcctcacacaatgctaggagttactaaacaaggtctcgccgctattaccatgaccaggggcaacaaggataccttcatcattttgcgtggtggtaagaagggtcctaactatgatgctgagcacgttgccgccgttcgcaaagatcttgagaaggccaaccttcctcctcgtatcatgatcgattgctctcatggcaactcaagcaagaatcatttgaaccaaccaaaggtctccaagagcatcgccgaacaaatcagaaatggcgactcttccattgttggtgttatgattgaatctcatatcaatgaaggtcgtcaagatgctccaatccgtcctggcgttaaggatactctcaagtacggtgtcagtatcactgatgcttgtgttagctgggaacaaactgctccaatgctagacgatcttgctgaagctgtccgtgctcgccgtcaaaaccaaaaaagtaattaa

SEQ ID NO: 1372 - protein, 372 aa, Schizosaccharomyces pombe
MSPVFLPSGETYDQEHLDDNRVLGYNPLVPAALVQQEIPVSETSRKVITDSRKEIQAILNKQDDRIIVVVGPCSIHDPKLAMDYAKLLKPKADELQDALCVVMRCYLEKPRTTIGWKGLVNDPNLDGSFAINKGIRMARQMYCDVTNFGIPLASEMLDNISPQFFADLLSFGAIGARTTESQLHRELASALSFPVGFKNGTDGTVGVAIDAIGATAHPHTMLGVTKQGLAAITMTRGNKDTFIILRGGKKGPNYDAEHVAAVRKDLEKANLPPRIMIDCSHGNSSKNHLNQPKVSKSIAEQIRNGDSSIVGVMIESHINEGRQDAPIRPGVKDTLKYGVSITDACVSWEQTAPMLDDLAEAVRARRQNQKSN

SEQ ID NO: 1373 - DNA, 1248 bp, Corynebacterium glutamicum
  CDS (101)..(1228)
tagttgtgccacctaaaacgcgaacagaaccggagtcgagcagcacctccccgcaagggtagaggggctgcttttttgtttcctaaattcaccccatcccatgcatagccctgaaaggcaagaaaaaatgagttctccagtctcactcgaaaacgcggcgtcaaccagcaacaagcgcgtcgtggctttccacgagctgcctagccctacagatctcatcgccgcaaacccactgacaccaaagcaggcttccaaggtggagcaggatcgccaggacatcgctgatatcttcgctggcgacgatgaccgcctcgttgtcgttgtgggaccttgctcagttcacgatcctgaagcagccatcgattacgcaaaccgcctggctccgctggcaaagcgccttgatcaggacctcaagattgtcatgcgcgtgtacttcgagaagcctcgcaccatcgtcggatggaagggattgatcaatgatcctcacctcaacgaaacctacgacatcccagagggcttgcgcattgcgcgcaaagtgcttatcgacgttgtgaaccttgatctcccagtcggctgcgaattcctcgaaccaaacagccctcagtactacgccgacactgtcgcatggggagcaatcggcgctcgtaccaccgaatctcaggtgcaccgccagctggcttctgggatgtctatgccaattggtttcaagaacggaactgacggaaacatccaggttgcagtcgacgcggtacaggctgcccagaacccacacttcttcttcggaacctccgacgacggcgcgctgagcgtcgtggagaccgcaggcaacagcaactcccacatcattttgcgcggcggtacctccggcccgaatcatgatgcagcttcggtggaggccgtcgtcgagaagcttggtgaaaacgctcgtctcatgatcgatgcttcccatgctaactccggcaaggatcatatccgacaggttgaggttgttcgtgaaatcgcagagcagatttctggcggttctgaagctgtggctggaatcatgattgagtccttcctcgttggtggcgcacagaaccttgatcctgcgaaattgcgcatcaatggcggtgaaggcctggtgtacggacagtctgtgaccgataagtgcatcgatattgacaccaccatcgatttgctcgctgagctggccgcagcagtaagggaacgccgagcagcagccaagtaattaagggcgctagactgtta

SEQ ID NO: 1374 - protein, 375 aa, Corynebacterium glutamicum
MHSPERQEKMSSPVSLENAASTSNKRVVAFHELPSPTDLIAANPLTPKQASKVEQDRQDIADIFAGDDDRLVVVVGPCSVHDPEAAIDYANRLAPLAKRLDQDLKIVMRVYFEKPRTIVGWKGLINDPHLNETYDIPEGLRIARKVLIDVVNLDLPVGCEFLEPNSPQYYADTVAWGAIGARTTESQVHRQLASGMSMPIGFKNGTDGNIQVAVDAVQAAQNPHFFFGTSDDGALSVVETAGNSNSHIILRGGTSGPNHDAASVEAVVEKLGENARLMIDASHANSGKDHIRQVEVVREIAEQISGGSEAVAGIMIESFLVGGAQNLDPAKLRINGGEGLVYGQSVTDKCIDIDTTIDLLAELAAAVRERRAAAK

SEQ ID NO: 1375 - DNA, 1083 bp, Methylophilus methylotrophus
  CDS (1)..(1083)
atgactgcatacgaaaaattagccaccgatgatgtgcgcgtgcttgaaatcaagccgctggtaaagcccgcggagctattgtctcgcctgcaggaaagtacagtcagtacccaaaacatccttaaaacgcggtcagcgattcatcatattctccatcagggcgacgaccggttgctggtgattgttggcccttgttccatccatgacacggaagctggcatggagtacgcgcgacgcctgctcgatgtgcgtcagcgactgggtggcgaattgctcattgtcatgcgcgtctattttgagaaaccccgtaccacggtagggtggaaaggcctgatcaacgacccgcatctggatgggacttatgatatcaatcttggattggagaaggcccgccgtttcctgctggatgtgaatgaaattggcatgcctgcagccacagaattcctcgatgtggtctccccgcaatatactgctgacctggtcagctggggagctattggcgctcggacgacagagtctcagattcaccgcgaattggcctctggcctgtcttgtccggttggctttaaaaatgggaccgatggcggcgtcaaagttgccattgatgcgattaaggcagcagccagtccgcatcactttttgtccgtgaccaaagaaggcgaatccgctatttttgccaccaagggtaatgaagactgccatgtgattttacgtggcggtaaagcgccgaactttgatgcgcctagtgtggcagcagtatgcgaccaattggcagacgctggcctggcaccggtattgatggtggattgcagtcatggcaatagccagaagcaatataaaaaccaaatttcggtggtgaatgatgtggctagccaaatagcgggtggagatgctcgcataatcgggatcatgctagagtcgcatttgaacgaagggcgacaggatcattcgccaggctgcagccttaattatgggcaatccatcaccgatgcctgtttgggatgggaggactcagtggctgtgctggaaacgctggctgctgcagtcaaggcccgccgtgacaagcatgccgctgctgaataa

SEQ ID NO: 1376 - protein, 360 aa, Methylophilus methylotrophus
MTAYEKLATDDVRVLEIKPLVKPAELLSRLQESTVSTQNILKTRSAIHHILHQGDDRLLVIVGPCSIHDTEAGMEYARRLLDVRQRLGGELLIVMRVYFEKPRTTVGWKGLINDPHLDGTYDINLGLEKARRFLLDVNEIGMPAATEFLDVVSPQYTADLVSWGAIGARTTESQIHRELASGLSCPVGFKNGTDGGVKVAIDAIKAAASPHHFLSVTKEGESAIFATKGNEDCHVILRGGKAPNFDAPSVAAVCDQLADAGLAPVLMVDCSHGNSQKQYKNQISVVNDVASQIAGGDARIIGIMLESHLNEGRQDHSPGCSLNYGQSITDACLGWEDSVAVLETLAAAVKARRDKHAAAE

SEQ ID NO: 1377 - DNA, 1107 bp, Debaryomyces hansenii
  CDS (1)..(1107)
atgagtaaaacaccaatcccagacgaatacgatgataccaggattttaggatacgatcctttgataccacctgcgttattacagcacgaaatcagagcaagtaaagaatcattggacgttgtgatcagaggacgtattgaatcatcagagattataagcggaaaggatgaccgttgtttggtcattgttggaccatgttctatccatgacactgaagcagcattggaatatgctaccagattgaagaagttgtcgttggaattggaaaatgacttagtaattgtcatgagagcatacttggaaaagccaagaactaccgttggttggaaagggttgatcaacgacccagatgtggacaactcgtttgatatcaacagagggttaagaatctcccgtcagttatactctgatttgaccggcaagactggcttaccaattggttccgagatgttggataccatttctccacaatacttctcagactttttgagttttggtgctattggtgctagaaccaccgagtcgcaattacaccgtgagttagcatctggtttatctttcccaattggtttcaagaatggtaccgatggtaacttaggcgttgccttagatgctgttcaagcgtcttctaagggtcaccacttcatgggtgtcaccaagaatggtactgctgccattactactaccaagggtaacgaaaactgtttcatcatcttgagaggtggtaagaagattaccaactacgaccctgaatctgtcgctgccgcaaaggaagccatcaacaagagtaccgatccaaatatcaagttgatggttgattgctctcatgataattctcaaaaagactacagaaaccaacctaaggtaatggaaagtgttgttgaccaaatctctaagggtgaaaacgctcttatcggtgtcatgattgaatctcacattaatgaaggtaaacaaagcatgccaggtccaaaagaagacaagagcgctttgaagtacggtgtctctatcactgatggatgtgttggttgggaaactactgttgaattattgcacaacttgagtaaggccgtgcaagaaagaagacaaattaataagtctaaagcttaa

SEQ ID NO: 1378 - protein, 368 aa, Debaryomyces hansenii
MSKTPIPDEYDDTRILGYDPLIPPALLQHEIRASKESLDVVIRGRIESSEIISGKDDRCLVIVGPCSIHDTEAALEYATRLKKLSLELENDLVIVMRAYLEKPRTTVGWKGLINDPDVDNSFDINRGLRISRQLYSDLTGKTGLPIGSEMLDTISPQYFSDFLSFGAIGARTTESQLHRELASGLSFPIGFKNGTDGNLGVALDAVQASSKGHHFMGVTKNGTAAITTTKGNENCFIILRGGKKITNYDPESVAAAKEAINKSTDPNIKLMVDCSHDNSQKDYRNQPKVMESVVDQISKGENALIGVMIESHINEGKQSMPGPKEDKSALKYGVSITDGCVGWETTVELLHNLSKAVQERRQINKSKA

SEQ ID NO: 1379 - DNA, 1074 bp, Yarrowia lipolytica
  CDS (1)..(1074)
atgtcccgttcctcctctcccaacgcctcctctgctgaggacgtgcgaattctgggctacgaccccctcctcgctcccgctcttctccagactgaggttgcctccaccaaaaacgcccgagagaccgtctccaagggccgaaaggactccattgatgtcatcaccggcaagtccgacaagttgctgtgcattgtcggtccctgctccctccacgaccccaaggccgccatggagtacgcccagcgactcaaggagctgtctgacaagctgtctggtgagctcgtcatcgttatgcgagcctacctcgagaagccccgaaccaccgttggctggaagggtctgatcaacgaccccgacatggacgagtctttcaacatcaacaagggtctgcgactctcccgaaaggtcttctgcgaccttaccgacttgggtctgcccattgcctccgagatgctcgataccatttctccccagttcctggccgacctgctctccctgggtgccattggtgctcgaaccaccgagtcccagctgcaccgagagctcgcctccggtctgtctttccccgttggtttcaagaacggaaccgacggtactctgggtgttgccgttgatgctgtccaggccgcctctcaccctcaccacttcatgggtgtcaccaagcagggtgttgccgccatcaccaccaccaagggtaacgagaactgcttcatcattctgcgaggaggtaagaagggcaccaactacgacgccgagtccgtcgccgagtgcaagaaggccaccgagtccatgctcatggttgactgctctcacggcaactccaacaaggactaccgaaaccagcccaaggtttccaaggccgttgctgagcaggttgctgctggcgagaagaagatcatcggtgtcatgatcgagagtaatatccacgagggcaaccagaaggtccccaaggagggcccctctgcccttaaatacggtgtctccatcaccgacgcctgtgtctcttgggagaccaccgtggacatgctcaccgagctggccaacgccgtcaaggagcgacgaaacaagaactaa

SEQ ID NO: 1380 - protein, 357 aa, Yarrowia lipolytica
MSRSSSPNASSAEDVRILGYDPLLAPALLQTEVASTKNARETVSKGRKDSIDVITGKSDKLLCIVGPCSLHDPKAAMEYAQRLKELSDKLSGELVIVMRAYLEKPRTTVGWKGLINDPDMDESFNINKGLRLSRKVFCDLTDLGLPIASEMLDTISPQFLADLLSLGAIGARTTESQLHRELASGLSFPVGFKNGTDGTLGVAVDAVQAASHPHHFMGVTKQGVAAITTTKGNENCFIILRGGKKGTNYDAESVAECKKATESMLMVDCSHGNSNKDYRNQPKVSKAVAEQVAAGEKKIIGVMIESNIHEGNQKVPKEGPSALKYGVSITDACVSWETTVDMLTELANAVKERRNKN

SEQ ID NO: 1381 - DNA, 1089 bp, Yarrowia lipolytica
  CDS (1)..(1089)
atgcccgctatgcacaacgcttctaacgctcagggagaccgaaaccggaccgaggactggcgaatccggggctacaaccctctcacagcccccgatctgctccagcatgagatccctctgaccaagcagtccaaggccaccattctcaagggccgacaggacgcctgtgatattctggatggtaaggacgaccgaatcattgttgtggttggcccctgttccatccatgaccccaaggctgccatggagtacgccgagcgactcaagcagatctctgacaagctgtctggcgagcttctgatcgtcatgcgagcctacctcgaaaagcctcgaaccaccgttggctggaagggccttattaatgatcctgacatggacggctctttcaagatcaacaagggcctgcgagtcgctagagatctcttcgtgaagctcaccgagctcaaccccattgcttctgagcttctggacaccatttctccccagttcctggctgatctcttctctgtcggagccattggtgctcgaaccaccgagtcccagcttcaccgagagcttgcctctggtctgtctttccccgttggtttcaagaacggtactgacggaggtattaaggtggctctggacgccatccaggccgccgcccacccccaccacttcctttccgtcaccaagcccggtgtggttgccattgtcggcaccgacggaaacgaggactgcttcctgattctgcgaggaggttccaagggccccaactacgatgctgagcacgtcgccgaggtcaagaagcaggttggagagaccaagggtccccgaatcatggtagactgctcgcacggcaactcatcaaagaaccacaagaaccagcctctggtcgcctctaacgtggctcagcagattgctgctggtgagaagtccatttgcggtcttatgattgagtccaacatccacgagggtcgacaggacatctgcgataacaaggaggacatgaagtacggtgtgtctgtcaccgatgcctgcatcaactgggaggacactgagaaggtgctcgaggagctggcccaggccgtcaagactcgacgaggttag

SEQ ID NO: 1382 - protein, 362 aa, Yarrowia lipolytica
MPAMHNASNAQGDRNRTEDWRIRGYNPLTAPDLLQHEIPLTKQSKATILKGRQDACDILDGKDDRIIVVVGPCSIHDPKAAMEYAERLKQISDKLSGELLIVMRAYLEKPRTTVGWKGLINDPDMDGSFKINKGLRVARDLFVKLTELNPIASELLDTISPQFLADLFSVGAIGARTTESQLHRELASGLSFPVGFKNGTDGGIKVALDAIQAAAHPHHFLSVTKPGVVAIVGTDGNEDCFLILRGGSKGPNYDAEHVAEVKKQVGETKGPRIMVDCSHGNSSKNHKNQPLVASNVAQQIAAGEKSICGLMIESNIHEGRQDICDNKEDMKYGVSVTDACINWEDTEKVLEELAQAVKTRRG

SEQ ID NO: 1383 - DNA, 1119 bp, Kluyveromyces lactis
  CDS (1)..(1119)
atgttcatcactaacgatcatattggggacagaagtagtttagaagactggagaatcaagggatatgatccattgaccccaccggacttattacaacatgaatatcccatcggtgaaaaggccaaaaagatcatcgttgaagctagagagaaagtatgtgacattttgaatgggaaggacgaccgtttagttgtagttattgggccatgttctattcatgatccaaaggctgcctacgaatacgcagaccttttgaagaaaatttctgatgaattatccgatgatctattaatcattatgagagcgtacttggagaaacctagaaccactgttggctggaaaggtttgatcaatgatccagatatcgataattctttccaaattaacaaaggtttaagaatttctagagagatgttcaccagattgactgaaaaattaccaatcgctggtgaaatgttggacaccatttctccacaatttttgagtgactgtttctctctgggtgctatcggcgctagaaccactgaatctcaactacatagggaattagcttctggtctttctttcccaattggttttaagaatggtactgacggtggtctccaagttgctgttgatgccatgagatctgctgcacactcacattacttcttgtctgttactaaacctggtgtcactgccatcgttggaacagaaggtaacgaagatacctttgttatcttaagaggtggtaagactggaactaatttcgatgctgaaaacgtaaaaaagacgcaagccgaattggtcaaggcaaaggttgctgatgctgaaggtgtccaaagaagaatcatggttgattgttctcatgggaattcaaagaaagatttcagaaatcaaccaaaggtggctcagtcactttacgaacaactatcagctggtcaaaatgctatctgtggtgtcatgatcgaatctaacttagtcgaaggtagacaagacgttcctccagaaggtggccgtgaaaagttgatttacggatgttctatcaccgatgcctgtatcggttgggaaacaactgaagatgttctaagattattggcaaagggtgttaaaaacagaagagctctttcaaaggcttga

SEQ ID NO: 1384 - protein, 372 aa, Kluyveromyces lactis
MFITNDHIGDRSSLEDWRIKGYDPLTPPDLLQHEYPIGEKAKKIIVEAREKVCDILNGKDDRLVVVIGPCSIHDPKAAYEYADLLKKISDELSDDLLIIMRAYLEKPRTTVGWKGLINDPDIDNSFQINKGLRISREMFTRLTEKLPIAGEMLDTISPQFLSDCFSLGAIGARTTESQLHRELASGLSFPIGFKNGTDGGLQVAVDAMRSAAHSHYFLSVTKPGVTAIVGTEGNEDTFVILRGGKTGTNFDAENVKKTQAELVKAKVADAEGVQRRIMVDCSHGNSKKDFRNQPKVAQSLYEQLSAGQNAICGVMIESNLVEGRQDVPPEGGREKLIYGCSITDACIGWETTEDVLRLLAKGVKNRRALSKA

SEQ ID NO: 1385 - DNA, 1095 bp, Kluyveromyces lactis
  CDS (1)..(1095)
atgtcacaaactccaacacctatgttccatgaacaagaagatgtcagaatcttgggttacgatccattggtttcaccagctctccttcaggcccaagttcctgcctctcaagagtgtctagaaactgcgcaaaagggtagaaaagagtcaattgacatcatcactggtaaagacgacagagttctggttgttgttggtccatgttccatccatgacttgaaagaagcgcaagactacgctaagggattaaaggctttgtctgacgaactaaaaggtgatttatgtattataatgagagcttacttggaaaagccaagaactactgttggttggaaaggtttgatcaacgatccagatgtggataacacttacaacattaacaagggtttgcaagtctctagacaattgtttgtgaatttgactagtttaggtttgccaattggttccgaaatgttggacaccatttctccacaatacttggccgatttgttgtccttcggtgccattggtgccagaaccactgaatcacaattgcatagagaactagcatccggtttgtctttcccagtaggtttcaagaacggtaccgatggtaccttgggtgttgcattggacgctgttcaagctgcctctcactctcaccatttcatgggtgtcaccaagcacggtgtcgctgctattaccaccaccaagggtaacgaacactgtttcgtcattctaagaggtggtaagcaaggtaccaactacgacagtgtttctgtcgcagaagccaagaaagctctacctccaaccggtgttctaatgattgattactctcacggtaattctaataaagacttcagaaaccaaccaaaggttaacgacgccgtttgcgaacaaatcgctaacggtgaagacaaaatcatcggtgtcatgattgaatcccacatcaacgaaggtaagcaatctattccagcggaaggtaaagctggtttgaaatacggtgtttctatcacagatggatgtataagtttggaaacaactgctgaagtactaagaaaattggctgcagcagttagagcaagaagagaactaaaaaagaagaacactgaataa

SEQ ID NO: 1386 - protein, 364 aa, Kluyveromyces lactis
MSQTPTPMFHEQEDVRILGYDPLVSPALLQAQVPASQECLETAQKGRKESIDIITGKDDRVLVVVGPCSIHDLKEAQDYAKGLKALSDELKGDLCIIMRAYLEKPRTTVGWKGLINDPDVDNTYNINKGLQVSRQLFVNLTSLGLPIGSEMLDTISPQYLADLLSFGAIGARTTESQLHRELASGLSFPVGFKNGTDGTLGVALDAVQAASHSHHFMGVTKHGVAAITTTKGNEHCFVILRGGKQGTNYDSVSVAEAKKALPPTGVLMIDYSHGNSNKDFRNQPKVNDAVCEQIANGEDKIIGVMIESHINEGKQSIPAEGKAGLKYGVSITDGCISLETTAEVLRKLAAAVRARRELKKKNTE

SEQ ID NO: 1387 - DNA, 1074 bp, Erwinia carotovora subsp
  CDS (1)..(1074)
atgcaaaaagattcgcttaataatattaatatcagtgcagaacaggttttgattactcccgatgaattgaaagccaagtttccgcttaacgacgtggagcaacgcgacattgcgcaagcgagagcgaccattgcggacatcattcatggccgtgatgaccggttattgatcgtctgcggaccttgctctattcatgatacagatgcagcgctggaatatgcgcgccgcttgcagttgcttgccgctgaattgaacgatcgtctctacattgtgatgcgcgtttattttgaaaagccacgtacaacagtgggttggaaagggctcatcaacgatccattcatggatggttcatttgatgtggaatctgggttgcacatcgctcgtgggctgcttctgcaactggtgaatatggggctgccgctggcgacagaagcgcttgatccgaacagtccgcagtacctgggcgatctatttagctggtcagctatcggcgcacgtacgactgaatcacaaacgcaccgtgagatggcttctggcctgtcgatgcctgttgggttcaaaaacggaacggatggcagtctgggaacggcgatcaatgcgatgagagctgccgcgatgccacatcgcttcgtcggtatcaatcaaactgggcaagtttgtctgctgcaaacgcaggggaatggtgatggccatgtgattctgcgcggtggtaaaaccccaaactacagtgcacaggatgtcgccgaatgtgaaaaacagatgcaggaagcaggactgagacctgcgctgatgatagattgtagccacggtaattcgaataaagactaccgccgtcagccactggttgttgaatctgcgattgaacaaatcaaggcgggaaatcgttcgattataggactgatgctggaaagccaccttaacgaggggagccagtcttcagaacaaccacgttcagatatgcgctacggtgtatcagtcacggatgcttgtatcagttgggaaagtacagaaacgttgctgcgttccgttcatcaagatctgagtgccgcacgtgtgaaacattcaggagagtaa

SEQ ID NO: 1388 - protein, 357 aa, Erwinia carotovora subsp
MQKDSLNNINISAEQVLITPDELKAKFPLNDVEQRDIAQARATIADIIHGRDDRLLIVCGPCSIHDTDAALEYARRLQLLAAELNDRLYIVMRVYFEKPRTTVGWKGLINDPFMDGSFDVESGLHIARGLLLQLVNMGLPLATEALDPNSPQYLGDLFSWSAIGARTTESQTHREMASGLSMPVGFKNGTDGSLGTAINAMRAAAMPHRFVGINQTGQVCLLQTQGNGDGHVILRGGKTPNYSAQDVAECEKQMQEAGLRPALMIDCSHGNSNKDYRRQPLVVESAIEQIKAGNRSIIGLMLESHLNEGSQSSEQPRSDMRYGVSVTDACISWESTETLLRSVHQDLSAARVKHSGE

SEQ ID NO: 1389 - DNA, 1047 bp, Erwinia carotovora subsp
  CDS (1)..(1047)
atgctacaaacagatgaactgcggagcgcgcgcatcgagagtctggttacgccccaaacgctacttgccagactcccgattacccctgacgttgccgaaaatgtcacctcctcacgcaagaaaattgaagccattctcaccggccacgatccccgtttactcgttgtgattggcccctgttcgatccatcacaccgacagcgccttggactatgcgcgccgtctggctgtgctacgcacgcagtatcaggatcggctggaaattgtcatgcgcacttattttgaaaaaccgcgcacggtggtcggttggaaggggcttatctccgatcccgcactcaatggctcgttccaggtgaacgaagggctggagattgctcgccgtctgctgctggacgtcaatcaacttggattgccgaccgcaacggaattcctcgatatggtcaccggccaatatatcgccgatttgattagctggggcgcgattggtgcgagaaccaccgaaagccaaatccaccgcgagatggcgtctgcactatcctgccctgtcggcttcaaaaacgggacggatggcaatacacgcatcgccgtcgatgcgatccgtgccgcacgcgcccaacacatgttcctctcgccggacaaacaaggcttcatgtcggtttacaaaacgcagggcaacccgtttggccacataattatgcgcggcgggaaaaaaccgaactatcacgcggaagatattgccgctgcctgcgcgcatctcagcgagttttctctgcccgaacatctggtgatcgatttcagccatgctaactgtcagaaacagcatcgccgccagctcgatgttgccgatgatatctgccagcaaattcgcgctggttcacgcgccatcgcaggcatcatggcggaaagtttcttaatcgaagggagtcagccggcgatcaacccgctggcgctgacgtatgggcaatccattaccgatccttgcctaagctggcaggacaccgaaacgctgctggcacgtctggcaagcgctgtcgatagccgattctag

SEQ ID NO: 1390 - protein, 348 aa, Erwinia carotovora subsp
MLQTDELRSARIESLVTPQTLLARLPITPDVAENVTSSRKKIEAILTGHDPRLLVVIGPCSIHHTDSALDYARRLAVLRTQYQDRLEIVMRTYFEKPRTVVGWKGLISDPALNGSFQVNEGLEIARRLLLDVNQLGLPTATEFLDMVTGQYIADLISWGAIGARTTESQIHREMASALSCPVGFKNGTDGNTRIAVDAIRAARAQHMFLSPDKQGFMSVYKTQGNPFGHIIMRGGKKPNYHAEDIAAACAHLSEFSLPEHLVIDFSHANCQKQHRRQLDVADDICQQIRAGSRAIAGIMAESFLIEGSQPAINPLALTYGQSITDPCLSWQDTETLLARLASAVDSRF

SEQ ID NO: 1391 - DNA, 1056 bp, Erwinia carotovora subsp
  CDS (1)..(1056)
atgaattaccaaaatgatgatttaagaattaaagagattaatgaacttttgccgccggttgctttgctagaaaagtttccagccacggagaaggccgcggaaacggtatcgttcgcgcgtacagccatccataaaattcttaacggcaatgatgaccgcctgctggtggtgattggtccttgctcgatccacgacacgaaagccgcgaaagagtatgccgcacgtctgctgacgctgcgtagcgagctgagcgacgatctggaagtggtcatgcgggtttattttgaaaaaccacgcaccacgattggctggaaagggctaatcaacgatccgcacatggataatagtttccagatcaacgatggtctacgcattgcgcgccagctgctgctggaaattaacgataccggtttacctgctgcgggtgaattcctggatatgattactccgcaatacctggcggatctgatgagctggggcgctattggcgcacgtactacagaatctcaggtacaccgtgaattagcgtctggcctgtcatgtcctgtgggctttaaaaacggcactgacggcacgatcaaagtagcgattgatgcgatcaacgcagccagtgcgccgcactgcttcctgtctgtcaccaaatggggacattcggctatcgtgaataccagtggtaacaacgattgccacatcattctgcgtggtggtaaaacgccgaactatagcgctgagcacgttaaagacgtgaaaattggcttggaaaaagcgggcctgacaccgcaggtcatgatcgatttcagccatgcgaacagcagcaagcagttcaaaaagcagatggaagtctgtactgatgtctgtgggcagatcgcacagggtgaaaaagcgattatgggcgtgatggtggaaagccatctggttgaaggcaaccagaatctggaaagcggcgaacctctggtttatggccgtagcgttaccgatgcctgtattagctgggaagacacagaatcactgttgcgccagttagcgtctgctgtacgagagcgccgcaataagtaa

SEQ ID NO: 1392 - protein, 351 aa, Erwinia carotovora subsp
MNYQNDDLRIKEINELLPPVALLEKFPATEKAAETVSFARTAIHKILNGNDDRLLVVIGPCSIHDTKAAKEYAARLLTLRSELSDDLEVVMRVYFEKPRTTIGWKGLINDPHMDNSFQINDGLRIARQLLLEINDTGLPAAGEFLDMITPQYLADLMSWGAIGARTTESQVHRELASGLSCPVGFKNGTDGTIKVAIDAINAASAPHCFLSVTKWGHSAIVNTSGNNDCHIILRGGKTPNYSAEHVKDVKIGLEKAGLTPQVMIDFSHANSSKQFKKQMEVCTDVCGQIAQGEKAIMGVMVESHLVEGNQNLESGEPLVYGRSVTDACISWEDTESLLRQLASAVRERRNK

SEQ ID NO: 1393 - DNA, 1113 bp, Acinetobacter sp
  CDS (1)..(1113)
atgatccaatcagtgacagcaatgaatactttacagtccaatccagtttcacagccagatatcgatgatgttaacatcaaaagcatccagcctcttgttacgcctgccgagttaaaagcagagcttccactgacagaaagtgcttatcaaaccgtactccacggtcgtgaaaccattcgcaacattcttgatggtacagacaaacgtatttttgttgtcattgggccatgctctattcacgaccctaaagcagcgcatgaatacgcaacacgcttaaaagtactcagcgaaaaagtaaaagacagtttgtatattgtgatgcgtgtttattttgaaaaaccacgtacaacagtaggctggaaaggtttgattaatgatcctgatatgaatgactcattcaatattgaaaaaggtctgcgtattggacgtaaattactccttgaactaaacgaacaaggtctaccttgtgctacagaagcgcttgatccaaactctcctcagtattatcaagatctgatttcatggtcggctattggcgctcgtaccactgaaagtcagacacatcgtgagatgtcatctggattatcatcaccagttggctttaaaaacggaacagatggtgggcttacagtcgcaacaaatgcgatgcaatctgtcaaacacggtcacagctttttaggtttgaatgaagctggtcaggtttctgtcattcataccagtgggaatccatatgcacacgttgtattacgtggcggtaacggaaagccaaactatgatgcagggtcagtcgcagaagctgaaaatgcactggcaaaagcaaaagtcagcactaaaatcatgattgatgccagccatgccaattcaaataaagacccatacttacagccacttgtactcaaaaatgtaaccgagcaaatcatcgacggtaataagtcaatagtgggtgtcatggttgaaagtcacctcaaaggcggacgtcaggatattcctgaaaacctatgtgatcttgaatacggcaagtctgttaccgatggctgtattgattgggaaaccacagaaaatgttttgcttgaaatgcatgaagcactcaaagatgttttagctcagcgttaa

SEQ ID NO: 1394 - protein, 370 aa, Acinetobacter sp
MIQSVTAMNTLQSNPVSQPDIDDVNIKSIQPLVTPAELKAELPLTESAYQTVLHGRETIRNILDGTDKRIFVVIGPCSIHDPKAAHEYATRLKVLSEKVKDSLYIVMRVYFEKPRTTVGWKGLINDPDMNDSFNIEKGLRIGRKLLLELNEQGLPCATEALDPNSPQYYQDLISWSAIGARTTESQTHREMSSGLSSPVGFKNGTDGGLTVATNAMQSVKHGHSFLGLNEAGQVSVIHTSGNPYAHVVLRGGNGKPNYDAGSVAEAENALAKAKVSTKIMIDASHANSNKDPYLQPLVLKNVTEQIIDGNKSIVGVMVESHLKGGRQDIPENLCDLEYGKSVTDGCIDWETTENVLLEMHEALKDVLAQR

SEQ ID NO: 1395 - DNA, 1056 bp, Acinetobacter sp
  CDS (1)..(1056)
atgaacgcgcttaatacattgatccagaaaaatacgacaaaagaaattacacttagcttgccacagcaattaaaagcaaaatattcgcttgctcccatttttttagagcagatcgcagagcatcgtcaaaccattcaaaatatccttgctggcaaagattcacggcttttggtcgtaactggtccatgttcgattcatgatcctgtttctgcgctgcaatacgcacaaaggcttgtcaaattacaagatcaagttaaagatcagatttttttagtgatgcgtgcttatctcgaaaaaccacgtacaacaattggctggaagggttttttatacgatccaaatcttgatggttcatcagatttacagctgggtttagaaaaatctcgcgcattatatttgcaaattattgaaatggggcttccaattgccagtgaaattttaagcccaatggcgactggctattttgatgatttactggcttggggagctattggggcacgtaccagtgaatctcagattcatcgtgaaatttcaagtcatatgccgtttccaattggttttaaaaatggtactgatggttcgattcagatcgcattggatgccattcaatctgcacaaaatgaacatcagtttttagggatgagtcagcttggccagcctgcaattttacaaagttctgggaatccactgccgcatttgatcttgcgtggagcaaatgatggaccaaattatgatattcagtccatttcgaatattagagcaaaacataagggcgaattacctgcgcttgtaattgactgtagtcatggcaatagttcaaaagatccgatgaaacaaccgcaagtacttcgacaaatcattgcagaaagaattgaaagtgatgttcgaggtgtgatgttggaaagccatttggtcgatggaaatcagaagatttcatgcgacataacctatggccaatctgtgactgatggttgccttgggtgggagaagacagagaatttacttttagaaatggctgatcaactcgcacaatgtcctttacgccaatcagcttaa

SEQ ID NO: 1396 - protein, 351 aa, Acinetobacter sp
MNALNTLIQKNTTKEITLSLPQQLKAKYSLAPIFLEQIAEHRQTIQNILAGKDSRLLVVTGPCSIHDPVSALQYAQRLVKLQDQVKDQIFLVMRAYLEKPRTTIGWKGFLYDPNLDGSSDLQLGLEKSRALYLQIIEMGLPIASEILSPMATGYFDDLLAWGAIGARTSESQIHREISSHMPFPIGFKNGTDGSIQIALDAIQSAQNEHQFLGMSQLGQPAILQSSGNPLPHLILRGANDGPNYDIQSISNIRAKHKGELPALVIDCSHGNSSKDPMKQPQVLRQIIAERIESDVRGVMLESHLVDGNQKISCDITYGQSVTDGCLGWEKTENLLLEMADQLAQCPLRQSA

SEQ ID NO: 1397 - DNA, 1119 bp, Candida glabrata
  CDS (1)..(1119)
atgttcatcaagaatgactacagaggtgacagaacccgtctagaagactggagaatcaaaggttacgatccattgactcctcctgatcttcttcagcatgaatacccaatcagtgagaaaggtgctgccaacatactgaaagctagagattctgtgtgtgacatcttgaatggtaaggatgaccgtatggttattgtcattggtccatgctccattcatgacccaaaggcagcttacgaatacgccgataagctagcagtaatcgctgagaagctatccgatgatctacttattatcatgagagcgtacttagagaagccaagaaccaccgttggatggaagggtctgataaatgacccagatattgataactctttccaaatcaacaaaggtttaagaatctcaagagaaatgttcacaaagctgatcgaaaagcttcctattgccggtgaaatgttagacactatctccccacaattcttgagtgactgtttctctctaggtgccattggtgccagaacaactgaatcccaactgcatagagaactagcttcaggtctatctttcccaattggtttcaagaatggtaccgatggtggcctacaagttgccatcgatgctatgagagctgcatctcacgaacattacttcctttctgtcacaaagcctggtgtcaccgctattgttggtactgaaggtaactccgacacttttatcattttaagaggtggtaagcatggtaccaactacgatgctgaaaatgtgaagtccaccaaagaacaactaaggaaagcaaaattgattgatgaagctgacagtaccagaagaataatgattgactgttctcacggtaacagtaataaggactacagaaatcaaccaaaggtcgctcaagagatctacaaccaactgagtgctggtgaaaacggtttgtgtggtgttatgatcgaatctaacctagtggaaggcagacaagatgttcctccagaaggtggtcgtgagggtctaaaatatggttgctctatcactgatgcttgtattggctgggatactaccgaaagcgttttggaacttctagccgaaggtgttagaaacagaagaaagcatttatccaagtaa

SEQ ID NO: 1398 - protein, 372 aa, Candida glabrata
MFIKNDYRGDRTRLEDWRIKGYDPLTPPDLLQHEYPISEKGAANILKARDSVCDILNGKDDRMVIVIGPCSIHDPKAAYEYADKLAVIAEKLSDDLLIIMRAYLEKPRTTVGWKGLINDPDIDNSFQINKGLRISREMFTKLIEKLPIAGEMLDTISPQFLSDCFSLGAIGARTTESQLHRELASGLSFPIGFKNGTDGGLQVAIDAMRAASHEHYFLSVTKPGVTAIVGTEGNSDTFIILRGGKHGTNYDAENVKSTKEQLRKAKLIDEADSTRRIMIDCSHGNSNKDYRNQPKVAQEIYNQLSAGENGLCGVMIESNLVEGRQDVPPEGGREGLKYGCSITDACIGWDTTESVLELLAEGVRNRRKHLSK

SEQ ID NO: 1399 - DNA, 1071 bp, Candida glabrata
  CDS (1)..(1071)
atgtctgatgcgaatgctaacgaagacgtgagaatcctgggctacgacccgctggtgtcgcctgcgctgctgcaggtgcaagtgccagccacagaggtgtctatccagaccgctaggcgcgggaggaaagagtccatcgagatcatcaccggccgtgacgaccgtgtgctcgtgatcgtcggaccttgctcggttcacgacctcgacgccgcgcaggagtacgcgcagaggctgaagaagctgtccgacgagctgcagaaggacctgtgcatcgtgatgagagcgtacctggagaaaccaagaaccacggtcggctggaaagggttgatcaacgaccctgacgtcaacaacaccttcaacatcaacaagggcctgcagagcgccagacagctgttcgtgaacttgaccaacaccggtgtccctatcggctctgagatgctggataccatctccccacagtacctcgcagacctgctctccttcggtgccatcggcgcaagaaccaccgagtcccaactgcacagagaactggcatcaggtctgtccttccctatcggcttcaagaacgggaccgacggtaccttgggcgtcgccgtagacgcctgccaggccgcatcccactcccaccacttcatgggtgtcaccaagcatggtgtcgccgccatcaccaccaccaagggtaacgagcactgcttcgtcatcctgagaggtggtaagaaaggtaccaactacgacgccaagtccgtcgccgaggccaagaaacagctaccggagggcgcaaacggcctgatgatcgactactcccacggtaactccaacaaggacttcagaaaccagccaaaggtcaacgacgccgtctgcgagcaaatcgccaacggtgaaaaggccatcgtcggtgtcatgatcgagtccaacatcaacgagggcaaccagtgcatcccaccagaaggtaaggccggcctaaagtacggtgtctccatcacggatgcctgtatctcctgggaaaccaccgaagacgtcttgagaaagttggctgccgccgtcagacaaagaagagaacactacaaataa

SEQ ID NO: 1400 - protein, 356 aa, Candida glabrata
MSDANANEDVRILGYDPLVSPALLQVQVPATEVSIQTARRGRKESIEIITGRDDRVLVIVGPCSVHDLDAAQEYAQRLKKLSDELQKDLCIVMRAYLEKPRTTVGWKGLINDPDVNNTFNINKGLQSARQLFVNLTNTGVPIGSEMLDTISPQYLADLLSFGAIGARTTESQLHRELASGLSFPIGFKNGTDGTLGVAVDACQAASHSHHFMGVTKHGVAAITTTKGNEHCFVILRGGKKGTNYDAKSVAEAKKQLPEGANGLMIDYSHGNSNKDFRNQPKVNDAVCEQIANGEKAIVGVMIESNINEGNQCIPPEGKAGLKYGVSITDACISWETTEDVLRKLAAAVRQRREHYK

SEQ ID NO: 1401 - DNA, 1083 bp, Photobacterium profundum
  CDS (1)..(1083)
atggctattcacccatcagtgatgagaacgacgacatgccgtcggcttccttcaccagcagaactgctcagtgactacccgtgcaaggccgacactgaacaccacattatgacatcgcgtaatgatgtgagggatattttacatggcaaagatgatcggcttttggtcgtgattggtccatgctcaattcatgacccggatgcagcactggcatacgcaaagcagcttaagccactggtcgaacagtttagtgatcacttacatattgtaatgcgaacgtatttcgaaaagccccgaacaacaactggttggaaaggcttaatattcgatccgcatctcgacaacagtaatgaccttattactgggttaacaacagcgcgtcagttagtgctcgctattaatgaacttggtgtaccaacctcaaccgaatttttggataataccagttttctatatttggccgacctcatgagctggggagccattggcgcccgcactacagagtcacaagttcaccgacagttaacctcgggcttaccctgccccgtcggtttcaaaaacggcaccgatggtaacattcgtattgcgacagatgccattctttcgagccaatcccctcacttgtataccgttacggggcacgatggacatttatatgcagtagaaagtacaggtaatgccgattgccacatcatcctacgtggtgggcaagaacctaactacagtccgggccatattcaagctgccagcaaagcgctataccaagccaagttaccagtaagtattatggtagattgcagccatggaaacagccaaaagcgtcataaaaaccaattagttgtcgcacaatcgttatgtgaacaactgtctcagggcgaacaagcaatcacgtcaattatggtggagagtttctttgaggaaggcagtcaagcgatcagtgccaatatgacctacggacaatcggtaacggatgcctgtatcaactggagcgacacagaaatattgcttaaccaatttgccgctgccattgcgactcgccgcgcactgtaccaatcggcctcgccagtcgccatgcacggctaa

SEQ ID NO: 1402 - protein, 360 aa, Photobacterium profundum
MAIHPSVMRTTTCRRLPSPAELLSDYPCKADTEHHIMTSRNDVRDILHGKDDRLLVVIGPCSIHDPDAALAYAKQLKPLVEQFSDHLHIVMRTYFEKPRTTTGWKGLIFDPHLDNSNDLITGLTTARQLVLAINELGVPTSTEFLDNTSFLYLADLMSWGAIGARTTESQVHRQLTSGLPCPVGFKNGTDGNIRIATDAILSSQSPHLYTVTGHDGHLYAVESTGNADCHIILRGGQEPNYSPGHIQAASKALYQAKLPVSIMVDCSHGNSQKRHKNQLVVAQSLCEQLSQGEQAITSIMVESFFEEGSQAISANMTYGQSVTDACINWSDTEILLNQFAAAIATRRALYQSASPVAMHG

SEQ ID NO: 1403 - DNA, 1053 bp, Photobacterium profundum
  CDS (1)..(1053)
atgcaaaaaacagatgacgtacgcattagcgagatcaaagaacttttaccaccagttgctgtattggaaagatttccagccactgaactggcggctgaaactgtatatcagtcacgtaaatcgattcacaacattctgaacgatgaagatgaccgtttgttggttgttgttgggccttgttcaattcatgacactgaagctgctatcgaatacggtaaaaagctgaaagtattacgtgaagaattaaaaggtgaccttgaaatcgtaatgcgtgtttactttgaaaaaccacgcaccacagtaggttggaaagggttaattaacgacccgtatatggacaatagctttaagttaaatgatggtttacgtattggacgtaagttgctacttgatttgaccgatatgggcttaccaacagcgggtgagttccttgatatgattaccccacaatacatgggtgatttgatcagctggggcgcaattggtgcgcgtactacagaatcgcaagttcaccgtgagctatcttcaggactatcttgccctgttggttttaaaaacggtacagatggcaacattaagatcgcgaccgatgcgattggatcggcaagtgcacctcaccactttttatcagtgactaagtatggtcattcagctattgtttctactttgggtaatgaagactgtcatatcattcttcgtggcggtaaagagcctaattacagctcagaacacgttaacgcggtgacatcacagctgggtaatgctggtcagcgtaagaaagtaatgattgattttagtcatgctaatagttcgaagaagtttgaacgtcagattattgtttctgaagatgtcggtcagcaagttgctggcggtaacaaagatatttttggtgttatggttgaaagccaccttgttgaaggtcgtcaagatatcgtagaaggcacagagccaacgtatggtcaaagtattaccgatgcatgtattggttgggcagatacagaaacagtacttcgtcaattagcacgtgatgttgctaagcgtcgtcaagcatag

SEQ ID NO: 1404 - protein, 350 aa, Photobacterium profundum
MQKTDDVRISEIKELLPPVAVLERFPATELAAETVYQSRKSIHNILNDEDDRLLVVVGPCSIHDTEAAIEYGKKLKVLREELKGDLEIVMRVYFEKPRTTVGWKGLINDPYMDNSFKLNDGLRIGRKLLLDLTDMGLPTAGEFLDMITPQYMGDLISWGAIGARTTESQVHRELSSGLSCPVGFKNGTDGNIKIATDAIGSASAPHHFLSVTKYGHSAIVSTLGNEDCHIILRGGKEPNYSSEHVNAVTSQLGNAGQRKKVMIDFSHANSSKKFERQIIVSEDVGQQVAGGNKDIFGVMVESHLVEGRQDIVEGTEPTYGQSITDACIGWADTETVLRQLARDVAKRRQA

SEQ ID NO: 1405 - DNA, 1113 bp, Photobacterium profundum
  CDS (1)..(1113)
atgccttctactacccagaatagattgaggaaagccaccatgcaaaaagaccaactgaataatgtacatattcaagatgaatgcgtattgatcactcctcaacaactaaaagccaggttgccactcagtgaaacagcactgaacttcattcgtgaatctcgtcaaaccattgcagatattactcacaagcgtgaccaccgtttactcgtggtatgcggaccatgctcaattcacgatattgacgcagcgaaagcgtacgcccaaaaattgaagcagctttctgaagagctaagtgatcaactgtacattgtaatgcgcgtttattttgaaaaaccacgtacaacagttggttggaaaggtcttatcaatgacccgcatcttgatggctcttttgaagtggaagaaggtttacacattggtcgtcagctactcattgacttggttgaaatggggattcctttagcaacagaagcgcttgatccgatcagtcctcaatacttaggtgatttattcagttgggcagccattggtgcacgtaccactgaatcacaaacacaccgtgaaatggcaagtggcctttcaatgcccgttgggtttaaaaatggtactgatggaagtttggcaacggctatcaatgccatgaaagctgcagcttctgggcaccgttttatggggattaatccagaaggtcaggtggcgctgttgaacacccaaggaaaccctgatggccatgtaattttacgtggcggtaagcaaacgaattatgattcagtctcggttactgagtgtgaaaatgagatgcatcagtcaggtctttcaccatccttgatggtagactgtagccatgcgaattcacgtaaagattaccgtcgtcagccattagtcgctgaagatgtacttcatcaaatccgtgaaggtaataaatcgatcattggtttgatgattgaaagccatttaaatgaaggtagtcaaagcgctgatttaccgcgcgaagaaatggcttatggggtatcgattaccgatgcatgtatcagctgggaagatacagaaacactattacgtcgtacgcgtaaagaattaacgcctttcttaaaggatcgctgcgaaggataa

SEQ ID NO: 1406 - protein, 370 aa, Photobacterium profundum
MPSTTQNRLRKATMQKDQLNNVHIQDECVLITPQQLKARLPLSETALNFIRESRQTIADITHKRDHRLLVVCGPCSIHDIDAAKAYAQKLKQLSEELSDQLYIVMRVYFEKPRTTVGWKGLINDPHLDGSFEVEEGLHIGRQLLIDLVEMGIPLATEALDPISPQYLGDLFSWAAIGARTTESQTHREMASGLSMPVGFKNGTDGSLATAINAMKAAASGHRFMGINPEGQVALLNTQGNPDGHVILRGGKQTNYDSVSVTECENEMHQSGLSPSLMVDCSHANSRKDYRRQPLVAEDVLHQIREGNKSIIGLMIESHLNEGSQSADLPREEMAYGVSITDACISWEDTETLLRRTRKELTPFLKDRCEG

SEQ ID NO: 1407 - DNA, 1056 bp, Photobacterium profundum
  CDS (1)..(1056)
atgccaatgaaaactgatgaactccgtaccgttagcctagggttaatgccaactccggcagaaattgaagctgtctctcctattactgacgaaattgcagcgcacgttgctgattctcgccgtcaagttgaagacatcctaaccggtaaggattctcgacttttagttgtcgtaggaccatgttctgttcacgatacagatgcagcaatggattatgctaaacaccttgttgctgttcaggaacaatacagagatgaactttgtattgttatgcgcacatactttgaaaagcctcgtaccgttgtaggctggaaagggttaatttcagatccacaccttgacggtagcttagattttgtcgcaggtttacataaagcacgtaagttattagtagatgtaaatgctttaggtttggctactgctactgaattccttgatatgattacaggacagtatcttgctgacttaatcacatggggagcaattggcgcgcgtacaactgagtctcaaattcaccgtgaaatggcttctgccctttcttgtcctgttggtttcaaaaatggtactgacggaaatatcaaaatagccattgatgcgattcgtgcaacacgtgaatctcacctattttgctcaccagcgaaaaatggtcaaatgacgatttaccgtacagcaggtaacccacacggtcatgtgattttacgtggtggcaaaatgccaaattaccaccaagctgatgttgaaacatcatgtaatacactggctgaatttgatttaccaacacgccttgttgttgacttcagccacggtaattgccaaaagcaacaccgtcgtcaacttgatgtcgcagctgatatctgtactcaaattcgtgaaggcagcaattacattgcgggtattatggctgaaagctttattattgaaggcaaccaagctgttgttgctggaaaagaaaaagaacttgtctacggtcaatctattacagacccttgtgtaaactgggaagataccgtcactatgctagatatgcttgctgacgcgatcaaaactcgtaaataa

SEQ ID NO: 1408 - protein, 351 aa, Photobacterium profundum
MPMKTDELRTVSLGLMPTPAEIEAVSPITDEIAAHVADSRRQVEDILTGKDSRLLVVVGPCSVHDTDAAMDYAKHLVAVQEQYRDELCIVMRTYFEKPRTVVGWKGLISDPHLDGSLDFVAGLHKARKLLVDVNALGLATATEFLDMITGQYLADLITWGAIGARTTESQIHREMASALSCPVGFKNGTDGNIKIAIDAIRATRESHLFCSPAKNGQMTIYRTAGNPHGHVILRGGKMPNYHQADVETSCNTLAEFDLPTRLVVDFSHGNCQKQHRRQLDVAADICTQIREGSNYIAGIMAESFIIEGNQAVVAGKEKELVYGQSITDPCVNWEDTVTMLDMLADAIKTRK

SEQ ID NO: 1409 - DNA, 1092 bp, Parachlamydia sp
  CDS (1)..(1092)
atggaacttctcccctcatataaagaattaaaaagccaatttccggcaagcgcatctcaagataatttcattgaagattgtcgagaaactgtaaaatctattttaaatggtactgataagcgattgttattgattgtagggccctgctcaatccatgattttcattctgctaaggaatttgcatttagattaaaatgcttagcagaatctctttcgtctcattttttcattttaatgcgtgtctattgtgaaaaagcgagaacagcaacgggctggaaaggatttttgtatgatccacttttagacggttccaatcaacttttactcggaatcaaaaagacaagagaattgttgctagagctttgcgatttgcgaatccctgccgcaaccgaatttttagatcctttaaccgcttattattatgaagatttaatttcttgggggtcgattggagcgagaacttcctcttcacaaatccacaggcaatttgcttcgaatttgcaaattccgataggctttaaaaatggaattgctggtaatatttcagctgctgttcaaggagcctatgcggcttctcaaccccatgcttacatggctttacacgaaaatggatggccaattgcaacgcaatctaaaggaaatctcgatactcacattgttttaagaggtggggaaacaaaaaccaattttgactctcattcgatatctgaagcgcttgcaaggttatcccatgcaaacttgccagaaagagtgttgatcgattgttctcatcataattcaaataaaaaacatgaaaaacaaccaattgtttttcaatccattatcgatcaagtactggcaggaaattcctttattaaaggtttaatgatagaaagtcacctttatgccggcaatcaaccttttcatttcaatccacaagagcttcgttatggtgtttcgattacggattcttgcttagattggaattcaactcaaacactcattgaatggggtgctcatcaattgcaagaaaatcttaatccgagtaagaagttatctttgtcttcagaatctctttttagttcgatgatatgtacaaagctaaaaagttaa

SEQ ID NO: 1410 - protein, 363 aa, Parachlamydia sp
MELLPSYKELKSQFPASASQDNFIEDCRETVKSILNGTDKRLLLIVGPCSIHDFHSAKEFAFRLKCLAESLSSHFFILMRVYCEKARTATGWKGFLYDPLLDGSNQLLLGIKKTRELLLELCDLRIPAATEFLDPLTAYYYEDLISWGSIGARTSSSQIHRQFASNLQIPIGFKNGIAGNISAAVQGAYAASQPHAYMALHENGWPIATQSKGNLDTHIVLRGGETKTNFDSHSISEALARLSHANLPERVLIDCSHHNSNKKHEKQPIVFQSIIDQVLAGNSFIKGLMIESHLYAGNQPFHFNPQELRYGVSITDSCLDWNSTQTLIEWGAHQLQENLNPSKKLSLSSESLFSSMICTKLKS

SEQ ID NO: 1411 - DNA, 1095 bp, Rhodopseudomonas palustris
  CDS (1)..(1095)
atgttgaccaccacagacgaccttcgccttcagaaaatcaccgagctgagtacgcctgccgaggtgatgggcgagattccgcgcacactgaccgcaacgcgtaccgttgcggcgagccgcagcgcgattcatgccatcctgaacggagccgacgaccggctcctcgtcgtcgtcggcccctgttcgattcacgatccggccgcagccatggactatgccagccgtctggcggcgctgcgcgagaccctggccgaccggctcgagatcgtgatgcgggtgtatttcgaaaagccgcgcaccacggtgggttggaagggactgatcaacgaccccgatctcgatggcagcttccggatcgacaaggggctacggttggcgcgggaagtactctcggccgtgaacaatctcggcctgccagcggcgaccgaattcctcgatctgatcacgcctcaatacatcgcggatctcgtcgcctggggcgcgatcggcgcgcgcaccaccgagagccagatccaccgcgaactcgcgtcaggcctgtcatgcccaatcggcttcaagaatggcaccgacggcaatgtccggatcgccgcggaggcggtgaagtccgcggcgcagccgcatcatttcatggcggtgaccaagggcgggcgcaatgcgatcgcggccaccactggtaacagcgactgccacgtcatcctgcgcggcggcgtcacaccgaactacgatgccgcaagtgtggaagccgccgcagcggtcctcggcaagatcggcctgccgccgcgcctgatgatcgacgccagccacgccaacagcagcaagcagccggacaaccagccgaaggtaacggccgatatcgggcgtcagatggcggctggcgagagccgcatcatcggcgtgatgatcgagagcaatctggtcgccggtcggcaggatgtggcgccgggtcggccgctgcaatacggccagagcatcaccgacggctgtatcgactgggcgacgaccgagacggtgctgcacgagctagccgatgcggtcgagagccggcgagctgcgcggcacgccgcaagcgctcagcagaaaggtgctgcggcgtga

SEQ ID NO: 1412 - protein, 364 aa, Rhodopseudomonas palustris
MLTTTDDLRLQKITELSTPAEVMGEIPRTLTATRTVAASRSAIHAILNGADDRLLVVVGPCSIHDPAAAMDYASRLAALRETLADRLEIVMRVYFEKPRTTVGWKGLINDPDLDGSFRIDKGLRLAREVLSAVNNLGLPAATEFLDLITPQYIADLVAWGAIGARTTESQIHRELASGLSCPIGFKNGTDGNVRIAAEAVKSAAQPHHFMAVTKGGRNAIAATTGNSDCHVILRGGVTPNYDAASVEAAAAVLGKIGLPPRLMIDASHANSSKQPDNQPKVTADIGRQMAAGESRIIGVMIESNLVAGRQDVAPGRPLQYGQSITDGCIDWATTETVLHELADAVESRRAARHAASAQQKGAAA

SEQ ID NO: 1413 - DNA, 1100 bp, Amycolatopsis methanolica
  CDS (1)..(1086)
atgtctctcagcgcaggccccgcggaaatttccgaaggcctcgacaaccagcgcaccctcggcgtcagcccgctgatctcccccgccctgctgcggcaggagctgccggtggacgcggcgatcgccaagaccgtcgcgcatggccggtcgtcggccgtcgacatcctccacggcgacgacgaccgcctcatcgtggtcgtcggcccctgctcggtgcacgaccccgcggccgccctcgactacgcccaccggctggccgagcacgccgccggtgtgcgcgacgaactgcacgtgatcatgcgggtgtacttcgagaagccacgcaccacgctgggctggaagggcctcatcaacgacccggacctggacggcagctacgccgtcaacaagggcctgcggatggcgcgcaagctgctgctggacatctccgcactggggctgccggtcgggtgcgagttcctggacccgatcacgccgcagttcatcgccgacaccgtgagctggggatccatcggcgcgcggaccgcggccagccaggtgcaccgccagctgtgcagcgcgctgtccatgccggtggggatcaagaactccactgagggcgatgtgcaggtggcggtggacgcgacccgcgcggcggcggcgagccacgtgttcgcgggcatcaacaacgacggcctggcggcgctgttcaccacggcgggcaacccggactgccacgtcatcctgcgcggcggttccgcaggcccgaactacgacgcggcgacggtggccgacacgctcgcgcggcaggccaaggccgggctgccggagcgggtgatcatcgacgcgagccacggcaacagcggcaaggaccacgtccgccagggcgtggtggccggggagatcgcggaccggatcgccgccggcgagcgcgggatcgccgggatcatgctggagagcttcctcgaggccgggcggcaggacctggtgctggggcacgcgggcgagctgacctacgggcagtcgatcaccgatgcgtgcctggactggcgaagcacgggtgagctgctggaccgcctctcggaggcggtggcggcgcggcggtgaggggggctacgcgg

SEQ ID NO: 1414 - protein, 361 aa, Amycolatopsis methanolica
MSLSAGPAEISEGLDNQRTLGVSPLISPALLRQELPVDAAIAKTVAHGRSSAVDILHGDDDRLIVVVGPCSVHDPAAALDYAHRLAEHAAGVRDELHVIMRVYFEKPRTTLGWKGLINDPDLDGSYAVNKGLRMARKLLLDISALGLPVGCEFLDPITPQFIADTVSWGSIGARTAASQVHRQLCSALSMPVGIKNSTEGDVQVAVDATRAAAASHVFAGINNDGLAALFTTAGNPDCHVILRGGSAGPNYDAATVADTLARQAKAGLPERVIIDASHGNSGKDHVRQGVVAGEIADRIAAGERGIAGIMLESFLEAGRQDLVLGHAGELTYGQSITDACLDWRSTGELLDRLSEAVAARR

SEQ ID NO: 1415 - DNA, 1071 bp, Treponema denticola
  CDS (1)..(1071)
atgataaaaaaccttattgacctccgaatcgagaggattcattgcataagttctcctgccgaaatggtagaaaaaatacccgcctcggattctctttattcttttatagccgaagcccgaaaaactatcagcaatataataaacggaaaggatgagcgttttttactcatagtcggcccctgctcgattcatgacacggaggcagccgaggattatgctatgcgcctattagagctaaaaaagaaatgctccgattctttctatattataatgcgtacctactttgaaaaacccagaaccgttttaggctggagaggccttatcgtagaacctgaacttgacggctttatcaatattgaaggcggcattcaaaagacaagaaaatttcttattaaacttgccgaaataggcattcctgcagcctccgaaatggtagaccctatgattccccaatacattgccgaccttgtaagctgggcttcgataggagcacgctcagccgaaagtcaaatccacagagaactggcctcaggactttcaatgccggtcggctttaaaaataccacctacggagacataacggccgctataaacggagttattgtttcccgcctgccccatgcctttgtaggcattgcccgaaacggactttcggcaatagtgcacacaaccggaaatcccgacactcacttggttttaaggggaggggtttcaaagcccaattataatagagaagaaattgaaaaagcagcctctcttatgaaggaaaaaatgctgaaaccgagcatagtaatagactgctcccacggaaattcgggaaaggacccgaaaaaacagataaacatctttgaagaaagcttaaaactccgcttcgataagaatgaacctcttgactatataaggggctgtatgattgaaagctttatccaagagggaagcacctcgatcgaaaaagcaaaggaacgcagcgaatacggtaaatccataaccgacccctgcctaggctgggaagaaactcaaacagaaatactaaaaatctatgaaaaatacaaaaggagaaagcaaaaatga

SEQ ID NO: 1416 - protein, 356 aa, Treponema denticola
MIKNLIDLRIERIHCISSPAEMVEKIPASDSLYSFIAEARKTISNIINGKDERFLLIVGPCSIHDTEAAEDYAMRLLELKKKCSDSFYIIMRTYFEKPRTVLGWRGLIVEPELDGFINIEGGIQKTRKFLIKLAEIGIPAASEMVDPMIPQYIADLVSWASIGARSAESQIHRELASGLSMPVGFKNTTYGDITAAINGVIVSRLPHAFVGIARNGLSAIVHTTGNPDTHLVLRGGVSKPNYNREEIEKAASLMKEKMLKPSIVIDCSHGNSGKDPKKQINIFEESLKLRFDKNEPLDYIRGCMIESFIQEGSTSIEKAKERSEYGKSITDPCLGWEETQTEILKIYEKYKRRKQK

SEQ ID NO: 1417 - DNA, 1068 bp, Geobacter sulfurreducens
  CDS (1)..(1068)
atgattcgcacgagcaacctgaagatcaaaagtattacccccatcattgcaccgggggaattacgccaggtgtttccccagtcggaggaggcggccgagttcgtcaactccagccgcgcccatatcaagaatatcctcaagggcaaggatccgcgcctgatggtggtggtgggcccctgttccattcacgatccgaaatcggctctggagtatgcggggcggctggcacgcctggcggccgaactgtcggatcagctattcatcgtgatgcgggtctacttcgaaaagccccgcactaccgtaggctggaagggactcatcaatgaccccgacatgaacggcacccatcagatatccaaggggctcggcatcgcccggcggctgctgtccgaaataacggaaatgctcctgccggtggcaaccgaaatgcttgaccccatcacgcccgactacctcgcggattgcatctcctggggagccatcggcgctcgtaccaccgagagccagacccaccgcgagatggccagcggcctctcgttccccgtgggattcaagaacggcaccgacggcaatctccagatagccatcgacgccatgaatgcggcactccattcccacagctttctcggcgtcaaccgggaggggcgcacctccatcattcagaccaccggcaaccccgatgtccacatcgtcctgcggggaggcaaaaaaccgaactatttccccgaagacatcagaaagaccgaagagatgctggaaaagggggggctcttccccaccatcatggtcgactgcagccacggcaactcggaaaaacgccacgagaagcagcccgacgtactctcttccgtcgtggaccagattgcggccggcaaccgctccatctccggcgtcatgatcgagagttttctggaagaagggaaccagtcgatccccagagatctctcaaccctcaagtacggcgtatccatcaccgacaagtgcattgactggaagaccaccgaaaccatcctgcgctcggcccacgaccgcctcaaggccgcgggaggcaggcccctgcacgggtaa

SEQ ID NO: 1418 - protein, 355 aa, Geobacter sulfurreducens
MIRTSNLKIKSITPIIAPGELRQVFPQSEEAAEFVNSSRAHIKNILKGKDPRLMVVVGPCSIHDPKSALEYAGRLARLAAELSDQLFIVMRVYFEKPRTTVGWKGLINDPDMNGTHQISKGLGIARRLLSEITEMLLPVATEMLDPITPDYLADCISWGAIGARTTESQTHREMASGLSFPVGFKNGTDGNLQIAIDAMNAALHSHSFLGVNREGRTSIIQTTGNPDVHIVLRGGKKPNYFPEDIRKTEEMLEKGGLFPTIMVDCSHGNSEKRHEKQPDVLSSVVDQIAAGNRSISGVMIESFLEEGNQSIPRDLSTLKYGVSITDKCIDWKTTETILRSAHDRLKAAGGRPLHG

SEQ ID NO: 1419 - DNA, 1095 bp, Ashbya gossypii
  CDS (1)..(1095)
atgacctcatttccgatgttcgcagcggacgctgaccaggccgaagacgtccgaatcctcggctacgaccctctggtgtcgccggcgctgcttcagtcgcaaattcccgcgacgcaggcgtgcctcgagacggcgcagaagggtcggcgggaggccatcgacatcataacagggaaggacgaccgggtgctggtggtggtcgggccgtgctcgatccacgacctggacgcggcgcaggagtacgcgcagcggctgaagaagctggcggaggagctggagggcgacctggtggtggtgatgcgcgcgtacctggagaagccgcggacgacagtggggtggaagggcctgatcaacgacccggacgtgaacaacactttcaacatcaacaagggcctacaggcggcgcggcagctgttcgtgaacctgacgtcgatcggcgtgccaattgggtccgagatgctcgacaccatctcgccgcagtacctcacggacctgctgtcgttcggcgctatcggcgcgcgcacgacggagtcgcaactgcaccgcgagctagcgtcggggctgtcgtttccgattgggttcaagaacggcacggacggctcgctggacgtggcactggacgcggtcaaggcgtcgtcccactcgcaccacttcatgggcgtgaccaagcacggcgtggccgccatcaccacgacgaagggcaacgagcactgctttgtcatcctgcgcggcggcaagcgcggcacgaactacgacgctacgtccgtggcggaggcgaaggccaagctgccccccacgggcgtgctgatgatcgactattcgcatgggaactccaacaaggacttccgcaaccagccgaaggtgaacgaggttgtgtcggagcagattgccaacggcgaggacaagatcgtcggcgtcatgatcgagtccaacatcaacgagggcagccagaagattccgcccgagggcaaagctggcctcaagtacggtgtttcgatcacggacggctgcatatcctgggagaccaccgaggaggtgctgaggaagctcgccggcgccgtccgcaagcggcgcgacctgcggaagaccaaataa

SEQ ID NO: 1420 - protein, 364 aa, Ashbya gossypii
MTSFPMFAADADQAEDVRILGYDPLVSPALLQSQIPATQACLETAQKGRREAIDIITGKDDRVLVVVGPCSIHDLDAAQEYAQRLKKLAEELEGDLVVVMRAYLEKPRTTVGWKGLINDPDVNNTFNINKGLQAARQLFVNLTSIGVPIGSEMLDTISPQYLTDLLSFGAIGARTTESQLHRELASGLSFPIGFKNGTDGSLDVALDAVKASSHSHHFMGVTKHGVAAITTTKGNEHCFVILRGGKRGTNYDATSVAEAKAKLPPTGVLMIDYSHGNSNKDFRNQPKVNEVVSEQIANGEDKIVGVMIESNINEGSQKIPPEGKAGLKYGVSITDGCISWETTEEVLRKLAGAVRKRRDLRKTK

SEQ ID NO: 1421 - DNA, 1122 bp, Ashbya gossypii
  CDS (1)..(1122)
atgttcattaaaaacgagtacattggtgacaaaagcaggctcgaggactggaggattaagggctacgacccactgactccgccgaatgtgctccagcacgagctacctgtcagtgcaaatgggcgcgcgataattgtacgggcacgcgagggggtggttcaagtgctttccggcagggatgaccggcttctggttgtggttgggccctgctccatccacgaccccgaggccgctctggaatacgcgcagaggcttagcgaggtggcctcgcggctgcgcggggagctgctggttattatgcgtgcgtatctggaaaaaccgcggaccacggtggggtggaaggggctcatcaacgaccccgacatcgataattcgttccaaataaacaagggattgcgtatctcgcgggagatgtacacgcagctggtggagcacattccaattgcgggcgaaatgctagacaccatatcgccgcagttcttaagcgactgcttctccttgggcgccattggcgcccggacgacagaatcgcagctgcaccgtgagctggcttctggactatcgttcccgatcggattcaagaacgggacagatggctgcttacaggttgctattgacgctatgcgtgccgctgctcactctcattactttctttcggttaccaagcctggagtgactgcgattgttgggactgaaggtaacgaggacaccttcatcattctacgcggtggtaaagatggcacaaactatgacgctgccagtgtacaacaggctaagcaggacttggtcaatgcgaagctagttgacagcgctggggtccagcggaggattatgattgactgctcgcatggaaattccaacaaggattaccgcaaccagccgaaagtcgcccaagatatctatgagcagctgagtaaaggtgagaatgccatttgtggggtgatgattgaatccaatcttgtagaggggcggcaggatatccccgaggggaacggtcgtgtgggcctaaagtatggttgttcgatcaccgacgcgtgcataggctgggatcaaacagtagaagtattagagctgcttgcaaagggcgtcataaacaagagagctgtaatgtcgacaaattaa

SEQ ID NO: 1422 - protein, 373 aa, Ashbya gossypii
MFIKNEYIGDKSRLEDWRIKGYDPLTPPNVLQHELPVSANGRAIIVRAREGVVQVLSGRDDRLLVVVGPCSIHDPEAALEYAQRLSEVASRLRGELLVIMRAYLEKPRTTVGWKGLINDPDIDNSFQINKGLRISREMYTQLVEHIPIAGEMLDTISPQFLSDCFSLGAIGARTTESQLHRELASGLSFPIGFKNGTDGCLQVAIDAMRAAAHSHYFLSVTKPGVTAIVGTEGNEDTFIILRGGKDGTNYDAASVQQAKQDLVNAKLVDSAGVQRRIMIDCSHGNSNKDYRNQPKVAQDIYEQLSKGENAICGVMIESNLVEGRQDIPEGNGRVGLKYGCSITDACIGWDQTVEVLELLAKGVINKRAVMSTN

SEQ ID NO: 1423 - DNA, 1098 bp, Amycolatopsis balhimycina
  CDS (1)..(1098)
atggccgcgatgacccacaccgtcgccacgaccgacctcgacaaccagcgcatcgagcggatcgtccccctggtcacccccgccctgctgcatcacgaactgccgctcagcgccaccgcggccgagacggtgcgaaagggccgcgagagcgtcgtccgcgtcctcgacggcacggacgaccggctgctcgtgatcaccgggccgtgctccatccacgaccccgccgcggcgctcgactacgccggccacctcgccgccatcgccggcgaggtcgccggcgacctgctcgtcgtcatgcgcgtgtacttcgagaaaccccggacgatcggcggctggaaggggctcatcaacgacccccacctcgacggcaccggcgacgtcaaccacgggctgcgcacggcccggcacctcctgctggagctcgccgaacgcggcctgcccgccgcgtgcgaatggctggacaccaccattcccgcgtacttcgcggacacggtctcgtggggcgccatcggcgcccgcaccgtggaaagccagaaccaccgcatgctcgccagcggcctgtccatgcccgtcggcttcaagaaccgccgcgacggcgacatcaccgtcgccatcgacgcgatccgggccgccgcggtccgccacgtggtccccggcgtcgaccccggcgggttgcccgccatcctgcacacggcgggcaacccggactgccacgtcgtcctgcgcggtggtgacggcgcgcccaaccacgactccgcgtccgtccacaagacactgaccgcgctggaggccgcgggcctgcccggccgggtggtgatcgacgccagccacgacaacagcggcaaggaccaccaccgccagcccctcgtcgcggccgagatcgcgggccaggtcgagaacgggcggaacggcatcgtcggggtgatgctcgagtccaacctccgcgccggccgccaggacctccagccgggccgtccgccggcatacggccagtccatcaccgacgcctgcatcgacgtccccaccacccggacggtcctccacggcctcgccgcggcggccgcggcccggcgaaagctcggcaagcaagcaagctga

SEQ ID NO: 1424 - protein, 365 aa, Amycolatopsis balhimycina
MAAMTHTVATTDLDNQRIERIVPLVTPALLHHELPLSATAAETVRKGRESVVRVLDGTDDRLLVITGPCSIHDPAAALDYAGHLAAIAGEVAGDLLVVMRVYFEKPRTIGGWKGLINDPHLDGTGDVNHGLRTARHLLLELAERGLPAACEWLDTTIPAYFADTVSWGAIGARTVESQNHRMLASGLSMPVGFKNRRDGDITVAIDAIRAAAVRHVVPGVDPGGLPAILHTAGNPDCHVVLRGGDGAPNHDSASVHKTLTALEAAGLPGRVVIDASHDNSGKDHHRQPLVAAEIAGQVENGRNGIVGVMLESNLRAGRQDLQPGRPPAYGQSITDACIDVPTTRTVLHGLAAAAAARRKLGKQAS

SEQ ID NO: 1425 - DNA, 1071 bp, Vibrio vulnificus
  CDS (1)..(1071)
atgcctacgctcagcaaattgattcactccactccttgtggaacactcccttctgtggaagagatcattcaacacgcctcactggacgaagagagcgaagcgtttatccgacaacgtcgccaagacatcactcgaattctaaatggccaagaccctcgattactggtgatcatcggcccatgttcaattcacgacccgcaagcaggcctagaatatgcgcagaaactggccaacattcagcatcagcatgaaaagcaacttctgattgtgatgcgaacttactttgaaaaaccacgcacacgcgcaggatggaaagggctgatcgtcgatcccgatctcgataacagccacgacattaataaaggtctgcggcttgctcgacatttcttacagcaagtcatcaagcttggcctcgcgacggcaaccgagtatttagacaccacgacttacccctatatttctgacctcatttgttggggggccattggcgcgaggacaactgaatctcaaattcaccgtcaaatggcctcggcgcttccctgccctattggtttcaaaaacgggaccgacggcaatgttgatattgctatcgacgcgatacacgcggcaaactcaccccatctcatctgtgtgccaggatttggggcacgtactctcacagccatcagtcatggtaaccccaatggccatatcattttgcgaggtggcaaaacaccaaactacaccaccgagcatgtttgccaaatcagccaacaactggaagccaacgatcttaacccgcgcctgatcattgattgcagccatggcaatagcctgaaagtggcaaagaaccaactcgatgtggcgagaaacatcgcctgtcagttgatcgaaggagaaaaatgcattgcaggcgtgatggcggagagcttcttggtagcaggcgcgcaaaagatcaccgatcgtccgttgatcaaaggcatgtcgattactgatgaatgtttggggtgggaagagacagaaagtattctcaatatttttgcggaagcggtgaatatcgtgatgacggagcgcttttccaccgttgcctaa

SEQ ID NO: 1426 - protein, 356 aa, Vibrio vulnificus
MPTLSKLIHSTPCGTLPSVEEIIQHASLDEESEAFIRQRRQDITRILNGQDPRLLVIIGPCSIHDPQAGLEYAQKLANIQHQHEKQLLIVMRTYFEKPRTRAGWKGLIVDPDLDNSHDINKGLRLARHFLQQVIKLGLATATEYLDTTTYPYISDLICWGAIGARTTESQIHRQMASALPCPIGFKNGTDGNVDIAIDAIHAANSPHLICVPGFGARTLTAISHGNPNGHIILRGGKTPNYTTEHVCQISQQLEANDLNPRLIIDCSHGNSLKVAKNQLDVARNIACQLIEGEKCIAGVMAESFLVAGAQKITDRPLIKGMSITDECLGWEETESILNIFAEAVNIVMTERFSTVA

SEQ ID NO: 1427 - DNA, 1047 bp, Photorhabdus luminescens
  CDS (1)..(1047)
atgtacaaaacagatggtttaaggactcaccgtgtcgatagtttagtcacacctcaaactcttgcaattcaatttcctgtatccgaaaaaatcgtcaataatgtgacagcgtcacggaaacgtattgccgatattctcagcgggaatgatccacggcttatggtaatcatcggtccttgttctattcatgatattgatgctgctttagattatgctcagcgactgaacaggttacgtgaaaaataccagcacagactggaaattattatgcgcacctattttgagaaaccacgcacagtggtgggctggaaaggtttaatttcagacccctatctcgacggttcttgccaggtaaatcggggtattactttggcccggaaattattggttgatgtcaatgagttgggtttacccacagcaaccgaatttctggatatggtgaccggccaatatattgccgatctgatcagttggggcgcgatcggagccagaacaacagaaagccagattcaccgagaaatggcatctgccctctcctgtccagttggctttaaaaatggaacggatggcaacatccgtatcgccatagatgcaatccgcgcagccggggtctgtcacacattcctctcgccggataagcgcggtcagatgaccatctatcaaaccgaaggcaacccatacggccacattattatgcgtggaggcaaacagcctaattacagtgccaaagatattgctacagcttgtactcaactacgtgaatttaatttaccagaacatttagttatcgatttcagtcatggtaattgtcaaaaaattcataaacgccaactgactatagcaaaagaggtgggtcaccagattcaagagggttctaccgctattgtcggtgtaatggttgaaagttttctggttgaaggcacccagcaagtcattcagggacaaccgctaaattacggtcaatcgatcaccgatccttgtctaaactggcaagatacagaacagcttattgacattctcgccgaagcagtaagttaccgtttctga

SEQ ID NO: 1428 - protein, 348 aa, Photorhabdus luminescens
MYKTDGLRTHRVDSLVTPQTLAIQFPVSEKIVNNVTASRKRIADILSGNDPRLMVIIGPCSIHDIDAALDYAQRLNRLREKYQHRLEIIMRTYFEKPRTVVGWKGLISDPYLDGSCQVNRGITLARKLLVDVNELGLPTATEFLDMVTGQYIADLISWGAIGARTTESQIHREMASALSCPVGFKNGTDGNIRIAIDAIRAAGVCHTFLSPDKRGQMTIYQTEGNPYGHIIMRGGKQPNYSAKDIATACTQLREFNLPEHLVIDFSHGNCQKIHKRQLTIAKEVGHQIQEGSTAIVGVMVESFLVEGTQQVIQGQPLNYGQSITDPCLNWQDTEQLIDILAEAVSYRF

SEQ ID NO: 1429 - DNA, 1053 bp, Photorhabdus luminescens
  CDS (1)..(1053)
atgaattaccagaatgacgatataagaattaaagagataaaagaattattacctcctgtggcactacttgaaaaatttccagcaactgaaaaggctgcattgacagtatgtaaggcgcgtaaaacgattcatcaaattctgacgggtgaagatgagcgtctgttggtggtgattgggccatgttctattcatgatcctaaagcagcaatggaatatgccgggcggttgaatgaattgcgtgaagagctgaaagaggatctggaagttgtcatgcgagtttattttgaaaaaccgcgcacaactattggctggaaagggttaattaatgaccctcatatgaatcacagttttgatattaatgatggtttgcgtttagctcgtcagttgttacgggatattaatgatatggggctaccggctgcgggtgaatatctggatatgatttctccacagtatttagccgatttgatgagttggggagcaattggcgctcgtacaacggaatctcaggtccatcgtgagttggcttctggtctttcctgtccggttggttttaaaaatggtactgatggtgcgataaaagttgccattgatgcgattaatgcagcgggttcccctcacagtttcctttctgtcactaagtggggacattctgcgattgtaaataccagcggaaacaacgattgtcatattatcctgcgtggcggtaaagagccgaattacagttctgaacatgttgctgtcgtgaagcaaaacttggaaaaagcaggtttaccggcaagaattatgattgatttcagtcatgccaatagttctaagcaatttaaaaagcagatggatgtgtgttcagatgtgagccggcagcttattgctggggagaaagcgattattggtgtcatggtagaaagtcatttggaagagggaaatcagaacccggatagcggtctgccattggtatatggcaaaagtattactgatgcttgcattggttgggctgacactgaaattttgttacgtcaattgtcgtcggcaataaaagcgcgtcgtggctga

SEQ ID NO: 1430 - protein, 350 aa, Photorhabdus luminescens
MNYQNDDIRIKEIKELLPPVALLEKFPATEKAALTVCKARKTIHQILTGEDERLLVVIGPCSIHDPKAAMEYAGRLNELREELKEDLEVVMRVYFEKPRTTIGWKGLINDPHMNHSFDINDGLRLARQLLRDINDMGLPAAGEYLDMISPQYLADLMSWGAIGARTTESQVHRELASGLSCPVGFKNGTDGAIKVAIDAINAAGSPHSFLSVTKWGHSAIVNTSGNNDCHIILRGGKEPNYSSEHVAVVKQNLEKAGLPARIMIDFSHANSSKQFKKQMDVCSDVSRQLIAGEKAIIGVMVESHLEEGNQNPDSGLPLVYGKSITDACIGWADTEILLRQLSSAIKARRG

SEQ ID NO: 1431 - DNA, 1095 bp, Photorhabdus luminescens
  CDS (1)..(1095)
atgttcatgcaaagagatgcacttaataacgttcacatcagtggtgagcaaattcttatcaccccaaaagaattaaagcaacaatacccactgagtgatgatgatctgcatgttattgcaaatgcacgtaaaacaattgcggatattattcagcgccgtgatccccgtttgctggtagtgtgtggtccttgctctattcatgacgtggatgcggcgctggattatgctcaccgtttggccgctctttctgctgaattgagtgatagcttgtacattgtcatgcgtgtctattttgaaaagcctcgaacaacagtgggttggaaaggtcttattaatgatccatacatggatggttcatttgatgtggaagctggcctgcatattgcccgccgcttactacttagtttagtgaaaatgggattgcctcttgcaacagaagctttagatccgaatagcccacaatatttgggggatttattcagttggtctgcaattggtgcgagaaccacagaatcccagacacaccgggaaatggcttcaggtttatctatgccggttggtttcaaaaatgggactgacggtagcttgaacacggcaattaatgcgatgtgtgcagccgctatgccacatcgttttgtgggaataaaccagtcggggcaggtgtgtttattacaaacgcaaggaaacccgaatggacatattatcttgcgtggtggtaagacccctaattacagtgttcaacatgtaatggaatgtgaacagcaaatgatgcaggctggattattgccatccttgatgattgattgtagtcatggtaactctaataaggattttcgtcgccaaagtttggttgtagattctgttgcggatcagatcatttcaggtaatcaatctattactggcattatgttggagagccatattaatgaaggtaaccaatcttctgagcaaccgcgtagtgaaatgaaatatggtgtatcagtcactgacgcgtgtattagttggcagacgacagaagcagttctaagaaaattacatcagcaaattagcatgcaattgtcgcaaagaatggcagtattgaaaaaagcgggataa

SEQ ID NO: 1432 - protein, 364 aa, Photorhabdus luminescens
MFMQRDALNNVHISGEQILITPKELKQQYPLSDDDLHVIANARKTIADIIQRRDPRLLVVCGPCSIHDVDAALDYAHRLAALSAELSDSLYIVMRVYFEKPRTTVGWKGLINDPYMDGSFDVEAGLHIARRLLLSLVKMGLPLATEALDPNSPQYLGDLFSWSAIGARTTESQTHREMASGLSMPVGFKNGTDGSLNTAINAMCAAAMPHRFVGINQSGQVCLLQTQGNPNGHIILRGGKTPNYSVQHVMECEQQMMQAGLLPSLMIDCSHGNSNKDFRRQSLVVDSVADQIISGNQSITGIMLESHINEGNQSSEQPRSEMKYGVSVTDACISWQTTEAVLRKLHQQISMQLSQRMAVLKKAG

SEQ ID NO: 1433 - DNA, 1119 bp, Gloeobacter violaceus
  CDS (1)..(1119)
atgcccggcggctctcgcgatgtcggcgagttcgcctttgagccgctcgacgatttgcggatcgtctcggtgagtgagattcctcctccagtgcaactgcgcgagcaattgcctctggatgcggctgcccagaatacagtgcgccggggccgctcgcagattcgcgctgtattgggcggctttgattcacgcctgttggtggtggtcggcccctgttcggtgcacgacgccgatgcggcgcgcgagtacgcccagaggctggccgagtgcgcccgccgctatgcggacgaactgctcatcgccatgcgcgtttacttcgagaaaccgcgcaccacggtcggctggaaaggactcatcaacgatcccggcctcgacggcagctgtcgtatcggtgagggactgaccaccgcccgcgcgttgctgctcgacattgcccggctcggactgccggcggccaccgaatttctcgacccgatcacccccgagtacatcgtcgatctgatcagttggggggcgattggggcgcgcacggtcgaaagtcaggtgcacaggcaagtggcttcggcgctttcctgtccggtgggttttaaaaacggctcctccggcgacatcgccgttgccgtcgaagcggtgctctcggcgcgcaacgcccatcagttcctttcgcacacccgcgagggtcgcacggctatcgtgctgaccagcggcaatcccgattgccatgtcgtgttgcgcggcggcaaaaacggccccaaccactcggctgaacatctcgcgcaggcagggcggttgttgcgcgaggcgggcttgccggagcgggtgatggtcgactgcagccacgccaacagctccaaagatcaccgccgccagggggaagtctgcaaacagttggcggcacggattgccgagggggatatgcggatgatgggcctgatgatcgaaagtcacctagtcgaagggcggcaggagttaggcgacggctgcaacttgcgccacggtcagagcatcaccgatgcgtgcatcggctgggaacagacagagcaattgcttaccggcctacacgaggcggccggcgctagacggtgtaagccggccgtccgcgccgagttgctggtttga

SEQ ID NO: 1434 - protein, 372 aa, Gloeobacter violaceus
MPGGSRDVGEFAFEPLDDLRIVSVSEIPPPVQLREQLPLDAAAQNTVRRGRSQIRAVLGGFDSRLLVVVGPCSVHDADAAREYAQRLAECARRYADELLIAMRVYFEKPRTTVGWKGLINDPGLDGSCRIGEGLTTARALLLDIARLGLPAATEFLDPITPEYIVDLISWGAIGARTVESQVHRQVASALSCPVGFKNGSSGDIAVAVEAVLSARNAHQFLSHTREGRTAIVLTSGNPDCHVVLRGGKNGPNHSAEHLAQAGRLLREAGLPERVMVDCSHANSSKDHRRQGEVCKQLAARIAEGDMRMMGLMIESHLVEGRQELGDGCNLRHGQSITDACIGWEQTEQLLTGLHEAAGARRCKPAVRAELLV

SEQ ID NO: 1435 - DNA, 1107 bp, Chromobacterium violaceum
  CDS (1)..(1107)
atgacaacgcttgccaggccggaacacggcctactcgcgcccgaacacggccacgcgtcgccgccgtccagccaggcggactaccgcgcgatggccagccccgccgaactattgcgcagcctgccggccggcccgcgcgccagcgcctcggtccattccggccgcgaggcggtgaaacgcgtactgagcggagcagatccgcgctggctggtggtggtgggcccctgctccatccacgacccgcgcgccggcctggactacgccgcccggctggcggacctcgcctccgagctggacgacacgctgctgatcgtgatgcgcgcctacttcgaaaagccgcgcaccagcgtgggctggaagggcctgatcaacgatccctacatggacgacagctattgcgtggacgagggcatgcacatcgcccgccgcttccttttggccgccgccgaactgggcctgccgctggccggcgaggcgctggacccgatgtcgccgctgtatctggccgacctctatagctggatggcgatcggcgcgcgcaccaccgaatcgcaaatccaccgcgagctggcctcggcgctggacagcgccgtcggattcaagaacagcaccgacggctcgctggacgcggcgctcaacgccatcgtctccgccagcgcgccgcacgcctacctcggcatgggcaaggacggccgggtggcggtggtgaacagccgcggcaacccgcactgccacctggtgctgcgcggcggcggcggccggcccaattacgactcggtgagcatcgcgctggccgagcaggcaatgaagaagcacgacattccgcccgccatcatggtggactgcgcgcacgccaactcatggaagcagcacacgctgcagccgcgcgtgctggccgacgcggtgtcccagatccgccacggcaaccgcagcatccgcgccttcatgctggagagcttcatcgaagccggcaaccagtccatcccggccgatctgtcgcagctgcgctacggctgctcggtgaccgatccctgcgtcgactggcacaccaccgccgacatcctgcgcgacgcgcgcgccaagctgcggccgctgctggaaagctga

SEQ ID NO: 1436 - protein, 368 aa, Chromobacterium violaceum
MTTLARPEHGLLAPEHGHASPPSSQADYRAMASPAELLRSLPAGPRASASVHSGREAVKRVLSGADPRWLVVVGPCSIHDPRAGLDYAARLADLASELDDTLLIVMRAYFEKPRTSVGWKGLINDPYMDDSYCVDEGMHIARRFLLAAAELGLPLAGEALDPMSPLYLADLYSWMAIGARTTESQIHRELASALDSAVGFKNSTDGSLDAALNAIVSASAPHAYLGMGKDGRVAVVNSRGNPHCHLVLRGGGGRPNYDSVSIALAEQAMKKHDIPPAIMVDCAHANSWKQHTLQPRVLADAVSQIRHGNRSIRAFMLESFIEAGNQSIPADLSQLRYGCSVTDPCVDWHTTADILRDARAKLRPLLES

SEQ ID NO: 1437 - DNA, 1059 bp, Chromobacterium violaceum
  CDS (1)..(1059)
atgcaacgccagaccgacgacgtcagaatccgcgaaatcaaggaactgcttcccccgatcgcccacctttacgagctgccgatcagcgagtcggcctccgagctgatctacaacacccgtcgcgaaatctcggccttgctgcgcggcgaggacgaccgcctgctggtggtgatcggcccctgttccatccacgacgtcgacgccgcggtcgagtacgcgcagaagctggcgccgctgcgccaggcgctggcggatgagctggtggtggtgatgcgggtgtatttcgagaagccgcgcaccacggtcggctggaagggcctgatcaacgacccgcacctgaacgagtcctacgacatcaacgccggcctgcgcatcgcgcgccgcctgctgctgacgctgaacaacctgggcatgccggccgccaccgaattcctcgacatgatcacgccgcagtacttcgccgacctgatcagctggggcgcgatcggcgcccgcaccaccgagagccaggtgcaccgcgagctggcctccggcctgtcctgcccggtcggtttcaagaacggcaccgacggcaacctgaagatcgccgtcgacgccatccgctcgtccagcgtgccgcaccatttcctgtcggtgaccaagaccggccattccgccatcgtttccaccggcggcaacccggactgccacgtgatcctgcgcggcggcaaggaacccaattactcggccgagcatgtgcgcgccgccgccgccgagctgaccgcggtcggcctgccgcacaagctgatggtggacttcagccacgccaacagccgcaaggactaccgccgccagatggaggtcagcgccgacgtggccggccagatcgccggcggcgaccgcaacatcttcggcgtgatggtggaaagccacctggtggaggggcgccaggatcagaagcccggctgcgagctcaagtacggccagagcatcaccgacgcctgcctgggctgggacgacaccgagacgctgctgcgccagctggccgacgccgtcaaggcgcgccgcgccgccgagtaa

SEQ ID NO: 1438 - protein, 352 aa, Chromobacterium violaceum
MQRQTDDVRIREIKELLPPIAHLYELPISESASELIYNTRREISALLRGEDDRLLVVIGPCSIHDVDAAVEYAQKLAPLRQALADELVVVMRVYFEKPRTTVGWKGLINDPHLNESYDINAGLRIARRLLLTLNNLGMPAATEFLDMITPQYFADLISWGAIGARTTESQVHRELASGLSCPVGFKNGTDGNLKIAVDAIRSSSVPHHFLSVTKTGHSAIVSTGGNPDCHVILRGGKEPNYSAEHVRAAAAELTAVGLPHKLMVDFSHANSRKDYRRQMEVSADVAGQIAGGDRNIFGVMVESHLVEGRQDQKPGCELKYGQSITDACLGWDDTETLLRQLADAVKARRAAE

SEQ ID NO: 1439 - DNA, 1140 bp, Neurospora crassa
  CDS (1)..(1140)
atggtcggccctgatatggtggcccttcgggctgatgacacaagagtcgagggacaggatcccctcatccctcctgctcttctcatttccgagattcccatgacggatgccgctctcgagactgttgtcaagggcaggaaggaggccgtaggtgtcatcatgggcaaggatgaccgtctccttgtcgttgttggcccctgctcccttcacgatcctgctacagctctcgagtactgcagcaggctcaaggctctttccgagaagctcaaggacgacctcgttatcgtgatgagagcctacctcgagaagcctcgcacgaccgtcggctggaagggtctcatcaacgatcccgatatcgactcttctttcaagatcaacaagggtcttcgtatctccagacagcttttctgcgatttgacctctgccggtatgcctattgcttcggagatgttggacaccatctcccctcagttccttgccgacttcatctctgtcggtgctatcggcgcccgtactaccgaaagccagcttcaccgcgagcttgcctctggtctctctttccctgtcggtttcaagaacggaaccgacggaaacctcggtgttgccattgatgccattggcgctgccgcggctaagcaccacttcatgggcgttaccaagcagggcttggccgctatcacccgcaccaagggcaacgagcacggtttcgttatcctccgtggtggcaccaagggccccaactacgacaaggagaacgtccaggctgcgaaggagactctcatcaagaagggccagaagctcgccatcatggtcgactgctctcacggcaactccaacaaggaccaccgcaaccagcccaaggttgccaaggtcgttgccgaccagattcgcgagggcgagaaagccatcattggtgtcatgatcgagtccaacatcaacgagggcaaccagaaggttcctgctgagggtccctcggcgctcaagaagggcgtcagcatcaccgatgcctgcattgactgggagtccactgtctcgaccctcgaggagctcgctgaggcggttcgcgagcgtcgtgaggtgaacggtggcctcgccagcggtgtggctacccccaagcccaaccctctcgaggaggactag

SEQ ID NO: 1440 - protein, 379 aa, Neurospora crassa
MVGPDMVALRADDTRVEGQDPLIPPALLISEIPMTDAALETVVKGRKEAVGVIMGKDDRLLVVVGPCSLHDPATALEYCSRLKALSEKLKDDLVIVMRAYLEKPRTTVGWKGLINDPDIDSSFKINKGLRISRQLFCDLTSAGMPIASEMLDTISPQFLADFISVGAIGARTTESQLHRELASGLSFPVGFKNGTDGNLGVAIDAIGAAAAKHHFMGVTKQGLAAITRTKGNEHGFVILRGGTKGPNYDKENVQAAKETLIKKGQKLAIMVDCSHGNSNKDHRNQPKVAKVVADQIREGEKAIIGVMIESNINEGNQKVPAEGPSALKKGVSITDACIDWESTVSTLEELAEAVRERREVNGGLASGVATPKPNPLEED

SEQ ID NO: 1441 - DNA, 1092 bp, Neurospora crassa
  CDS (1)..(1092)
atgtcgcaacatttctacattgagaaccgcaacgtcggcaatcaggccgaaagcgaggattggcgcattcgcggctacaacccgctgacccctcccgacctgctccaacatgagatcccccagaccgctgaatcgaaacaaaccgtcatcaatggccgcaaggaggtggtcgccgttgtcaatggcaccgacgagaaggaaaggttactagtagtcatcggtccctgctccatccacgatcccaatgccgccctcgaatactgcgatctactactcaaggagaaggagaagcacaaggatgagctgttgattgtcatgcgatcctacctcgaaaagccccggacgaccgttggctggaagggcctgatcaacgaccccgatatcgacaacagcttccagatcaacaagggcttgcgcctgagcagacagttgttcgttgacctcacctccaagggcatgcccctcgccagcgagatgttggataccatcagcccgcaattccttgccgatctgttgagtgtcggcgctgtcggtgctcgcaccaccgaaagccagctccaccgcgagttggccagtggcctcagtttccccgtaggcttcaagaacggcactgacggtaccctgggtgttgccattgatgctattggcgctgtcagacatccccatcactttttgtccgtcaccaagcccggtgtcgttgccatcgtcggaactgttggcaacgaggactgcttcgtcatcctccgtggcggtaccaagggcaccaactacgatgcgaagagcatcgctgaggccaaggctgcgctggagaagagcggcttgcgccagcgcctgatgattgactgcagccacggcaactcgaataagaaccacaagaaccagcccaaggtcgctgccgaaattgcgcaacaacttgagaacggcgaaactggtaaccagaaggtgcccgaggaaggcaagtgcggcctcaagtacggtgtcagtatcactgatgcttgtattggctgggaggacactgtcgccactctcgacacgcttgcgcaggccgtcaaaaagaggagagaagtcctgagcaagaacgccgctgcctaa

SEQ ID NO: 1442 - protein, 363 aa, Neurospora crassa
MSQHFYIENRNVGNQAESEDWRIRGYNPLTPPDLLQHEIPQTAESKQTVINGRKEVVAVVNGTDEKERLLVVIGPCSIHDPNAALEYCDLLLKEKEKHKDELLIVMRSYLEKPRTTVGWKGLINDPDIDNSFQINKGLRLSRQLFVDLTSKGMPLASEMLDTISPQFLADLLSVGAVGARTTESQLHRELASGLSFPVGFKNGTDGTLGVAIDAIGAVRHPHHFLSVTKPGVVAIVGTVGNEDCFVILRGGTKGTNYDAKSIAEAKAALEKSGLRQRLMIDCSHGNSNKNHKNQPKVAAEIAQQLENGETGNQKVPEEGKCGLKYGVSITDACIGWEDTVATLDTLAQAVKKRREVLSKNAAA

SEQ ID NO: 1443 - DNA, 1068 bp, Synechococcus sp
  CDS (1)..(1068)
atggccaccacctcggatttgcatgtggtggagacccgtccgctggtggctccggctctgctgcacggagatctgccgattgatgccgccgccacggagacggtcgcatcggcccgtcgtcggatccaggccattttgcgcggcgatgatcagcgtcagctggtggtggtgggcccctgctcggtccacgatgtgaaggcggcgcgggagtacgccgaacggctggccccgatccgggaacggctgaaggatcagctggaggtggtgatgcgggtttatttcgaaaagccgcgtacgacggttggttggaaaggcctcatcaatgacccccacctcgatggctcgtacgacatcaacacaggcctgaggcgggctcgtggcttactgctggacctgtccagggagggcatgccggcagcgacggaactgctggatccggtggttccccagtacatcgctgatctgatcagctggactgcgatcggagcccgcaccacggaaagccagacccatcgggagatggcttcaggcttgtcgatgccgatcggctacaagaacagtaccgatggcagcgcctgcatcgccatcaatgcgatgcaggcggcatcgaaacctcatcattttctgggaatcaaccacgacggccatgcctcgatcgtgagcacgactggcaacccggatggtcatctagtgctgcgtggcggtcatcagggcagcaactaccacctggaggccgttcaggctgctgcagcggaactgagcaaggcgggcctgaaggatcgtctgatggtggactgcagccatgccaactcgaacaaggatttccgccgccaggccgatgtactcgccacggtggctgatcagttgaaggctggttccggccatgtgatgggcgtgatgatcgaaagtcatctggtggaaggcaatcagaaactgaccgctggtctctcccagctcacctatggccagagcattacggatgcctgcatcagcctggagaccacggatgcgctgctgtcccagctggctgcagccgtggccgatcgcagcagcgctttgacggcataa

SEQ ID NO: 1444 - protein, 355 aa, Synechococcus sp
MATTSDLHVVETRPLVAPALLHGDLPIDAAATETVASARRRIQAILRGDDQRQLVVVGPCSVHDVKAAREYAERLAPIRERLKDQLEVVMRVYFEKPRTTVGWKGLINDPHLDGSYDINTGLRRARGLLLDLSREGMPAATELLDPVVPQYIADLISWTAIGARTTESQTHREMASGLSMPIGYKNSTDGSACIAINAMQAASKPHHFLGINHDGHASIVSTTGNPDGHLVLRGGHQGSNYHLEAVQAAAAELSKAGLKDRLMVDCSHANSNKDFRRQADVLATVADQLKAGSGHVMGVMIESHLVEGNQKLTAGLSQLTYGQSITDACISLETTDALLSQLAAAVADRSSALTA

SEQ ID NO: 1445 - DNA, 1053 bp, Rhodopirellula baltica
  CDS (1)..(1053)
atgatccgcaccgatgaccttcgtatcggcgccatcaaaaatctgatgtcccccagtgaattgctatccgaaattccggccagcgatgcgatttcacagacggtcgctgacggtcgaaccgcgatccaaaacgtgcttcagcagaaggacgaccgtttgctcgtcgtcgtcgggccgtgttcgattcacgatccggattccgctcgtcagtacgcggagaagttggcggtcgagcaaaaaaagcacgccgatgagctgttgatcgtcatgcgggtttacttcgaaaaacctcgaacaacggttggctggaagggtctgatcaacgaccccaaacttgacgacagcttcgaaatcaatcacggattgcgaaccgctcggcgtttgctcagcgacatcaacgcgatgggactgccgaccggaaccgagtttttggatttgatcagcccgcagtatgtggctgacttggtcgggtggggtgccatcggagcacgcacgaccgaaagccaaggtcaccgcgaattggcgtcggggctgtcttgcccggtcggcttcaaaaatggaaccagcggcaacgttcagatcgctgtcgatgcgatttgctccgcacgtcgaccacaccacttcctatccgtcacgaaggaaggaacctcggcgatcttcgcaacaaccggaaacccggactgccacatcattctgcgtggcggaaagcacaccaactacgatgccgccagcatcgatatggcatcgggattgctcgagaaagcggacctgccagcacgaatcatgatcgattgcagccacgcgaacagccgcaagattttcaaacgtcaatcgtacgtttgccgggacatctgtgcccaagtatccgatggcgaccaacgcatcatgggcgtgatgatcgaaagcaatctgctcgagggcaaccaaaaactcagcgattcgccgcttgttcagggtctcagcgtcaccgatgcgtgtatcggttgggaaaccaccgagcaactcttcagcgacctgggaaaatccgtcgccgcacgccgtaaagtcggctga

SEQ ID NO: 1446 - protein, 350 aa, Rhodopirellula baltica
MIRTDDLRIGAIKNLMSPSELLSEIPASDAISQTVADGRTAIQNVLQQKDDRLLVVVGPCSIHDPDSARQYAEKLAVEQKKHADELLIVMRVYFEKPRTTVGWKGLINDPKLDDSFEINHGLRTARRLLSDINAMGLPTGTEFLDLISPQYVADLVGWGAIGARTTESQGHRELASGLSCPVGFKNGTSGNVQIAVDAICSARRPHHFLSVTKEGTSAIFATTGNPDCHIILRGGKHTNYDAASIDMASGLLEKADLPARIMIDCSHANSRKIFKRQSYVCRDICAQVSDGDQRIMGVMIESNLLEGNQKLSDSPLVQGLSVTDACIGWETTEQLFSDLGKSVAARRKVG

SEQ ID NO: 1447 - DNA, 1068 bp, Prochlorococcus marinus subsp
  CDS (1)..(1068)
atgacgacttcatccaataatcaatctttagaaaaaacatctgatttgcatgttgttgaaacacgtccattaatacctccaagcaaacttcataatgatatacctttagattatacctctgcagaaactgtctctaatactagaagatcaatacaaaatattttgcacaataatgatcctcggattctagtcatagtgggaccatgttcaattcatgatattgaggctgctaaagattattcagaatatattcaggaatttagaaaaatttataaagataaattagaaattgtaatgcgagtatatttcgaaaaacccagaactacaattggttggaaaggattaataaatgaccctcatttagatggttcatatgacattaatacaggtttacgaagagcgagaaatttactatcttatttggcaacgcgtgggataccctctgctactgagttattagatccaattgttcctcaatatattgctgatttaatcagttggacagcaattggtgcaaggactaccgaaagtcaaactcatagagaaatggcttcaggattatccatgcctattggttttaaaaatggtactgatggttcttttagtactgctattaatgcgatgcagtcggcttcaaaatctcatcatttcttaggtgttaatgatcaaggttatgcttctattgtaaatacaaccggcaatccagatggacatatagttttaaggggaggttctaaaggagttaatttcgaaaatcaacatgtaaaaagtatttcttccgaattaaaagaaggtaatcttccttacaaagttatgattgattgtagccatggaaattctaataaagattacacaaagcaatctgatgtccttaaaaacgtagcaaatcagattaagaatggtgaaaaaaatattttaggagtaatgcttgaaagtcatctgaaggagggtaatcaaaaactttcaaatatgaaagatcttgaatatggtacgagtattactgatgcttgcataaatatagaaacaacgaaaaatttgcttcagattctatatgattcaattttgtaa

SEQ ID NO: 1448 - protein, 355 aa, Prochlorococcus marinus subsp
MTTSSNNQSLEKTSDLHVVETRPLIPPSKLHNDIPLDYTSAETVSNTRRSIQNILHNNDPRILVIVGPCSIHDIEAAKDYSEYIQEFRKIYKDKLEIVMRVYFEKPRTTIGWKGLINDPHLDGSYDINTGLRRARNLLSYLATRGIPSATELLDPIVPQYIADLISWTAIGARTTESQTHREMASGLSMPIGFKNGTDGSFSTAINAMQSASKSHHFLGVNDQGYASIVNTTGNPDGHIVLRGGSKGVNFENQHVKSISSELKEGNLPYKVMIDCSHGNSNKDYTKQSDVLKNVANQIKNGEKNILGVMLESHLKEGNQKLSNMKDLEYGTSITDACINIETTKNLLQILYDSIL

SEQ ID NO: 1449 - DNA, 1083 bp, Prochlorococcus marinus
  CDS (1)..(1083)
atgaattctggcgaaatgaccaccacttccgacttgcatgtggtggatacgcggcccttggtgtcgccgctcttgcttcatcaggagctgccccttgatctagtggctctcaaaaccgttgcagatactcgtaagcgcatccaggcaattctgcgtggtgaggatccccgcttgctggtgattgttggtccctgctcggttcatgacattgcctctgcaagggactatgcccgtcagttggagccattgcgacagcgatatgccgcccagttggaggtggttttgcgggtctatttcgaaaaacctcgcaccacagttggctggaaaggtctcatcaatgatccccatctcgatggttcctatgacatcaacactggcttgaggcgtgcgcggtcgttgttgctcgaccttgctcgcgagggtatgccgacggccactgaattgctggatccggttgtgcctcaatacatcgctgatttgatcagttggacggcgattggagccagaaccactgagagtcagacccatcgggagatggcttctggattgtcaatgcccgtcggttacaaaaacggtaccgatggcagtgccaagattgcgatccatgcgatgcaggcagcatctagaccgcatcattttcttgggatcaatcggcagggtcaggcttcgattgtgcataccactggaaaccctgatggccatctcgtgttgcggggaggtaatggctgtaccaattaccatcccgaagcggtggaagaggttgcaaaagaattagtgaaggctggcttggttgatcggttgatggtggattgcagccatgacaattcgaagaaagattttcggcgacagtcagaggtgcttcaggctgttgctactcaggtacgccaaggatcaacccatctcatgggtgtgatgttggaaagtcatcttgtcgagggcaatcagaagttgcctgaagacctctctactcttgtctatggtcaaagcattacggatgcttgtatcgatatagagacaacggcaactctccttgaggatttggcggctgcagtggcttcagtgacgttgtcaccaataacttga

SEQ ID NO: 1450 - protein, 360 aa, Prochlorococcus marinus
MNSGEMTTTSDLHVVDTRPLVSPLLLHQELPLDLVALKTVADTRKRIQAILRGEDPRLLVIVGPCSVHDIASARDYARQLEPLRQRYAAQLEVVLRVYFEKPRTTVGWKGLINDPHLDGSYDINTGLRRARSLLLDLAREGMPTATELLDPVVPQYIADLISWTAIGARTTESQTHREMASGLSMPVGYKNGTDGSAKIAIHAMQAASRPHHFLGINRQGQASIVHTTGNPDGHLVLRGGNGCTNYHPEAVEEVAKELVKAGLVDRLMVDCSHDNSKKDFRRQSEVLQAVATQVRQGSTHLMGVMLESHLVEGNQKLPEDLSTLVYGQSITDACIDIETTATLLEDLAAAVASVTLSPIT

SEQ ID NO: 1451 - DNA, 1074 bp, Prochlorococcus marinus
  CDS (1)..(1074)
atgaccttttcaacgaattttcagatatctgataaaacttccgatctacacgttgttgagactaggccattagtccctccagcttcccttcacaaggatttgccattagatcatcactcttcaaccattgtttctaagacaagaaaaacaatacaagcaattctggcaggatcagattcacgattattggtaattgttggcccttgttcaattcatgatattgctgctgccaaagattatgcaaatcagctgcttccgctaagagaaaaattttctaagcaactcgaaattgtaatgagagtttattttgaaaaacctaggacaactactggttggaagggtctcattaatgatcctcatcttgatgggtcttatgacattaatactggtttaagaagagcgagatctttgcttctagatttagcaaatttaggtattccaacagcaactgagcttttagatcctgttgttcctcaatatatagctgatttaattagttggactgcaattggggcaagaacgactgagagtcaaactcatagagaaatggcttccggattatctatgccaataggatataagaatggaacagatgggactattgctattgctattaatgctatgaaagcagcttcaaagcctcatcattttctaggtattaatcatgaaggccatgcatctattattagtacgacaggcaaccctgatggtcatcttgttttgagagggggaagtagtggtactaattatcatctggaatcagtgcaaaaagttgctcaagaacttctacaatcaggctcaaaaagtaaagtgatggttgactgtagtcacggtaactcagataaggattttcgaaaacaaggtattgtcttgaaagaggttgctaagcaggttaaagaaggttcgtctaatgtcatgggagtgatgcttgagagccatttggttgaaggtaatcaaaaattaactaaggacttatcaacattgatttatggaaaaagtattacagatgcctgtatagatttgaagacgacagaaactttgtttgagcaacttgctgatgctgttactttttaa

SEQ ID NO: 1452 - protein, 357 aa, Prochlorococcus marinus
MTFSTNFQISDKTSDLHVVETRPLVPPASLHKDLPLDHHSSTIVSKTRKTIQAILAGSDSRLLVIVGPCSIHDIAAAKDYANQLLPLREKFSKQLEIVMRVYFEKPRTTTGWKGLINDPHLDGSYDINTGLRRARSLLLDLANLGIPTATELLDPVVPQYIADLISWTAIGARTTESQTHREMASGLSMPIGYKNGTDGTIAIAINAMKAASKPHHFLGINHEGHASIISTTGNPDGHLVLRGGSSGTNYHLESVQKVAQELLQSGSKSKVMVDCSHGNSDKDFRKQGIVLKEVAKQVKEGSSNVMGVMLESHLVEGNQKLTKDLSTLIYGKSITDACIDLKTTETLFEQLADAVTF

SEQ ID NO: 1453 - DNA, 1113 bp, Haemophilus ducreyi
  CDS (1)..(1113)
atgccttataaaaatgatgatcttcgtatcactaaaattgaacagctattacccccgatcgctttattagagcgttttccagccagtgatgttgctgagcatactgttgctagagcaagagaagctattcataaaattattcacggtgaagacgatcgtttattagttgttattgggccttgctcaattcatgatccagaatctgctctagattatgctaaacgaattaaagcattacgtgataatccacagattaatcaaaacttagagttagtaatgcgcgtttattttgaaaaaccacgaacaaccgttggttggaaagggttaattaatgacccctatctgaatgaaacttatgcattaaacgatggtttacgaattgcacgaaaagtactgtccgatattaatgatttaaccgtgcctgccgcgggtgagtttttagatatgatcattccacaatatgtagccgattttatgagttggggagccattggagcacggaccgctgaatcacaagttcatcgtgagttagcctcaggtttatcttgtgcggtaggtttcaaaaatgccactaatggcagtgttaaaaccgctttagatgcaataaaatctgctgaagtttcacatcacttcttatccgtgaccaaatttgctcattcagctgttatttctaccgcaggtaatgaggattgccacattattttgcgtggtggcgataatggcacaaattatgatattgcgtctgtaaaaaaagtgtgtgcagatattgagaaagcagggcggcgtcctcacgtaatgattgactttagtcatgctaatagccaaaaacaatttaaacgacaaatggaagtttgtactaatgtatgccaacagattgcaaatggttcatcattaatttctggtgtgatgatagaaagccatttagtcgaaggtcggcaagatcttgtcgaaggtggtttagataaattagtatatggtcaaagtgttacagatgcttgtattggttgggaagacagcgaaacagcactgtttgccttagctgaagcggtcgcattacgccgacaacggaccaacaataatgctaatgatttggttaatcatatagtaaaatag

SEQ ID NO: 1454 - protein, 370 aa, Haemophilus ducreyi
MPYKNDDLRITKIEQLLPPIALLERFPASDVAEHTVARAREAIHKIIHGEDDRLLVVIGPCSIHDPESALDYAKRIKALRDNPQINQNLELVMRVYFEKPRTTVGWKGLINDPYLNETYALNDGLRIARKVLSDINDLTVPAAGEFLDMIIPQYVADFMSWGAIGARTAESQVHRELASGLSCAVGFKNATNGSVKTALDAIKSAEVSHHFLSVTKFAHSAVISTAGNEDCHIILRGGDNGTNYDIASVKKVCADIEKAGRRPHVMIDFSHANSQKQFKRQMEVCTNVCQQIANGSSLISGVMIESHLVEGRQDLVEGGLDKLVYGQSVTDACIGWEDSETALFALAEAVALRRQRTNNNANDLVNHIVK

SEQ ID NO: 1455 - DNA, 1080 bp, Haemophilus ducreyi
  CDS (1)..(1080)
atggattctgtagcaaatcaagatagtttacataatgtaaatatctctactgaaaaagtattacttactccaaaacaactaaaaactgagtttccattacccgatcatttacgtaagcaaattgaaaaatcacgccaagaaattgccgcgattattcataaaaaagatccacgtaaacttattatcatcggaccttgttctattcacgatatctctgccgcattagagtatggccaaaaactaaaaaaattagccgaccaagtaagcgatcaactttatattgtaatgcgggtatattttgaaaaaccgcgcaccaccgtaggatggaagggcttaattaacgatccacaaatagatggcacttttaatgttgaagccggtttacgcattgcacgtaaattgtgcttagatttaactgaactaggcttaccattagccacagaagcactagatccaatgacaccacaatatttagcagatctttttagctggtcagcgattggagcaagaacgactgaatcacaaacacatcgtgaattagcttctggtttatctatggccgttggctttaaaaatggcactgatggcggcctagctgtggcgattaacgccatgcaatctgccgcacaaccgcatcgtttcattggtatcaatcaaaatggacaggtcaatttattaaataccaaagggaatcctgatggccacgtgattttacgtggcggtaaaaaacctaactttgaacaaaaatatgtaatggaatgtgaaactgcattacgtaaagcgggtttagaagaagcaataatgattgattgtagccacggtaattcaaataaagatcacacacgtcaacctatagttgcagaaaatgtactcacgcaattattggcaggtaaccgatcgatcatcggcttaatgattgaaagccatttaaatgcgggtaatcagccctctgaacaatcattccaagagatgaaatacggcatatccattacagatgcttgtattgattggcaaaccactgaacatatacttctcaacttcgccgcaaaattaagaaatcccccatcttcctttcagtaa

SEQ ID NO: 1456 - protein, 359 aa, Haemophilus ducreyi
MDSVANQDSLHNVNISTEKVLLTPKQLKTEFPLPDHLRKQIEKSRQEIAAIIHKKDPRKLIIIGPCSIHDISAALEYGQKLKKLADQVSDQLYIVMRVYFEKPRTTVGWKGLINDPQIDGTFNVEAGLRIARKLCLDLTELGLPLATEALDPMTPQYLADLFSWSAIGARTTESQTHRELASGLSMAVGFKNGTDGGLAVAINAMQSAAQPHRFIGINQNGQVNLLNTKGNPDGHVILRGGKKPNFEQKYVMECETALRKAGLEEAIMIDCSHGNSNKDHTRQPIVAENVLTQLLAGNRSIIGLMIESHLNAGNQPSEQSFQEMKYGISITDACIDWQTTEHILLNFAAKLRNPPSSFQ

SEQ ID NO: 1457 - DNA, 1086 bp, Candidatus Blochmannia floridanus
  CDS (1)..(1086)
atgcaaaagaataatttaggtaatataaatttttgtgatataagttctttgctttctcctaaacaattaaaatctcaatttcctttaacgtatgttgatcaactttttattgaagaaacacaaaatattattataaatattattcaaaaaaaagatcctcgtttgttgattatatgtggtccttgttctattcatgatgtgaacgctgcttttgattatgccaagaaattaaaatctttatcattagaattgcaagatcaattatatattgtaatgagagtatatttagaaaaacctcgtactacaattggatggaaaggattaattaatgatccttatatagatggttcttgtgatattcagtctggattaaaaattgctcgtcaattattattgcaattaataaaaattaaattgcctgtagcgactgaaatattaaatccaaatgttcctcaatatattggagatttatttagttgggtagctattggggctcgtactacagagtcacagatacatcgagaaatagcttctagttttcagtcggtaataggttttaaaaatagtactcatggagatattgatcatgcaattaatgcaatacgtgcagcttccatgtctcataattatattagtattgatcaatctgggcaggtgtgttcattacatactaaaggaaatacaaatagtcatataattttaagaggagggattcaacctaattattatccagaaaatattatttgttgtgaaaaaaaaataacagaaatagggttacctataacattaatgatcgattgtagtcatggtaattctaataaggattatcatcgtcaaatagatgtagctcaatctattttaaatcaaataaagttgggtaatcattctattataggattaatgatggaaagttatatttatcctggaaatcaaatagtagatttgacgcatacttcttctattaaaatgcagtatggggtatctataacagatgcttgtatagattgggattcaactgaacgattattaagatgcttacataaagaattgaaaccatttctttctactcgtttaaaaagagtatga

SEQ ID NO: 1458 - protein, 361 aa, Candidatus Blochmannia floridanus
MQKNNLGNINFCDISSLLSPKQLKSQFPLTYVDQLFIEETQNIIINIIQKKDPRLLIICGPCSIHDVNAAFDYAKKLKSLSLELQDQLYIVMRVYLEKPRTTIGWKGLINDPYIDGSCDIQSGLKIARQLLLQLIKIKLPVATEILNPNVPQYIGDLFSWVAIGARTTESQIHREIASSFQSVIGFKNSTHGDIDHAINAIRAASMSHNYISIDQSGQVCSLHTKGNTNSHIILRGGIQPNYYPENIICCEKKITEIGLPITLMIDCSHGNSNKDYHRQIDVAQSILNQIKLGNHSIIGLMMESYIYPGNQIVDLTHTSSIKMQYGVSITDACIDWDSTERLLRCLHKELKPFLSTRLKRV

SEQ ID NO: 1459 - DNA, 1074 bp, Bordetella pertussis
  CDS (1)..(1074)
atgtcgcacaataccgatgaccttcgtatccgtgaaatcaaagagctgaatcctcccgcgcatgtcatgcgcgagtttccgtgctcgaaggatgtttctgaaatcgtctacgccgcccgccagggcatgcatcgcatcctgcatggcatggatgaccgcctgatcgtcgtgatcggcccttgctcgatccacgataccaaggcggcgctcgaatacgcggatcgcctcaagccggtgcgcgaccgcctggccgccgatctcgaggtggtgatgcgcgtctacttcgaaaagccgcgcaccaccgtgggctggaagggcctgatcaacgaccccgacctggatggcagcttcgatatcaacaagggcgtgcgcgtggcgcgcgaactgctgctggacatcaacagccgcggcctgccggcgggttgcgagttcctcgacatgattaccccgcagtacatcgccgacctggtgtcgtggggggcgatcggggcgcggacgaccgaaagccaggttcaccgcgagctggcttccggcctgtcgtgtcctgtcggtttcaagaatggcaccgacggcaatgtgaagatcgccgtcgacgccatcaaggccgcctcgcaaccgcaccatttcctctcggtgaccaagggcgggcattcggccatcgtctcgaccgcgggcaacgaggactgccacgtcattctgcgcggcggcaaggcgcccaactacgatgccgccagcatcgaagcggcctgccaggacatggccaaggccggcctggcccagcgcatcatgatcgacgccagccacgccaacagcagcaagaagcccgagaatcagccgctggtggtcgatgatgtggccaaccagatcgagcagggcgatgcccgcatcgtgggcctgatgatagaaagccatctgctgggcggccgccaggacctggtgcccggccaggccttgacgtacgggcagagcatcaccgacggttgcatcgactgggatgcttcggtgcaggtgctggagcgcctggcccatgcggtgcgcgaacgccggcgcgcgtcgctgagcgccggcaagtag

SEQ ID NO: 1460 - protein, 357 aa, Bordetella pertussis
MSHNTDDLRIREIKELNPPAHVMREFPCSKDVSEIVYAARQGMHRILHGMDDRLIVVIGPCSIHDTKAALEYADRLKPVRDRLAADLEVVMRVYFEKPRTTVGWKGLINDPDLDGSFDINKGVRVARELLLDINSRGLPAGCEFLDMITPQYIADLVSWGAIGARTTESQVHRELASGLSCPVGFKNGTDGNVKIAVDAIKAASQPHHFLSVTKGGHSAIVSTAGNEDCHVILRGGKAPNYDAASIEAACQDMAKAGLAQRIMIDASHANSSKKPENQPLVVDDVANQIEQGDARIVGLMIESHLLGGRQDLVPGQALTYGQSITDGCIDWDASVQVLERLAHAVRERRRASLSAGK

SEQ ID NO: 1461 - DNA, 1119 bp, Bordetella bronchiseptica
  CDS (1)..(1119)
atgacccgtatcgatgacccgctgcacgatcgcgaggccggccaggccgacgcgacgcaagacaccacccgcatcgacgacgtgcgcatcggcgccgtgcgtcccctgatttcgcccgccctgctgcaggacgaactgccggtatcggcgccgctacaggcgctggtcgaggacagccgcgcgcgcatcgccgacgtgctgcacggccgcgacgaccggctggtggtggtggtcggcccctgctccatccacgaccacgaacaggccatggagtacgcgcgccagctcaaggaggcggccgacacgctggccgacgacctgctcatcgtcatgcgcgtgtacttcgagaagccgcgcaccaccgtgggctggaagggctacatcaacgatccgcgcctggacggcagtttccgcatcaacgaaggcctgcgccgcgcgcgccacctgctgctggaaatcggcgccctgggactgcccatcgccaccgaattcctggacctgctcagcccgcaatacatcgccgacctgatcgcctggggcgcgatcggcgcgcgcaccaccgaaagccccagccaccggcaactggcctcgggcctgagctgcccgctgggtttcaagaacggcaccgacggcggcatccaggtggcggctgacgccatcgtggccgccagcgccccgcatgccttcatgggcatgaccaagatgggcaccgccgccatcttcgagacgcgcggcaacgacgacacccacgtcatcctgcgcggcggcaagcaaggccccaactacgacgcggccgccatcgacgcctgctgtgcggcgctggccaaggccggcctgcgcgagcaggtcatggtcgactgctcgcacgccaattcgaacaagtcgcacgcgcgccaggtcgacgtggcgcgcgacctggcccggcagctggccggcggcgaccgccgcatcatcggcatcatgatcgaaagcaacctcgaggaaggccgccaggatctcaagcccggcgtgccgctcaagcgcggcgtgtccatcaccgacgcctgcctgagctgggcccagaccgagccggtgctggccgagctggcccaggccgtgcgccagcgccgcgaaggctga

SEQ ID NO: 1462 - protein, 372 aa, Bordetella bronchiseptica
MTRIDDPLHDREAGQADATQDTTRIDDVRIGAVRPLISPALLQDELPVSAPLQALVEDSRARIADVLHGRDDRLVVVVGPCSIHDHEQAMEYARQLKEAADTLADDLLIVMRVYFEKPRTTVGWKGYINDPRLDGSFRINEGLRRARHLLLEIGALGLPIATEFLDLLSPQYIADLIAWGAIGARTTESPSHRQLASGLSCPLGFKNGTDGGIQVAADAIVAASAPHAFMGMTKMGTAAIFETRGNDDTHVILRGGKQGPNYDAAAIDACCAALAKAGLREQVMVDCSHANSNKSHARQVDVARDLARQLAGGDRRIIGIMIESNLEEGRQDLKPGVPLKRGVSITDACLSWAQTEPVLAELAQAVRQRREG

SEQ ID NO: 1463 - DNA, 1179 bp, Nitrosomonas europaea
  CDS (1)..(1179)
atgaagtcgggcagtctgtattgccagtgtggcaaggaagtgcaaaaagaaatagtcatcaaggaatcatctgtggaacataaaactgacgaccggcgcattatcagaggagatgagctgatcacgccggtgaaactgcttcatgatcatcctctgactgaacaggcgactgaaactgtggttactgccagacaggagtgccacgatattttgcggggagaggatgaccggttactggtggtatgtggcccatgctcgattcatgatgtggatgcggcagtggaatatgcttcccgactgagtcatctgcgtcaggagctgaaagatcagttacatatcatcatgcgggtttatttcgagaaacctcgcacaacagttggctggaaaggcctgatcaacgacccagacctggataacagtttcaacattgacaagggattgcggcttgcccgcgacctgttgctgaaactgggtaatataaatatgccggctgcaactgaatttcttgatctgatcagcccgcaatatgtggctgacctcatcagttgggcggccatcggcgcacgcacgactgaaagccagggacatcgtgaactggcctccggtgtttcgtgtccagtggggttcaagaatggtacctacggcaatctgaatatcgcaatcgatgcgattggtgctgcatcccacccgcataatttcctgtcagtcaccaaagaaggccgggttgctactttcaccaccaggggaaatgaagattgtcatatcatcctgcgcggcggaagatcaccgaattacgatgcagagagtgttgcttctgcggtcgaagcactgcggaaagccaagctgcctccttatctgatgatcgattgcagtcacgccaacagccacaaggattaccggcgtcagccggaagtggctgccgatgtggctcagcaaattgcggaaggaaactgctcaatcagcgggatcatgcttgaaagtcacctggtggccggcaggcagaatgttgaaggtaagcggcgggaagagctggtttacgggcaaagcatcacggatggctgtatcgatttcgatacgacacagcaggtgctgttcgagctggcggaagcggtggaaaaacgaagaaatttgcagaataccccgatactggttccagatcattccactgcgctttcctga

SEQ ID NO: 1464 - protein, 392 aa, Nitrosomonas europaea
MKSGSLYCQCGKEVQKEIVIKESSVEHKTDDRRIIRGDELITPVKLLHDHPLTEQATETVVTARQECHDILRGEDDRLLVVCGPCSIHDVDAAVEYASRLSHLRQELKDQLHIIMRVYFEKPRTTVGWKGLINDPDLDNSFNIDKGLRLARDLLLKLGNINMPAATEFLDLISPQYVADLISWAAIGARTTESQGHRELASGVSCPVGFKNGTYGNLNIAIDAIGAASHPHNFLSVTKEGRVATFTTRGNEDCHIILRGGRSPNYDAESVASAVEALRKAKLPPYLMIDCSHANSHKDYRRQPEVAADVAQQIAEGNCSISGIMLESHLVAGRQNVEGKRREELVYGQSITDGCIDFDTTQQVLFELAEAVEKRRNLQNTPILVPDHSTALS

SEQ ID NO: 1465 - DNA, 1083 bp, Coxiella burnetii
  CDS (1)..(1083)
atgcagaaaactgacaatttaagaataaaagccatccaccccctgatgctccccgcccttctcatcgaagagctgcccatcacagccgctgtagcttcaaccgtcaacctagctcgattagctgccagagacatcattcacggccaagatgaccgtttgttagtagtccttggcccttgctccattcacgacgttaaagccgccctcgaatacgctaatcgactcaaacgctgtattgatcgacacgctaaggaactgtgcatcatcatgcgcgtttattttgaaaaaccccgaacgaccgttggatggaagggcttgattaacgacccccagctcgatggaagtttccacattaaccaagggctgcgggtcgcccggcgtttactgctcgacattaatgaaatcggggttcctaccggaagcgaatttctagacaccattataccccagtatatttctgatttaacttcgtggtccgccatcggcgctcgcacgaccgaaagccaaacccaccgagagctagcttctggcctttcaatgccaattggcttcaaaaacggtaccacgggcaatgtccaaatcgccattgatgcagtgctggctgcccgacaagcccatcattttttaggggtatccaaacaaggcatcgctgctattatcattacaaaaggaaaccctgacggtcacgtgattttgcgcggctcctcccagagcaccaactatgatcccaaatccattgaagaagccattctgaaactcaaagctaaccatttacccccctcggtgatggttgactgtagccacggcaatagccgcaaaaaccacaaaaatcaaatgcgagttgttgacgccttatacgatcaaattacccaaggcagctcttatttattgggcgccatgattgaaagtaatttagttgaagggaaacaaaccctcgaatccggaaaagctttaacctatgggcagagcatcaccgatgcttgcatctcgtgggaagataccgaacttgcgttggaaaaactggcacaagccgttattattcggcgccaacacagcgaagagagaaaacatcatggcgaataa

SEQ ID NO: 1466 - protein, 360 aa, Coxiella burnetii
MQKTDNLRIKAIHPLMLPALLIEELPITAAVASTVNLARLAARDIIHGQDDRLLVVLGPCSIHDVKAALEYANRLKRCIDRHAKELCIIMRVYFEKPRTTVGWKGLINDPQLDGSFHINQGLRVARRLLLDINEIGVPTGSEFLDTIIPQYISDLTSWSAIGARTTESQTHRELASGLSMPIGFKNGTTGNVQIAIDAVLAARQAHHFLGVSKQGIAAIIITKGNPDGHVILRGSSQSTNYDPKSIEEAILKLKANHLPPSVMVDCSHGNSRKNHKNQMRVVDALYDQITQGSSYLLGAMIESNLVEGKQTLESGKALTYGQSITDACISWEDTELALEKLAQAVIIRRQHSEERKHHGE

SEQ ID NO: 1467 - DNA, 834 bp, Vibrio anguillarum
  CDS (1)..(834)
atggggcggatacctttgaaattagtcatgcgaacttattttgaaaaaccacgaacacgaagaggatggaaaggatttattgttgacccagatctcaatggtaaattcgatttactcaaggggattactcacagtcggaaactaatgcaatcgattctagaacttggtgttcccacagccaatgagtttctcgatactaatatcgccttatatattgcagacctagtatgttggggagccatcggtgctcgcactactgaatcacaacctcatcgacagttggcttctgggttacattgccctatgggctttaaaaacggtactgacggtaatattgacatatccattgatgctatacacgcagcacaagattgtcatacgatgctaacacaaacaaccgacaaccaaactgttgcaatacaaactcaaggcaacaatcactgccacgtaatcttacgtggtggggcaactccaaattattcgtcccaacatataaaacaaacctcgctccaacttaaacgaagtaaactctcacccaaaatagttgtcgactgcagtcatgggaatagcggaaaactcgcaaaaaaccagttaatcgttgttgaagatattgctcgccagatctcttccggtgaaatcaacatcgcaggtgtcatgtgtgaaagctatctagttggcggcaatcaaaaactcggtaacggagctctcaattacggccaatcaattactgatgaatgcttaagttgggaagatactttaatatttctcgaccacttgaatgttgcaatgttaaaaaaagtgagctctcaactaactccaaccgagtacgtttaa

SEQ ID NO: 1468 - protein, 277 aa, Vibrio anguillarum
MGRIPLKLVMRTYFEKPRTRRGWKGFIVDPDLNGKFDLLKGITHSRKLMQSILELGVPTANEFLDTNIALYIADLVCWGAIGARTTESQPHRQLASGLHCPMGFKNGTDGNIDISIDAIHAAQDCHTMLTQTTDNQTVAIQTQGNNHCHVILRGGATPNYSSQHIKQTSLQLKRSKLSPKIVVDCSHGNSGKLAKNQLIVVEDIARQISSGEINIAGVMCESYLVGGNQKLGNGALNYGQSITDECLSWEDTLIFLDHLNVAMLKKVSSQLTPTEYV

SEQ ID NO: 1469 - DNA, 1143 bp, Xylella fastidiosa
  CDS (1)..(1143)
atgtctcctccgcttggtctatgtctaaatgttctgagattacatcccatgccaccatttaccgacgacctccgtatccgaaaaattgaaccactgacacctcctaacaagctcctcttacaactaccatgcgatgagcaggcatcgctgactgttgcgacctcacgcaacgcactgcacgatatcctgcacggccacaatgaccgtttagccgtcgtgataggcccatgctcaatccatgatccaattgcagccattgattactcgcaacgtctacgcccattgcgtgagatgtacaaggatgcactagaaatcgtgatgcgagtttactttcagaaaccgcgcaccactattggttggaaaggattggtcaacgatccggatcttgatggcagcttccagatcaataagggcttgcatatcgcgcgcaacctgctgcgcgatatcaatcatctcggcttacccgctggtgtggaatttctagacacgatttcgccgcaatatctggctgacttagtcgcctggggtgccattggtgctcgcaccactgaaagccaaatacaccgtgaaatggcttcaggtttatcgtgcccgattggctttaaaaacagtaccagtggtgatgtgaagattgctgctgacgcgattaaagcagcttcgcatccgcaccatttcctttcagtgacaaagacaggtgttgccgcagtcgtcgccacccagggtaaccccgattgtcacgtgattctgcgtggaggcaaggtcccgaattacgacgcaatcaatgtcgaagctgccagccaaacattgcttaaatccaagctaccggtgcgactgatgattgatgcgagccatgccaatagcggcaaaaatccaaacaatcaacctaaggtgatcgagaacatcgtagaacagcttaaagccggtgaacgccgcatcatcggtgtcatgattgaaagccacattgttggtggccggcaagaattagtccttggaaacacacttaactatggacagagcattaccgatgcttgcatcgactgggatacctcggttgcaatgttagaacagctcgctcaggccgtacgcgtcagacagactctaccaacgaccactacagctaacaaaacatcaaaaacccaataa

SEQ ID NO: 1470 - protein, 380 aa, Xylella fastidiosa
MSPPLGLCLNVLRLHPMPPFTDDLRIRKIEPLTPPNKLLLQLPCDEQASLTVATSRNALHDILHGHNDRLAVVIGPCSIHDPIAAIDYSQRLRPLREMYKDALEIVMRVYFQKPRTTIGWKGLVNDPDLDGSFQINKGLHIARNLLRDINHLGLPAGVEFLDTISPQYLADLVAWGAIGARTTESQIHREMASGLSCPIGFKNSTSGDVKIAADAIKAASHPHHFLSVTKTGVAAVVATQGNPDCHVILRGGKVPNYDAINVEAASQTLLKSKLPVRLMIDASHANSGKNPNNQPKVIENIVEQLKAGERRIIGVMIESHIVGGRQELVLGNTLNYGQSITDACIDWDTSVAMLEQLAQAVRVRQTLPTTTTANKTSKTQ

SEQ ID NO: 1471 - DNA, 1053 bp, Vibrio parahaemolyticus
  CDS (1)..(1053)
atgtttcaaactgatgatgtaagaattaatagagtaaaagagttattgccccctgttgcagttctagagaagttcccagcgaccgaaaccgcttcttcgaccacttttgattgccgtaatgccattcacaatattcttgaaggaaaagatgatcgtttacttgtgatcgttggtccttgctctatccatgatcctgcagctgcagttgaatacggcaaaaagctgaaagtgttgcgtgatgaacttggtgagcaactggaagttgtgatgcgagtttactttgaaaaaccacgtacgacagtcggctggaaaggtttgatcaacgacccatacctgaacgacacatttaagctaaatgacggtcttcgtattggacgtaagctgcttttggatctcactgacatgggcctaccaacagcgagtgaattcctagacatgattacgcctcaatacgttgcggatttgatcagctggggcgcgattggtgcacgcacgacggaatcgcaagttcaccgcgaactcgcttctggtctttcttgcccggttggtttcaaaaacggtactgacggtaacattaaaatcgcgagtgatgctattcgctctgcaagcgcttctcaccatttcctatcggtaacgaagtacggtcattcagcgattgttgaaaccgcaggtaacccagactgccacatcattttacgtggtggtaaagaaccaaactacagtgcagcacacgttgctcaaatcaaagacgagttggacgcggctggtctaccgaagaaagtgatgatcgattttagccacgcgaacagctctaagcagttcaaacgtcaaatgcttgtgtctgatgatgtatcagagcaaatcgctggtggtgaagatgcaatctttggcgtgatgatcgagtctcatttggttgaaggccgccaagatttagtggatggtaaagtggcaacttacggtcagtcgattactgatgcatgtattggttgggacgatacggaaacggtacttcgtcagctttctgaagcagtaaaagcgcgccgtagcaaataa

SEQ ID NO: 1472 - protein, 350 aa, Vibrio parahaemolyticus
MFQTDDVRINRVKELLPPVAVLEKFPATETASSTTFDCRNAIHNILEGKDDRLLVIVGPCSIHDPAAAVEYGKKLKVLRDELGEQLEVVMRVYFEKPRTTVGWKGLINDPYLNDTFKLNDGLRIGRKLLLDLTDMGLPTASEFLDMITPQYVADLISWGAIGARTTESQVHRELASGLSCPVGFKNGTDGNIKIASDAIRSASASHHFLSVTKYGHSAIVETAGNPDCHIILRGGKEPNYSAAHVAQIKDELDAAGLPKKVMIDFSHANSSKQFKRQMLVSDDVSEQIAGGEDAIFGVMIESHLVEGRQDLVDGKVATYGQSITDACIGWDDTETVLRQLSEAVKARRSK

SEQ ID NO: 1473 - DNA, 1053 bp, Vibrio parahaemolyticus
  CDS (1)..(1053)
atgcctataaaaacagatgaattgagaacccaacctttgggtccaatgcctaccccagcggagctaggtagtgtacatccgatcacggatgacgttgcagatcgcatcgctcaatctcgtcgtcagattgaaaacattttaacaggtgaagacgatcgccttcttgctatcgttggtccatgttctgttcacgatactgaagccgcaattgattacgcgaaacgcttgagtgaaatccaagataagtacaaagacgagctatttatcgttatgcgtacttactttgaaaagcctcgtacagtagttggttggaaaggtcttatcaccgaccctaacctagacggttcttacgcgcttgaagctggccttcacaaagctcgtaaactgctactggatatcaacaagcttggtcttgcgactgctactgagtttcttgatatgatcactggccaatacattgcggatttgatcacttggggcgcaattggcgcacgtacgacagaatctcaaattcaccgtgaaatggcatcagcgctatcttgccctgttggctttaaaaatggcacaaacggtaatgtgaaaatcgcgattgacgcgattcgtgcctcccaagcttcacactacttctactcgccagataagaatggtcgtatgacggtgtaccgcacaagtggcaacccattcggtcatattattttgcgtggcggcgaaaaaggtccaaactttgacgaagcatctgtgaagcaagcgtgtgattcacttgctgagtttggtttacctgagcgtcttattgtagacttcagtcatgcaaactgtcagaagcagcaccgaaaacaacttgatgttgcgagcgacatttgtactcaaattaagtcaggcagcactcgcattgcgggtatcatggcggaaagcttcattatggaaggcaaccagccaatgactgacattaacaacctaacttacggtcaatcaattactgacccttgtttaggttgggacgatacagtaactatgctagatatgctggcagaagctgtaaaatccactaagtaa

SEQ ID NO: 1474 - protein, 350 aa, Vibrio parahaemolyticus
MPIKTDELRTQPLGPMPTPAELGSVHPITDDVADRIAQSRRQIENILTGEDDRLLAIVGPCSVHDTEAAIDYAKRLSEIQDKYKDELFIVMRTYFEKPRTVVGWKGLITDPNLDGSYALEAGLHKARKLLLDINKLGLATATEFLDMITGQYIADLITWGAIGARTTESQIHREMASALSCPVGFKNGTNGNVKIAIDAIRASQASHYFYSPDKNGRMTVYRTSGNPFGHIILRGGEKGPNFDEASVKQACDSLAEFGLPERLIVDFSHANCQKQHRKQLDVASDICTQIKSGSTRIAGIMAESFIMEGNQPMTDINNLTYGQSITDPCLGWDDTVTMLDMLAEAVKSTK

SEQ ID NO: 1475 - DNA, 1074 bp, Vibrio parahaemolyticus
  CDS (1)..(1074)
atgcaaaaaagtgaattgagcaatattaacatcagcgatgaacaggttcttattacgccagatgagctaaaagtgaagcttcctcttagtgaaaaggcacgccgttttattcaagaatctcgccaaaccatcgccaacatcattcacaaaaaagaccatcgcctacttgtcgtatgtggaccatgctctatccatgacattgaagccgcaaaggattacgcgaagcgtctaaaagctctttctgaacaactaagcgaccaactgtatattgtaatgcgtgtttactttgagaagccgcgcaccacggtcggctggaaaggcctgatcaatgacccacacctagatggcagcttcgacattgaacacggtctgcatgtaggacgtgaactgctggtggaactggcggaaatggaaatcccacttgcaaccgaagctcttgacccaattagcccacaatacttagccgatacttttagttgggcagcgatcggcgcacgcacaacagaatcacaaacacaccgtgagatggctagtggtctttcgatgccgattggctttaagaatggcacagatggtagtttggcaaccgcaatcaatgcgatgcaggcagcctcttctagccaccgctttatgggtatcaaccgtgaaggtcaagttgcgttgctcacaacccaaggtaacccgaatggccacgtgatcctacgtggtggtaaacagacgaactacgattcagtatccgttacggaatgcgaacaagaaatggcgaaatcaggtcttgaagcgtcattgatggtggattgcagccatgcaaactcacgcaaagattaccgtcgtcagccattggtcgcagaagatgtgattcaccaaatccgtgaagggaacaagtcgatcatcggtttgatgatcgagagccacatcaatgaaggtaatcaatcttctgagctggcgttggatgagatgaaatacggcgtatctatcactgacgcttgtattaattgggagtcaactgaggcactattacgtcatgcacacgaagagctggtgcctttcttagaaaaccgccttaaaggctaa

SEQ ID NO: 1476 - protein, 357 aa, Vibrio parahaemolyticus
MQKSELSNINISDEQVLITPDELKVKLPLSEKARRFIQESRQTIANIIHKKDHRLLVVCGPCSIHDIEAAKDYAKRLKALSEQLSDQLYIVMRVYFEKPRTTVGWKGLINDPHLDGSFDIEHGLHVGRELLVELAEMEIPLATEALDPISPQYLADTFSWAAIGARTTESQTHREMASGLSMPIGFKNGTDGSLATAINAMQAASSSHRFMGINREGQVALLTTQGNPNGHVILRGGKQTNYDSVSVTECEQEMAKSGLEASLMVDCSHANSRKDYRRQPLVAEDVIHQIREGNKSIIGLMIESHINEGNQSSELALDEMKYGVSITDACINWESTEALLRHAHEELVPFLENRLKG

SEQ ID NO: 1477 - DNA, 1083 bp, Pseudomonas syringae
  CDS (1)..(1083)
atgaattcgcccgttgccgtaaaatcgtccgacctgtccagccatgccgtcacattggcggacaacaaccccgcctcgaaacgcctgcccagcacgcttgagcttaaaatgcgcctgccactcaatgccacgctgaccgaacaggttgcagcccatcgccgcgccgtgcgcgccattctcaatggcgaagactcacgactgctggtcatcgtgggcccctgctcgatccatgatccgcaatccgcgctggaatatgccgagcgactcgccagcctggccgcagaagtcagcgatcagatgctgctggtgatgcgtgcctacgtcgaaaaaccgcgcaccaccgtaggctggaaaggcctggcgtacgaccccgacctggatggcagtgacgacatggccggcggcttgacgctgtcgcggcagttgatgcgtgacatgctgggcatgggcctgccgatcgccaccgaaatactgcagcccatggctgccggctacttcgacgacctgctcagctgggtcgccattggcgctcgcaccaccgaatcgcagatccaccgggaaatggccagcgggctgcccatggcggttggcttcaagaacggcacggatggcggcgtagcggtggccagcgacgcaatgcgctcagcggcgcacccgcatcgtcatttcggcatggacgctcacggtcacccggcgatcatcgagacgcagggcaatccggacacgcacatcgtgcttcgcggcggacacagcggccccaactacgatcgccagagcgttgctcaggtgcaggccggcctgagcaataacgccatagcgtcgcgaatcatggtcgattgcagccacgccaacagcggcaaggacccggcgcgtcagcctcacgtgttcaacgatgtgcttgaacagcgcttgtccggcaacccgtcactgattggcatgatgatcgagagccatctacacgatggctgccaggcgctgggcgaaacgctgcagtacggggtgtcggttaccgacggctgcctgggctggaccgcgaccgagcagttgttgcgtgaagcggtcgaccgcttgcgttacagataa

SEQ ID NO: 1478 - protein, 360 aa, Pseudomonas syringae
MNSPVAVKSSDLSSHAVTLADNNPASKRLPSTLELKMRLPLNATLTEQVAAHRRAVRAILNGEDSRLLVIVGPCSIHDPQSALEYAERLASLAAEVSDQMLLVMRAYVEKPRTTVGWKGLAYDPDLDGSDDMAGGLTLSRQLMRDMLGMGLPIATEILQPMAAGYFDDLLSWVAIGARTTESQIHREMASGLPMAVGFKNGTDGGVAVASDAMRSAAHPHRHFGMDAHGHPAIIETQGNPDTHIVLRGGHSGPNYDRQSVAQVQAGLSNNAIASRIMVDCSHANSGKDPARQPHVFNDVLEQRLSGNPSLIGMMIESHLHDGCQALGETLQYGVSVTDGCLGWTATEQLLREAVDRLRYR

SEQ ID NO: 1479 - DNA, 1077 bp, Pseudomonas syringae
  CDS (1)..(1077)
atggctgatttaccgattaacgacctcaacgttgcctccaacgagactctgatcacaccggatcagctcaagcgcgacatcccgctgaccgacgctgcactgcagactgtcagccagggtcgcgaagtgattcgcaacattctcgatggcaatgatcaccgcctgttcatcgtgatcggcccgtgctcgatccacgacctgaaagcggccaaagagtacgccgagcgcctcaaggtactggcggcggaagtttccgacacgctgtatctggtcatgcgcgtgtacttcgagaagcctcgcaccacagtgggctggaaaggcctgatcaacgacccgtacctggatgactcgttcaagatccaggatggcttgcacatcggccgccaactgctgctggacctggctgaaatgggcctgccgaccgcaaccgaagcgctggacccgatctccccgcaatacctgcaggacctgatcagctggtcggccatcggcgcgcgcaccaccgaatcgcagacccaccgcgagatggcttccggcctgtcttcggccgtcggcttcaagaacggcaccgacggcggcctgaccgttgccatcaacgctctgcagtcggtctcaagcccgcatcgcttcctgggcatcaaccaggaaggcggcgtgtcgatcgtgaccaccaagggcaacgcctatggccacgtcgtgctacgcggtggcaatggcaagcccaactatgattcggtcagcgtcgcgctctgcgagcaggcgctgaacaaggccggcattcgccccaacatcatggtcgattgcagccacgccaactccaacaaggacccggccctgcaaccgctggtgatggaaaacgtcgccaaccagattctggaaggcaacgagtcgatcatcggcctgatggtcgagagccatctgaactggggttgtcaggcgattcccaaggatctgtcggaattgcagtacggcgtctccatcaccgatgcctgcatcgactgggaaagcactgaaaaaaccctgcgcagcatgcatgccaagctcaagggcgtactgccggcgcgcacgcgtaaatga

SEQ ID NO: 1480 - protein, 358 aa, Pseudomonas syringae
MADLPINDLNVASNETLITPDQLKRDIPLTDAALQTVSQGREVIRNILDGNDHRLFIVIGPCSIHDLKAAKEYAERLKVLAAEVSDTLYLVMRVYFEKPRTTVGWKGLINDPYLDDSFKIQDGLHIGRQLLLDLAEMGLPTATEALDPISPQYLQDLISWSAIGARTTESQTHREMASGLSSAVGFKNGTDGGLTVAINALQSVSSPHRFLGINQEGGVSIVTTKGNAYGHVVLRGGNGKPNYDSVSVALCEQALNKAGIRPNIMVDCSHANSNKDPALQPLVMENVANQILEGNESIIGLMVESHLNWGCQAIPKDLSELQYGVSITDACIDWESTEKTLRSMHAKLKGVLPARTRK

SEQ ID NO: 1481 - DNA, 1062 bp, Pseudomonas putida
  CDS (1)..(1062)
atgcacgcttccagcctcgccctgcccctgacccagccgcaagcggccaacaccactgtcagcagacgcctgcccagcccgcacctgctcaagcagcagatgccactgcccagcgaactggcccagcaagtccaggcccatcgccaggccatccgcaacatcctcgaaggccgcgacccgcgcctgctggtcatcgtcggcccctgctcgattcatgacccacgctcggccctggaatacgccgaccgcctggccgcccttggccgcgaagtcaacgacaagctgctgctggtgatgcgcgcctacgtcgaaaaaccgcgtactacagtgggctggaaaggcctggcctacgacccgcacctcgatggcagtgacgacatgcactcgggtatcgccttgtctcgcgggctgatgctgagcatgatcgaacgcggcctgccgatcgctaccgagttgctgcaaccgatggccgccggttacttcgacgacctgttggcctgggcggcgatcggcgcacgcaccaccgaatcgcaaatccaccgcgaaatggtcagtggcctggagctgccggtcggcttcaagaacggtacggacggcggcatcgccatcgccagcgacgccatgcgcagcgctgcccacccgcaccgccacttcggtatggatgctcagggccacccggcgatcatcgagaccttgggcaacccggacacacaccttgtactgcgcggcggccacaaaggcccgaaccatgatgccaacagcatcgccatggcccgccaggcgttggccaaggccggtctgcaggcacggatcatggtcgattgcagccacgccaacagcggcaaggacccggcgcgccagccagcggtcttcaatgatgtgctggaacagcgcctggccggcgaccgttcgttggtcggcgtcatgatcgaagggcacttgttcgatggctgccaggcgttgggcaagggcacactgaaatacggtgtgtcgattaccgacggctgcctgggctgggcctcgaccgaaaccctgttgcgtgaggcggcacaaaaactgtag

SEQ ID NO: 1482 - protein, 353 aa, Pseudomonas putida
MHASSLALPLTQPQAANTTVSRRLPSPHLLKQQMPLPSELAQQVQAHRQAIRNILEGRDPRLLVIVGPCSIHDPRSALEYADRLAALGREVNDKLLLVMRAYVEKPRTTVGWKGLAYDPHLDGSDDMHSGIALSRGLMLSMIERGLPIATELLQPMAAGYFDDLLAWAAIGARTTESQIHREMVSGLELPVGFKNGTDGGIAIASDAMRSAAHPHRHFGMDAQGHPAIIETLGNPDTHLVLRGGHKGPNHDANSIAMARQALAKAGLQARIMVDCSHANSGKDPARQPAVFNDVLEQRLAGDRSLVGVMIEGHLFDGCQALGKGTLKYGVSITDGCLGWASTETLLREAAQKL

SEQ ID NO: 1483 - DNA, 1113 bp, Pseudomonas putida
  CDS (1)..(1113)
atggcggccggcacccgtgacctgacgagtaacacgatggctgatttaccgatcgatgacttgaacgttgcctccaacgagaccctgatcacccctgatcagctcaagaaggaaatccccctcagcgccaaggccctgcagaccgtgactgccggccgtgaagtggtgcgcaatattctcgacggcaaggaccatcgcctgttcgtcgtggtcggcccttgctccatccacgacatcaaggcagcccacgaatacgccgagcgcctgaaagtgctggccgaagaagtgtccgatacgctgtacctggtcatgcgcgtgtacttcgaaaagccgcgcaccaccgtcggctggaaaggcctgatcaacgatccgtacctggatgactcgttcaagatccaggacggcctgcacatcggccgcaagttgctgctggacctggccgaaatgggcctgccgaccgccaccgaagcgctcgacccgatttcgccgcagtacctgcaagacctgatcagctggtcggccatcggtgcccgcaccaccgaatcgcaaacacaccgcgagatggcctcgggcctgtcctcggcggtgggtttcaagaacggtaccgatggcggcctgaccgttgccatcaatgccctgcagtcggtgtccaagccgcaccgcttcctgggcatcaaccaggaaggcggcgtgtcgatcgtcaccaccaagggcaacccatacggccacgtggtactgcgcggcggcaatggcaagccgaactacgactcggtcagcgtcgccctgtgcgaacaggacctggccaaggccaagatcaaggccaacatcatggtcgactgcagccatgccaactccaacaaggacccggccctgcaaccgctggtgatggagaacgtcgccaaccagattctcgaaggcaaccagtcgatcatcggcctgatggtcgaaagccacctgaactggggctgtcagtccattccgaaaaacctggacgatttgcagtatggcgtgtcgatcacggacgcctgcatcgactggtcggctaccgagaaaaccctgcgcagcatgcatgccaagctcaaggatgtgctgccgcagcgtaagcgcggctga

SEQ ID NO: 1484 - protein, 370 aa, Pseudomonas putida
MAAGTRDLTSNTMADLPIDDLNVASNETLITPDQLKKEIPLSAKALQTVTAGREVVRNILDGKDHRLFVVVGPCSIHDIKAAHEYAERLKVLAEEVSDTLYLVMRVYFEKPRTTVGWKGLINDPYLDDSFKIQDGLHIGRKLLLDLAEMGLPTATEALDPISPQYLQDLISWSAIGARTTESQTHREMASGLSSAVGFKNGTDGGLTVAINALQSVSKPHRFLGINQEGGVSIVTTKGNPYGHVVLRGGNGKPNYDSVSVALCEQDLAKAKIKANIMVDCSHANSNKDPALQPLVMENVANQILEGNQSIIGLMVESHLNWGCQSIPKNLDDLQYGVSITDACIDWSATEKTLRSMHAKLKDVLPQRKRG

SEQ ID NO: 1485 - DNA, 1086 bp, Bradyrhizobium japonicum
  CDS (1)..(1086)
atgctgagcacgactgacgatcttcgtatccgtgaactgaaagagctgagcacgccggatgaggtaatgcgggaggtcccgcgcacgctcaccgcaacgcgtgtggtgatggcggcgcgcaacgccatccatgccatcctcaccggccaggacgaccgcctgctggtggtggtcggcccgtgctcggtgcatgatccccgggccgcgctcgactacgctgagcgtctgacaaaactgcgcgaggacctcgccgaccagctcgagatcgtaatgcgggtctatttcgagaagccgcgcaccaccgtcggctggaagggcctgatcaacgaccccgatctcgacggcagcttcgacatcaacaagggcctgcggctggcgcgcaacgtgctgtcagcggtgaacaatctcggcctcccggccggcgccgaattcctggacatgacgacgccgcaatacatcgctgacctcgtgtcctgggccgcgatcggcgcgcgcacgaccgagagccagatccatcgcgagctggcctccgggctgtcctgcccggtcggcttcaagaacggcaccgatggcaatgtgcggatcgcggcggacgcagtgaagtcggcctcgcatccgcatcatttcatggcggtgaccaagctcggccgctcggcgatcgcctcgaccgcgggcaacgaggactgccacatcatcctgcgcggcggcagcacgccgaactacgatgcggcaagcgtcgcggcggcctgcaacgagctggcgaaatccggcgtcgcgccgctggtgatggtggatgcgagccacgccaattcgagcaagaagccggagaaccagccgctggtcatggccgacattgccggccagatttccggtggcgagagccgcatcatgggtgtgatgatcgagagcaatctcgtcgccggccgccaggacgtggttccgggcaagccgctcacctacggccagagcatcacggacggctgtatcgactgggcgaccacggcaactgtgctcgagcagctcgccgatgcggtcgaaatccggcgcaacgcccagcgcgcggggctgcacgagcgctcggcgtaa

SEQ ID NO: 1486 - protein, 361 aa, Bradyrhizobium japonicum
MLSTTDDLRIRELKELSTPDEVMREVPRTLTATRVVMAARNAIHAILTGQDDRLLVVVGPCSVHDPRAALDYAERLTKLREDLADQLEIVMRVYFEKPRTTVGWKGLINDPDLDGSFDINKGLRLARNVLSAVNNLGLPAGAEFLDMTTPQYIADLVSWAAIGARTTESQIHRELASGLSCPVGFKNGTDGNVRIAADAVKSASHPHHFMAVTKLGRSAIASTAGNEDCHIILRGGSTPNYDAASVAAACNELAKSGVAPLVMVDASHANSSKKPENQPLVMADIAGQISGGESRIMGVMIESNLVAGRQDVVPGKPLTYGQSITDGCIDWATTATVLEQLADAVEIRRNAQRAGLHERSA

SEQ ID NO: 1487 - DNA, 1053 bp, Yersinia pestis
  CDS (1)..(1053)
atgaattaccagaatgatgatttacggattaaagaaattaaggaactcctacctcctgttgcgttgttagagaaatttccctccacagttaatgcggcagaaaccgtcgccaagacccggaatgctattcacaacatcttgcgtgctcaggatgatcgcttgctggtggtgattggcccatgctctattcatgatacgcaagcggctaaagaatatgcggcccgtttgctggcactgcgtgaagaactgcagggcgagctggaagttgtcatgcgtgtttattttgaaaagccgcgtacaacggtgggttggaaaggcctgattaacgatccgcatatggacaatagctacgacatcaatgaaggtttacgtctggcgcgtgaattactcgtcgaaattaacgacagcgggttaccggccgccggtgagtttttggatatgattacgccgcagtatctggctgatctgatgagctggggagccattggcgcacgtactactgaatctcaggttcaccgcgaactggcttctggtctgtcttgccccgttggttttaaaaatggtaccgacggcaccattaaagtggctattgatgcgatcaacgcggccagtgccccacactgtttcttgtcggtgaccaaatggggtcattcggcgattgtgaatactgccggcaatggtgattgccatatcattttacgtggtggtaaagagccgaattacagcagtaagcatgtgaatgcggttaaagaagggctgattaaagcgggcctggaaccccagattatgatcgatttcagccacgctaacagttgcaaacagtttcaaaagcagatggaagtgggaacggatgtttgccaacaaattgcgcaaggtgaaaaatctatcataggcgtgatgatcgaaagccatttagtcgaaggtagccaaaacctggaaagtggtgaaccactaacctatggccagagtattaccgatgcctgtattggctggaaagatactgaggcgctgttgcgccagttggctggagcagtgagagctcgccgccagtag

SEQ ID NO: 1488 - protein, 350 aa, Yersinia pestis
MNYQNDDLRIKEIKELLPPVALLEKFPSTVNAAETVAKTRNAIHNILRAQDDRLLVVIGPCSIHDTQAAKEYAARLLALREELQGELEVVMRVYFEKPRTTVGWKGLINDPHMDNSYDINEGLRLARELLVEINDSGLPAAGEFLDMITPQYLADLMSWGAIGARTTESQVHRELASGLSCPVGFKNGTDGTIKVAIDAINAASAPHCFLSVTKWGHSAIVNTAGNGDCHIILRGGKEPNYSSKHVNAVKEGLIKAGLEPQIMIDFSHANSCKQFQKQMEVGTDVCQQIAQGEKSIIGVMIESHLVEGSQNLESGEPLTYGQSITDACIGWKDTEALLRQLAGAVRARRQ

SEQ ID NO: 1489 - DNA, 1077 bp, Yersinia pestis
  CDS (1)..(1077)
atgatcatgcaaaaagactcgctcaataacgtccatatcagtgccgaacaaatcctgataaccccggaagaactgaaaaatcagtttccactgagcgaaaatgatcagtattcgatagagcgcgcacgtaaaaccattgctgacattattcaggggcgagatccgcgtctgttggtcgtttgtgggccctgttcaattcatgatgtggatgcggcactggattacgcgcgtcgtttgaaaaaactctctgtggaattggatgacagcttatatatcgttatgcgtgtctattttgagaagccaagaactaccgtgggttggaaaggcctgatcaatgaccctgcaatggatggttcatttgatgtagaggcaggtttacacattgcccgtcgtttattgctggatttagtgggcatggggttgccgttagcgactgaagctctggatcctaatagcccacaatatttaggtgacctgttcagttggtcggccattggtgcccgtacaacggagtcacagacccaccgtgaaatggcatcaggcttgtctatgccggttggatttaaaaatggcactgacggtagcctaggcacggcaatcaatgcaatgcgcgccgctgccatgccacatcgctttatggggatcaatcagtcgggccaggtctgcctgttacaaactcagggtaacccacacggccatgtcattctacggggaggtaaaacaccaaactacagtgcacaagatgtcgctcagtgtgaaaaacagatgcaggatgcgggactcatcccatccttaatgatagattgcagtcacggtaattcaaataaagactaccgccgtcaggttgcggtggctgaatctgtggttgaacagatcaaggcgggcaatcgttcaattacaggtgtgatgctggaaagccacatccacgaaggaaatcagtcatctgaacagccacgtgctgatatgcgctacggtgtttctgtgactgacgcctgtattaactgggaaagcactgaaaccctgttacgtggtatgcgccaagaattgcttgcagcactgacggcacggactgcatga

SEQ ID NO: 1490 - protein, 358 aa, Yersinia pestis
MIMQKDSLNNVHISAEQILITPEELKNQFPLSENDQYSIERARKTIADIIQGRDPRLLVVCGPCSIHDVDAALDYARRLKKLSVELDDSLYIVMRVYFEKPRTTVGWKGLINDPAMDGSFDVEAGLHIARRLLLDLVGMGLPLATEALDPNSPQYLGDLFSWSAIGARTTESQTHREMASGLSMPVGFKNGTDGSLGTAINAMRAAAMPHRFMGINQSGQVCLLQTQGNPHGHVILRGGKTPNYSAQDVAQCEKQMQDAGLIPSLMIDCSHGNSNKDYRRQVAVAESVVEQIKAGNRSITGVMLESHIHEGNQSSEQPRADMRYGVSVTDACINWESTETLLRGMRQELLAALTARTA

SEQ ID NO: 1491 - DNA, 1038 bp, Wigglesworthia glossinidia brevipalpis
  CDS (1)..(1038)
atgaattatatttgtgaaaaaattaaatataaaaaattaataagcccaaaaaaattaaaaaaaatttttaaaataaaaaaagaagaagaattttttgttttaagatctagaaaaactattagtaatattattaataaaaaagacaatagaaaattaattatatgtggtccttgctctattcatgatatagaatccacaattgaatatgcaagaaaattaaatattttgtacaaaaaattaatagataaaatatatattgtaataatgatacgttatgaaaaaaaaataaatttttcagaatggaagggaatgatttatgatccatatttgaatggattacatgatattaatcatggattaaaagttattagaaatttgttaattaagttaataaaaatcaaacaacctatagcaatagatatattgaatccatttttttattattatttcgatgatgttattagttgggcatctattggatctgatctaataaattctcaaattagtttagcattttcgtctaattcatcaatcccaataggttttaaaaatagttcagatggaaatatagaaaatactttaaatgcaattataaagtattctaaaattaatgaatttattggaataaatgaaagtggaaaatcttgtattataagaagcccaggaaatattaataatcatattatattaataggtggaaattttccaaattattttcttcaaaatatatatgattgcaaaaaaagaatgaagaattctagaattactacatctataatgatagattgcaacaatggaaattattataaaaattataatgatcaaatagaagtaattaaatcatgtattaagtttttaaaaaaaaataataaaataattataggactaataataaaaagctatattaattctggaaatcagaagtttatttttcctaaaaataaaataaaatatggattatcaataaccagtccttgtattaatttaaaagatactaaactttttttacataatttatatgaatcaataaatatataa

SEQ ID NO: 1492 - protein, 345 aa, Wigglesworthia glossinidia brevipalpis
MNYICEKIKYKKLISPKKLKKIFKIKKEEEFFVLRSRKTISNIINKKDNRKLIICGPCSIHDIESTIEYARKLNILYKKLIDKIYIVIMIRYEKKINFSEWKGMIYDPYLNGLHDINHGLKVIRNLLIKLIKIKQPIAIDILNPFFYYYFDDVISWASIGSDLINSQISLAFSSNSSIPIGFKNSSDGNIENTLNAIIKYSKINEFIGINESGKSCIIRSPGNINNHIILIGGNFPNYFLQNIYDCKKRMKNSRITTSIMIDCNNGNYYKNYNDQIEVIKSCIKFLKKNNKIIIGLIIKSYINSGNQKFIFPKNKIKYGLSITSPCINLKDTKLFLHNLYESINI

SEQ ID NO: 1493 - DNA, 1053 bp, Vibrio vulnificus
  CDS (1)..(1053)
atgttccaaacagatgatgtaagaattaataacgttaaagagttacttccaccagtagctgttttagagaagtacccggcgactgaaaccgcttcttcgacaactttccaatcgagaaacgacattcacaacattctcatcggcaaggacgatcgcctgctggttattgtcggcccttgctctatccacgatcctgtggccgcggttgaatacggcaagcgtttgaaaacgttgcgtgacgagctcaaaggtgagctcgaaattgttatgcgcgtttactttgaaaagccacgtaccactgtgggttggaaaggtttgattaatgacccgtaccttaacgacacctacaagttgaatgatggtttacgcatgggccgaaaactgttgttggatcttaccgatatgggtcttccaacggcgagtgagttccttgacatgatcacaccacagtatgtggctgatttgatcagttggggtgcgattggtgcacgtactacggaatctcaggttcaccgtgaactggcgtcgggtctttcttgtccggttggttttaaaaatggcacggatggcaacattaagattgcaagtgatgcgattcgctcagcaagtgcttctcaccatttcctatcggtaacgaaatacggccattctgctatcgttgaaaccgcgggtaatccagactgccacattattttgcgtggtggtaaagagccaaactacagtgcagcgcatgtttcagcagtaaaagaagagctagctacatcgggtttaccacaaaaagtgatgatcgacttcagccacgccaacagctccaagcagtataagcgtcaaatgttggtggccgacgatgtctctgagcagctagcggccggtgaagaggcaatctttggggtgatgatcgaatcacatcttgtggaaggtcgacaagatcttgttgatggtaaagcggcgacttatggtcagtcgattaccgacgcttgcatcggttgggaagatactgaaactgtgcttcgccaattggcaaatgcagtggcagctcgtcgagcgaaatag

SEQ ID NO: 1494 - protein, 350 aa, Vibrio vulnificus
MFQTDDVRINNVKELLPPVAVLEKYPATETASSTTFQSRNDIHNILIGKDDRLLVIVGPCSIHDPVAAVEYGKRLKTLRDELKGELEIVMRVYFEKPRTTVGWKGLINDPYLNDTYKLNDGLRMGRKLLLDLTDMGLPTASEFLDMITPQYVADLISWGAIGARTTESQVHRELASGLSCPVGFKNGTDGNIKIASDAIRSASASHHFLSVTKYGHSAIVETAGNPDCHIILRGGKEPNYSAAHVSAVKEELATSGLPQKVMIDFSHANSSKQYKRQMLVADDVSEQLAAGEEAIFGVMIESHLVEGRQDLVDGKAATYGQSITDACIGWEDTETVLRQLANAVAARRAK

SEQ ID NO: 1495 - DNA, 1053 bp, Vibrio vulnificus
  CDS (1)..(1053)
atgccactaaaaacagatgaattgagaacccaacctttgggtccaatgccaactcccgctgagttgagccaagcccatccgattaccgacgatgtggccgagcgaattgcgaaatctcgcagacaaattgaagatattttaacgggtaaggacaaccgccttttggtgattgtcggtccttgctctgtgcacgatactgaagccgcgattgattacgcgacgcgtttaagctcgattcaagagctgtatcgcgatgagctgttcatcgttatgcgcacctactttgaaaaaccacgcactgtggtgggctggaaaggcctcattaccgacccaaatctggatggctcttacgcactagaagcaggcctgcataaagcacgtaagctattgctcgacatcaacaaacttggccttgctaccgcaactgagtttcttgacatgatcactggtcaatatattgctgatttgatcacttggggcgcgattggtgctcgaaccactgaatcgcaaattcaccgtgaaatggcatctgcactctcctgcccggttggctttaaaaacggcaccaacggcaacgtgaaaattgcgattgacgcaattcgagcatcaaaagcttcgcattacttctactctccagataaaaatggccgcatgaccgtttaccgcaccagtggtaacccatatggacacattattctgcgtggtggtgataccggccctaactttgatgcaaaatcggttgagtctgcctgtcaatcactggctgagttcgatttgccacagcgtttgatcgttgatttcagtcacgcgaactgtgaaaagcaacatcgtaaacagctcgatgtcgcgcaagacatttgtaaccagctaaaagcaggcagcacttatatcgcaggcatcatggcagaaagctttattaccgaaggcaatcagccgatgactgaccttgataacttgacctacggccaatcgatcactgacccttgcctaagctgggaacacacagcgcaaatgctggacatgcttgcgactgctgtaaaagaaagccgttaa

SEQ ID NO: 1496 - protein, 350 aa, Vibrio vulnificus
MPLKTDELRTQPLGPMPTPAELSQAHPITDDVAERIAKSRRQIEDILTGKDNRLLVIVGPCSVHDTEAAIDYATRLSSIQELYRDELFIVMRTYFEKPRTVVGWKGLITDPNLDGSYALEAGLHKARKLLLDINKLGLATATEFLDMITGQYIADLITWGAIGARTTESQIHREMASALSCPVGFKNGTNGNVKIAIDAIRASKASHYFYSPDKNGRMTVYRTSGNPYGHIILRGGDTGPNFDAKSVESACQSLAEFDLPQRLIVDFSHANCEKQHRKQLDVAQDICNQLKAGSTYIAGIMAESFITEGNQPMTDLDNLTYGQSITDPCLSWEHTAQMLDMLATAVKESR

SEQ ID NO: 1497 - DNA, 1071 bp, Vibrio vulnificus
  CDS (1)..(1071)
atgcagaaaagtgaactaagcaatattaatatcagcgatgaacaagtgctgattacgccagaacagctaaaacagaaactgccactgagcgacaacgcccgccgcttcattcaagagtcgcgtaataccgtcgccaatattattcataagcaagatcatcgtctgctggtggtttgtggtccttgttctattcacgatctggacgcggcaaaggattacgcgcgtcgcctaaaagcgctctccgccgagttaagcgatcaactgtatattgtgatgcgtgtttactttgaaaaacctcgtactactgtgggttggaaagggctcatcaacgaccctcatctggatggtagcttcgatattgagcatggtctgcatgttggccgtcaattgctggtggagctggctgaaatggagatccctctggcgacagaagcactcgacccaattagcccgcaatacttggctgatacattcagttgggctgcgattggtgcgcgtacgacagaatcacaaactcaccgtgaaatggccagtggtttgtctatgccgattggttttaaaaatggcacggatggcagcttgtcaacggcgatcaacgcaatgcaagcggcctcttcaagccaccgttttatggggatcaaccgtgaaggccaagtggcattgctgacgactcaaggtaacccaaatggtcacgtgattttgcgtggtggtaagcagaccaactacgattctgtgtcggtggcggagtgtgagcaagacatggccaaagtgggtttagatgcgtcattgatggtggattgtagccatgccaattcacgcaaagattaccgtcgtcagcctttagtcgccgaagacgtgattcatcaaattcgcgaaggcaacaaatcgatcattggtttgatgattgaaagccacattaatgaaggtaatcaatcctcagatttaccgctttctgagatgcggtacggtgtttctattaccgatgcctgtatcaattggcaggcaactgaggcactattgcgtaaagcacacaaagagttagtgccacatttagaaaaccgtctcaaataa

SEQ ID NO: 1498 - protein, 356 aa, Vibrio vulnificus
MQKSELSNINISDEQVLITPEQLKQKLPLSDNARRFIQESRNTVANIIHKQDHRLLVVCGPCSIHDLDAAKDYARRLKALSAELSDQLYIVMRVYFEKPRTTVGWKGLINDPHLDGSFDIEHGLHVGRQLLVELAEMEIPLATEALDPISPQYLADTFSWAAIGARTTESQTHREMASGLSMPIGFKNGTDGSLSTAINAMQAASSSHRFMGINREGQVALLTTQGNPNGHVILRGGKQTNYDSVSVAECEQDMAKVGLDASLMVDCSHANSRKDYRRQPLVAEDVIHQIREGNKSIIGLMIESHINEGNQSSDLPLSEMRYGVSITDACINWQATEALLRKAHKELVPHLENRLK

SEQ ID NO: 1499 - DNA, 1062 bp, Synechococcus elongatus
  CDS (1)..(1062)
atgccgcaaacctttgatcttcacgttgttgagacacgacccttgttgacgcctgctaccctgctggcggatttaccgctgactgaatcccaagctacccttgtggccacaactcgcgatcgcattcgtgagattttcaaggggcgcgatcgccgcctgctggtgattgtggggccttgttcaattcacgatgtcaaggcagcgctggaatatggggaaaagttggcccggatacgcgatcgcctgcgggatagtctcgaaattgtgatgcgggtttactttgaaaaaccacggacctctgtaggttggaaaggcctcatcaacgatccgcacctcgatggcagctatgatatcaacaccgggctacgccttgcccgcaagctactgctggatttggccaacttaggaatacccgccgctacagaattactcgatccgatcattccccagtacattgccgatgttgtcagttggactgctattggcgctcgcaccaccgaaagccaaactcaccgtcaaatggcctcgggtctctcgatgcccgtaggcttcaaaaatggcaccgatggtcacttagattctgccattaatgccatgattgcggcccagcagtcccaccattttttgggcattaatgctgaaggccgcgccagtattgttgccaccactgggaatcccgatactcacctggtgctacggggcggcaaagacggccccaactattctgccgcccacattgagatggctgccgcactcttagagcgtaagggactcacaccacggctcatggtggattgtagtcatgccaacgctgccaaagacccccaacgccaagtgctagtgtgtgagaacctcgcccatcaggtccagcaaggctcccgttatttggcgggtgtgatgatcgaaagtcatctcaaggcgggtaatcaaccaattcccaaggatctctcgcagttggtctatggccaaagtattaccgatccctgcgtggactttgcaacaacagtaacaatgctcgaacaattggctagtgcggtaggatcgcaactggtggccagataa

SEQ ID NO: 1500 - protein, 353 aa, Synechococcus elongatus
MPQTFDLHVVETRPLLTPATLLADLPLTESQATLVATTRDRIREIFKGRDRRLLVIVGPCSIHDVKAALEYGEKLARIRDRLRDSLEIVMRVYFEKPRTSVGWKGLINDPHLDGSYDINTGLRLARKLLLDLANLGIPAATELLDPIIPQYIADVVSWTAIGARTTESQTHRQMASGLSMPVGFKNGTDGHLDSAINAMIAAQQSHHFLGINAEGRASIVATTGNPDTHLVLRGGKDGPNYSAAHIEMAAALLERKGLTPRLMVDCSHANAAKDPQRQVLVCENLAHQVQQGSRYLAGVMIESHLKAGNQPIPKDLSQLVYGQSITDPCVDFATTVTMLEQLASAVGSQLVAR

SEQ ID NO: 1501 - DNA, 1032 bp, Streptococcus mutans
  CDS (1)..(1032)
atgtcttttaaagcaactagtgataaaattaatatagaagaaatgcggagcttgtcaaaattaacaggtgaagctttagcccaaaaggaagcacgtgatcgtgaattggtttccattatcaagggagaggacaaccgtttactcttgattattggtccttgttcatcagataatgaagaagctgttcttgagtatgctaaacgtcttgctaaattgcaggaagaagttaaagatcgcatctttatggtgatgcgtgtttatacggcaaagccacgcactaatggtgatggctacaaaggaatggtccatcaacctaatacaggcgcggctcccagtctgattaacggtattacagctgtacgccatctgcattatcgtgtgattactgaaacgggtattacaacagcagatgaaatgctctatcctgaaaaccttcctttgattgatgatttagtatcctatattgcagttggtgcccgttcagttgaggatcaacaacaccgttttgtagcttcaggcattgatgtgcctactggcatgaaaaatccaacatcaggaaatcttaatatcatgtttaatggtatttatgctgcgcaaaataaacaatcgttccttttcaatggcgaagaagttgaaaccagcggcaatcctacagctcacgttatcttgcgaggcggcgttaatgaatatggaaaaaatattccaaattattactatgacaatgttttagatacgattgatcagtatgaaaagatggggctgcaaaatccttttattgttgttgataccaatcatgataactctggtaaaaactatttggaacaagtaagaattgttcggcaaacccttattaaccgtgactggaatgacaaaatcaataaatatgttcgcggctttatgattgaatcttatctggaagatggtcgtcagaatgagccagaagtttttggcaagtctattacggatccttgtttgggttgggaaaatactaaacaattggttcatgaaatttatgatactttaggaaattaa

SEQ ID NO: 1502 - protein, 343 aa, Streptococcus mutans
MSFKATSDKINIEEMRSLSKLTGEALAQKEARDRELVSIIKGEDNRLLLIIGPCSSDNEEAVLEYAKRLAKLQEEVKDRIFMVMRVYTAKPRTNGDGYKGMVHQPNTGAAPSLINGITAVRHLHYRVITETGITTADEMLYPENLPLIDDLVSYIAVGARSVEDQQHRFVASGIDVPTGMKNPTSGNLNIMFNGIYAAQNKQSFLFNGEEVETSGNPTAHVILRGGVNEYGKNIPNYYYDNVLDTIDQYEKMGLQNPFIVVDTNHDNSGKNYLEQVRIVRQTLINRDWNDKINKYVRGFMIESYLEDGRQNEPEVFGKSITDPCLGWENTKQLVHEIYDTLGN

SEQ ID NO: 1503 - DNA, 1035 bp, Streptococcus mutans
  CDS (1)..(1035)
atgggtattcatcaaaaaagcaaaaccatagatcttttcacggttaaacaaggcacgcaattaaaaggtcaggatttggctaagaaagaagcacgtgatcgtgaattggtttccattatcaagggagaggacaaccgtttactcttgattattggtccttgttcatcagataatgaagaagctgttcttgagtatgctaaacgtcttgctaaattgcaggaagaagttaaagatcgcatctttatggtgatgcgtgtttatacggcaaagccacgtactaatggtgatggttataaaggcctcattcatcaaccaaatacttctaaattgccagatttgattaatggcattcatgctgttcgtaatttgcattatcgtgtgattactgagacaggattgacaacagcagatgaaatgctttacccttctaatcttgtcttagtagatgatttggtttcttatcatgctgttggtgctcgttcggttgaagatcaggaacatcgctttgtggcttcaggcattgatgtgcctactggcatgaaaaatccaacgtctggtaatctcaaggttatgcttaatgctttacatgcagcacaaaattcacaaaattttatctataatggagcagaagtagaaacagacggcaattccttggctcatgttattttgcgcggaggcagcaatgagcatggtgactatgaacctaattattattatgacgttctcttaaaactgatccaacagtatgaaaatatgaatttaatcaatccctttattgttgttgataccaatcatgataactctggcaaaaattatttggaacaagtaagaattgttcggcaaacccttattaaccgtgactggaatgataaaatcaataagtatgttcgcggctttatgattgaatcttatctagaagatggtcgtcaggataagccagaagtttttggcaagtctattacggatccttgtttgggttgggaaaatactcaacagttgatttatgagatttaccatactctcaaagcaaaataa

SEQ ID NO: 1504 - protein, 344 aa, Streptococcus mutans
MGIHQKSKTIDLFTVKQGTQLKGQDLAKKEARDRELVSIIKGEDNRLLLIIGPCSSDNEEAVLEYAKRLAKLQEEVKDRIFMVMRVYTAKPRTNGDGYKGLIHQPNTSKLPDLINGIHAVRNLHYRVITETGLTTADEMLYPSNLVLVDDLVSYHAVGARSVEDQEHRFVASGIDVPTGMKNPTSGNLKVMLNALHAAQNSQNFIYNGAEVETDGNSLAHVILRGGSNEHGDYEPNYYYDVLLKLIQQYENMNLINPFIVVDTNHDNSGKNYLEQVRIVRQTLINRDWNDKINKYVRGFMIESYLEDGRQDKPEVFGKSITDPCLGWENTQQLIYEIYHTLKAK

SEQ ID NO: 1505 - DNA, 1008 bp, Streptococcus agalactiae
  CDS (1)..(1008)
atgggatttcatcagttaagtgataaaattaatattgaaatattgaagcagaaaactagcttagatctagaagttagccaaaaaaaattagccaaagaagaagagttaaaaaatatcataaaaggtgaggatcagcggtttctagtaatagtaggtccttgttctgcggataatccaaaggcggtgctaacttatgcaaagcgtttagctaaattggaagctgcctttaaagataaaatgtttttggttatgagagtttataccgctaagccaagaacgaatggtgatggttataaaggcttagttcaccattctgacaaactaggagttttttttcaagcacgtaagatgcactatgacatcattcgagagactggactcctgacagctgatgaattactttatccagagatgttatcagtgatggatgatttagtttcttactatgctattggtgcgcgttcagtggaagatcagggacaccgttttatatcttcaggtatagatgcaccagtaggtatgaaaaatccaacgtctggtaatttaagagtcatgcttaatgcggtctatgcagcacaaaatcaacaggaattattctatcaaaataagcaagttagaacagatggtaatttgctgtcacatgttattttgagaggatatcataatgccgactatcgaagtatccctaattatcattatgaaaaccttttagaaactattactcattatgaagagactgatttgcaaaatccctttattgttgttgatacaaatcatgacaattcaggtaagcaatttttagaacaaattcgcattgtgaaatcagtacttgcagaccgacagtggcatactaaaattagaaactatgttcgtggttttttgatagaatcttatttagaagatggaagacaagataaaccagatgtttttggtaagtctatcacagatccatgtctaggttgggataaaacagaaatgctaattagggatatttacaatagtttgtaa

SEQ ID NO: 1506 - protein, 335 aa, Streptococcus agalactiae
MGFHQLSDKINIEILKQKTSLDLEVSQKKLAKEEELKNIIKGEDQRFLVIVGPCSADNPKAVLTYAKRLAKLEAAFKDKMFLVMRVYTAKPRTNGDGYKGLVHHSDKLGVFFQARKMHYDIIRETGLLTADELLYPEMLSVMDDLVSYYAIGARSVEDQGHRFISSGIDAPVGMKNPTSGNLRVMLNAVYAAQNQQELFYQNKQVRTDGNLLSHVILRGYHNADYRSIPNYHYENLLETITHYEETDLQNPFIVVDTNHDNSGKQFLEQIRIVKSVLADRQWHTKIRNYVRGFLIESYLEDGRQDKPDVFGKSITDPCLGWDKTEMLIRDIYNSL

SEQ ID NO: 1507 - DNA, 1065 bp, Shewanella oneidensis
  CDS (1)..(1065)
atgaccattaaaacagacgaattacgcacttccttattagctaaagtcatctcacctgcacaactggcatctgagtaccccttaacccaagatgctgccgactacctcgttcaacaacgtcgtgaagttgaagccatcattatgggcgaagaccaacgcctgttggtgatcattggcccttgctctatccacgatacgcaagccgccctcgattacgcccgccgcttagcagtgctacatcaagagttaaaggacgacctctgtattttaatgcgagtgtattttgaaaagccgcgcacgattgtgggttggaaggggttgatttccgatcctgacttagatggcagcttcgagccaaataaaggattgcgtattgcacgccagcttctacagcaaatcactgagcttaagctgcccatcgctaccgaatttttagatatggtgaacgggcaatatattgccgatttaatcacctggggcgcgattggtgctcgcaccaccgaaagccaagtacaccgtgaaatggcctcagccctttcttgccctgtgggctttaaaaacggaaccgatggcaatattaatatcgccgttgatgcggtacgtgccgcaaaagtgccgcatatcttctactcaccggataaagatggtgcgatgtctgtctatcgcacccatggtaatccttacggacacatcattttacgtggcggtaaaaaacccaattactttgagcaagacattgaacaagcaagattaaaacttgagtctgtcaatgttacaccgcgtgtggtggttgattttagccacggaaatagtgaaaaaaatcacctaaaacaactggtcgttgctgaaaatatcatggcgcaaatgcgtgctggtagtacggccattgccggcatcatggccgaaagtttcttacaagaaggcaaccaaaaggtgattgaaggtcaacccctatgttatggccaaagcatcacggatgcctgcttacattgggctgactccgaaaaattactgcgagatcttgccagcgcctcacgcgatagacgcgaactccttggcaaataa

SEQ ID NO: 1508 - protein, 354 aa, Shewanella oneidensis
MTIKTDELRTSLLAKVISPAQLASEYPLTQDAADYLVQQRREVEAIIMGEDQRLLVIIGPCSIHDTQAALDYARRLAVLHQELKDDLCILMRVYFEKPRTIVGWKGLISDPDLDGSFEPNKGLRIARQLLQQITELKLPIATEFLDMVNGQYIADLITWGAIGARTTESQVHREMASALSCPVGFKNGTDGNINIAVDAVRAAKVPHIFYSPDKDGAMSVYRTHGNPYGHIILRGGKKPNYFEQDIEQARLKLESVNVTPRVVVDFSHGNSEKNHLKQLVVAENIMAQMRAGSTAIAGIMAESFLQEGNQKVIEGQPLCYGQSITDACLHWADSEKLLRDLASASRDRRELLGK

SEQ ID NO: 1509 - DNA, 1092 bp, Shewanella oneidensis
  CDS (1)..(1092)
atgcagcaggatacaattaataacgtccatatcagttcagagaatgttcttattaccccgcaggagctcaaagcggctctaccactctctgagcatgcatatcgttatatcctcaatgcacgcaaaactgtggcggatatcgtccataagcgcgataaccgcgtgctcatcatcactggaccttgttcgattcatgatatcgatgccgccaaagaatacgctttaaaactcaaaaaattacacgatgaacttagtgatgaattttacatcctgatgcgggtgtactttgagaagccacgtaccacagtgggttggaaggggatgattaacgaccccgatatggatggctcttttgatgtggaaaagggcttaaagctggcccgtgagttgatgatttggctggcggaacttgagctgcctgttgcaaccgaagcactcgaccctatcagccctcagtacatttctgagctagtgacttggtcggccataggtgcccgcaccaccgaatcgcaaacccatagggaaatggcgtcgggcttatctatgcccgttggctttaaaaatggtacagatggtaagctcgatgtggcaatcaatgccctcaaatcggcagccagtagccacagatttatggggatcaaccaacagggtcaagtggcgctgttgcaaaccgcgggcaacccagatggtcatgtgattttacgtggtggcgtaacacctaactacgatgcggccagtgtggctgaatgtgaggcgcagcttcataaggccaaactcaatgcccgtcttattatcgattgtagccatggcaactcctctaaggattacgcaaggcaagtccctgtgtgtgaagatgtatttgcgcagatctacaatggtaacaagtccattattggcgtgatgttagagagccatttaaacgaaggtaatcaaagttgtgataaaccatcaggcgaactggcctatggggtttcggtaacagactcctgtattaattgggaaaaaaccgaaagcgttttacgtgcgggcgcatcgaagttatcttcagtgttaccaactcgtttcgatttgcgtaaagtggccaatgcttaa

SEQ ID NO: 1510 - protein, 363 aa, Shewanella oneidensis
MQQDTINNVHISSENVLITPQELKAALPLSEHAYRYILNARKTVADIVHKRDNRVLIITGPCSIHDIDAAKEYALKLKKLHDELSDEFYILMRVYFEKPRTTVGWKGMINDPDMDGSFDVEKGLKLARELMIWLAELELPVATEALDPISPQYISELVTWSAIGARTTESQTHREMASGLSMPVGFKNGTDGKLDVAINALKSAASSHRFMGINQQGQVALLQTAGNPDGHVILRGGVTPNYDAASVAECEAQLHKAKLNARLIIDCSHGNSSKDYARQVPVCEDVFAQIYNGNKSIIGVMLESHLNEGNQSCDKPSGELAYGVSVTDSCINWEKTESVLRAGASKLSSVLPTRFDLRKVANA

SEQ ID NO: 1511 - DNA, 1059 bp, Shewanella oneidensis
  CDS (1)..(1059)
atgtattaccaaaatgatgacgttcgcattaatgaagttaaagagttacttccccctattgcgatcctagaacgatttcctgcctccgaaaacgctgctgcaactgtgtttaatgcccgtcaaagcatccataatattctcgctcgtgaagatgatcgcctattagtggtcattggtccctgctctattcatgatcctaaagcggcgctggaatacggtcagcgattggttgtccttagagagcgctatcaagatcaacttgagattgtgatgcgagtgtattttgaaaagccgcgaactaccgtagggtggaaggggctgatcaatgatccttacatggataacagtttcaaactgaatgatggtttgcgaacagcgcgtaaactcttggtcgatttgaatgattcaggcatgccgacagcgggtgagttcctcgacatgattactccgcaatatgtggcggatatgatgtgttggggcgccattggtgcccgcacaacagaatcacaagtccaccgcgaactggcctcgggtttatcttgtcctgtgggctttaaaaatggcacagacggcacaatcaaagtggcaatcgatgccattggtgccgctaatgcgccgcatcactttttatctgtgaccaaatttggccattcggcgattgtctccactaaaggcaacccagattgccatatcatccttcgcggcggccgagagccgaattacagtgcgagccacgtcgcccaaatcagtgaccaactgaaaaaagccaaactggtcgacaacatcatgatcgactttagccatgccaatagcagcaaacaatatcagcggcaaatggtggtggccaatgaggttgccgaacaagtcgcggcgggcaatcaggcgatttttggggtgatggttgaaagccacttagtcgaagggcgccaagatctgatcgagggccaagcgttatgctacggccagagtgtgactgatgcttgtattggttgggaagattctgagcgtttgttagctgtgctaaatcagagtgttgttgagcgacgtcagcgggtttaa

SEQ ID NO: 1512 - protein, 352 aa, Shewanella oneidensis
MYYQNDDVRINEVKELLPPIAILERFPASENAAATVFNARQSIHNILAREDDRLLVVIGPCSIHDPKAALEYGQRLVVLRERYQDQLEIVMRVYFEKPRTTVGWKGLINDPYMDNSFKLNDGLRTARKLLVDLNDSGMPTAGEFLDMITPQYVADMMCWGAIGARTTESQVHRELASGLSCPVGFKNGTDGTIKVAIDAIGAANAPHHFLSVTKFGHSAIVSTKGNPDCHIILRGGREPNYSASHVAQISDQLKKAKLVDNIMIDFSHANSSKQYQRQMVVANEVAEQVAAGNQAIFGVMVESHLVEGRQDLIEGQALCYGQSVTDACIGWEDSERLLAVLNQSVVERRQRV

SEQ ID NO: 1513 - DNA, 1053 bp, Escherichia coli O6
  CDS (1)..(1053)
atgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccccacaatatctcgctgacctgatgagctggggcgcaattggcgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcgcaggtgatgatcgatttcagccatgctaactcgtcaaaacaattcaaaaagcagatggatgtttgtactgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgagtgcagtaaaagcgcgtcgcgggtaa

SEQ ID NO: 1514 - protein, 350 aa, Escherichia coli O6
MNYQNDDLRIKEIKELLPPVALLEKFPATENAANTVAHARKAIHKILKGNDDRLLVVIGPCSIHDPVAAKEYATRLLTLREELQDELEIVMRVYFEKPRTTVGWKGLINDPHMDNSFQINDGLRIARKLLLDINDSGLPAAGEFLDMITPQYLADLMSWGAIGARTTESQVHRELASGLSCPVGFKNGTDGTIKVAIDAINAAGAPHCFLSVTKWGHSAIVNTSGNGDCHIILRGGKEPNYSAKHVAEVKEGLNKAGLPAQVMIDFSHANSSKQFKKQMDVCTDVCQQIAGGEKAIIGVMVESHLVEGNQSLESGEPLAYGKSITDACIGWDDTDALLRQLASAVKARRG

SEQ ID NO: 1515 - DNA, 1170 bp, Corynebacterium efficiens
  CDS (1)..(1170)
atgtttccccatatgatttcccccataaacggtttccacaccaccatcaccgcccgaaaggcagaccccagcaccatgagcgccccagtgtccctccccaacccggcatccaccagcaacaaacgggtggttgccttccatgagctgcccagcccggccgaactcaccgccgacaaccccctgagtccacgtcaggcggagaaggttgagcgcgaccgccaggagatcgccgatatcttcgccggcgatgatgaccgcctcgtggttgtggtcggcccgtgttcggtccatgacccggaggctgcgatcgactacgccaaccgcctggcgcccctggccaagcggctggaccaggacctgaagatcgtcatgcgtgtctacttcgagaagccacgcaccaccgtcgggtggaaggggctgatcaatgatccgcacctcaacgagacctacgacatcgccgagggactgcgcctggcacgcaaggtgcttatcgacgttgtgaacctcgacctgcccgtcggttgtgaattcctcgaaccgaacagcccgcagtactacgccgatgccgtggcctggggtgccatcggtgcacgcaccaccgaatcccaggtccaccgccagctcgcctccgggatgtccatgcccatcggtttcaagaacggcaccgacggcaatgtccaggttgccatcgatgcggtggaatccgcccggagcccccacttcttctttggcacctccgaccacggtgcaccctcggtggtgcagaccgcgggtaactccaacagccatatcatcctccgtggtggcaccaccggacccaaccacgatgcggcatccgtggcgcaggccgtggagaagctgggggagggggcacgtctcatgatcgatgcctcccacgccaactcaggcaaggaccatatccgtcaggtcggtgtggtccgtgagatcgccgagcagatcgccgctggtgatgaggccatcgccggcatcatgatcgagtccttcctcgtcggtggcgcccagaacctggatcctgccaggctgaagatcaacggcggtgaggggctggtctacggccagtccgtcaccgacaagtgcatcgacatcgacaccaccgtcgatctgctcggtgagctcgccgcggcggtccgtacccgccggcaggcctga

SEQ ID NO: 1516 - protein, 389 aa, Corynebacterium efficiens
MFPHMISPINGFHTTITARKADPSTMSAPVSLPNPASTSNKRVVAFHELPSPAELTADNPLSPRQAEKVERDRQEIADIFAGDDDRLVVVVGPCSVHDPEAAIDYANRLAPLAKRLDQDLKIVMRVYFEKPRTTVGWKGLINDPHLNETYDIAEGLRLARKVLIDVVNLDLPVGCEFLEPNSPQYYADAVAWGAIGARTTESQVHRQLASGMSMPIGFKNGTDGNVQVAIDAVESARSPHFFFGTSDHGAPSVVQTAGNSNSHIILRGGTTGPNHDAASVAQAVEKLGEGARLMIDASHANSGKDHIRQVGVVREIAEQIAAGDEAIAGIMIESFLVGGAQNLDPARLKINGGEGLVYGQSVTDKCIDIDTTVDLLGELAAAVRTRRQA

SEQ ID NO: 1517 - DNA, 1134 bp, Bifidobacterium longum
  CDS (1)..(1134)
atggcagcactacgtggtccggatagttccgaggatgaacgtcgtttgggggagcaggccgtctttcctgagaccgtcgatgtcaacattcgtcagcttgaccccattcccgcgccgcgtgctttcctcagggagcagccgctcaccgatgagatgagcgagctcgtgctccactcgcggcaggaaatccgcgatgtgctcaacggccgcgacgaccgactgctcgtcatcgtgggcccctgctcaatccacgacccgaaggccgcgcacgagtacgcagaaaagctggctgccgtcaagcgcgagttggaagaccgactcgtgatcgtgatgcgcgtgtacttcgagaagccgcgcaccaccatcggctggaaaggcctcatcaacgaccccgatctggacggtcgcttcaatattcgtaagggcatgtggctggcccgcaaggtgctcaccgacgtgctgagcctcggtctgcccgccgccaccgaatggcttgaccccatcaccccgcagtacatctgcgacgcgatcagctggggtgccatcggcgcgcgtaacaccgaatcccaagtccaccgcgaactggccagtggcctgtccatgccggtgggcttcaagaactccaccgacggctccatcaaggccgccgccgattcctgtttcgcggccggcttcgagcatcacttcctgtccattaacttggacggtcgcgtgatttccgccgaaaccaaaggcaacccggattgccatctggttctgcgcggctccagccacggcccgaactacgatgccgaatccgtgcgtcaagctctggaagacctcaaggtttccaaagcgtccggcccgagccagcatggcctcgtcatcgatgccgcccacggcaactgcggcaaagacgaaaaccgcgaagccgaagtcatcgaagagatcgctgagcgcctggcgcacggcgaacaaggcatcaccggcgtaatgatggaaagcttcttggtcggcggtcaccaaaagccggccccgctcgaccagttggtctacggtcagtccgtcaccgactcttgcgtgccgtgggaacgcaccaacgaactgctgcacaccctagccgacgccgtcaccgctcgccgctcggctaaatag

SEQ ID NO: 1518 - protein, 377 aa, Bifidobacterium longum
MAALRGPDSSEDERRLGEQAVFPETVDVNIRQLDPIPAPRAFLREQPLTDEMSELVLHSRQEIRDVLNGRDDRLLVIVGPCSIHDPKAAHEYAEKLAAVKRELEDRLVIVMRVYFEKPRTTIGWKGLINDPDLDGRFNIRKGMWLARKVLTDVLSLGLPAATEWLDPITPQYICDAISWGAIGARNTESQVHRELASGLSMPVGFKNSTDGSIKAAADSCFAAGFEHHFLSINLDGRVISAETKGNPDCHLVLRGSSHGPNYDAESVRQALEDLKVSKASGPSQHGLVIDAAHGNCGKDENREAEVIEEIAERLAHGEQGITGVMMESFLVGGHQKPAPLDQLVYGQSVTDSCVPWERTNELLHTLADAVTARRSAK

SEQ ID NO: 1519 - DNA, 1233 bp, Bifidobacterium longum
  CDS (1)..(1233)
atgcagcagcaggaggaagcagcacattcgctgcatccgttgcaagtcggtccgcagccgttgaacaccccagaagagcttcgcgccattcgtcaggcgatgggggaggggaagaacccgctcgttgccactgatgtgccgcgttgggaagatcaggtgggtgtcagtcgcatcatcaaccgccgcgtattggagttggagccgctgcccacgcccgcgcaagtgctcgctgaactcccgctgactgatcaggctcaggaaatcgtcgcctactcgcgtgatgagattcgcgcgtgcctgtacggccaagacgacaggctgttggtcatcgtcggcccctgttcggttcatgacccgaaggccgcgctggactacgcgcgccgattggccaagctgaaagatgagctcggtgaacagctgctcatcgtcatgcgcgtgtacttcgagaagccgcgcactaccattggctggaagggcctgatcaacgacccggatattgatggcagccacaatattcgcaagggcctgttgcttgctcgcaaaaccttgcttggtgtgctgaaggaaggattggcggccgccacggaatttctggagcccaccagcccgcagttcatctcggacgcggtgagttggggcgccattggtgcgcgcaacacggaaagccagatccaccgccaattggccagcgggctttccatgccggtcggctttaagaatgccactgacggctcggtgaaggcagcggtcaacggttgcttcgccgctgctcagcagcacacgttcttcggcattgaccatctggggcgtgcctgcgcagtcgagacccttggcaacccggactgccatgtggtgttgcgcggctcgattcacggcccgaactacgatgccgaatccgtggccaaagccatggaagacgtacgcgccgaaatgcccgccgaatccgcagcctcgcatggtctgattgttgattgctcgcacggtaactccggcaaggacgaacatcgtcaggccgaagtcgtgcgcaatattgccagcagaattgcagctggcgaacagggtattaccggcatcatgatggaaagctttattgaaggaggcaatcagaaggccgcgccgcttgatcagctggtctatggcaagtcgattactgacaagtgcatcagctgggaagaaaccgaggccttgctgcgcgagcttgcggaagccgtagccacacggcgttggcactga

SEQ ID NO: 1520 - protein, 410 aa, Bifidobacterium longum
MQQQEEAAHSLHPLQVGPQPLNTPEELRAIRQAMGEGKNPLVATDVPRWEDQVGVSRIINRRVLELEPLPTPAQVLAELPLTDQAQEIVAYSRDEIRACLYGQDDRLLVIVGPCSVHDPKAALDYARRLAKLKDELGEQLLIVMRVYFEKPRTTIGWKGLINDPDIDGSHNIRKGLLLARKTLLGVLKEGLAAATEFLEPTSPQFISDAVSWGAIGARNTESQIHRQLASGLSMPVGFKNATDGSVKAAVNGCFAAAQQHTFFGIDHLGRACAVETLGNPDCHVVLRGSIHGPNYDAESVAKAMEDVRAEMPAESAASHGLIVDCSHGNSGKDEHRQAEVVRNIASRIAAGEQGITGIMMESFIEGGNQKAAPLDQLVYGKSITDKCISWEETEALLRELAEAVATRRWH

SEQ ID NO: 1521 - DNA, 1221 bp, Phytophthora infestans
  CDS (20)..(1153)
cggacctgttaagtaagaaatgccgagcacccagccgcaccctgcacctgaaaccgaacgtgtgaccaagcgtcagcgtctagaagaccgtaatgtcgtcgccattaagccgctggtgcctcctgcctgcgtcctggaggaactgcccgtgactcctgaggtgcacgaactggtggacgctacgcgcgacgccgtgtcccgcatcctgcacggtcaagatgaccgcctcgtcgtggtcgtcggcccttgctccattcacgacgtggacgctgccatggactacgccaagcgtctgaaaactcttgcgggcgagctgaacggagaacttctggtgatcatgcgcacctacttcgagaagccccgaacgactgtgggctggaagggtctgatcaatgacccggacctcgaccagtctttcaagatcaacaagggtattcgcattgcccgtaagctgttgctggacgtgaattcgctgggtcttcccgtgagtctggagttcctcgacaccatctcgccccagttcacctcagacctcatttcgtggggagccatgggcgcgcgtactaccgagtcccagctgcaccgcgaacttaccagtggcctgtcgattcctgtgggattcaagaatggcacgggcggcaacgccaaggtggcagtggacgctgccgttgcttcgtcgcagcctcacaacttcctcggtctgaacgaacacggattggcatcgattgtgcgcaccaagggcaacaaggactgccacgtcatcctgcgcggcggctccgatggccccaactacgagcaaaagtacattgatgaggctgctgccatgctaaagaaggctaagcagccgtccaaaatcatggtggactgctcgcacggcaactcgcgcaagctgcacgctaaccagcgaaaggtagttagctacctggctggtattgtttccgagggaaacacgaatgtgcttggtgttatgatcgagtccaatatcgtggagggcaaccagtcgcttggcgacgacccgtccaagctcgtctacggccagagcatcacggatgcgtgcatcaactgggatgacacagtcacgacgctgaaggaacttgcaggtgccgtcgcaaagcggcgcaaacttgatgccgcgaacccggccaccaagtagttgtcagaaacctaaagcacaccaatagcacatgtatcacgatagacacaccaaaaaaaaaaaaaaaa

SEQ ID NO: 1522 - protein, 377 aa, Phytophthora infestans
MPSTQPHPAPETERVTKRQRLEDRNVVAIKPLVPPACVLEELPVTPEVHELVDATRDAVSRILHGQDDRLVVVVGPCSIHDVDAAMDYAKRLKTLAGELNGELLVIMRTYFEKPRTTVGWKGLINDPDLDQSFKINKGIRIARKLLLDVNSLGLPVSLEFLDTISPQFTSDLISWGAMGARTTESQLHRELTSGLSIPVGFKNGTGGNAKVAVDAAVASSQPHNFLGLNEHGLASIVRTKGNKDCHVILRGGSDGPNYEQKYIDEAAAMLKKAKQPSKIMVDCSHGNSRKLHANQRKVVSYLAGIVSEGNTNVLGVMIESNIVEGNQSLGDDPSKLVYGQSITDACINWDDTVTTLKELAGAVAKRRKLDAANPATK

SEQ ID NO: 1523 - DNA, 1062 bp, Chlorobium tepidum
  CDS (1)..(1062)
atgcaacaactacaggatttacgagtttcaagaatcattactcttagctcgccaaaggcactgaaggaaaaattgcccgtaacggagcatattgccgatacggtctacaaggctaggcaggaagttgagaatattctgaccggcaaggacagccgtatgctggtcatcgtcggcccatgctccattcacgacatcaaggcggctcgtgactatgcctcgcgcctttttgctttgcgcaaagaactcgaatcggagttctgcattgtcatgagggtttatttcgagaaaccacggacgaccatcggctggaaagggttcatcaacgaccctcatctcaacgatacctacgatatcgagcatggcctgttccatgcccgaaagctgttgattgagctgaatgaaatgggcctgcccgcagccacggagtttctcgatccgatctcgccgcaatatgttgctgacctgatcagctgggcagccattggcgcgcgtaccatcgagtcacagactcaccgccagatggccagtggcctgtcaatgccggtcggttttaaaaacgcgaccgatgggcgccttcaggtggccatcgacgctattcggtcggcgatgcaccagcacagttttctcggaatcgaccaagacgggcacagcagcgtcatcaccaccaaagggaacccgtttggccatctcgtgctgcgcggcggctctagcaagccgaactacgatgccgacagcatcgcccatgctgaaaaacagttgcgcaaggccgacctgactccgcatctgctggtcgattgcagccatgctaactccggcaagaagtgtggtaatcagctcaaggtctgggccgatattcttgcccagaaggagcagggcaacaccagcatcgtaggggtcatgatcgagagcaatatcttctctggaaaccagcctttcccggtcgatccgagagagctgcaatacggcgtctcgattaccgacgagtgcgtctcttgggaggagaccgagaggatgcttcgggatggagccgcattcatgaagcaggttcgctcgaaagcctga

SEQ ID NO: 1524 - protein, 353 aa, Chlorobium tepidum
MQQLQDLRVSRIITLSSPKALKEKLPVTEHIADTVYKARQEVENILTGKDSRMLVIVGPCSIHDIKAARDYASRLFALRKELESEFCIVMRVYFEKPRTTIGWKGFINDPHLNDTYDIEHGLFHARKLLIELNEMGLPAATEFLDPISPQYVADLISWAAIGARTIESQTHRQMASGLSMPVGFKNATDGRLQVAIDAIRSAMHQHSFLGIDQDGHSSVITTKGNPFGHLVLRGGSSKPNYDADSIAHAEKQLRKADLTPHLLVDCSHANSGKKCGNQLKVWADILAQKEQGNTSIVGVMIESNIFSGNQPFPVDPRELQYGVSITDECVSWEETERMLRDGAAFMKQVRSKA

SEQ ID NO: 1525 - DNA, 1074 bp, Xanthomonas campestris
  CDS (1)..(1074)
atgccgccgctgaccgatgacctgcgtatccgcaagatcgaaccgttgaccccgccctcgcagctgctgtcgctgctgccctgcgatgagcgcgcttccgaaaccgtcaccaacgcacgtgccgccctgcacgagattctgcacgggcgcgatgaccgcctggcggtggtgatcggcccctgttcgatccacgaccctgtggctgccatggagtacgcgcagcgtctgcgccccttgcgtgagcagtttggcgacgcgctggaaatcgtgatgcgcgtgtacttcgaaaagccgcgcaccaccattggctggaagggcctgatcaacgacccggacctggatggcagtttccagatcaacaagggcctgcgcgtggcgcgtggcttgctgcgcgatatcaacaacctcggcctgccggccggcgtggaatttctcgacatcatctcgccgcagtacatcgctgacttggtggcctggggcgcgatcggtgcgcggaccaccgaaagccaggtgcatcgcgaaatggcctccggcctgtcgtgcccagtggggttcaagaacggcaccggtggcgacgtcaagattgccgtggacgcggtgggtgcggcctcgcatccgcatcatttcctggcggtgaccaaggatggccacacggcggtggcggccaccgcgggcaacccggattgtcatgtgattttgcgtggcggcaagcagcctaacttcgacgcggccaatgtggaagcatccagccaggtgctcaacaaggccggcttgccggcgcggctgatgatcgacgccagccacgccaacagcggcaagaacccggacaaccagcccaaggtcatcgacgacatcgccacgcagctggagggcggcgagacgcgcatcgttggcgtgatggtggaaagccacctggtcggcggccggcaggaactggtgccgggcggcacgctgacctacggccaaagcatcaccgacggctgcctggattgggacgcctcgctgcaggtgctggagcgcttggcgattgcggtgcgtgcacgtcgtgcgcggcgggttgccgaggctgcgtga

SEQ ID NO: 1526 - protein, 357 aa, Xanthomonas campestris
MPPLTDDLRIRKIEPLTPPSQLLSLLPCDERASETVTNARAALHEILHGRDDRLAVVIGPCSIHDPVAAMEYAQRLRPLREQFGDALEIVMRVYFEKPRTTIGWKGLINDPDLDGSFQINKGLRVARGLLRDINNLGLPAGVEFLDIISPQYIADLVAWGAIGARTTESQVHREMASGLSCPVGFKNGTGGDVKIAVDAVGAASHPHHFLAVTKDGHTAVAATAGNPDCHVILRGGKQPNFDAANVEASSQVLNKAGLPARLMIDASHANSGKNPDNQPKVIDDIATQLEGGETRIVGVMVESHLVGGRQELVPGGTLTYGQSITDGCLDWDASLQVLERLAIAVRARRARRVAEAA

SEQ ID NO: 1527 - DNA, 1074 bp, Xanthomonas axonopodis
  CDS (1)..(1074)
atgccgcccgtcaccgatgacctgcgtatccgcaagatcgaagccctcgcaccgcccgcgcagctgctgtcgctgctgccctgcgatgagcgcgcctccgaaaccgtgaccaacgcgcgcgccgcgctgcacgacatcctgcatgggcgcgacgaccgcctggccgtggtgatcgggccatgctcgatccacgacccggtcgcggcgatggagtacgcgcaacgcttgcgcccgttgcgcgatcagttcggcgacgcgctggagatcgtgatgcgggtgtacttcgaaaagccgcgcaccaccatcggctggaagggcttgatcaacgatccggacctggacggcagcttccagatcaacaagggcctgcgcgtggcgcgtggcctgctgcgcgatatcaacaatctcggcctgccggccggcgtggaatttctcgacatcatttcgccgcaatacatcgccgacctggtggcctggggcgcgatcggcgcacgcaccaccgagagccaggtgcatcgcgaaatggcgtccgggctgtcatgcccggtgggcttcaagaacggcaccggtggcgacgtcaagattgcggtggacgcggtgggcgcggcctcgcatccgcatcatttcctggccgtgaccaaggacggacataccgccgtggcagcgacggcgggcaatccggattgccatgtgatcctgcgcggcggcaaacagcccaacttcgatgcggccaatgtggaagcggccagccaggtgctcaatgcatccggcctgcccgcgcgcctgatgatcgatgccagccacgccaacagcagcaagaatcccgagaaccagcccaaggtcgtcgaggacatcgccaaccagctggaaggcggcgaaacacgcatcgtcggcgtgatggtggaaagtcacctggtcggtggacgccaggacctcttgccggggtgcgagctgacctacggccagagcattaccgacggctgcatcggctgggacagttcggtgcaggtgctggaacgcctggcgaccgcagtgcgcgcacggcgcatgcgccggattgccgaggctgcatga

SEQ ID NO: 1528 - protein, 357 aa, Xanthomonas axonopodis
MPPVTDDLRIRKIEALAPPAQLLSLLPCDERASETVTNARAALHDILHGRDDRLAVVIGPCSIHDPVAAMEYAQRLRPLRDQFGDALEIVMRVYFEKPRTTIGWKGLINDPDLDGSFQINKGLRVARGLLRDINNLGLPAGVEFLDIISPQYIADLVAWGAIGARTTESQVHREMASGLSCPVGFKNGTGGDVKIAVDAVGAASHPHHFLAVTKDGHTAVAATAGNPDCHVILRGGKQPNFDAANVEAASQVLNASGLPARLMIDASHANSSKNPENQPKVVEDIANQLEGGETRIVGVMVESHLVGGRQDLLPGCELTYGQSITDGCIGWDSSVQVLERLATAVRARRMRRIAEAA

SEQ ID NO: 1529 - DNA, 1080 bp, Ralstonia solanacearum
  CDS (1)..(1080)
atgccgaagaacaccgacgacctgcgcattcgcgaactgaaagagctgaccccgccggcgcacctgatccgcgaattcccgtgcaacgacgccgtttccgagctgatctaccagagccgcacggcgatgcaccgcatcctgcacggcatggacgaccgcctgatcgtcatcatcgggccgtgctcgatccacgacaccaaggccgccctcgactacgcgcgccgcctggtcgaacagcgcgagcgcttcaaggccgacctggaaatcgtcatgcgcgtgtacttcgagaagccgcgcaccacggtcggctggaagggcctgatcaacgacccgtacatggacggcagcttcaagatcaacgacggcctgcgcaccgcgcgcgagctgctggtgaacatcaacgagctgggcgtgccggcgggcaccgaatacctcgacatgatcagcccgcagtacatcgccgacctggtgagctggggcgcgatcggggcgcgcacgaccgaatcgcaggtgcaccgcgaactcgcctccggactgtcgtgcccggtcggcttcaagaacggcaccgatggcaacgtgaagatcgccgtggacgcgatcaaggcggcgtcgcagccgcaccacttcctgtcggtcaccaagggcggccactcggccatcgtgtcgacggcgggcaacgaggattgccacatcatcctgcgcggcggcaaggcgcccaactacgatgccgccagcgtgcaggcggcctgcgaagacatcgccaagtccggcctggccgcgcgcctgatgatcgatgcctcgcacgccaacagcagcaagaagcacgagaaccagatcccggtctgcgaagacatcggccgccagatcgccggcggcgacgaccgcatcgtcggcgtgatggtggaatcgcacatcaatgccggccgccaggaccacgtgcagggcaccccggtcgaggacctgaactacggccagagcgtgaccgacgcctgcatcggctgggacgattcgctcaaggtactggaaacgctggccgacgccgtgcgcaagcgccggctggtgccccgcaacggcaactga

SEQ ID NO: 1530 - protein, 359 aa, Ralstonia solanacearum
MPKNTDDLRIRELKELTPPAHLIREFPCNDAVSELIYQSRTAMHRILHGMDDRLIVIIGPCSIHDTKAALDYARRLVEQRERFKADLEIVMRVYFEKPRTTVGWKGLINDPYMDGSFKINDGLRTARELLVNINELGVPAGTEYLDMISPQYIADLVSWGAIGARTTESQVHRELASGLSCPVGFKNGTDGNVKIAVDAIKAASQPHHFLSVTKGGHSAIVSTAGNEDCHIILRGGKAPNYDAASVQAACEDIAKSGLAARLMIDASHANSSKKHENQIPVCEDIGRQIAGGDDRIVGVMVESHINAGRQDHVQGTPVEDLNYGQSVTDACIGWDDSLKVLETLADAVRKRRLVPRNGN

SEQ ID NO: 1531 - DNA, 1179 bp, Ralstonia solanacearum
  CDS (1)..(1179)
atgggcaatcggcggactgccccggtttcggcgcaccgctcgtgtttccaggagttttccgtgattcgcatcgacaatccccaaagcgaccaagaagtcggcgtggccgacgctacccaggacaccacccgcatcgatgacgtgcgcatcggtgcggtccgtccgctcatttccccggcactcctgctcgacgagttgcccgtgtcgcccgccgtgcaggcgcacgtcgaagcgagccgggccgcggtcacggacatcctgcacggacgggacgatcgcctgcttgccgtggtgggcccgtgctcgatccacgatcacgaccaggcgctcgactacgcccatcggctcgggacggccgcgaatcgcctgcgcgacgatctgctgatcgtcatgcgcgtgtatttcgaaaagccgcgcacgaccgtcggctggaagggctacatcaacgatccgcggctcgacggcagcttccgcatcaacgaagggctgcgccgtgcgcgccagttgctcctggaagtcaacgcgatgggattgccggcggccaccgagtttctcgatctgctgagtccgcagtacatcgcggacctgattgcctggggcgcgatcggcgccaggacgacggaaagccagagccatcggcagctcgcctcgggactgagctgtcccatcggcttcaagaacggcacggatggcggtgtccagatcgcggcggacgcgattctggcggcgcggtcgagccactcgttcatgggcatgacgaagatggggatggccgcgattttcgagacgcgcggcaacggtgatgcgcacgtcattcttcgcggcggcaagaagggaccgaactatgacgcggcggccatcgaagacagctgcgcgattctccgggcggccgggctgcgcgagcaggtgatggtcgactgttcgcacgcgaactcgggcaagtcccatgcccgtcaagccgacgttgcgcgggatctggcgcagcagctgtcgtccggcgagcggcgcatcagcggcgtgatgatcgagagccatctggaagaggggcgccaggatctgaaacccggcgtgccgttgcagcgcggcgtgtccattaccgatgcctgccttgggtggtcccagacggaaccgttgctggaaaccctcgcaacggctgtgcgtgcgcggcggcgcggctag

SEQ ID NO: 1532 - protein, 392 aa, Ralstonia solanacearum
MGNRRTAPVSAHRSCFQEFSVIRIDNPQSDQEVGVADATQDTTRIDDVRIGAVRPLISPALLLDELPVSPAVQAHVEASRAAVTDILHGRDDRLLAVVGPCSIHDHDQALDYAHRLGTAANRLRDDLLIVMRVYFEKPRTTVGWKGYINDPRLDGSFRINEGLRRARQLLLEVNAMGLPAATEFLDLLSPQYIADLIAWGAIGARTTESQSHRQLASGLSCPIGFKNGTDGGVQIAADAILAARSSHSFMGMTKMGMAAIFETRGNGDAHVILRGGKKGPNYDAAAIEDSCAILRAAGLREQVMVDCSHANSGKSHARQADVARDLAQQLSSGERRISGVMIESHLEEGRQDLKPGVPLQRGVSITDACLGWSQTEPLLETLATAVRARRRG

SEQ ID NO: 1533 - DNA, 1065 bp, Synechococcus sp
  CDS (1)..(1065)
atgaaacagacttccgatctccacgtcgtcgagacgcgttccttgatcagtcctgcggaaattcaccagaagctgcccctttccgagacagcagcagacttggtggcttctacccgcgatcgcgttcgtagcattttgcgcaatagcgatcgccgcctgttggtgattgtcgggccctgctccattcacgacgtcaacgcagcttacgactacggccaaaagctcttgccactgcgcgaagagctggcggatgaacttgaaatcgtgatgcgggtctactttgaaaagccccgcacgacggtcggctggaaaggattgatcaacgatccccacctcgacggcagctacgacatcaataccggcatccagcgggctcgcaagttattgctcggtttggcagatatgggcttgcccgccgcgacagaactgctcgacccgattattccgcagtacatcgctgatgtaattgcttggacggcgattggggcgcgaaccaccgaaagtcaaactcaccgcgaaatggcttcgggcctgtcgatgccgatcggcttcaaaaatggcaccgatggtagcttccatatcgcagccaatgccatgctttccgccagccagccccaccatttcctgggaattaaccatgacggtctggccagcattgtctcgaccaccggcaatccagacggtcatttagtgctgcgcggcggcagcaaaggtccaaattacgcagcagcggacattgaagaagcagcctatcaactggctagcatgggcctccatgcacgagtgatggtggactgcagccacggcaactccaacaaggactatcgccgtcagtcagtggtgctctcagatctggccgaacaggttgctgagggatcgcgtcacctgatgggcgtgatgattgaaagccacctggttgaaggcaatcaacccatcccagccgacttgtcagagttgcgctacggccaaagcatcaccgatccctgcgtcgactttccgaccacagagaaaatgctgcgggagctagcccgagcccagcgcggcttagtcccgtccttggcttaa

SEQ ID NO: 1534 - protein, 354 aa, Synechococcus sp
MKQTSDLHVVETRSLISPAEIHQKLPLSETAADLVASTRDRVRSILRNSDRRLLVIVGPCSIHDVNAAYDYGQKLLPLREELADELEIVMRVYFEKPRTTVGWKGLINDPHLDGSYDINTGIQRARKLLLGLADMGLPAATELLDPIIPQYIADVIAWTAIGARTTESQTHREMASGLSMPIGFKNGTDGSFHIAANAMLSASQPHHFLGINHDGLASIVSTTGNPDGHLVLRGGSKGPNYAAADIEEAAYQLASMGLHARVMVDCSHGNSNKDYRRQSVVLSDLAEQVAEGSRHLMGVMIESHLVEGNQPIPADLSELRYGQSITDPCVDFPTTEKMLRELARAQRGLVPSLA

SEQ ID NO: 1535 - DNA, 1035 bp, Escherichia coli
  CDS (1)..(1035)
atgcagtcagtcagtaaatcaatctaccgagggaagttgcttggcagtttacctgctgtgggcgagattcataaagaaatcgcagtatcagaagaaaccgtaacatggatctctctgcaacgagagattatagcgaatattttgctgggaaaagatcctcgcttgcttgtgattgttggtccatgctcaatccatgacgttcaggctgccgttgaatatgcgaaacgattgtccgtattacagaataagtacttatcgcaaatgtacattgtaatgcgcacttattttgagaaacctcgaactcgtaaaggctggaaaggaataatgcacgagcctgatctaaatggaagctataatgttgagaaagggatacgatatgctcgccagtgtttgtcctcaatcacaacaatgcgtgtcgcaaccgctacagaattcctcgatcctttccttactccctatattgctgatttaatatgttggggggctgttggtgccagaactactgaatcacaaacgcatcgtcaacttgcatctggtttacattgtcctgttggatttaaaaacagcactgatggaaatattaacttagctattgatgctattcttgcagcccgtgaacaacatgttgtatatatgacatctttaacaaaatgtatatctaccctattaaccgatggcaatccacatggacatctcatattacgtggtggtagagagccgaactatggtttgtcggatataacgaaggcagtgaaattaatgcatgatgaaggtatcaatcatcgtctgataattgactgtagccatggtaatagtggtaaagtggctgaacggcaaatctctgttgctcgtgaagtcattgataatcggaaaaagatgccgggatatgtagctggaattatgctggaaagctttttacaaggtggaaaacaatcagacagccttccgcgagagtatggtcagtctgttactgatgagtgtctttcatggcaacagacagaacaattattatcaactctggcagcacaactttaa

SEQ ID NO: 1536 - protein, 344 aa, Escherichia coli
MQSVSKSIYRGKLLGSLPAVGEIHKEIAVSEETVTWISLQREIIANILLGKDPRLLVIVGPCSIHDVQAAVEYAKRLSVLQNKYLSQMYIVMRTYFEKPRTRKGWKGIMHEPDLNGSYNVEKGIRYARQCLSSITTMRVATATEFLDPFLTPYIADLICWGAVGARTTESQTHRQLASGLHCPVGFKNSTDGNINLAIDAILAAREQHVVYMTSLTKCISTLLTDGNPHGHLILRGGREPNYGLSDITKAVKLMHDEGINHRLIIDCSHGNSGKVAERQISVAREVIDNRKKMPGYVAGIMLESFLQGGKQSDSLPREYGQSVTDECLSWQQTEQLLSTLAAQL

SEQ ID NO: 1537 - DNA, 1200 bp, Stigmatella aurantiaca
  CDS (62)..(1147)
aattcagcgaaaccttggaatcgggccccctccatcggccaagatggcggcgagaccgcacatgaccgctcgcactgaaaatctgaacgtagttggtttcgaccacatgccctccccctccgagatcaaggagcgcgtgccgatgacaagcctcgcagccgacaccgtgctctccggacggcgcgcgctgatggacatcctcaaccgcaaggatccacgcatcttcgtcatcgtgggcccctgctccatacatgatcccaaggccggcatcgagtacgcccgtcgacttcgcaacctctccgacgagatccgggagacgatcctcgtggtgatgcgggtgtacttcgagaaaccgcgcacctccaccggctggaagggcttcatcaacgacccgaggatggacgactccttccacatcgaggaaggcatggagcggggccgccgcttcttgagggacgtggccgaactgggcctgcccgcggcgaccgaagcgctcgatcccattgccccccagtattacggcgacctgatttcctggacggcgattggcgcgcgcacggcggagtcccagacccaccgcgagatggcctcggggctgtcgacgcccgtgggcttcaagaacggaaccgacggctcgctggacgcggcggtcaacggcatcctctccgcctcgcacccccacagcttcctggggctgaacgagggcggtgaggcggcgatcatccgcaccggaggcaatgcctacagccacctggtgctccgaggcggagggggacggcccaactacgacacggtgtccatcgcgctcgccgaacaggcgctcaccaaggccaagctgccggggaacatcgtggtggactgctcccacgccaactcctggaagaagccggagttgcagcccctggtcatgcgcgacgtggtgcaccagatccgcgaaggcaaccgctccgtggtgggtttgatgctcgaaagcttcctggaagcgggcaaccagcccatccccgccgatctctcgaagctgcgctacggctgctcggtgaccgatgcgtgcgtggactggggcaccaccgaagagacgctgcgcaacgcccacaaggtgctgcgcgaggcattgcccacgcggagctcgggccgcccagcgccctgaacttgcgccccacccctctccgccctgctcgggggcggagaggcgctgtcaca

SEQ ID NO: 1538 - protein, 361 aa, Stigmatella aurantiaca
MTARTENLNVVGFDHMPSPSEIKERVPMTSLAADTVLSGRRALMDILNRKDPRIFVIVGPCSIHDPKAGIEYARRLRNLSDEIRETILVVMRVYFEKPRTSTGWKGFINDPRMDDSFHIEEGMERGRRFLRDVAELGLPAATEALDPIAPQYYGDLISWTAIGARTAESQTHREMASGLSTPVGFKNGTDGSLDAAVNGILSASHPHSFLGLNEGGEAAIIRTGGNAYSHLVLRGGGGRPNYDTVSIALAEQALTKAKLPGNIVVDCSHANSWKKPELQPLVMRDVVHQIREGNRSVVGLMLESFLEAGNQPIPADLSKLRYGCSVTDACVDWGTTEETLRNAHKVLREALPTRSSGRPAP

SEQ ID NO: 1539 - DNA, 1092 bp, Rhizobium loti
  CDS (1)..(1092)
atgttgaccaccacagacgacctccgggtcaaggaaatccgagaactgagcacgccggaccaggtgatgcgggaaatcccgcgcacgctgacggcgacgcgcaccgtgagcgcctcacgcaatgcgatccacgctattctgaacggcaccgacgaccggctgcttgtcgtcgtcggtccctgttcgatccacgatccggtcgcggccgttgactatgccagccgtctggcggcgctgcgcgagaccctgtccgaccggcttgagatcgtgatgcgggtgtatttcgagaagccgcgcaccacggtcggctggaagggcctgatcaacgatcccgaccttgacggcagcttcaacatcgacaaggggctcaggatggcacgcaacgtgctttccgccgtcaacaatctcggcctgccggcggccaccgaattcctcgacatgaccacgccgcaatacattgccgacctcgtcgcctggggtgccatcggcgcgcgcaccaccgaaagccaaatccaccgtgagctggcctcgggcctgtcctgcccggtcggtttcaagaacggcaccgacggcaatctcaggatcgccggcgaggcggtgaaatcggccgcccagccgcatcatttcatggcggtgaccaagggcggacgcagcggcatcgccaccaccaccggcaatgaggactgccatgtcatcctgcgcggcggcgttcagcccaactacgacgcggcgagcgtcgaggcggcctcggtcgaactcgcccgcatcggtgtcgcgccgcggctgatgatcgatgtcagccacgccaactccgccaagaagcctgagaaccagccgaaggtggcggccgatgtggccggccaggtggcggcgggcgacgagcgcatcatcggcctgatgatcgagagcaatctcgtcgccggccggcaggacgtggtgcccggcaagccgctcgtctatggccagagcatcaccgatggctgcatcgactgggcgaccaccgagaccgtgctgcatggccttgccggtgccgtcgagtggcgccggtcggcacgccgcgccatgctggaaagccggcagggtgctgcctga

SEQ ID NO: 1540 - protein, 363 aa, Rhizobium loti
MLTTTDDLRVKEIRELSTPDQVMREIPRTLTATRTVSASRNAIHAILNGTDDRLLVVVGPCSIHDPVAAVDYASRLAALRETLSDRLEIVMRVYFEKPRTTVGWKGLINDPDLDGSFNIDKGLRMARNVLSAVNNLGLPAATEFLDMTTPQYIADLVAWGAIGARTTESQIHRELASGLSCPVGFKNGTDGNLRIAGEAVKSAAQPHHFMAVTKGGRSGIATTTGNEDCHVILRGGVQPNYDAASVEAASVELARIGVAPRLMIDVSHANSAKKPENQPKVAADVAGQVAAGDERIIGLMIESNLVAGRQDVVPGKPLVYGQSITDGCIDWATTETVLHGLAGAVEWRRSARRAMLESRQGAA

SEQ ID NO: 1541 - DNA, 1083 bp, Amycolatopsis mediterranei
  CDS (1)..(1083)
atgacgctctccgccggaccggccaccatcggtgacctcgacgccgcccgcaccacgtcgatcagtccgctcatttcgcccgcactgctgcgcgaagaccatccggtcgacgccgcggtcgcgaaggtggtgcgccacggccgcgccgagacggtcgacatcctcgaaggccgcgacgaccggctgctcgtcgtggtcggcccgtgctcggtgcatgaccccgaagccgccctcgactacgcccgccggctggcggcgaaggccgaggagctgcgcggcgagctgcacgtcgtgatgcgcgtgtacttcgagaagccgcgcaccacgctgggctggaagggcctgatcaacgacccggacctcgacggcacgttctccgtcaacaagggcctgcggatggcgcgcaagctgctgctcgacgtgtccgagctggggttgccggtcggctgcgagttcctcgacccgatcacgccgcagttcatcgcggacatcgtgacgtggggttcgatcggtgcccgcacggcggccagccaggtccaccgccagctgtgcagcgcgctgtcgatgccggtgggcatcaagaactccaccgagggcgacgtccaggtggcgatcgacgccacccgcgcggcggcggccagccacgtgttcccgggcatcaacaccgacggcctggcggcgctgctgacgacgtccggcaacccggactgccacgtgatcctgcgcggccacaacaccggcccgaactacgactcgctcactgtcgccgacaccctggcccggctggcgaaggcgggcctgccggagcgggtgatcatcgacgcttcgcacgggaacagcggcaaggaccacgtgcggcagggcgcggtggtgtccgagctggctgcgcggatcgcggcgggcgagcgcgggatttccgggctgatgatggagagcttcctggccggtgggcggcaggagctttcgctggggcacgcctcggagctgacctacgggcagtcgatcacggacgcgtgcctggcctgggacgacaccgcgccgctgctggacgagctcgcctcggcggtgcgggcgcgccgctga

SEQ ID NO: 1542 - protein, 360 aa, Amycolatopsis mediterranei
MTLSAGPATIGDLDAARTTSISPLISPALLREDHPVDAAVAKVVRHGRAETVDILEGRDDRLLVVVGPCSVHDPEAALDYARRLAAKAEELRGELHVVMRVYFEKPRTTLGWKGLINDPDLDGTFSVNKGLRMARKLLLDVSELGLPVGCEFLDPITPQFIADIVTWGSIGARTAASQVHRQLCSALSMPVGIKNSTEGDVQVAIDATRAAAASHVFPGINTDGLAALLTTSGNPDCHVILRGHNTGPNYDSLTVADTLARLAKAGLPERVIIDASHGNSGKDHVRQGAVVSELAARIAAGERGISGLMMESFLAGGRQELSLGHASELTYGQSITDACLAWDDTAPLLDELASAVRARR

SEQ ID NO: 1543 - DNA, 1053 bp, Pasteurella multocida
  CDS (1)..(1053)
atgaataaagataacatacataatgtcaatattgttggtgaaaaggtactgattaccccaaaagaattgaaggaaaaactccctctatcccttcctcttcgtagccaaatagcgcaatcacgccgtgatattgcgaatatcatccataaaaaagatcagcgtttattggttgtgattggaccatgttctattcatgatccgatcgcggctttagaatacgcttcacgtttaaaacacttagcagaagaattacaagatcaattgtatattgtgatgcgagtgtattttgaaaaaccaagaacaactgttggctggaaaggattgattaatgatccgaaattggatggttcatttgatgtggaacatggcttacatattgcacgagcattactgctagagctggctgaaatgggactccctttggcaaccgaagcacttgatcccattatgccgcaatatattgctgatctatttagttggtctgcgattggtgcgagaacgacagaatcacaaacgcacagagaaatgtcatcaggtttatccatggcagtgggatttaaaaatggtacggatggcagtttagccaccgcaattaatgcaatgaaagcagcgtcagttggacacagttttattgggattaatcaacaaggtcaagtcaatctattacatacagcgggcaaccctaatgggcatgtgattttgcgtggcggaaaatcaccaaattatgaagctgaacatatcgcactttgtgaacaagaattgcaaaaagcaggtttgacgcaagcaattatgatcgattgtagccatggtaactcgaataaagattaccgtttgcagccgaaagtggcaaaaaatgccgtacagcaaattgtgaagggaaatcgctctattatcgggttgatgttagaaagtcatttatacgcaggtaatcaaagtgctgatcagccattgagtgaaatgcaatatggggtttcgattacggatgcctgtattgattggcagacgacagaacaattattacgtgaaatgacgagcgcattgcgccaaaaataa

SEQ ID NO: 1544 - protein, 350 aa, Pasteurella multocida
MNKDNIHNVNIVGEKVLITPKELKEKLPLSLPLRSQIAQSRRDIANIIHKKDQRLLVVIGPCSIHDPIAALEYASRLKHLAEELQDQLYIVMRVYFEKPRTTVGWKGLINDPKLDGSFDVEHGLHIARALLLELAEMGLPLATEALDPIMPQYIADLFSWSAIGARTTESQTHREMSSGLSMAVGFKNGTDGSLATAINAMKAASVGHSFIGINQQGQVNLLHTAGNPNGHVILRGGKSPNYEAEHIALCEQELQKAGLTQAIMIDCSHGNSNKDYRLQPKVAKNAVQQIVKGNRSIIGLMLESHLYAGNQSADQPLSEMQYGVSITDACIDWQTTEQLLREMTSALRQK

SEQ ID NO: 1545 - DNA, 1086 bp, Pasteurella multocida
  CDS (1)..(1086)
atgacagaatataaaaatgaaatttatatcgaaaatgatgacaccagaattgataaaattgagcaagttttaccgcctgtggcgttattagaaaaatttcctgccagtgatgtggcagtagaaaccgtcagacaaacacgaaaaaaagcacataatattattcatcgaaaagatgaccgtttattagttgtcatgggaccttgttccattcatgatcctgtttctgcgctggagtatgcgaaacggattaaaatgatgcgcgaaaaataccaagatagcttggagattattatgcgtgtctattttgaaaaaccgcgaaccacggtagggtggaaaggcttgattaatgatcctcacctaaatggtacctttgagctgaatgaagggttgcgtcttgcgcgtaaattattatcggacgttaatgatttaggggtaccggctgcgggtgaatttttggacatgattacaccacaatatctggctgatttcatgagttggggtgcgattggtgccagaaccacagaatcacaggtgcaccgtgaacttgcctctggtctatcttgtgcagttggctttaaaaatggcacgaatggtggggtcagaatcgcgttagatgcgattggggcagcagaagcaccacattattttctttctgtcacgaaatttggtcattctgcgattgtatctacaaaagggaatgaagactgccacattattttacgaggcggtgataaaggtcctaattatgatgcagagcatattgctatggtttgtgcagagatcgaaaaaacagggcgtattccacatgtgatggtcgatttcagccatgctaacagttgtaaacaatttaaaaaacaattagaggtttgtgacagtgtttgccagcaaatcgctatgggttctactcaaatctttggtgtgatggtagaaagccatcttgttgaagggcgacaagatttagtagatggaaaagcggtcacttatgggcagagtatcacggacgcctgtattgggtgggaagatagcgagaaagttttggaatcgctttcaaaagctgtcatccaacgccgaaatttgcagcaataa

SEQ ID NO: 1546 - protein, 361 aa, Pasteurella multocida
MTEYKNEIYIENDDTRIDKIEQVLPPVALLEKFPASDVAVETVRQTRKKAHNIIHRKDDRLLVVMGPCSIHDPVSALEYAKRIKMMREKYQDSLEIIMRVYFEKPRTTVGWKGLINDPHLNGTFELNEGLRLARKLLSDVNDLGVPAAGEFLDMITPQYLADFMSWGAIGARTTESQVHRELASGLSCAVGFKNGTNGGVRIALDAIGAAEAPHYFLSVTKFGHSAIVSTKGNEDCHIILRGGDKGPNYDAEHIAMVCAEIEKTGRIPHVMVDFSHANSCKQFKKQLEVCDSVCQQIAMGSTQIFGVMVESHLVEGRQDLVDGKAVTYGQSITDACIGWEDSEKVLESLSKAVIQRRNLQQ

SEQ ID NO: 1547 - DNA, 1125 bp, Emericella nidulans
  CDS (1)..(1125)
atgtcctccttcttccttccaaatcctaatttaggagatagcaatcaccttgaggattcaagaatccgcggatacaaccctctcacaccacccaacctcctgcaacatgagattgctctaacagagaaagcgcggcaaacggtccttcaaggccgagccgaggccattgccgtcgcccacggcacagacacagacaagcgccgcctcctcgtcgtcattggaccctgctcaattcacgaccccgaaatggccttagagtactgcgaccggctattgaaattgaaggagaaatacaaggatgagttgctaattgttatgcgctcttatctggagaagccccgaacgaccgtcggttggaagggcctcatcaacgacccggatatcgacaacagcttcaacatcaacaagggcctgcgcatctcgcgtcagctcttcgtcgacttgaccaacaagggaatgccaattgccagtgagatgctggacactatctccccgcagtttctggcggactgtctctccgtcggtgcggtcggcgcacggacaaccgaatcgcaggtccatcgtgaattggcctctgggctctcgttccccgttggcttcaagaacggtacagatggctcgttagacgtcgcggttgatgcgattggatccgtaaaacaccctcatcacttcctgtccgtcaccaagcctggtgttgtcgccattgtcggtaccgttggcaatcctgattgctttgttatcctccgcggcggcaagaaagggccgaactacgatgctgctagcatcaccgaagcaaaggagaagctcatagctaagggtctggcaccccgtctgatggtcgactgcagccacggcaactcacaaaaggatcacaagaaccagcctaaggtggcagctgttcttgcggagcagattgctgcaggcgaaaccgcaatcatgggcgtcatgatagagagtaatatcaacgagggcaaccaaaaggtcccacccgagggcaaggccggcctcaaatacggcgtcagtatcaccgacgcctgtatcaattgggaagacaccgagtcaacgctagagacccttgcaaaggctgttgcgactcggagagaaaagctcgcccccagttcatag

SEQ ID NO: 1548 - protein, 374 aa, Emericella nidulans
MSSFFLPNPNLGDSNHLEDSRIRGYNPLTPPNLLQHEIALTEKARQTVLQGRAEAIAVAHGTDTDKRRLLVVIGPCSIHDPEMALEYCDRLLKLKEKYKDELLIVMRSYLEKPRTTVGWKGLINDPDIDNSFNINKGLRISRQLFVDLTNKGMPIASEMLDTISPQFLADCLSVGAVGARTTESQVHRELASGLSFPVGFKNGTDGSLDVAVDAIGSVKHPHHFLSVTKPGVVAIVGTVGNPDCFVILRGGKKGPNYDAASITEAKEKLIAKGLAPRLMVDCSHGNSQKDHKNQPKVAAVLAEQIAAGETAIMGVMIESNINEGNQKVPPEGKAGLKYGVSITDACINWEDTESTLETLAKAVATRREKLAPSS

SEQ ID NO: 1549 - DNA, 1089 bp, Emericella nidulans
  CDS (1)..(1089)
atgagcggtcaaaacgaagatacccgcgtcctgggttacgaccctctgctttcgcctgagtttgttcagtccgagattccttctaacgagcactccattcctacggtccgctctggccgcaaccaggctgtcgaaattattgaacagcgcgatgaccgccttctagtggtcgttggcccttgctccatccacgatcccgaaaccgccctcgaatatgccactcgtcttaaggaacttgctgctcgtctctcctccgacctctgcgtcatcatgcgcgcctacctcgaaaagccccgcacaacagttggatggaaaggtctgatcaacgaccctgatattgacgagtcctaccagatcaacaagggtctccgcgtgtcccgcaagctctacgccgacctcacaggcatgggcatgcctattgccagcgagatgctcgacaccatctccccgcagtacatggctgacctgatttccctcggtgccattggtgcccgcaccaccgagtcgcaactgcaccgtgagcttgcctccggtctcagtttccccatcggttacaagaatggcactgacggcaacctgaccgttgccattgacgcgatcggcgctgctgcccacccccaccgcttccttggtgtcaccaagcaaggtcttgcggccattaccaagaccgccggtaaccctcacggcttcgtgattatgcgtggaggaaacaagggcacaaattacgaccgcgagagcatccagggggcccgcgaagcccttcgcggcaagaagcagcgtgaggttctcatggttgactgctcacatggcaactccaagaaaaaccaccgtaaccagcctctcgttgccaaggaggtcgctgaccaactccgtgagggccaggatgccatcattggtgtcatgattgaatccaacatcaacgagggtaaccagaaggttccccctgagggtccctccggtctcaagaagggtgtcagtatcaccgatgcctgcattgactgggagaccaccgtcactgtgttggaggacctcgccgatgccgtccgtgccaggcgcgccgtcaagtcaaaagccaacggtactgcttaa

SEQ ID NO: 1550 - protein, 362 aa, Emericella nidulans
MSGQNEDTRVLGYDPLLSPEFVQSEIPSNEHSIPTVRSGRNQAVEIIEQRDDRLLVVVGPCSIHDPETALEYATRLKELAARLSSDLCVIMRAYLEKPRTTVGWKGLINDPDIDESYQINKGLRVSRKLYADLTGMGMPIASEMLDTISPQYMADLISLGAIGARTTESQLHRELASGLSFPIGYKNGTDGNLTVAIDAIGAAAHPHRFLGVTKQGLAAITKTAGNPHGFVIMRGGNKGTNYDRESIQGAREALRGKKQREVLMVDCSHGNSKKNHRNQPLVAKEVADQLREGQDAIIGVMIESNINEGNQKVPPEGPSGLKKGVSITDACIDWETTVTVLEDLADAVRARRAVKSKANGTA

SEQ ID NO: 1551 - DNA, 1239 bp, Vibrio cholerae
  CDS (114)..(1175)
cggtttttacttcaatttacacccctttccgcagctgttttcggcgtaatggtttattctcgttgacaaattcgttatctttagcgcttcgcaataaaaggacaggcgctcctatgccactgaaaaccgatgaattaagaacccaagcattgggacctatgcctactccggcagaattaagtcacgcacatcctatcactgatgaagttgcgctacggatcgcgcagtctcgtcgccaaattgaaagcattcttaccggtgaagatgatcgcctattagtgatagtggggccttgttcggtgcatgataccgatgccgcactcgactacgctcgccgccttgctgcgctacaagaaaactatactgatgagctttttgtggtgatgcggacctatttcgaaaaaccacgtactgtggtgggttggaaaggactgatcaccgatccaaacttagatggctcttacgctttagaaaccggtctcaataaagcgcgaaagttgctgcttgatgtaaacaagctcggattggctaccgcgaccgagtttcttgatatgatcacaggccaatacatcgcggaccttatcacgtggggcgcaattggtgcgcgtaccactgagtcgcaaattcaccgtgagatggcctctgcgctctcctgccctgtgggttttaaaaatggcactaacggtaatgtgaaaatcgcgattgatgcgatccgcgcggccaaagcgtcacattacttctattcaccagataagaatggtcgtatgacggtttaccgtaccagtggtaacccatttggtcatattattctgcgtggtggtgatagcggaccaaactttgatgcggcttcgattaatgaagcttgccagcagttggcgcaattcaacttaccagagcgtttagtggtggatttcagccacgcgaactgtcaaaaacaacaccgtaaacaagtggatgtcgcgcgcgatatttgccagcaaattgaagctggcagccacaaaattgcgggcatcatggcggaaagcttccttgtggaaggcaatcagccaatgcacgatctcaataatctgacttatggtctgtcgatcaccgatccttgtttaggatggaaagataccgccaccatgcttgatatgctggctcaatcgatcaaagtccgtcgttctcgtcattaaggaaatacctcatgccttcttttgatattgtttcagaaattgatgcggttgagctgcgtaacgc

SEQ ID NO: 1552 - protein, 353 aa, Vibrio cholerae
MPLKTDELRTQALGPMPTPAELSHAHPITDEVALRIAQSRRQIESILTGEDDRLLVIVGPCSVHDTDAALDYARRLAALQENYTDELFVVMRTYFEKPRTVVGWKGLITDPNLDGSYALETGLNKARKLLLDVNKLGLATATEFLDMITGQYIADLITWGAIGARTTESQIHREMASALSCPVGFKNGTNGNVKIAIDAIRAAKASHYFYSPDKNGRMTVYRTSGNPFGHIILRGGDSGPNFDAASINEACQQLAQFNLPERLVVDFSHANCQKQHRKQVDVARDICQQIEAGSHKIAGIMAESFLVEGNQPMHDLNNLTYGLSITDPCLGWKDTATMLDMLAQSIKVRRSRH

SEQ ID NO: 1553 - DNA, 2184 bp, Candida albicans
  CDS (461)..(1573)
agggatttgctaatctacaaatggagtcataagtggtggtttgtaattgtcaagattttattgccccccctgtgttgcagaacgaagggaaaaaaaaaaaaaagtttttcattgttttattcaacggactatttacaaaatgtaatatgtgtgtttgtgatgactgaaaaaaaaacagaaaagttttttatgactaaatcaattcaaaccaccaccacgcaccatttctgaaaaatttaaaaaaggaacagaattttgccatttttcaagttttctttggaatatccaatttaataaattttttcttttcctcttttcttctcttttcccttctttacttatttctttcgcttttcttgttgatattagttattctttgtcaaataaataatatcattatataatactttcattaatttgtcttttgttaaattatttgaaagtataccagtttccttaaatgagtaaaactcctgttcctaccgaatacgacgacacaagaatattgggttacgatcctttagttccaccagccttattacaacacgaaataaaggcatctgccgaatcattggatgttgttataaaaggccgttacgattctgcccaaatccttaagggtaatgatgacagatgtattgtaattgttggtccatgttcaattcacgatcctccacaagccttagaatatggtaaacgtttgaagaaattggctgatgaattaaaagatgacttggtgattatcatgagagcttatttggaaaaaccaagaactaccgttggttggaaaggtttgatcaatgatcctgatgttgataattcttttgatattaaccgtgggttgaagatatctcgtcaattatattccgatttgactagtgttgttggattaccaattggatcagaaatgttagacaccatttctccacaatacttttccgatttcttgagttttggggccattggagctagaaccaccgaatcacaattacacagagaattagcttctggtttaagcttcccaattggatttaaaaatggtaccgatggtggtttagccgttgccttggatgccgtgcaagcttcttcaaaaggacatcacttcatgggtgtcaccaaaaacggtatggctgccattaccactactaaaggtaacgattgttgtttcattatattaagaggtggtaaaaaaatcaccaattacgatgttgaatcagttaaagctgctaaagaagctattgccaaatgtaccgatccaagtatcaagttgatggttgattgctctcacgacaactcaagaaaagactacagaaaccaacctcaagtattagacagtgttgctgaacaaataagtaatggtgaagactccattattggggttatgattgaatccaatattcatgaaggtaaacaaccaatgcccccagcaggtagtggtaaagaagcattgaaatacggtgtgtctatcaccgatggatgtgtttcttgggaaaccactgttgaaatgttgaccaaattgagtcaagcagtccaaactagaagaagtttaaagaaacaaaaagtttccaattaaatagagtgtttttaagtgaataaagtgaaaacaaaacaaaaacaaaaaacaaaaaacaacctaaaaaatttttcttcttgtgtataatttcgatacttctaatagcatatatattcttctatatatatatatatcttttgagtttttaaaagaataaataaaaagttgtttgtcttattcaacccaaaccatatccaagagtaaatctctaatattttcatttgaacgtgtagtagaggtggtggtggtggtgatgtcatcttttattgctcgtaggaaatcagccaatttcgggttactttcactatacccatggtatcgattaaatggatttcgagcaatctttttctttaacaaagatcccagtaatccataccaatcattctgaaaatgtttaacagcatatttgaattcactttcatttaattcttgaaaatatttttcaatttctaattcatcaagatcttttggatcaggggaattcccaatataattgattcctattttcaggaaataataatgcttgttgtaaatggtgttttaacaaatctttctcgttttaaattcaaatcccactatggtgattttctctggatacattgcaaataatt

SEQ ID NO: 1554 - protein, 370 aa, Candida albicans
MSKTPVPTEYDDTRILGYDPLVPPALLQHEIKASAESLDVVIKGRYDSAQILKGNDDRCIVIVGPCSIHDPPQALEYGKRLKKLADELKDDLVIIMRAYLEKPRTTVGWKGLINDPDVDNSFDINRGLKISRQLYSDLTSVVGLPIGSEMLDTISPQYFSDFLSFGAIGARTTESQLHRELASGLSFPIGFKNGTDGGLAVALDAVQASSKGHHFMGVTKNGMAAITTTKGNDCCFIILRGGKKITNYDVESVKAAKEAIAKCTDPSIKLMVDCSHDNSRKDYRNQPQVLDSVAEQISNGEDSIIGVMIESNIHEGKQPMPPAGSGKEALKYGVSITDGCVSWETTVEMLTKLSQAVQTRRSLKKQKVSN

SEQ ID NO: 1555 - DNA, 1047 bp, Buchnera aphidicola
  CDS (1)..(1047)
atgaaaaaaacagatgaactacgtacaatacgaattgatccattgataacaccatctgaattagcaaaaaaatatgctattacttcagaaatcatggataatgttattataacgagacaaaatatagctcgaattatgactggagaagatttgcgtttgcttgttgtaataggtccatgttcagtacatgatccaattgcagcagttgaatatgctcatcgattatatgaactacgtaaaaaatatcaagatcgtcttgaaattataatgcgtacatattttgaaaaaccaagaacagtagttggttggaagggattaatttcagatccagatttaaatggtagtttcagagttaatcatggtttagctgttgcacgtaaattattattagatatcaatgaactaggaatgcctgcagcaacagagtttttagatatggtaatagggcaatttattgcggatttaattagctggggtgcgattggagctagaactactgaaagtcaaattcatagagaaatggcttcagctctttcttgtccagtaggttttaaaaatggaacagatggaaatatacgtattgcaattgatgctattagagcagcacaagcacgtcatttgttttttgctccgaataaagatggacaaatgactattaatcataccagtggaaatccttatggacatataattatgagaggtggtcgaactcctaattatcatgctcacgatattaattcagcaatagaacatttacgtgaatttaatttgttagaacatttaatgattgattttagtcatggtaattgtttaaaggaacatattcgtcaaaaagatgttgctaaatctgtttcaaaacaaatttctcaaggttcaaaaactatatttggtgtaatgattgaaagttttttagaagaaggttttcaaacagttaaagaaaatcaaccactaatatatggaaaatcaattactgatgcatgtttaaattggaaagacagtgtccttattattaagcaattagcagatgcggtagatactcgtttttaa

SEQ ID NO: 1556 - protein, 348 aa, Buchnera aphidicola
MKKTDELRTIRIDPLITPSELAKKYAITSEIMDNVIITRQNIARIMTGEDLRLLVVIGPCSVHDPIAAVEYAHRLYELRKKYQDRLEIIMRTYFEKPRTVVGWKGLISDPDLNGSFRVNHGLAVARKLLLDINELGMPAATEFLDMVIGQFIADLISWGAIGARTTESQIHREMASALSCPVGFKNGTDGNIRIAIDAIRAAQARHLFFAPNKDGQMTINHTSGNPYGHIIMRGGRTPNYHAHDINSAIEHLREFNLLEHLMIDFSHGNCLKEHIRQKDVAKSVSKQISQGSKTIFGVMIESFLEEGFQTVKENQPLIYGKSITDACLNWKDSVLIIKQLADAVDTRF

SEQ ID NO: 1557 - DNA, 1047 bp, Buchnera aphidicola
  CDS (1)..(1047)
atgaaaaaaacagatgaattgcgaacaatacgcattgacccgttagttactccagctgaattagcacaacgtcatgttataactccttcaattatggatactgttatttcaacgagaaaaaatattgctaatattatgacgggattagatcctcgtttacttgtcattataggaccttgttcagtacatgatcctgttgctgcagtagaatatgctggaagattacaagtattgcgtaagaaatatgaatcgcgtcttgaaattgttatgcgaacttattttgaaaaacctcgtacagtaataggttggaaggggctaatttcagatcctgaccttaatggtagctttcacgtaaataatggtttatcgatagctagaaaattattgttggacattaataagttaggagttccagctgcgactgaatttttagacatggtaataggacaatttattgctgatctcattagttggggcgctattggtgcgcgtactactgaaagtcaaattcatcgtgaaatggcatcagcattatcttgtcctgtaggttttaaaaatggtacggatggtaatataagaattgctgtagatgctattcgtgctgctagtgtagaacatttatttttagcgcctaacaaatatggtcaaatgactattaattataccagtggaaatcccttcggtcatgttattatgcgcggtggaaaatctccaaattatcatgctaaagatattgctattgcaataaaatacttacacgaatttactctttcagagtatttgatgatagactttagtcatggaaattgtttaaaacaacatcgtcgtcaattagatgtgggtgaatctattgctaagcagataagagatggatcaacagctatttttggtgttatgattgaaagttttttagaagaaggttctcaaaaagttattgacaataaatctttagtatatggaaaatctattactgatccttgtttgggttggaatgatagtgcatttttacttgaaaagttggcaaatgctgttgatagtagattttaa

SEQ ID NO: 1558 - protein, 348 aa, Buchnera aphidicola
MKKTDELRTIRIDPLVTPAELAQRHVITPSIMDTVISTRKNIANIMTGLDPRLLVIIGPCSVHDPVAAVEYAGRLQVLRKKYESRLEIVMRTYFEKPRTVIGWKGLISDPDLNGSFHVNNGLSIARKLLLDINKLGVPAATEFLDMVIGQFIADLISWGAIGARTTESQIHREMASALSCPVGFKNGTDGNIRIAVDAIRAASVEHLFLAPNKYGQMTINYTSGNPFGHVIMRGGKSPNYHAKDIAIAIKYLHEFTLSEYLMIDFSHGNCLKQHRRQLDVGESIAKQIRDGSTAIFGVMIESFLEEGSQKVIDNKSLVYGKSITDPCLGWNDSAFLLEKLANAVDSRF

SEQ ID NO: 1559 - DNA, 1047 bp, Erwinia herbicola
  CDS (1)..(1047)
atgaacaaaaccgacgaactgcgtaccgcacgcattggtagtctgattaccccccccagcctggcggctgagcatcctgtctctccggcaattgccgacaatgtcaccgctgcccgtaaacgtattgcctgtattctgacgggtgaagatcaccgcctgctggtggtgattggcccctgctcgctgcacgacccgaaagcggcactggaatatgctgagcgtctgaacgcgttacgccgccgctatgaagatcggctggagattgtgatgcgcgcctactttgaaaagccgcgcaccgtagtgggctggaaaggcttaatctccgatccggatctggatgggagctacgatgtgaaccgcggcataggcatcgcccgccagctgctgattgatatcaacgcgctgggcctgcctaccgccacggaattcctggatatggtgatcggccagtttattgccgatctgattagctggggcgcgattggcgcacgcaccaccgaaagccagatccaccgcgaaatggcatcggccctctcctgcccggtcggctttaaaaacggcaccgatggtaacgtacagattgccgtggatgcgattcgcgccgcgcgcgccagccacatgttcctttcgcccgataagctgggccagatgactatctatcagaccagcggcaacccgcatggtcatgtgatcctgcgtggcggcaaacagcctaactatcatgccagtgatgtcgccgccgcagccgaaagtctgtcggcgtttaatctgccacagcagctggtgatcgacttcagtcacggtaactgcctgaagcagcatcgtcgtcagatggatgtcgcggcagaggtggcagaacagattaaagcgggatcgcaggccgttgccggtgtgatgattgaaagcttcctggaagagggcaatcagaaagtcgtcagcggcgaaccgctggtctatggcaagtcgattaccgatccctgcctcggctggcaggagagcgaaaaggtgctcgccctgctggccgaggcggtttctcaccgcctctga

SEQ ID NO: 1560 - protein, 348 aa, Erwinia herbicola
MNKTDELRTARIGSLITPPSLAAEHPVSPAIADNVTAARKRIACILTGEDHRLLVVIGPCSLHDPKAALEYAERLNALRRRYEDRLEIVMRAYFEKPRTVVGWKGLISDPDLDGSYDVNRGIGIARQLLIDINALGLPTATEFLDMVIGQFIADLISWGAIGARTTESQIHREMASALSCPVGFKNGTDGNVQIAVDAIRAARASHMFLSPDKLGQMTIYQTSGNPHGHVILRGGKQPNYHASDVAAAAESLSAFNLPQQLVIDFSHGNCLKQHRRQMDVAAEVAEQIKAGSQAVAGVMIESFLEEGNQKVVSGEPLVYGKSITDPCLGWQESEKVLALLAEAVSHRL

SEQ ID NO: 1561 - DNA, 1047 bp, Salmonella typhimurium
  CDS (1)..(1047)
atgaacagaaccgacgaactccgtactgcgcgtatcgacagcctggtaacaccgaccgaactcgcgcagcggtatcctgtatcgtcctccgtcgccagtcacgttaccgactcccgacgccggatagaaaagattttaaatggtgaagatccacggctactggtcgtcattggcccctgttcgattcacgatctgaatgctgccatggaatacgcgacgcagctccaggcacaacgccaaaagcatcaggcgcgtctggagatcgtcatgcgcacctattttgaaaaaccgcgcaccgtcgtgggatggaaaggcctgatttccgatcccgacttgaatggcagttaccgcgtcaattatgggcttgaactggcgcgtcgcttgctattgcaggtgaacgaactgggagtaccgaccgccacagagtttcttgatatggtcaccggccagtttattgccgatctgatcagttggggagcgattggcgcgcgtaccaccgaaagccaaatccatcgggaaatggcttctgcgctctcttgtccggtcggctttaaaaatggtacggatggcaatacccgcattgccgttgatgctattcgcgcctcccgcgccagtcatatgtttctctcgccggataaagacggacagatgactatctaccagacgagtggcaacccgtatgggcacatcatcatgcgcggcggtaaaaaaccgaactaccacgctgaagatattgccgccgcctgcgatacgttgcatgaatttgatctgccggaacatctggtcgtcgacttcagccacggcaactgtcaaaaacagcatcgccgccagttagaggtatgtgatgatatttgccagcagattcgtaatggctccacggcaattgccgggattatggcagagagttttttacgggaaggcacgcaaaaaattatcagcggtcaaccattaatctatggtcagtccattaccgatccttgcctgaactgggaagatacggaagttttgttggaaaaacttgccgcggcggtagacagccgcttttaa

SEQ ID NO: 1562 - protein, 348 aa, Salmonella typhimurium
MNRTDELRTARIDSLVTPTELAQRYPVSSSVASHVTDSRRRIEKILNGEDPRLLVVIGPCSIHDLNAAMEYATQLQAQRQKHQARLEIVMRTYFEKPRTVVGWKGLISDPDLNGSYRVNYGLELARRLLLQVNELGVPTATEFLDMVTGQFIADLISWGAIGARTTESQIHREMASALSCPVGFKNGTDGNTRIAVDAIRASRASHMFLSPDKDGQMTIYQTSGNPYGHIIMRGGKKPNYHAEDIAAACDTLHEFDLPEHLVVDFSHGNCQKQHRRQLEVCDDICQQIRNGSTAIAGIMAESFLREGTQKIISGQPLIYGQSITDPCLNWEDTEVLLEKLAAAVDSRF

SEQ ID NO: 1563 - DNA, 23 bp, artificial sequence
  primer
atgaacagaactgacgaactccg

SEQ ID NO: 1564 - DNA, 24 bp, artificial sequence
  primer
ttagaagcgggtatctaccgcaga

SEQ ID NO: 1565 - DNA, 1071 bp, Escherichia coli K12; identical to SEQ ID NO: 1333
  CDS (1)..(1071)

SEQ ID NO: 1566 - protein, 356 aa, Escherichia coli K12; identical to SEQ ID NO: 1334

SEQ ID NO: 1567 - DNA, 1235 bp, Salmonella typhimurium; identical to SEQ ID NO: 1325
  CDS (165)..(1235)

SEQ ID NO: 1568 - protein, 356 aa, Salmonella typhimurium; identical to SEQ ID NO: 1326

SEQ ID NO: 1569 - DNA, 1086 bp, Deinococcus radiodurans; identical to SEQ ID NO: 1327
  CDS (1)..(1086)

SEQ ID NO: 1570 - protein, 361 aa, Deinococcus radiodurans; identical to SEQ ID NO: 1328

SEQ ID NO: 1571 - DNA, 1056 bp, Neisseria meningitidis; identical to SEQ ID NO: 1329
  CDS (1)..(1056)

SEQ ID NO: 1572 - protein, 351 aa, Neisseria meningitidis; identical to SEQ ID NO: 1330

SEQ ID NO: 1573 - DNA, 1047 bp, Yersinia pestis; identical to SEQ ID NO: 1331
  CDS (1)..(1047)

SEQ ID NO: 1574 - protein, 348 aa, Yersinia pestis; identical to SEQ ID NO: 1332

SEQ ID NO: 1575 - DNA, 1047 bp, Salmonella enterica subsp. enterica serovar Typhi
  CDS (1)..(1047)
atgaacagaaccgacgaactccgtactgcgcgtatcgacagcctggtaacaccaaccgaactcgcgcagcggtatcctgtatcgtcctccgtcgccagtcacgttaccgactcccgacgccggatagaaaagattttaaatggtgaagatccacggctactggtcgtcattggcccctgttcgattcacgatctgaatgctgccatggaatacgcgacgcagctccaggcacaacgccaaaagcatcaggcgcgtctggaaatcgtcatgcgcacctattttgaaaaaccgcgcaccgtcgtgggatggaaaggcctgatttccgatcccgacttgaatggcagttaccgcgtcaatcatgggcttgaactggcgcgtcgcttgctattgcaggtgaacgaactgggagtaccgaccgccacagaatttcttgatatggtcaccggccagtttattgccgatctgatcagttggggaacgattggcgcgcgtaccaccgaaagccaaatccatcgggaaatggcttctgcgctctcttgcccggtcggctttaaaaatggtacggatggcaatacccgcattgccgttgatgctattcgcgcctcccgcgccagtcatatgtttctctcgccggataaagacggacagatgactatctaccaaacgagtggcaacccgtatgggcacatcatcatgcgcggcggtaaaaaaccgaactaccacgctgaagatattgccgccgcctgcgacacgttgcatgaatttgatctgccggaacatctggtcgtcgacttcagccacggcaactgtcaaaaacagcatcgccgccagttggacgtatgtgatgatatttgccagcagattcgtaatggctccacggcaattgccgggattatggcagagagttttttacgggaaggcacgcaaaaaattatcagcggtcaaccgttaatctatggtcaatccattaccgatccctgcctgaactgggaagatacggaagttctgttggaaaaacttgccgcggcggtagacagccgcttttaa

SEQ ID NO: 1576 - protein, 348 aa, Salmonella enterica subsp. enterica serovar Typhi
MNRTDELRTARIDSLVTPTELAQRYPVSSSVASHVTDSRRRIEKILNGEDPRLLVVIGPCSIHDLNAAMEYATQLQAQRQKHQARLEIVMRTYFEKPRTVVGWKGLISDPDLNGSYRVNHGLELARRLLLQVNELGVPTATEFLDMVTGQFIADLISWGTIGARTTESQIHREMASALSCPVGFKNGTDGNTRIAVDAIRASRASHMFLSPDKDGQMTIYQTSGNPYGHIIMRGGKKPNYHAEDIAAACDTLHEFDLPEHLVVDFSHGNCQKQHRRQLDVCDDICQQIRNGSTAIAGIMAESFLREGTQKIISGQPLIYGQSITDPCLNWEDTEVLLEKLAAAVDSRF

SEQ ID NO: 1577 - DNA, 1047 bp, Escherichia coli; identical to SEQ ID NO: 1323
  CDS (1)..(1047)

SEQ ID NO: 1578 - protein, 348 aa, Escherichia coli; identical to SEQ ID NO: 1324

SEQ ID NO: 1579 - DNA, 1188 bp, Escherichia coli
  CDS (92)..(1144)
caggtcgacaccccgtttacacattctgacggaagatatagattggaagtattgcattcactaagataagtatggcaacactggaacagacatgaattatcagaacgacgatttacgcatcaaagaaatcaaagagttacttcctcctgtcgcattgctggaaaaattccccgctactgaaaatgccgcgaatacggttgcccatgcccgaaaagcgatccataagatcctgaaaggtaatgatgatcgcctgttggttgtgattggcccatgctcaattcatgatcctgtcgcggcaaaagagtatgccactcgcttgctggcgctgcgtgaagagctgaaagatgagctggaaatcgtaatgcgcgtctattttgaaaagccgcgtaccacggtgggctggaaagggctgattaacgatccgcatatggataatagcttccagatcaacgacggtctgcgtatagcccgtaaattgctgcttgatattaacgacagcggtctgccagcggcaggtgagtttctcgatatgatcaccccacaatatctcgctgacctgatgagctggggcgcaattggcgcacgtaccaccgaatcgcaggtgcaccgcgaactggcatcagggctttcttgtccggtcggcttcaaaaatggcaccgacggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcacaggtgatgatcgatttcagccatgctaactcgtccaaacaattcaaaaagcagatggatgtttgtgctgacgtttgccagcagattgccggtggcgaaaaggccattattggcgtgatggtggaaagccatctggtggaaggcaatcagagcctcgagagcggggagccgctggcctacggtaagagcatcaccgatgcctgcatcggctgggaagataccgatgctctgttacgtcaactggcgaatgcagtaaaagcgcgtcgcgggtaaggtttaattgtcggatgcgccgtcagagtggcgtatccgatgga

SEQ ID NO: 1580 - protein, 350 aa, Escherichia coli
MNYQNDDLRIKEIKELLPPVALLEKFPATENAANTVAHARKAIHKILKGNDDRLLVVIGPCSIHDPVAAKEYATRLLALREELKDELEIVMRVYFEKPRTTVGWKGLINDPHMDNSFQINDGLRIARKLLLDINDSGLPAAGEFLDMITPQYLADLMSWGAIGARTTESQVHRELASGLSCPVGFKNGTDGTIKVAIDAINAAGAPHCFLSVTKWGHSAIVNTSGNGDCHIILRGGKEPNYSAKHVAEVKEGLNKAGLPAQVMIDFSHANSSKQFKKQMDVCADVCQQIAGGEKAIIGVMVESHLVEGNQSLESGEPLAYGKSITDACIGWEDTDALLRQLANAVKARRG

SEQ ID NO: 1581 - DNA, 1131 bp, Nostoc sp. PCC 7120; identical to SEQ ID NO: 1335
  CDS (1)..(1131)

SEQ ID NO: 1582 - protein, 376 aa, Nostoc sp. PCC 7120; identical to SEQ ID NO: 1336

SEQ ID NO: 1583 - DNA, 1053 bp, Salmonella enterica subsp. enterica serovar Typhi; identical to SEQ ID NO: 1337
  CDS (1)..(1053)

SEQ ID NO: 1584 - protein, 350 aa, Salmonella enterica subsp. enterica serovar Typhi; identical to SEQ ID NO: 1338

SEQ ID NO: 1585 - DNA, 1077 bp, Pseudomonas aeruginosa; identical to SEQ ID NO: 1339
  CDS (1)..(1077)

SEQ ID NO: 1586 - protein, 358 aa, Pseudomonas aeruginosa; identical to SEQ ID NO: 1340

SEQ ID NO: 1587 - DNA, 1047 bp, Buchnera sp; identical to SEQ ID NO: 1341
  CDS (1)..(1047)

SEQ ID NO: 1588 - protein, 348 aa, Buchnera sp; identical to SEQ ID NO: 1342

SEQ ID NO: 1589 - DNA, 1032 bp, Streptococcus pneumoniae
  CDS (1)..(1032)
atggtatttacagcaaaaagctctaaaataaatatagaagaagttcgtgccttgtcaaaattagaaggtcaggctttggagaggaaatcacagcgagatcaagagctagaagccattatacgtggagaagaccagcgaattctcttggtaatcgggccatgctcatctgacaacgaagaagctgtccttgaatacgctaagcgtttggcagtcctacaagaagaagtggcagatcgtatctttatggttatgcgtgtttatactgccaaaccccgtaccaacggagatggctataagggcttgattcaccagcctaacgcgacagaagcgcctagtcttatcaatggaatcaaagccgttcgccatcttcactatcgtgtcatcacagaaacagggatgacaactgctgatgaaatgctttatcctgaaaaccttccgcttgtagatgatttgatttcttacatggcagttggtgcccgttcagttgaagaccagcaacaccgctttgtggcaagtggggcaggattttctactggttttaaaaatccaacctctggaaatctcaatgtcatgtttaatgggatttatgctgctcaaaacaaacaaagtttccttttcttaggaaaagaagtagaaacaactgggaacccgctttcacacgctattcttcgtggtgctcttaatgagtatggaaaaaatattcccaactactattatgacaatttaattgataccattgcccagtatgagaaaatgggcttggaaaatccttttatcatcattgataccaatcatgacaattctggtaagcagtatattgaacagatccgaattgtccgccagaccttgattaaccgtgcttggaatgaaaaaattaagcagttcgttcgtggttttatgattgagtcttatctggaagatggtcgacaaaatgagccagaagtatttggtaagtctatcacagacccttgcctgggttgggataacacagaagctcttgtcagagaaatttacaaaacgttaggagaatag

SEQ ID NO: 1590 - protein, 343 aa, Streptococcus pneumoniae
MVFTAKSSKINIEEVRALSKLEGQALERKSQRDQELEAIIRGEDQRILLVIGPCSSDNEEAVLEYAKRLAVLQEEVADRIFMVMRVYTAKPRTNGDGYKGLIHQPNATEAPSLINGIKAVRHLHYRVITETGMTTADEMLYPENLPLVDDLISYMAVGARSVEDQQHRFVASGAGFSTGFKNPTSGNLNVMFNGIYAAQNKQSFLFLGKEVETTGNPLSHAILRGALNEYGKNIPNYYYDNLIDTIAQYEKMGLENPFIIIDTNHDNSGKQYIEQIRIVRQTLINRAWNEKIKQFVRGFMIESYLEDGRQNEPEVFGKSITDPCLGWDNTEALVREIYKTLGE

SEQ ID NO: 1591 - DNA, 1074 bp, Vibrio cholerae; identical to SEQ ID NO: 1343
  CDS (1)..(1074)

SEQ ID NO: 1592 - protein, 357 aa, Vibrio cholerae; identical to SEQ ID NO: 1344

SEQ ID NO: 1593 - DNA, 1038 bp, Lactococcus lactis subsp. lactis; identical to SEQ ID NO: 1345
  CDS (1)..(1038)

SEQ ID NO: 1594 - protein, 345 aa, Lactococcus lactis subsp. lactis; identical to SEQ ID NO: 1346

SEQ ID NO: 1595 - DNA, 1023 bp, Lactococcus lactis subsp. lactis; identical to SEQ ID NO: 1347
  CDS (1)..(1023)

SEQ ID NO: 1596 - protein, 340 aa, Lactococcus lactis subsp. lactis; identical to SEQ ID NO: 1348

SEQ ID NO: 1597 - DNA, 1032 bp, Streptococcus pneumoniae
  CDS (1)..(1032)
atggcatttattgaaaaaggtcaagaaatcgatatggaagtcatcaaggctgaaacccaattgtctgcggaagccttgagactcaaggaaagccgtgacagggaattggcagatattatttcaggggaagatgaccgtattctcttggtgattggtccttgctcttctgataatgaagaggcggtcttggaatatgctcgccgtttatctgccttgcaaaagaaggtagcggataagattttcatggtcatgcgcgtgtatactgctaagcctcgtaccaatggagacggctataaaggattagttcaccagccagatacttctaaggctccaagcctgattaatggcttgcaggctgtgcgccagttgcactaccgcgtgattacagagactggtttgacaacggcagatgagatgctttatccgtcaaatctgatcttggtggatgacttggtcagctaccatgccgttggagctcgttctgtggaagaccaagagcaccgctttgtggcttctgggattgatgcaccagtagggatgaaaaatccaacctcaggaaatttgggtgttatgtttaacgccatctatgctgctcaaaacaagcaaaccttcctttatcatgggcaggaagttgagacatcaggtaatcctttggcccatgttatcctccgtggagcagtcaacgagtatggcaattatatgccgaattactactatgaaaatctactccaagccattgaacgctatgaaaccatgggacttgaaaatccttttatcctcattgacaccaaccatgataactcaggcaagcaatatatggagcagattcgaattgttcgccagaccttgcagaatcgtgattggaatgagaaaattaaaaagacggttcgaggatttatgattgaatcttacctagcagatggtcgtcaaaaccaaccagagatctttggttgctctattactgacccttgcctaggttgggaaaatacagaggccttggtagaagagatttatgttaccttgacaaaatag

SEQ ID NO: 1598 - protein, 343 aa, Streptococcus pneumoniae; identical to SEQ ID NO: 1350

SEQ ID NO: 1599 - DNA, 1095 bp, Pseudomonas aeruginosa; identical to SEQ ID NO: 1351
  CDS (1)..(1095)

SEQ ID NO: 1600 - protein, 364 aa, Pseudomonas aeruginosa; identical to SEQ ID NO: 1352

SEQ ID NO: 1601 - DNA, 1110 bp, Caulobacter crescentus; identical to SEQ ID NO: 1353
  CDS (1)..(1110)

SEQ ID NO: 1602 - protein, 369 aa, Caulobacter crescentus; identical to SEQ ID NO: 1354

SEQ ID NO: 1603 - DNA, 1143 bp, Xylella fastidiosa
  CDS (1)..(1143)
atgtctcctccgcttggtctatgtctaaatgttctgagattacatcccatgccaccatttaccgacgacctccgtatccgcaaaattgaaccactgacacctcctaaccagctcctattgcaactaccatgcgatgagcaggcatcgctgactgttgcgacctcacgcaacgcactgcacgatatcctgcacggccacaacgaccgtttagccgtcgtgataggcccatgctcaatccatgatccaattgcagccattgattacgcgcaacgtctacacccattgcgtgagatgtacaaggatgcactagagatcgtgatgcgggtttactttcagaaaccgcgcaccaccattggttggaaaggattggtcaacgatccggatcttgatggcagcttccaaatcaataagggcctgcatatcgcgcgcaacctgctacgcgatatcaatcatctcggcttacccgctggtgtggaatttctagacacgatttcgccgcaatatctggctgacttagtcgcctggggtgccattggtgcacgcaccactgagagccaaatacaccgtgaaatggcttcaggtttatcgtgcccgattggctttaaaaacagtaccagtggtgatgtgaaaattgctgctgacgcgattaaagcagcttcgcatccgcaccatttcctttcagtgacaaagacaggtgttgccgcagtcgtcgccacccagggtaaccccgattgtcacgtgattctacgtggaggcagggtcccgaattacgacgcaatcaatgtcgaagctgccagccaaacattgcttaaatccaagctaccggtgcgactgatgattgatgcgagccatgccaatagcggcaaaaacccaaacaatcaacccaaggtgatcgagaacatcgtagaacagcttgaagccggtgaacgccgcatcgtcggtgtcatgattgaaagccacattgttggtggtcggcaagaattagtccttggaaacacacttacctatggacagagcattaccgatgcttgcatcgactgggatacctcggtcgcaatgttagagcagctcgctcaggccgtacgcgtcagacagactctaccaacgaccgctacaactaacaaaacatcaaaaacccaataa

SEQ ID NO: 1604 - protein, 380 aa, Xylella fastidiosa
MSPPLGLCLNVLRLHPMPPFTDDLRIRKIEPLTPPNQLLLQLPCDEQASLTVATSRNALHDILHGHNDRLAVVIGPCSIHDPIAAIDYAQRLHPLREMYKDALEIVMRVYFQKPRTTIGWKGLVNDPDLDGSFQINKGLHIARNLLRDINHLGLPAGVEFLDTISPQYLADLVAWGAIGARTTESQIHREMASGLSCPIGFKNSTSGDVKIAADAIKAASHPHHFLSVTKTGVAAVVATQGNPDCHVILRGGRVPNYDAINVEAASQTLLKSKLPVRLMIDASHANSGKNPNNQPKVIENIVEQLEAGERRIVGVMIESHIVGGRQELVLGNTLTYGQSITDACIDWDTSVAMLEQLAQAVRVRQTLPTTATTNKTSKTQ

SEQ ID NO: 1605 - DNA, 1047 bp, Buchnera aphidicola; identical to SEQ ID NO: 1357
  CDS (1)..(1047)

SEQ ID NO: 1606 - protein, 348 aa, Buchnera aphidicola; identical to SEQ ID NO: 1358

SEQ ID NO: 1607 - DNA, 1089 bp, Haemophilus influenzae; identical to SEQ ID NO: 1359
  CDS (1)..(1089)

SEQ ID NO: 1608 - protein, 362 aa, Haemophilus influenzae; identical to SEQ ID NO: 1360

SEQ ID NO: 1609 - DNA, 1502 bp, Candida albicans; identical to SEQ ID NO: 1361
  CDS (336)..(1442)

SEQ ID NO: 1610 - protein, 368 aa, Candida albicans; identical to SEQ ID NO: 1362

SEQ ID NO: 1611 - DNA, 1113 bp, Saccharomyces cerevisiae; identical to SEQ ID NO: 1363
  CDS (1)..(1113)

SEQ ID NO: 1612 - protein, 370 aa, Saccharomyces cerevisiae; identical to SEQ ID NO: 1364

SEQ ID NO: 1613 - DNA, 2048 bp, Saccharomyces cerevisiae; identical to SEQ ID NO: 1365
  CDS (619)..(1731)

SEQ ID NO: 1614 - protein, 370 aa, Saccharomyces cerevisiae; identical to SEQ ID NO: 1366

SEQ ID NO: 1615 - DNA, 1107 bp, Schizosaccharomyces pombe; identical to SEQ ID NO: 1367
  CDS (1)..(1107)

SEQ ID NO: 1616 - protein, 368 aa, Schizosaccharomyces pombe; identical to SEQ ID NO: 1368

SEQ ID NO: 1617 - DNA, 1089 bp, Amycolatopsis orientalis; identical to SEQ ID NO: 1369
  CDS (1)..(1089)

SEQ ID NO: 1618 - protein, 362 aa, Amycolatopsis orientalis; identical to SEQ ID NO: 1370

SEQ ID NO: 1619 - DNA, 1248 bp, Corynebacterium glutamicum; identical to SEQ ID NO: 1373
  CDS (101)..(1228)

SEQ ID NO: 1620 - protein, 375 aa, Corynebacterium glutamicum; identical to SEQ ID NO: 1374

SEQ ID NO: 1621 - DNA, 1083 bp, Methylophilus methylotrophus; identical to SEQ ID NO: 1375
  CDS (1)..(1083)

SEQ ID NO: 1622 - protein, 360 aa, Methylophilus methylotrophus; identical to SEQ ID NO: 1376

SEQ ID NO: 1623 - DNA, 1047 bp, Yersinia pseudotuberculosis IP 32953
  CDS (1)..(1047)
atgtacaagacagatgaactgcggaccgctcgcatcgatagcttgattacaccgcagcaactggctgaaaagttaccgatttctgaggttattgcagataacgtgacagcgtcacgtaaacgaatagagaaaatacttattggtgaagacccacgtctactcgtggtgattggcccctgctctattcacgaccttgatgcagccgttgattatgccacccggctcaaggtgctacgagaacgctatcaagaccggctggaaatcgtgatgcgcacctatttcgagaaaccacggactgtagtgggttggaaggggctgatttctgatccggcacttgacggctcatgccaggtgaacttgggtattgaactggcacgtaagctactgttagccgtgaatgaactcgggctgccgaccgctaccgagttcctcgatatggtaacaggccaatatattgccgacctcatcagttggggggcaataggcgcacgtaccaccgaaagccagatccaccgagagatggcctcggcactctcctgccccgtgggtttcaaaaatggtacagatggcaatgtgcgtattgctattgatgccattcgcgccgcacaagccagccatatgttcctttctccggataaaaccggccaaatgacgatttaccaaaccagtggtaacccctatgggcatattattatgcggggtggcaagcaacctaactatgatgcctctgatatcgcagccgcctgtgacagcttgcgggaatttgatttgccagaacatctggtggtggattttagccacggcaattgccagaagatgcatcgccgccagttggatgttgccgaaaatatcgggctacagatccgcgcgggttcaacagcgattgtcggtgttatggctgagagtttcctgattgagggcacacagaagattgttgccggacagcccttaacttatgggcaatccatcactgacccttgcctgaattgggatgatactgaacaactgttaagcctattggcagatgcagtaaacagccggttttaa

SEQ ID NO: 1624 - protein, 348 aa, Yersinia pseudotuberculosis IP 32953
MYKTDELRTARIDSLITPQQLAEKLPISEVIADNVTASRKRIEKILIGEDPRLLVVIGPCSIHDLDAAVDYATRLKVLRERYQDRLEIVMRTYFEKPRTVVGWKGLISDPALDGSCQVNLGIELARKLLLAVNELGLPTATEFLDMVTGQYIADLISWGAIGARTTESQIHREMASALSCPVGFKNGTDGNVRIAIDAIRAAQASHMFLSPDKTGQMTIYQTSGNPYGHIIMRGGKQPNYDASDIAAACDSLREFDLPEHLVVDFSHGNCQKMHRRQLDVAENIGLQIRAGSTAIVGVMAESFLIEGTQKIVAGQPLTYGQSITDPCLNWDDTEQLLSLLADAVNSRF

SEQ ID NO: 1625 - DNA, 1053 bp, Yersinia pseudotuberculosis IP 32953; identical to SEQ ID NO: 1487
  CDS (1)..(1053)

SEQ ID NO: 1626 - protein, 350 aa, Yersinia pseudotuberculosis IP 32953; identical to SEQ ID NO: 1488

SEQ ID NO: 1627 - DNA, 1107 bp, Debaryomyces hansenii CBS767; identical to SEQ ID NO: 1377
  CDS (1)..(1107)

SEQ ID NO: 1628 - protein, 368 aa, Debaryomyces hansenii CBS767; identical to SEQ ID NO: 1378

SEQ ID NO: 1629 - DNA, 1074 bp, Yarrowia lipolytica CLIB99; identical to SEQ ID NO: 1379
  CDS (1)..(1074)

SEQ ID NO: 1630 - protein, 357 aa, Yarrowia lipolytica CLIB99; identical to SEQ ID NO: 1380

SEQ ID NO: 1631 - DNA, 1089 bp, Yarrowia lipolytica CLIB99; identical to SEQ ID NO: 1381
  CDS (1)..(1089)

SEQ ID NO: 1632 - protein, 362 aa, Yarrowia lipolytica CLIB99; identical to SEQ ID NO: 1382

SEQ ID NO: 1633 - DNA, 1119 bp, Kluyveromyces lactis NRRL Y; identical to SEQ ID NO: 1383
  CDS (1)..(1119)

SEQ ID NO: 1634 - protein, 372 aa, Kluyveromyces lactis NRRL Y; identical to SEQ ID NO: 1384

SEQ ID NO: 1635 - DNA, 1095 bp, Kluyveromyces lactis NRRL Y; identical to SEQ ID NO: 1385
  CDS (1)..(1095)

SEQ ID NO: 1636 - protein, 364 aa, Kluyveromyces lactis NRRL Y; identical to SEQ ID NO: 1386

SEQ ID NO: 1637 - DNA, 1074 bp, Erwinia carotovora; identical to SEQ ID NO: 1387
  CDS (1)..(1074)

SEQ ID NO: 1638 - protein, 357 aa, Erwinia carotovora; identical to SEQ ID NO: 1388

SEQ ID NO: 1639 - DNA, 1047 bp, Erwinia carotovora; identical to SEQ ID NO: 1389
  CDS (1)..(1047)

SEQ ID NO: 1640 - protein, 348 aa, Erwinia carotovora; identical to SEQ ID NO: 1390

SEQ ID NO: 1641 - DNA, 1056 bp, Erwinia carotovora; identical to SEQ ID NO: 1391
  CDS (1)..(1056)

SEQ ID NO: 1642 - protein, 351 aa, Erwinia carotovora; identical to SEQ ID NO: 1392

SEQ ID NO: 1643 - DNA, 1113 bp, Acinetobacter sp; identical to SEQ ID NO: 1393
  CDS (1)..(1113)

SEQ ID NO: 1644 - protein, 370 aa, Acinetobacter sp; identical to SEQ ID NO: 1394

SEQ ID NO: 1645 - DNA, 1056 bp, Acinetobacter sp; identical to SEQ ID NO: 1395
  CDS (1)..(1056)

SEQ ID NO: 1646 - protein, 351 aa, Acinetobacter sp; identical to SEQ ID NO: 1396

SEQ ID NO: 1647 - DNA, 1119 bp, Candida glabrata CBS138; identical to SEQ ID NO: 1397
  CDS (1)..(1119)

SEQ ID NO: 1648 - protein, 372 aa, Candida glabrata CBS138; identical to SEQ ID NO: 1398

SEQ ID NO: 1649 - DNA, 1071 bp, Candida glabrata CBS138; identical to SEQ ID NO: 1399
  CDS (1)..(1071)

SEQ ID NO: 1650 - protein, 356 aa, Candida glabrata CBS138; identical to SEQ ID NO: 1400

SEQ ID NO: 1651 - DNA, 1083 bp, Photobacterium profundum; identical to SEQ ID NO: 1401
  CDS (1)..(1083)

SEQ ID NO: 1652 - protein, 360 aa, Photobacterium profundum; identical to SEQ ID NO: 1402

SEQ ID NO: 1653 - DNA, 1053 bp, Photobacterium profundum; identical to SEQ ID NO: 1403
  CDS (1)..(1053)

SEQ ID NO: 1654 - protein, 350 aa, Photobacterium profundum; identical to SEQ ID NO: 1404

SEQ ID NO: 1655 - DNA, 1113 bp, Photobacterium profundum; identical to SEQ ID NO: 1405
  CDS (1)..(1113)

SEQ ID NO: 1656 - protein, 370 aa, Photobacterium profundum; identical to SEQ ID NO: 1406

SEQ ID NO: 1657 - DNA, 1056 bp, Photobacterium profundum; identical to SEQ ID NO: 1407
  CDS (1)..(1056)

SEQ ID NO: 1658 - protein, 351 aa, Photobacterium profundum; identical to SEQ ID NO: 1408

SEQ ID NO: 1659 - DNA, 1092 bp, Parachlamydia sp; identical to SEQ ID NO: 1409
  CDS (1)..(1092)

SEQ ID NO: 1660 - protein, 363 aa, Parachlamydia sp; identical to SEQ ID NO: 1410

SEQ ID NO: 1661 - DNA, 1095 bp, Rhodopseudomonas palustris; identical to SEQ ID NO: 1411
  CDS (1)..(1095)

SEQ ID NO: 1662 - protein, 364 aa, Rhodopseudomonas palustris; identical to SEQ ID NO: 1412

SEQ ID NO: 1663 - DNA, 1100 bp, Amycolatopsis methanolica; identical to SEQ ID NO: 1413
  CDS (1)..(1086)

SEQ ID NO: 1664 - protein, 361 aa, Amycolatopsis methanolica; identical to SEQ ID NO: 1414

SEQ ID NO: 1665 - DNA, 1071 bp, Treponema denticola; identical to SEQ ID NO: 1415
  CDS (1)..(1071)

SEQ ID NO: 1666 - protein, 356 aa, Treponema denticola; identical to SEQ ID NO: 1416

SEQ ID NO: 1667 - DNA, 1020 bp, Geobacter sulfurreducens
  CDS (1)..(1020)
atgatcatcgtcatgaaagcgggagcggcaaaaaaagaccgggacgaggtaatcaggcggatcagggagctgggctacaagccccatgtcatccatggcaccacgcgggacgtgatcggggccgtgggggacgagcggggcaagttggtccttcagggcgtcgaatccatgcacggcgtggagagcgtggtgccgatcctgaagccgtacaagctggcatcaagggaggtgaagcccgaaccgagtgttgtcgccattacggataccgtggtcatcggcggccctgaagtcattgtcatggccggtccctgttcggtcgagggagaggccatgattatcgagacggccagggcggtaaaggcggccggcgcccaggtgcttcggggcggagcgttcaagccgcgcacctctccctactccttccagggactcgaagaggaagggctcaagctgctggccaaggcgcgcgaggagacgggtctccccatcgtgaccgaggtggtcaatcccgagacggccgaactggtgtccgagtactccgacattctccagatcggagcccgcaatgcccagaactttgccctgctcaagaaggtggggcagcttcggcgcccggtgctcctcaagcggggcatgtccatgaccatccaggagttcctcatgagcgccgagtatgtcatgagtgaagggaatcagtcggttatcctctgcgaacgcggtatccgcaccttcgagaccgccacccgcaacacgctggatctctcggccattccggtgttgaagcagatgacccatctgccggtcattgccgatccttcccacggcaccggaaactatcactatgtggcacccatggccctggcagctgttgccgccggcgcggacgggctcatgatcgaggtgcatcccgatcccgagcgtgcgtcgtccgatgggccccagtcgctcaagccgaagaaattcgacgcgcttatggcaaagttgcggctcgtggcggcgtccgtggacaggcgactgtaa

SEQ ID NO: 1668 - protein, 339 aa, Geobacter sulfurreducens
MIIVMKAGAAKKDRDEVIRRIRELGYKPHVIHGTTRDVIGAVGDERGKLVLQGVESMHGVESVVPILKPYKLASREVKPEPSVVAITDTVVIGGPEVIVMAGPCSVEGEAMIIETARAVKAAGAQVLRGGAFKPRTSPYSFQGLEEEGLKLLAKAREETGLPIVTEVVNPETAELVSEYSDILQIGARNAQNFALLKKVGQLRRPVLLKRGMSMTIQEFLMSAEYVMSEGNQSVILCERGIRTFETATRNTLDLSAIPVLKQMTHLPVIADPSHGTGNYHYVAPMALAAVAAGADGLMIEVHPDPERASSDGPQSLKPKKFDALMAKLRLVAASVDRRL

SEQ ID NO: 1669 - DNA, 1068 bp, Geobacter sulfurreducens; identical to SEQ ID NO: 1417
  CDS (1)..(1068)

SEQ ID NO: 1670 - protein, 355 aa, Geobacter sulfurreducens; identical to SEQ ID NO: 1418

SEQ ID NO: 1671 - DNA, 1122 bp, Ashbya gossypii; identical to SEQ ID NO: 1421
  CDS (1)..(1122)

SEQ ID NO: 1672 - protein, 373 aa, Ashbya gossypii; identical to SEQ ID NO: 1422

SEQ ID NO: 1673 - DNA, 1098 bp, Amycolatopsis balhimycina; identical to SEQ ID NO: 1423
  CDS (1)..(1098)

SEQ ID NO: 1674 - protein, 365 aa, Amycolatopsis balhimycina; identical to SEQ ID NO: 1424

SEQ ID NO: 1675 - DNA, 1053 bp, Vibrio vulnificus
  CDS (1)..(1053)
atgttccaaacagatgatgtaagaattaataacgttaaagagttacttccaccagtagctgttttagagaagtacccagcgactgaaaccgcttcttcgacaactttccaatcgagaaacgacattcacaacattctcatcggcaaggacgatcgcctgctggttattgtcggcccttgctctatccacgatcctgtggccgcggttgaatacggcaagcgtttgaaaacgttgcgtgacgatctcaaaggtgagcttgaaattgttatgcgcgtttactttgaaaagccacgtaccactgtgggttggaaaggtttgattaatgacccgtaccttaacgacacctacaagttgaatgatggtttacgcatgggccgaaaactgttgttggatcttaccgatatgggtcttccaacggcgagtgagttccttgacatgatcacaccacagtatgtggctgatttgatcagttggggtgctattggtgcacgtaccacggaatctcaggttcaccgtgaactggcgtcgggtctttcttgtccggttggttttaaaaatggcacggatggcaacattaagattgcaagtgatgcgattcgctcagcaagtgcttctcaccatttcctatcggtaacgaaatacggccattctgctatcgttgaaaccgcgggtaatccagactgccacattattttgcgtggtggtaaagagccaaactacagtgcagcgcatgtttcagcggtaaaagaagagttagctacatcgggtttgccacaaaaagtgatgatcgacttcagccacgccaacagctccaagcagtataagcgtcaaatgttggtcgccgacgatgtctctgagcagctagcggctggtgaagaggcaatctttggggtgatgatcgaatcacatcttgtggaaggtcgacaagatcttgttgatggtaaagcggcgacttatggtcagtcgattaccgacgcttgtatcggttgggaagatactgaaactgtgcttcgccaattggcaaatgcagtggcagctcgtcgagcaaaatag

SEQ ID NO: 1676 - protein, 350 aa, Vibrio vulnificus
MFQTDDVRINNVKELLPPVAVLEKYPATETASSTTFQSRNDIHNILIGKDDRLLVIVGPCSIHDPVAAVEYGKRLKTLRDDLKGELEIVMRVYFEKPRTTVGWKGLINDPYLNDTYKLNDGLRMGRKLLLDLTDMGLPTASEFLDMITPQYVADLISWGAIGARTTESQVHRELASGLSCPVGFKNGTDGNIKIASDAIRSASASHHFLSVTKYGHSAIVETAGNPDCHIILRGGKEPNYSAAHVSAVKEELATSGLPQKVMIDFSHANSSKQYKRQMLVADDVSEQLAAGEEAIFGVMIESHLVEGRQDLVDGKAATYGQSITDACIGWEDTETVLRQLANAVAARRAK

SEQ ID NO: 1677 - DNA, 1047 bp, Photorhabdus luminescens; identical to SEQ ID NO: 1427
  CDS (1)..(1047)

SEQ ID NO: 1678 - protein, 348 aa, Photorhabdus luminescens; identical to SEQ ID NO: 1428

SEQ ID NO: 1679 - DNA, 1053 bp, Photorhabdus luminescens; identical to SEQ ID NO: 1429
  CDS (1)..(1053)

SEQ ID NO: 1680 - protein, 350 aa, Photorhabdus luminescens; identical to SEQ ID NO: 1430

SEQ ID NO: 1681 - DNA, 1095 bp, Photorhabdus luminescens; identical to SEQ ID NO: 1431
  CDS (1)..(1095)

SEQ ID NO: 1682 - protein, 364 aa, Photorhabdus luminescens; identical to SEQ ID NO: 1432

SEQ ID NO: 1683 - DNA, 1119 bp, Gloeobacter violaceus; identical to SEQ ID NO: 1433
  CDS (1)..(1119)

SEQ ID NO: 1684 - protein, 372 aa, Gloeobacter violaceus; identical to SEQ ID NO: 1434

SEQ ID NO: 1685 - DNA, 1107 bp, Chromobacterium violaceum; identical to SEQ ID NO: 1435
  CDS (1)..(1107)

SEQ ID NO: 1686 - protein, 368 aa, Chromobacterium violaceum; identical to SEQ ID NO: 1436

SEQ ID NO: 1687 - DNA, 1059 bp, Chromobacterium violaceum; identical to SEQ ID NO: 1437
  CDS (1)..(1059)

SEQ ID NO: 1688 - protein, 352 aa, Chromobacterium violaceum; identical to SEQ ID NO: 1438

SEQ ID NO: 1689 - DNA, 1140 bp, Neurospora crassa; identical to SEQ ID NO: 1439
  CDS (1)..(1140)

SEQ ID NO: 1690 - protein, 379 aa, Neurospora crassa; identical to SEQ ID NO: 1440

SEQ ID NO: 1691 - DNA, 1092 bp, Neurospora crassa; identical to SEQ ID NO: 1441
  CDS (1)..(1092)

SEQ ID NO: 1692 - protein, 363 aa, Neurospora crassa; identical to SEQ ID NO: 1442

SEQ ID NO: 1693 - DNA, 1068 bp, Synechococcus sp; identical to SEQ ID NO: 1443
  CDS (1)..(1068)

SEQ ID NO: 1694 - protein, 355 aa, Synechococcus sp; identical to SEQ ID NO: 1444

SEQ ID NO: 1695 - DNA, 1053 bp, Rhodopirellula baltica; identical to SEQ ID NO: 1445
  CDS (1)..(1053)

SEQ ID NO: 1696 - protein, 350 aa, Rhodopirellula baltica; identical to SEQ ID NO: 1446

SEQ ID NO: 1697 - DNA, 1068 bp, Prochlorococcus marinus subsp; identical to SEQ ID NO: 1447
  CDS (1)..(1068)

SEQ ID NO: 1698 - protein, 355 aa, Prochlorococcus marinus subsp; identical to SEQ ID NO: 1448

SEQ ID NO: 1699 - DNA, 1083 bp, Prochlorococcus marinus; identical to SEQ ID NO: 1449
  CDS (1)..(1083)

SEQ ID NO: 1700 - protein, 360 aa, Prochlorococcus marinus; identical to SEQ ID NO: 1450

SEQ ID NO: 1701 - DNA, 1074 bp, Prochlorococcus marinus; identical to SEQ ID NO: 1451
  CDS (1)..(1074)

SEQ ID NO: 1702 - protein, 357 aa, Prochlorococcus marinus; identical to SEQ ID NO: 1452

SEQ ID NO: 1703 - DNA, 1113 bp, Haemophilus ducreyi; identical to SEQ ID NO: 1453
  CDS (1)..(1113)

SEQ ID NO: 1704 - protein, 370 aa, Haemophilus ducreyi; identical to SEQ ID NO: 1454

SEQ ID NO: 1705 - DNA, 1080 bp, Haemophilus ducreyi; identical to SEQ ID NO: 1455
  CDS (1)..(1080)

SEQ ID NO: 1706 - protein, 359 aa, Haemophilus ducreyi; identical to SEQ ID NO: 1456

SEQ ID NO: 1707 - DNA, 1086 bp, Candidatus Blochmannia floridanus; identical to SEQ ID NO: 1457
  CDS (1)..(1086)

SEQ ID NO: 1708 - protein, 361 aa, Candidatus Blochmannia floridanus; identical to SEQ ID NO: 1458

SEQ ID NO: 1709 - DNA, 1074 bp, Bordetella pertussis; identical to SEQ ID NO: 1459
  CDS (1)..(1074)

SEQ ID NO: 1710 - protein, 357 aa, Bordetella pertussis; identical to SEQ ID NO: 1460

SEQ ID NO: 1711 - DNA, 1119 bp, Bordetella bronchiseptica; identical to SEQ ID NO: 1461
  CDS (1)..(1119)

SEQ ID NO: 1712 - protein, 372 aa, Bordetella bronchiseptica; identical to SEQ ID NO: 1462

SEQ ID NO: 1713 - DNA, 1179 bp, Nitrosomonas europaea; identical to SEQ ID NO: 1463
  CDS (1)..(1179)

SEQ ID NO: 1714 - protein, 392 aa, Nitrosomonas europaea; identical to SEQ ID NO: 1464

SEQ ID NO: 1715 - DNA, 1083 bp, Coxiella burnetii; identical to SEQ ID NO: 1465
  CDS (1)..(1083)

SEQ ID NO: 1716 - protein, 360 aa, Coxiella burnetii; identical to SEQ ID NO: 1466

SEQ ID NO: 1717 - DNA, 1143 bp, Xylella fastidiosa; identical to SEQ ID NO: 1469
  CDS (1)..(1143)

SEQ ID NO: 1718 - protein, 380 aa, Xylella fastidiosa; identical to SEQ ID NO: 1470

SEQ ID NO: 1719 - DNA, 1053 bp, Vibrio parahaemolyticus; identical to SEQ ID NO: 1471
  CDS (1)..(1053)

SEQ ID NO: 1720 - protein, 350 aa, Vibrio parahaemolyticus; identical to SEQ ID NO: 1472

SEQ ID NO: 1721 - DNA, 1053 bp, Vibrio parahaemolyticus; identical to SEQ ID NO: 1473
  CDS (1)..(1053)

SEQ ID NO: 1722 - protein, 350 aa, Vibrio parahaemolyticus; identical to SEQ ID NO: 1474

SEQ ID NO: 1723 - DNA, 1074 bp, Vibrio parahaemolyticus; identical to SEQ ID NO: 1475
  CDS (1)..(1074)

SEQ ID NO: 1724 - protein, 357 aa, Vibrio parahaemolyticus; identical to SEQ ID NO: 1476

SEQ ID NO: 1725 - DNA, 1083 bp, Pseudomonas syringae; identical to SEQ ID NO: 1477
  CDS (1)..(1083)

SEQ ID NO: 1726 - protein, 360 aa, Pseudomonas syringae; identical to SEQ ID NO: 1478

SEQ ID NO: 1727 - DNA, 1077 bp, Pseudomonas syringae; identical to SEQ ID NO: 1479
  CDS (1)..(1077)

SEQ ID NO: 1728 - protein, 358 aa, Pseudomonas syringae; identical to SEQ ID NO: 1480

SEQ ID NO: 1729 - DNA, 1062 bp, Pseudomonas putida; identical to SEQ ID NO: 1481
  CDS (1)..(1062)

SEQ ID NO: 1730 - protein, 353 aa, Pseudomonas putida; identical to SEQ ID NO: 1482

SEQ ID NO: 1731 - DNA, 1113 bp, Pseudomonas putida; identical to SEQ ID NO: 1483
  CDS (1)..(1113)

SEQ ID NO: 1732 - protein, 370 aa, Pseudomonas putida; identical to SEQ ID NO: 1484

SEQ ID NO: 1733 - DNA, 1086 bp, Bradyrhizobium japonicum; identical to SEQ ID NO: 1485
  CDS (1)..(1086)

SEQ ID NO: 1734 - protein, 361 aa, Bradyrhizobium japonicum; identical to SEQ ID NO: 1486

SEQ ID NO: 1735 - DNA, 1077 bp, Yersinia pestis; identical to SEQ ID NO: 1489
  CDS (1)..(1077)

SEQ ID NO: 1736 - protein, 358 aa, Yersinia pestis; identical to SEQ ID NO: 1490

SEQ ID NO: 1737 - DNA, 1038 bp, Wigglesworthia glossinidia brevipalpis; identical to SEQ ID NO: 1491
  CDS (1)..(1038)

SEQ ID NO: 1738 - protein, 345 aa, Wigglesworthia glossinidia brevipalpis; identical to SEQ ID NO: 1492

SEQ ID NO: 1739 - DNA, 1071 bp, Vibrio vulnificus
  CDS (1)..(1071)
atgcctacgctcagcaaattgattcactccactccttgtggaacactcccttctgtggaagagatcattcaacacgcctcactggacgaagagagcgaagcgtttatccgacaacgtcgccaagacatcactcgaattctgaatggccaagaccctcgattactggtgatcatcggcccatgttcaattcacgacccgcaagcaggcctagaatatgcgcagaaactggccaacattcagcatcagcatgaaaagcaacttctgattgtgatgcgaacttactttgaaaaaccgcgcacacgcgcaggatggaaagggctgatcgtcgatcccgatctcgataacagccacgacattaataaaggtctgcggcttgctcgacaattcttacagcaagtcatcaagcttggccttgcgacggcaaccgagtatttagacaccacgacttacccctatatttctgacctcatttgctggggtgccattggcgcgaggacaactgaatctcaaattcaccgtcaaatggcctcggcgcttccctgtcctattggtttcaaaaacgggaccgacggcaatgttgatattgctatcgacgcgatacacgcggcaaactcaccccatctcatctgtgtgccaggatttggggcacgtactctcacagccatcagtcatggtaaccccaatggccatatcattttgcgaggtggcaaaacgccaaactacaccaccgagcatgtttgccaaatcagccaacaactggaagccaacgatcttaacccgcgcctgatcattgattgcagccatggcaatagcctgaaagtggcaaagaaccaactcgatgtggcgagaaacatcgcctgtcagttgatcgaaggagaaaaatgcattgcaggcgtgatggcggagagcttcttggtagcaggcgcgcaaaagatcaccgatcgtccgttggtcaaaggcatgtcgattactgatgaatgtttggggtgggaagagacggaaagtattctcaatatttttgcggaagcggtgaatgtcgtgatgacggagcgcttttccaccgttgcctaa

SEQ ID NO: 1740 - protein, 356 aa, Vibrio vulnificus
MPTLSKLIHSTPCGTLPSVEEIIQHASLDEESEAFIRQRRQDITRILNGQDPRLLVIIGPCSIHDPQAGLEYAQKLANIQHQHEKQLLIVMRTYFEKPRTRAGWKGLIVDPDLDNSHDINKGLRLARQFLQQVIKLGLATATEYLDTTTYPYISDLICWGAIGARTTESQIHRQMASALPCPIGFKNGTDGNVDIAIDAIHAANSPHLICVPGFGARTLTAISHGNPNGHIILRGGKTPNYTTEHVCQISQQLEANDLNPRLIIDCSHGNSLKVAKNQLDVARNIACQLIEGEKCIAGVMAESFLVAGAQKITDRPLVKGMSITDECLGWEETESILNIFAEAVNVVMTERFSTVA

SEQ ID NO: 1741 - DNA, 1053 bp, Vibrio vulnificus; identical to SEQ ID NO: 1495
  CDS (1)..(1053)

SEQ ID NO: 1742 - protein, 350 aa, Vibrio vulnificus; identical to SEQ ID NO: 1496

SEQ ID NO: 1743 - DNA, 1071 bp, Vibrio vulnificus; identical to SEQ ID NO: 1497
  CDS (1)..(1071)

SEQ ID NO: 1744 - protein, 356 aa, Vibrio vulnificus; identical to SEQ ID NO: 1498

SEQ ID NO: 1745 - DNA, 1062 bp, Synechococcus elongatus; identical to SEQ ID NO: 1499
  CDS (1)..(1062)

SEQ ID NO: 1746 - protein, 353 aa, Synechococcus elongatus; identical to SEQ ID NO: 1500

SEQ ID NO: 1747 - DNA, 1032 bp, Streptococcus mutans; identical to SEQ ID NO: 1501
  CDS (1)..(1032)

SEQ ID NO: 1748 - protein, 343 aa, Streptococcus mutans; identical to SEQ ID NO: 1502

SEQ ID NO: 1749 - DNA, 1035 bp, Streptococcus mutans; identical to SEQ ID NO: 1503
  CDS (1)..(1035)

SEQ ID NO: 1750 - protein, 344 aa, Streptococcus mutans; identical to SEQ ID NO: 1504

SEQ ID NO: 1751 - DNA, 1008 bp, Streptococcus agalactiae; identical to SEQ ID NO: 1505
  CDS (1)..(1008)

SEQ ID NO: 1752 - protein, 335 aa, Streptococcus agalactiae; identical to SEQ ID NO: 1506

SEQ ID NO: 1753 - DNA, 1065 bp, Shewanella oneidensis; identical to SEQ ID NO: 1507
  CDS (1)..(1065)

SEQ ID NO: 1754 - protein, 354 aa, Shewanella oneidensis; identical to SEQ ID NO: 1508

SEQ ID NO: 1755 - DNA, 1092 bp, Shewanella oneidensis; identical to SEQ ID NO: 1509
  CDS (1)..(1092)

SEQ ID NO: 1756 - protein, 363 aa, Shewanella oneidensis; identical to SEQ ID NO: 1510

SEQ ID NO: 1757 - DNA, 1059 bp, Shewanella oneidensis; identical to SEQ ID NO: 1511
  CDS (1)..(1059)

SEQ ID NO: 1758 - protein, 352 aa, Shewanella oneidensis; identical to SEQ ID NO: 1512

SEQ ID NO: 1759 - DNA, 1053 bp, Escherichia coli O6; identical to SEQ ID NO: 1513
  CDS (1)..(1053)

SEQ ID NO: 1760 - protein, 350 aa, Escherichia coli O6; identical to SEQ ID NO: 1514

SEQ ID NO: 1761 - DNA, 1170 bp, Corynebacterium efficiens; identical to SEQ ID NO: 1515
  CDS (1)..(1170)

SEQ ID NO: 1762 - protein, 389 aa, Corynebacterium efficiens; identical to SEQ ID NO: 1516

SEQ ID NO: 1763 - DNA, 1134 bp, Bifidobacterium longum; identical to SEQ ID NO: 1517
  CDS (1)..(1134)

SEQ ID NO: 1764 - protein, 377 aa, Bifidobacterium longum; identical to SEQ ID NO: 1518

SEQ ID NO: 1765 - DNA, 1233 bp, Bifidobacterium longum; identical to SEQ ID NO: 1519
  CDS (1)..(1233)

SEQ ID NO: 1766 - protein, 410 aa, Bifidobacterium longum; identical to SEQ ID NO: 1520

SEQ ID NO: 1767 - DNA, 1221 bp, Phytophthora infestans; identical to SEQ ID NO: 1521
  CDS (20)..(1153)

SEQ ID NO: 1768 - protein, 377 aa, Phytophthora infestans; identical to SEQ ID NO: 1522

SEQ ID NO: 1769 - DNA, 1062 bp, Chlorobium tepidum; identical to SEQ ID NO: 1523
  CDS (1)..(1062)

SEQ ID NO: 1770 - protein, 353 aa, Chlorobium tepidum; identical to SEQ ID NO: 1524

SEQ ID NO: 1771 - DNA, 1074 bp, Xanthomonas campestris; identical to SEQ ID NO: 1525
  CDS (1)..(1074)

SEQ ID NO: 1772 - protein, 357 aa, Xanthomonas campestris; identical to SEQ ID NO: 1526

SEQ ID NO: 1773 - DNA, 1074 bp, Xanthomonas axonopodis; identical to SEQ ID NO: 1527
  CDS (1)..(1074)

SEQ ID NO: 1774 - protein, 357 aa, Xanthomonas axonopodis; identical to SEQ ID NO: 1528

SEQ ID NO: 1775 - DNA, 1080 bp, Ralstonia solanacearum; identical to SEQ ID NO: 1529
  CDS (1)..(1080)

SEQ ID NO: 1776 - protein, 359 aa, Ralstonia solanacearum; identical to SEQ ID NO: 1530

SEQ ID NO: 1777 - DNA, 1179 bp, Ralstonia solanacearum; identical to SEQ ID NO: 1531
  CDS (1)..(1179)

SEQ ID NO: 1778 - protein, 392 aa, Ralstonia solanacearum; identical to SEQ ID NO: 1532

SEQ ID NO: 1779 - DNA, 1065 bp, Synechococcus sp; identical to SEQ ID NO: 1533
  CDS (1)..(1065)

SEQ ID NO: 1780 - protein, 354 aa, Synechococcus sp; identical to SEQ ID NO: 1534

SEQ ID NO: 1781 - DNA, 1035 bp, Escherichia coli; identical to SEQ ID NO: 1535
  CDS (1)..(1035)

SEQ ID NO: 1782 - protein, 344 aa, Escherichia coli; identical to SEQ ID NO: 1536

SEQ ID NO: 1783 - DNA, 1200 bp, Stigmatella aurantiaca; identical to SEQ ID NO: 1537
  CDS (62)..(1147)

SEQ ID NO: 1784 - protein, 361 aa, Stigmatella aurantiaca; identical to SEQ ID NO: 1538

SEQ ID NO: 1785 - DNA, 1092 bp, Rhizobium loti; identical to SEQ ID NO: 1539
  CDS (1)..(1092)

SEQ ID NO: 1786 - protein, 363 aa, Rhizobium loti; identical to SEQ ID NO: 1540

SEQ ID NO: 1787 - DNA, 1083 bp, Amycolatopsis mediterranei; identical to SEQ ID NO: 1541
  CDS (1)..(1083)

SEQ ID NO: 1788 - protein, 360 aa, Amycolatopsis mediterranei; identical to SEQ ID NO: 1542

SEQ ID NO: 1789 - DNA, 1053 bp, Pasteurella multocida; identical to SEQ ID NO: 1543
  CDS (1)..(1053)

SEQ ID NO: 1790 - protein, 350 aa, Pasteurella multocida; identical to SEQ ID NO: 1544

SEQ ID NO: 1791 - DNA, 1086 bp, Pasteurella multocida; identical to SEQ ID NO: 1545
  CDS (1)..(1086)

SEQ ID NO: 1792 - protein, 361 aa, Pasteurella multocida; identical to SEQ ID NO: 1546

SEQ ID NO: 1793 - DNA, 1089 bp, Emericella nidulans; identical to SEQ ID NO: 1549
  CDS (1)..(1089)

SEQ ID NO: 1794 - protein, 362 aa, Emericella nidulans; identical to SEQ ID NO: 1550

SEQ ID NO: 1795 - DNA, 1239 bp, Vibrio cholerae; identical to SEQ ID NO: 1551
  CDS (114)..(1175)

SEQ ID NO: 1796 - protein, 353 aa, Vibrio cholerae; identical to SEQ ID NO: 1552

SEQ ID NO: 1797 - DNA, 1113 bp, Candida albicans
  CDS (1)..(1113)
atgagtaaaactcctgttcctaccgaatacgacgacacaagaatattgggttacgatcctttagttccaccagccttattacaacacgaaataaaggcatctgccgaatcattggatgttgttataaaaggccgttacgattctgctcaaatccttaagggtaatgatgacagatgtattgtaattgttggtccatgttcaattcacgatcctccacaagccttagaatacggtaaacgtttgaagaaattggctgatgaattaaaagatgacttggtgattatcatgagagcttatttggaaaaaccaagaactaccgttggttggaaaggtttgatcaatgatcctgacgttgacaattcttttgatatcaaccgtgggttgaagatatctcgtcaattatattccgatttgactagtgttgttggattaccaattggatcagaaatgttagacaccatttctccacaatacttttccgatttcttgagttttggggccattggagctagaaccaccgaatcacaattacacagagaattagcttctggtttaagcttcccaattggatttaaaaatggtaccgatggtggtttagccgttgccttggatgccgtgcaagcttcttcaaaaggacatcatttcatgggtgtcaccaaaaacggtatggctgccattaccactactaaaggtaacgattgttgtttcattatattaagaggtggtaaaaaaatcaccaattacgatgttgaatcagttaaagctgctaaagaagccattgccaaatgtaccgatccaagtatcaagttgatggttgattgctctcacgacaactcaagaaaagactacagaaaccaacctcaagtattagacagtgttgccgaacaaataagtaatggtgaagactccattattggggttatgattgaatccaatattcatgaaggtaaacaaccaatgcccccagcaggtagtggtaaagaagcattgaaatacggtgtgtctatcaccgatggatgtgtttcttgggaaaccactgttgaaatgttgaccaaattgagtcaagcagtccaaactagaagaagtttaaagaaacaaaaagtttccaattaa

SEQ ID NO: 1798 - protein, 370 aa, Candida albicans; identical to SEQ ID NO: 1554

SEQ ID NO: 1799 - DNA, 1047 bp, Buchnera aphidicola; identical to SEQ ID NO: 1557
  CDS (1)..(1047)

SEQ ID NO: 1800 - protein, 348 aa, Buchnera aphidicola; identical to SEQ ID NO: 1558

SEQ ID NO: 1801 - DNA, 1047 bp, Erwinia herbicola; identical to SEQ ID NO: 1559
  CDS (1)..(1047)

SEQ ID NO: 1802 - protein, 348 aa, Erwinia herbicola; identical to SEQ ID NO: 1560

SEQ ID NO: 1803 - DNA, 23 bp, artificial sequence
  primer
atgcaaaaagacgcgctgaataa

SEQ ID NO: 1804 - DNA, 21 bp, artificial sequence
  primer
ttaagccacgcgagccgtcag

SEQ ID NO: 1805 - DNA, 2374 bp, Escherichia coli K12
  CDS (86)..(2281)
ctgcaggacaacagtaaaatcagagcgtttctgcttttactgatgtctggcggtcggagctggtgaccagtttgacccatatctcatggggcagggttttccaccttgtccggtattcttacttccccgaaacgggtttgcgcttatgaaatcaatgaatattgccgccagtagtgaactggtatcccgactttcttctcatcgtcgcgtggtggcgttgggagatactgattttacggacgtcgcggcagtcgtcattaccgctgcggatagtcgcagtggcattcttgcgttgcttaagcgcaccggttttcatctaccggtgtttttgtattccgaacatgctgttgaattacctgcgggcgttacggcggtaatcaacggcaacgagcagcagtggctggagctggaatccgcagcctgtcagtatgaagagaatttgctgccaccgttttatgacacgctgacgcagtacgttgagatgggcaacagcacctttgcttgccctggacatcaacatggtgcgttttttaaaaagcatcctgccggacgccatttttacgatttctttggtgagaacgtctttcgcgccgatatgtgtaacgctgacgtaaaattgggcgatctgcttattcatgaaggatcggcgaaagatgcgcagaaattcgcagccaaagtctttcatgccgataaaacctattttgtgctgaacggcacatcggcagcgaataaagtggtgacgaatgcgctgttaacgcgtggcgatctggtgctcttcgaccgtaacaaccataagtcgaatcatcacggcgcgctgattcaggcgggggcgacgccggtctatctggaagcttcacgcaacccgtttggtttcattggcggtattgatgcgcactgttttaatgaagagtatctgcgccagcaaattcgcgacgttgcgccagaaaaagccgacctgccgcgcccgtatcgcctggcgattattcagctgggaacctatgacggcactgtctataacgcccgtcaggtgatcgataccgttgggcatctgtgtgattacattctgtttgattccgcgtgggtcggttatgaacaatttatcccgatgatggcggatagctcgccgctgctgttagaacttaacgaaaacgatccggggatctttgtgactcagtcggtgcacaaacagcaggcgggattctcacagacgtcgcagatccataaaaaagataaccatatccgcggacaggcgcgtttttgcccgcataagcggttgaataacgcctttatgctccatgcttctaccagccctttctatccgctgtttgctgcactggatgttaacgccaaaattcatgaaggggagagtgggcgtcggctgtgggctgagtgtgttgagatagggattgaagcgcgcaaggctattcttgcgcgctgtaagctgttccgcccgtttatcccgcccgttgttgatggcaaattgtggcaggattatccgacatcagtgttagccagcgaccgccgttttttcagttttgagccgggggcgaagtggcacggctttgaaggatatgccgcggatcagtattttgttgatccgtgcaagctgttactcactacaccaggtatcgatgccgaaaccggcgaatatagcgactttggcgttccggcgacgattctggcgcactatctgcgtgagaacggcattgtgccggagaagtgcgatctcaactccattctgtttttattaactccggcggaaagccacgagaagctggcacaactggtggcgatgctggcgcaatttgaacagcatattgaggatgactcgccgctggttgaggtgttgccgagcgtttataacaagtatccggtgcgctatcgcgactacaccctgcgccagttgtgtcaggagatgcacgatctgtatgtcagtttcgacgtcaaagacctacaaaaagcgatgttccgccagcagagtttcccgtcagtggtgatgaacccccaggatgcgcatagcgcttatattcgcggtgacgtggagttggtgcggattcgtgatgccgaagggcgaattgcggcagaaggggcgttgccttatccacctggcgtgctttgcgtggtacccggggaagtctggggtggggcggttcaacgttatttccttgcactggaagaaggggtgaatttgttgccgggattttcgccggagctgcaaggtgtttatagcgaaaccgatgcggatggcgtgaaacggttgtacggttatgtgttgaagtaagaataaaaaaaacgggtcaccttctggcgacccgtttttctttgcgtaattagtggctaaccgtctgtgtgcctgtcgggacacgaacgtgtt

SEQ ID NO: 1806 - protein, 731 aa, Escherichia coli K12
MGQGFPPCPVFLLPRNGFALMKSMNIAASSELVSRLSSHRRVVALGDTDFTDVAAVVITAADSRSGILALLKRTGFHLPVFLYSEHAVELPAGVTAVINGNEQQWLELESAACQYEENLLPPFYDTLTQYVEMGNSTFACPGHQHGAFFKKHPAGRHFYDFFGENVFRADMCNADVKLGDLLIHEGSAKDAQKFAAKVFHADKTYFVLNGTSAANKVVTNALLTRGDLVLFDRNNHKSNHHGALIQAGATPVYLEASRNPFGFIGGIDAHCFNEEYLRQQIRDVAPEKADLPRPYRLAIIQLGTYDGTVYNARQVIDTVGHLCDYILFDSAWVGYEQFIPMMADSSPLLLELNENDPGIFVTQSVHKQQAGFSQTSQIHKKDNHIRGQARFCPHKRLNNAFMLHASTSPFYPLFAALDVNAKIHEGESGRRLWAECVEIGIEARKAILARCKLFRPFIPPVVDGKLWQDYPTSVLASDRRFFSFEPGAKWHGFEGYAADQYFVDPCKLLLTTPGIDAETGEYSDFGVPATILAHYLRENGIVPEKCDLNSILFLLTPAESHEKLAQLVAMLAQFEQHIEDDSPLVEVLPSVYNKYPVRYRDYTLRQLCQEMHDLYVSFDVKDLQKAMFRQQSFPSVVMNPQDAHSAYIRGDVELVRIRDAEGRIAAEGALPYPPGVLCVVPGEVWGGAVQRYFLALEEGVNLLPGFSPELQGVYSETDADGVKRLYGYVLK

SEQ ID NO: 1807 - DNA, 2961 bp, Hafnia alvei
  CDS (185)..(2404)
gatcatcctgatgttctactctcgtaagatgggtagaaaccaagagaagttaaccacgccgacggatcgtcagtcttaatccactcaaccattaacacgcaagttggtaacagcacacagcacagaggatgaatttccgcctctgtgctaataacccagcccacacaagtctggagagttttgcatgaatatcattgccatcatgaacgatttaagcgcttattttaaggaagaacccctgcgcgagctgcatcaagagttagagaaggaaggcttccgtattgcttatcccaaagaccgcaacgatctgctgaagctgattgaaaacaactcccgcctgtgtggcgtcattttcgactgggataaatataacctcgaactcagcgctgaaatcagcgagctcaacaaactgctgccaatttatgccttcgccaatacctattcgacgcttgacgtcaacatgagcgacctgcgtcttaatgttcgcttctttgaatatgcattaggcagcgcgcaagacattgccaccaagatccgccaaagcaccgatcagtatattgataccattctgccaccgctgaccaaggcgctgttcaaatacgtcaaagaagagaaatacacagtctgtacgccggggcatatgggcggaactgcgttcgataaaagccctgtcggtagcctgttctatgatttcttcggtgaaaacaccatgcgttcggatatctcgatctccgtatctgagctcggatcgctgctcgatcatagcggcccacaccgtgacgccgaagagtatatcgcgcgcacgttcaacgccgatcgcagctatatcgtaaccaacggaacatctacggcgaataaaattgtcggcatgtattcatctcctgccggtgccactattctgatagaccgtaactgccataaatcattgacccatttgatgatgatgagcaacgttgtccccgtctatctgcgcccaacccgtaacgcctacggcattttaggcgggataccgcaaagcgagttcacccgcgccagcattgaagagaaagtgaaaaatacgcccaatgcgacatggccggtgcatgcggtagtcaccaactctacctatgacggcctgttctacaataccgaatacatcaaaaacacgcttgatgttaagtcgattcacttcgattcggcatgggtgccttacaccaacttccatccgatttaccaaggcaaagcagggatgagcggtgaacgtgtgccggggaaaatcatctacgagactcagtccacccacaaactgctggcggcattctcgcaggcatcgatgatccacgtgaaaggtgagatcaacgaagaaaccttcaatgaagcctatatgatgcatacctcaacatcaccgcattacgggatcgttgcgtcgacggaaaccgcggcggctatgatgaagggcaacgccggtaagcgtttaattaacggttcaattgaacgagcgatccgcttccgtaaagagatccgccgcttacgtacagaatctgatggctggttctttgacgtatggcagccggataacattgacgaggttgcttgctggccactcaatccacgtaatgaatggcatggattcccgaacatcgacaacgatcatatgtatcttgatccgatcaaagtcactctgctgaccccaggtttaagccccaatggcactctggaagaggaagggataccggcgtcgatcgtgtcgaaatatctggatgagcacggcatcatcgtggaaaaaaccgggccatataacctgctcttcctgtttagtatcgggatcgataaaaccaaggcgttgagcttgttgcgggcattaaccgatttcaaacgcgtgtatgacctcaacctgcgcgtgaaaaacgtgttgccatcgctctataacgaggcgcctgatttctataaagagatgcgaattcaggagttggctcaggggattcatgctctggtgaaacaccacaatctaccagacctgatgtatcgtgcatttgaggtattaccaaagctggtgatgacgccgcatgatgcgttccaagaagaagtgcgtggcaatattgagccatgtgccttggatgatatgttagggaaagttagcgccaacatgatcttgccgtatcctccgggtgttccggtggttatgccgggagaaatgctcactaaggagagccgccctgttctgagcttcttgcagatgctatgtgaaattggcgcacactatccgggctttgaaacggatattcacggcgttcatcgtgatggtgcaacgggtaaatacatggtcgtggtgctcaaacaaggcgcagatgaaccgggtgataaaccgagtgatacggtgaagaaagcgccgggtaaaaaaccatcagcggcgaagaagtcataacggcgagaagttacaggtaacgcttatcccctgagtgataggttcttgtcatgatggggataaagcgggtgcctgagagccaaccatgcatgaaaacaatttgagaagactgggaaggttaggcgccatcccagtctgattttgccgttacatattgccgttacaacgcgtgcttatcttcgtagtttaagaacgcggcaacctctgtttttccctgcttaattcgtagctcacacagcgaaccacgtaccatccaggtaaagatcaatagcgtaaaacacatcactattaatccgtaaagcaacagcttacgcgacatcaaagcctccaattgcattgctgcattgaagaggctatcctcacattgttcagatgtggttaggattgcctcaggttaatgtaagttgacctggggcttttactttctgcctcaccacatatttcatgctcaaggcaaaaagcctcaagcacccgccgtgattctatccaaacaatgcttagctatcgcgcgtctattgccgttacatcagagttgcttgaataactgcaaaacgctt

SEQ ID NO: 1808 - protein, 739 aa, Hafnia alvei
MNIIAIMNDLSAYFKEEPLRELHQELEKEGFRIAYPKDRNDLLKLIENNSRLCGVIFDWDKYNLELSAEISELNKLLPIYAFANTYSTLDVNMSDLRLNVRFFEYALGSAQDIATKIRQSTDQYIDTILPPLTKALFKYVKEEKYTVCTPGHMGGTAFDKSPVGSLFYDFFGENTMRSDISISVSELGSLLDHSGPHRDAEEYIARTFNADRSYIVTNGTSTANKIVGMYSSPAGATILIDRNCHKSLTHLMMMSNVVPVYLRPTRNAYGILGGIPQSEFTRASIEEKVKNTPNATWPVHAVVTNSTYDGLFYNTEYIKNTLDVKSIHFDSAWVPYTNFHPIYQGKAGMSGERVPGKIIYETQSTHKLLAAFSQASMIHVKGEINEETFNEAYMMHTSTSPHYGIVASTETAAAMMKGNAGKRLINGSIERAIRFRKEIRRLRTESDGWFFDVWQPDNIDEVACWPLNPRNEWHGFPNIDNDHMYLDPIKVTLLTPGLSPNGTLEEEGIPASIVSKYLDEHGIIVEKTGPYNLLFLFSIGIDKTKALSLLRALTDFKRVYDLNLRVKNVLPSLYNEAPDFYKEMRIQELAQGIHALVKHHNLPDLMYRAFEVLPKLVMTPHDAFQEEVRGNIEPCALDDMLGKVSANMILPYPPGVPVVMPGEMLTKESRPVLSFLQMLCEIGAHYPGFETDIHGVHRDGATGKYMVVVLKQGADEPGDKPSDTVKKAPGKKPSAAKKS

SEQ ID NO: 1809 - DNA, 4341 bp, Escherichia coli
  CDS (660)..(2858)
ggatcccgcccgcccacgccatttcattactgaaaccggtattggctatcggtttatgctttgaatattaattttaatacagcctgccttttattaattaaagccgtaataataaatacggctttttatcttaaacaacacacaaaaataacaattcaatattttatattactgagtaaaaagctcatcattaaataaattaagattgatcattttttattgatcaccttcacagttcaaccgtatttcctggatagaatatcttcaccttcattcacatcaggaaaggtaaattaaatggaaaataacagccgcactatgccccatataaggcggacaactcatattatgaagtttgctcatcgcaatagcttcgactttcacttcttcaatgcccgttagtctaccgactaagggcacttcagcgtacaggtcttcctgactctctgtattacaggcatatgcctgtattccgcagtgctcattctctgttaacccttgtattatcagccacctgactggtaagggtttctgcattctgaaaaaagcaatctacctgatttatttatcagcggggtaactttgcttttttccggcacgatcgatttctcattcgagaaattgaggacctgctattacctaaaataaagagatgaaaaatgtcaaaattaaaaattgcggttagtgattcttgcccggactgttttaccacgcagcgagaatgtatctacattaatgaaagtcgtaatatcgatgtggcggcaatagttttatcgctcaacgatgttacatgcggaaaactcgatgaaatcgatgccacgggttatggcatcccggtatttattgctactgaaaatcaagaacgtgtacccgcagagtatttgccccgtatttcgggtgtctttgagaattgcgaatcgcgacgagaattttatggtcgccagttagaaaccgctgccagccattatgaaactcaactgcgcccacctttcttccgcgcactggtcgattatgtcaatcaaggtaacagcgcgtttgattgccctggtcatcagggcggcgaatttttccgtcgccatccggcggggaatcagtttgtggaatactttggtgaggcgctgttccgtgccgacttgtgcaacgccgacgtagcgatgggcgatctgctgattcacgaaggcgcgccatgcattgcacagcaacatgcggcaaaagtgtttaatgccgataaaacctacttcgttttaaatggcacttcatcttctaacaaagtggttttaaacgccctgctaacaccgggtgatctggtgctgtttgatcgcaataaccacaaatctaaccaccacggagcgttgctacaggctggtgcaacaccggtttatctggaaacggcacgtaacccgtatggctttatcggtggcattgatgcgcactgttttgaagaaagttacctgcgtgagctgatcgcggaagtcgcaccgcagcgggcaaaagaggctcgtcctttccgcctcgctgtgattcagttaggcacctacgacggtacgatttataacgcccgccaagtggtggataaaattggtcatctgtgtgactacatcctgtttgactcagcatgggtcggctatgaacagtttattccgatgatggcggactgttcgccgctgttgctggatcttaatgagaacgatccgggtattctggttacgcaatctgtgcataaacaacaggctggtttttctcagacttcacaaattcataaaaaagacagccacatcaaagggcaacagcgttatgtaccgcacaaacgcatgaacaacgcctttatgatgcacgcctccaccagcccgttctatccgctgtttgccgcactgaatatcaacgccaaaatgcatgaaggtgtcagcggtcgtaatatgtggatggattgtgtggtaaatggcattaatgcccgcaaactgatcctcgataactgtcagcatattcgtccgttcgtacctgaactggtggatggtaaaccctggcagtcgtatgaaacagcgcaaattgcggttgatctgcgcttcttccagtttgtaccaggggaacactggcattcttttgaaggctatgcagagaatcaatactttgtcgatccatgcaaactgttgctgacaaccccaggtattgatgcacgtaacggcgaatatgaagcgttcggtgtacccgcgacgattcttgctaacttcctgcgcgaaaatggcgtagtgccggaaaaatgcgatcttaactccatcctcttcctgctgactccggcagaagatatggccaaacttcagcaacttgttgccctgctggtacgcttcgaaaaactgcttgagtccgacgcgccattagcagaagtgctaccttccatctacaaacagcatgaagagcgctacgccggttataccctgcgtcagttgtgtcaggaaatgcatgatttgtatgcccgccacaacgtgaaacaactgcaaaaagagatgttccgtaaggagcacttcccacgcgtcagcatgaatccgcaagaagccaactacgcctatttacgcggtgaagtggaactggttcgtctgccggatgcagaaggccgtatcgctgccgaaggtgcgcttccttatcctccgggtgtgctgtgtgttgttccgggtgaaatctggggtggtgctgttctgcgttacttcagcgctctggaagaagggatcaacctgctgccaggttttgcaccggagctgcagggtgtctatatcgaagaacatgatggtcgtaagcaagtttggtgctatgtcatcaagcctcgtgatgcgcaaagcaccctgttgaaaggggaaaaattatgagtcaggctaaatcgaacaaaatgggcgtcgttcagttaaccatactgacgatggtcaacatgatgggctccggtatcatcatgctgccgacaaagcttgccgaagtcgggacaatctcaattatctcctggctggtgacagccgtaggctcaatggcactggcatgggcattcgcaaaatgcggtatgttcagccgtaaatcaggcggtatgggcggttatgccgagtatgctttcggtaaatccggtaactttatggcgaactatacctacggcgtctcactgctgattgctaacgtcgcgattgctatttcggcggttggttacggcaccgaactgctcggcgcgagtttgtcgccagtgcagattggtcttgcgaccatcggggtgctgtggatttgtaccgtggctaactttggtggtgcgcgcattaccgggcaaatcagtagcattaccgtgtggggggtcattattccggtcgtcggtctgtgcattattggctggttctggtttagcccgacgctgtacgttgattcctggaatccgcatcatgcaccgttcttcagtgcggtaggttcttccatcgctatgacgctgtgggcttttcttggtctggagtctgcgtgtgcgaatactgatgtagtggaaaacccggaacgtaatgtgccaatcgcggtactcggcggtacgttaggtgcggcggtgatttatatcgtctccaccaacgtgattgccgggattgtgccaaatatggagctggcaaattcaacggcaccatttggtctggccttcgcgcagatgttcacgccggaagtgggtaaagtcattatggcgctgatggtgatgtcctgctgcggttcgctacttggctggcagttcaccattgcccaggtgtttaaatcttcatctgatgaaggctacttccctaaaattttctcccgtgtaaccaaagtggatgcaccggtgcagggaatgttgaccattgtgattattcagagtggattggcactgatgaccattagcccgtcgctaaacagtcagttcaacgtgctggttaacctggccgtggtgaccaatatcattccgtatattctgtcaatggcggcattagtcattattcagaaggtcgctaatgtgcccccctcaaaagcgaaagttgcaaactttgttgcttttgttggcgcgatgtatagcttttatgcgctgtactcatccggggaagaagccatgctgtacggttccatcgtgaccttccttggttggacactgtatggtctggtatcaccacgctttgaactgaaaaataaacacggttaataaaacaaagtaaaaaagggcgattgaatgatcgccctttctgtttgttggcaaatagttcgttatttatgccgcatccggcagatgtagggtctaaacgcgatcgaacacagcaactatttgcgtaattatatggggcatctgcgacaaaaactggaacaggatcc

SEQ ID NO: 1810 - protein, 732 aa, Escherichia coli
MSKLKIAVSDSCPDCFTTQRECIYINESRNIDVAAIVLSLNDVTCGKLDEIDATGYGIPVFIATENQERVPAEYLPRISGVFENCESRREFYGRQLETAASHYETQLRPPFFRALVDYVNQGNSAFDCPGHQGGEFFRRHPAGNQFVEYFGEALFRADLCNADVAMGDLLIHEGAPCIAQQHAAKVFNADKTYFVLNGTSSSNKVVLNALLTPGDLVLFDRNNHKSNHHGALLQAGATPVYLETARNPYGFIGGIDAHCFEESYLRELIAEVAPQRAKEARPFRLAVIQLGTYDGTIYNARQVVDKIGHLCDYILFDSAWVGYEQFIPMMADCSPLLLDLNENDPGILVTQSVHKQQAGFSQTSQIHKKDSHIKGQQRYVPHKRMNNAFMMHASTSPFYPLFAALNINAKMHEGVSGRNMWMDCVVNGINARKLILDNCQHIRPFVPELVDGKPWQSYETAQIAVDLRFFQFVPGEHWHSFEGYAENQYFVDPCKLLLTTPGIDARNGEYEAFGVPATILANFLRENGVVPEKCDLNSILFLLTPAEDMAKLQQLVALLVRFEKLLESDAPLAEVLPSIYKQHEERYAGYTLRQLCQEMHDLYARHNVKQLQKEMFRKEHFPRVSMNPQEANYAYLRGEVELVRLPDAEGRIAAEGALPYPPGVLCVVPGEIWGGAVLRYFSALEEGINLLPGFAPELQGVYIEEHDGRKQVWCYVIKPRDAQSTLLKGEKL

SEQ ID NO: 1811 - DNA, 1850 bp, Bacillus subtilis
  CDS (312)..(1784)
aagctttaagcagttcttcacgatccgcccctttttcatatgcaagctcaacctgctggaaaaatgcaatcacatccactgcttcttcggttgtccaatcttcattcatcggatattgatactccattttcttcactccttgtagatttacttcccttaagagaaagcatcttcatttgatcataaattgttctttacattctttcaagttcataatataattcatttgttttacgtctaaaaaacggttgagaaactgattttaatacacactattatgcataggtatgattacaaaggtgggaaaacaaatgtcgcaacatgaaacacccttatacacaggactgaaaaagcatgcaagcagacagcctgttcaattccacattcccggccataaaaaaggggcaggaatggacccagaattcagacaatttatcggtgaaaacgcgttaagcatagatttgattaatattgaaccattagacgatctgcacgcgccaaaaggcattattaaacaagcacaagatctggctgctgaagcatttggagcggatcatacatttttttctgttcaaggaacaagcggcgccattatgacaatggtaatggctgtttgcggacctggtgataaaattattattccaagaaatgttcataaatcaattatgacagctattgtattttccggagcggttccaatttttattcatcctgaaattgacaatgaattgggcatctcccacggaattacacttgaatctgctaaacgggcgcttaccgagcatccggatgcaaaagggcttctcgtcatcaacccgacatatttcggtgttgcagccgacttaaaaagcatcgtagaactcgctcattcgtttgatgtgccagtgcttgtggatgaagcacacggcgttcacattcattttcacgacgaattgccgctatcggctatgcaggcaggagcggacatagcagcgacaagtgtacacaagctgggcggatcactgacacaaagctctattttaaacatgagagaaggccttgtatctaaagacagagtgcaatccatcctgagcatgctgacaactacgtcaacttcttacttgcttctcgcttctttggatgttgccagaaaacgccttgcaacagaaggccgccagcttgctgaggaaacactcaagcttgccaatcagacgagagatcgcctcaatcagattgaaggcatttattgtgtcggttctgagattcttgggtcgaaagcagcttacagctatgatccgacaaaattgattatctctgtgaaaagtcttggcctgacaggacatgacgtggaaaaatggcttcgtgaatcctttaatattgaggtggagctttctgatctgtacaatattttgtgtattttcactcctggtgacagccaaaatgatgcagaccggcttgtagaggctttaactgagatcgcacagcaaatgtcagaacaagatgtaacacatcagcaaactgaggttctgcttccagaaatacctttattggcaatgactccgcgtgatgctttctatgcaaatacggaagtcatcccattaaaagaagcatccggacggattattgctgaatttgtcatggtatatccgcctggtattccaatcttcatcccaggagaaattattacagaagaaaacatcagctacatttttaaaaaccttgacgcaggcctccctgttcaaggacctgaggactcgactttacatatgatccgggtcatcaaagaacaaaaagcaattcaataaaaaataaaaagccatgcggctttaagccgcatgcttttttttactcttcatcaacaggacattgac

SEQ ID NO: 1812 - protein, 490 aa, Bacillus subtilis
MSQHETPLYTGLKKHASRQPVQFHIPGHKKGAGMDPEFRQFIGENALSIDLINIEPLDDLHAPKGIIKQAQDLAAEAFGADHTFFSVQGTSGAIMTMVMAVCGPGDKIIIPRNVHKSIMTAIVFSGAVPIFIHPEIDNELGISHGITLESAKRALTEHPDAKGLLVINPTYFGVAADLKSIVELAHSFDVPVLVDEAHGVHIHFHDELPLSAMQAGADIAATSVHKLGGSLTQSSILNMREGLVSKDRVQSILSMLTTTSTSYLLLASLDVARKRLATEGRQLAEETLKLANQTRDRLNQIEGIYCVGSEILGSKAAYSYDPTKLIISVKSLGLTGHDVEKWLRESFNIEVELSDLYNILCIFTPGDSQNDADRLVEALTEIAQQMSEQDVTHQQTEVLLPEIPLLAMTPRDAFYANTEVIPLKEASGRIIAEFVMVYPPGIPIFIPGEIITEENISYIFKNLDAGLPVQGPEDSTLHMIRVIKEQKAIQ

SEQ ID NO: 1813 - DNA, 3091 bp, Lactobacillus sp
  CDS (572)..(2767)
cactgccatataggaacgatgatagtatctcttcatgagtatcgataaatactctgtaaatattaatcatgggcaattagcaccttctcattgaatatagtaatattaactattaataacagattatgattaatataatatgaacatacctaagtgtcccttccgttcaagcacttagacggtaaattacaacattcgcttacaacttctattaaatcgaaaaagttaatatttcatatataaacagtaattagttatattgatccacaaagccccctagtttccgcaataaattccgatccgccttttttatacacattctcattattgtctcagttgcaaacattccctttttcacttttaaagtaaccgttacctttacttatacgtcggcgtttgttcccattaatttttagttctatttttttattcttttaaagaaaaataaggatgattccgccttgattaaaatcaataatggtttatactagattatgtattcaagttgaattcggttacatcacatagtgtgttgtaattacggatttacatatttttaggaggttttatgatgagttcttctcttaaaattgcttcgactcaagaagcgcgtcaatatttcgatactgaccgcgttgttgtcgatgctgtaggctctgattttactgatgtcggtgctgttatcgcaatggattacgaaacagatgtcatcgacgctgctgatgcaactaagtttggtattcctgtttttgccgtaactaaggatgcccaagctatcagtgctgatgagctgaagaagattttccacatcattgatttggaaaacaaatttgatgctactgttaacgctcgtgaaatcgaaactgctgttaacaactacgaagacagcattttaccaccattcttcaagtcattgaaagaatacgttagccgtggtttaatccaattcgactgcccaggtcaccaaggtggtcaatactacagaaagcacccagctggtcgtgaattctacgacttcttcggcgaaactgtcttccgtgcagacttatgtaacgctgacgttgccttgggtgacttgctgatccacgaaggtcctgctgttgctgctgaaaagcatgctgcacgtgtttacaacgctgacaagacttacttcgttttaggtggttcttccaacgctaacaacactgtaacatctgctttagtttctaacggcgacttggtattgttcgaccggaacaaccacaagtccgtttacaactcagctttagctatggctggtggccgtcctgtttacctccaaacaaaccgtaacccatacggcttcatcggtggtatctacgacagcgacttcgatgaaaagaagatccgtgaactggcagctaaggttgacccagaacgtgctaagtggaagcgtccattccgtctggctgttatccaattaggtacttacgatggtactatctacaacgcacacgaagttgtaaagcgtatcggtcacctttgtgattacatcgaattcgactctgcttgggtaggttacgaacaattcattcctatgatgcgtaactcttcaccattattgattgatgaccttggtccagaagatcctggtatcattgttgttcaatcagttcacaagcaacaagccggcttctcacaaacttcacaaatccacaagaaggatagccacatcaagggtcaattacgttactgtgaccacaagcactttaacaactccttcaacttgttcatgtctacttcaccattctacccaatgtatgcagcattagacgttaacgctgctatgcaagaaggcgaagcaggtcgcaagttatggcatgaccttctgattactaccattgaagctcgtaagaagttgatcaaggctggctcaatgttccgtccattcgttccacctgttgttaacggcaagaagtgggaagatggcgacactgaagatatggctaacaacattgactactggcgctttgaaaagggtgctaagtggcatgcttacgaaggctacggcgacaaccaatactacgttgatccaaacaagttcatgttaactacacctggtatcaacccagaaactggtgactacgaagacttcggtgttccagctactatcgttgctaactacttacgtgaccacggtatcatccctgaaaagtctgacttgaactctatcttgttcttgatgactccagctgaaactccagctaagatgaacaacctgatcactcaacttcttcaattacaacgcttgatcgaagaagatgctccattgaagcaagttcttccttcaatctacgctgctaacgaagaacgttacaatggctacactatccgtgaactttgccaagaattgcacgacttctacaagaacaacaacacgttcacataccagaagcgtctcttcttacgtgaattcttcccagaacaaggtatgcttccatacgaagctcgtcaagaattcatccgcaaccacaacaagcttgttccattgaacaagatcgaaggcgaaatcgccctcgaaggtgctcttccataccctccaggagtattctgtgtagcaccaggtgaaaagtggtcagaaactgctgttaagtacttcactatcttacaagatggtatcaacaacttccctggattcgctccagaaatccaaggtgtatacttcaagcaagaaggcgacaaggttgttgcttacggtgaagtttacgatgcagaagttgctaagaacgatgatcgttacaacaactaataactgcattgcctgattaacaggcaggaaaaaaccggcgttatgccggttttttgttgcacaatttttcttttttaacttgattgtcaataagtaagttttatccatagtagttccatagctattgaactattaaaccaagaccaatatccgtgcaaattttaaggacctggcagaagttaacgagttagatactccttgatctctacacactacggagctcactcattgtggagattaaggttcctaacataggtagtacaccttccgatcactaaatctaacaggacgaggatatatgcagattcctcgaatccggttcca

SEQ ID NO: 1814 - protein, 731 aa, Lactobacillus sp
MSSSLKIASTQEARQYFDTDRVVVDAVGSDFTDVGAVIAMDYETDVIDAADATKFGIPVFAVTKDAQAISADELKKIFHIIDLENKFDATVNAREIETAVNNYEDSILPPFFKSLKEYVSRGLIQFDCPGHQGGQYYRKHPAGREFYDFFGETVFRADLCNADVALGDLLIHEGPAVAAEKHAARVYNADKTYFVLGGSSNANNTVTSALVSNGDLVLFDRNNHKSVYNSALAMAGGRPVYLQTNRNPYGFIGGIYDSDFDEKKIRELAAKVDPERAKWKRPFRLAVIQLGTYDGTIYNAHEVVKRIGHLCDYIEFDSAWVGYEQFIPMMRNSSPLLIDDLGPEDPGIIVVQSVHKQQAGFSQTSQIHKKDSHIKGQLRYCDHKHFNNSFNLFMSTSPFYPMYAALDVNAAMQEGEAGRKLWHDLLITTIEARKKLIKAGSMFRPFVPPVVNGKKWEDGDTEDMANNIDYWRFEKGAKWHAYEGYGDNQYYVDPNKFMLTTPGINPETGDYEDFGVPATIVANYLRDHGIIPEKSDLNSILFLMTPAETPAKMNNLITQLLQLQRLIEEDAPLKQVLPSIYAANEERYNGYTIRELCQELHDFYKNNNTFTYQKRLFLREFFPEQGMLPYEARQEFIRNHNKLVPLNKIEGEIALEGALPYPPGVFCVAPGEKWSETAVKYFTILQDGINNFPGFAPEIQGVYFKQEGDKVVAYGEVYDAEVAKNDDRYNN

SEQ ID NO: 1815 - DNA, 1449 bp, Bacillus halodurans
  CDS (1)..(1449)
atgaaaaaagcctcaacattgccgctatttgaacggctcgttcagcatgatcgcgggggacctatctcgtgccatgttccaggccataagcagggggctctttttcataaggatgcctgttcatattttcaaagcattttatcccttgatgtaacggagctaaccggccttgatgatctccatgatcccagaggagttattgcagaggctcaagctttgacagcccgctacgtcggggcagaagcgacgtgttttttagtcaatggctcgacggttggtaatttggcaatgattttaggtacacttgagcctggcgatactgtttttgtacaaagggattcgcataaatcggtgatgaatgggttagcgatggcaagggtccatccaatctttctttcaccatcctacgatgagagaacgcaattaccaacaggtattaccgaacaaacgttaaaacaagcactaatagaacacccgaatgggaaagcacttattttaacatatccatcgtattatggggttgcccgctcgatccgtccgctcgtccagatggcgaaagaagctggattgtacgtacttgtggatgaggcgcacggagcacattttccggtaggtgatccatttccgaaacaagcacttgagcaaggggccgacgtagtcgttcaatctgcgcataaaaccttacccgccttaacaatgggctcctatcttcactttgctcatggactacattcgaaaatcaaggattccattcgagagcaattgcagattttgcagtcgagcagcccatcctatccgattcttgcctcattagatgcagcaagaggatttttagaggatctcacgaatgtaaaagatacgctcgattccatcgcggagatgaataggcggattgaacaggtcgagcgtttgtcggttgctacattttccccgctacccaccgatccattaaaaacggtgattacagtagaaggggcaacaggatttgccttgcaaaccgaacttgaaaaagaggggatatactcagagctggcagacgatcgtcatgttttgcttatgtgggggctaacccctttacagaaagtccgacaagaggaaatcatcgacaaaatgtgccgagcaaccaagcggcttcctgcgcttgagcaaataagtaaagggtgccccctatcgttatcgtggcaagcacacacgtcgcttgatctatcatatgatgaacaaaaacgatattcaattgaagaggttgccgtggaagaggctgtggggaaagtgagtggagcaacggttatcccttatcccccaggggtacctctcctattaaaaggggaaaaaatcacagaaccgttaattgcccaatttcagcagttgcaggaggcaggggcccgttttcaggggagaccttctgagcaacaagggttgtatgtgtttacgttggaggctatgacatga

SEQ ID NO: 1816 - protein, 482 aa, Bacillus halodurans
MKKASTLPLFERLVQHDRGGPISCHVPGHKQGALFHKDACSYFQSILSLDVTELTGLDDLHDPRGVIAEAQALTARYVGAEATCFLVNGSTVGNLAMILGTLEPGDTVFVQRDSHKSVMNGLAMARVHPIFLSPSYDERTQLPTGITEQTLKQALIEHPNGKALILTYPSYYGVARSIRPLVQMAKEAGLYVLVDEAHGAHFPVGDPFPKQALEQGADVVVQSAHKTLPALTMGSYLHFAHGLHSKIKDSIREQLQILQSSSPSYPILASLDAARGFLEDLTNVKDTLDSIAEMNRRIEQVERLSVATFSPLPTDPLKTVITVEGATGFALQTELEKEGIYSELADDRHVLLMWGLTPLQKVRQEEIIDKMCRATKRLPALEQISKGCPLSLSWQAHTSLDLSYDEQKRYSIEEVAVEEAVGKVSGATVIPYPPGVPLLLKGEKITEPLIAQFQQLQEAGARFQGRPSEQQGLYVFTLEAMT

SEQ ID NO: 1817 - DNA, 2196 bp, Sinorhizobium meliloti
  CDS (1)..(2196)
atgcgcagcctcgcagaggcgattgaaaaggaaggttatcgggtcgttgcagggctcacctatgaggatgcacgccgcctcgtgaacgtcttcaacaccgagtcctgctggctgatttcagtcgacgggacggaatcaagtacgacgcgctgggagattttagccgagctgctcgccgcgaaacgctcccggaacaacctgctgccaatctttctgtttggcgacgatacaacggcggaaatggtgccggcgcccgtgctgcgccacgccaatgcctttatgcgtcttttcgaggattctccggaattcatggcgcgcgcgatcgtgcgcgcggcgcagaattatcttgagaggcttccgcctccaatgttcaaggcgttgatggaatacacgcttcacggcgcctattcctggcacacgccagggcacggaggcggggtggcgtttcgcaagagcccggttggccagctcttttatacgttttttggagagaacacattgaggtcggacatttctgtgtccgtcggcagcgttggttcgctcctcgatcatgttgggccgattggcgagggtgagcgcaatgccgctcgcatatttggtgcggatgagacgctgttcgttgtcggcggcacctcgaccgccaataagatcgtgtggcagggtatggtcactcggaacgacctcgtcctctgcgaccgaaactgccataagtctatcctgcactcgctgattatgacgggtgcaacgccgatttacctgacgccctcacgcaacggcctcggcatcatcggaccgattgcgaaggagcagtttaccccagaggcaatcgcgcacaagatcgtcgccagtccgtttgccagtgagacgaacggtaaagtgcgcctgatggtagtgacaaactccacctatgatgggctctgctacaatgtagatggaatcaaatcggcgctcggcgatgcggtggaggtactgcatttcgacgaggcctggtttgcttacgccaattttcacgaattctacgatggttatcacgcgatctcttcaacgaagcccgcgcgctcgcaagaagccatcacattcgcaacccagtccacgcacaagctgctggccgccttctctcaagcttcaatgcttcatgtgcagcatgccgtggcgaagcaactcgacatcacacgcttcaacgaagcgttcatgatgcacacatcgacatcgccgcaatatgggatcatcgcctcgtgcgacgtggctgctgccatgatggagcagcccgccgggcgggcgctggtacaggagaccattgacgaagccatgagtttccgccgagccgtcaacgccgtgcggacacagatgcaggattcctggtggttcgaagtctgggagccccccatcgcggatcgggccccgagcgacgccacgtcggattggcttctaaagcccggtgacgcttggcatggtttcgaagacctggctgagaatcacgttatggttgacccgatcaaggtcacgatcctttcgcccggactcaatgcgggcggagcgatgctggagcatggtattccggctgcagtcgtcacgaagttcctttcttctcgccggatcgaaatcgagaaaaccggcctctactctttcctggtgctcttctccatggggatcacacggggcaagtggagcaccctgatcaccgagctcttgaacttcaaagacctctatgatgccaatgcgcctctttcacgcgcccttcccgccctcgcggcagcccatccggacgtctaccgtgcaatgggccttagagatctttgcgagaaaattcacgacgtgtaccgcagcgatggcgtgccgaatgcccagcgcgagatgtacaccgtgctacccgaaatggcactgcgcccggcagacgcctacaaccgcctggtcaaggggtgcgtcgaaagcgtcgatatcgacgaattgatcggccggacactcgcagtcatgattgtaccctatcctccgggcatcccgctcatcatgcctggcgagcggatcactgcagccacaagatcgatccaggactatctcgtctacgcccggagtttcgacaggaaattcccgggatttgagacggacatccacggactccgtttcgtcgctaacccgagtggacggagatatctcgtggattgcatcgtcgaggagggacaagatgataccgcgtga

SEQ ID NO: 1818 - protein, 731 aa, Sinorhizobium meliloti
MRSLAEAIEKEGYRVVAGLTYEDARRLVNVFNTESCWLISVDGTESSTTRWEILAELLAAKRSRNNLLPIFLFGDDTTAEMVPAPVLRHANAFMRLFEDSPEFMARAIVRAAQNYLERLPPPMFKALMEYTLHGAYSWHTPGHGGGVAFRKSPVGQLFYTFFGENTLRSDISVSVGSVGSLLDHVGPIGEGERNAARIFGADETLFVVGGTSTANKIVWQGMVTRNDLVLCDRNCHKSILHSLIMTGATPIYLTPSRNGLGIIGPIAKEQFTPEAIAHKIVASPFASETNGKVRLMVVTNSTYDGLCYNVDGIKSALGDAVEVLHFDEAWFAYANFHEFYDGYHAISSTKPARSQEAITFATQSTHKLLAAFSQASMLHVQHAVAKQLDITRFNEAFMMHTSTSPQYGIIASCDVAAAMMEQPAGRALVQETIDEAMSFRRAVNAVRTQMQDSWWFEVWEPPIADRAPSDATSDWLLKPGDAWHGFEDLAENHVMVDPIKVTILSPGLNAGGAMLEHGIPAAVVTKFLSSRRIEIEKTGLYSFLVLFSMGITRGKWSTLITELLNFKDLYDANAPLSRALPALAAAHPDVYRAMGLRDLCEKIHDVYRSDGVPNAQREMYTVLPEMALRPADAYNRLVKGCVESVDIDELIGRTLAVMIVPYPPGIPLIMPGERITAATRSIQDYLVYARSFDRKFPGFETDIHGLRFVANPSGRRYLVDCIVEEGQDDTA

SEQ ID NO: 1819 - DNA, 1380 bp, Listeria innocua
  CDS (1)..(1380)
atgcgagatcaatctaaaatgcctttagtggaacggttagatgctcatgctaaatcctgcccaatatcactccatgttccaggacacaaaagtggagccatttatccagctgtatggcaaaatttattaaaatgggatgtaacagaaatcaccgggatggacgacttacatcacccagaagacgtgattttggaagcagaggagttactttctgaatgctatggaagtaaaaaaagctattttctagtcaatgggacaagcggaggaagcttggcggttattatggcgacgttaaagcgcggggagaaagttttagtgccaagagatgcacataaatcaatcttgcatggcatcgaactcgccggtggaaaaccgattttcttaactccggcaaccaataaagaagtcggcgtcgcgagtggcgtgacaaccgaacttctggaagaaaccttacataatcacccagatataaaactatgtattttcacttatccgagctattatggaacgacttttaatttagaaaaatgtattcgaattgcgcatcaatatggcgcggttgtgtttgtcgatgaggcgcacggggcacattttttaacgagctctgagtttccaaaaagtgcagtggagcttggtgcggatgtagttgttcagtcggcgcataagacgctaccggcgctaacgatgggatcctatttacatgtcgtgaatgatttaccggtttttgaaaaactagcttattatctgcaagtatttcaaacgagtagcccatcttatttaatcatggcgtcactggatgcggcgcggaaatatgcggcaacttacacagcagcagacgtcgaagctttttggaaaatgcgtgctagatggattaaatggctaacgaagaataaatttgaagtcattttgccagatgatccacttaaaatcatcgtccgcaaaacaggctacacgggctacgaattgcaaacgatttttgaagaaagttcttattttccagagcttgccgacgagtcacaggtattactgattttaccattaatcaaaaaagggattgatttcacgccaattagtcggattcattctccatcgaaaaaagaaatcgcgaaacaaccatatgaaatgtcagcgccttttgcgtcaggtcttgcgttaacttacgaagaaatgcacgcccgcgcgaccgaatttgtgtcattagatgaagctacgacacgcgtttcggctgaaacaatctcgctttatccgccgggaatcccagctattatccgcggagaaagtatcacagaaaaacatatccgcgaactaaaaagtattcgctcgcggcactaccaaggcggcgaaaaactagccgagaattacatccgtatattccgctaa

SEQ ID NO: 1820 - protein, 459 aa, Listeria innocua
MRDQSKMPLVERLDAHAKSCPISLHVPGHKSGAIYPAVWQNLLKWDVTEITGMDDLHHPEDVILEAEELLSECYGSKKSYFLVNGTSGGSLAVIMATLKRGEKVLVPRDAHKSILHGIELAGGKPIFLTPATNKEVGVASGVTTELLEETLHNHPDIKLCIFTYPSYYGTTFNLEKCIRIAHQYGAVVFVDEAHGAHFLTSSEFPKSAVELGADVVVQSAHKTLPALTMGSYLHVVNDLPVFEKLAYYLQVFQTSSPSYLIMASLDAARKYAATYTAADVEAFWKMRARWIKWLTKNKFEVILPDDPLKIIVRKTGYTGYELQTIFEESSYFPELADESQVLLILPLIKKGIDFTPISRIHSPSKKEIAKQPYEMSAPFASGLALTYEEMHARATEFVSLDEATTRVSAETISLYPPGIPAIIRGESITEKHIRELKSIRSRHYQGGEKLAENYIRIFR

SEQ ID NO: 1821 - DNA, 2307 bp, Yersinia pestis
  CDS (1)..(2307)
atgattgatttaagcagtcacaagaaacgcaacgttttagtggttgacagcaatattcgtgatatcaataccgctaatggtcgggcggtaaacgaacttatcattgcgcttaatgacattaattttaatgtgattgcggcggcgacgtttgaagatggcgcggcaacagtgatctccgactcttcgttgtgctgtatttttgtcgattggacttcgggtggtaatgatgatgaatcccatagtcaggcatttgcattgctacaagacattcgtcgccgtaataaatcagtgcctgtgttattgatggctgagcattcatgtatcaatagcttaagtttggagaccatgcagcttgttaatgaatttgtttggatgcatgaagatacctccgagtttatcgctgctcgtgccaaagcactcatcatcaagtattaccagcagttgctgccgccttttacgcaagcgctgtttcaatatacgcaagataatcctgaatattcatgggctgcccccggtcatcaagggggcgttgccttcagtaagacggcggttggacgcgagtttcttgatttctttggcgagaatctatttcgtacggatactggtattgaacgtgagtcattgggatctttactggatcacagtgggccgataaaagagtcagaagcgtatgccgcacaagtttttggtgcacatgcaagttactcgatgcttaatggcacatcgggctctaatcgcgccattatggccgctgtcgtgggagataagcagatcgcattgtgtgatcgtaactgtcataaatccattgagcagggattggtcctgtcgggtgcattaccggtattttttattccaacccgtaaccgctatggcattattggaccaattcctaaagcacaattccaacccacggctattgcacaaaaaattgaacaaaaccccttaaagtcattggcttgtgatagcaagcccgtctatgcagttatcacgaattgtacctatgacggtatgtgctataacgcccaacaggcacaggatttattggcaaaaagcgttgatcagattcatttcgacgaagcttggtacgcctatgcccgttttaatcccctttatcgggagcgttttgcgatgcgtggtgacccggctgaccatgatgcgctgggaccaactatttttgctacacaatcaacgcataaattattggcagcgctgtcgcaagcttcttatattcatgtgagaaatggcaaaaagccgatagaacattcgcggtttaatgagtcgtatatgttgcagtcaaccacttcgccattgtacgccattattgctgccaatgaagtgggggcggcgatgatggaaggcgggcaggggctagcattgacacaagaggtgatcgatgaagctgttgattttcggttggcgctggctcgtgcacatgatgcttttgcaaaacaaggcgaatggttctttaaaccttggaatacaccggaaataacggatagcaaaagcggtaaaaagttacctttctcccaagcatcacgagagcaactgacaaccgatcccgcctgttgggttctcaagccgggagacccgtggcatggtttcgagcagttggaagaagattggtgcatgttggatccgatcaaggccgggattatggtgccgggaatgggggatgacggtaagttgtcagaaaagggaattcccgcagcgatagtgaccgccttccttgggcagcggggaattgtaccgtcgcggaccacggattttatggtgctgtgcttgttttcggtgggtgtaacgaaaggtaaatggggcacactcattaatgtgttactggaatttaagcagcactacgatagcaatacaccgatatcggtgtgcctacctgacttggcgaaaaattatcctcatcaatacgctcataaggggttaaaagtgttgtgtgatgagatgtttgcttatatgaagatcagtgaaatggataaactgcaagctgaggcatttagccatttgcctacgccagtggtcttaccccgtcaggcttttcaagatcatatggctgggcggtgtgagctactacctatcgataagcttgctgggcgtgtttccgctgtcggggttattccatatccgccgggcatcccaattgtcatgccgggggagagttttggtagccatgaagaaccatggctacgttatatcttaagtatcaccaaatggggccagcattttcccggcttcgagaagatcttggaagggtccgagcagaagaatgggcaatattttatttgggtactaaagcagtaa

SEQ ID NO: 1822 - protein, 768 aa, Yersinia pestis
MIDLSSHKKRNVLVVDSNIRDINTANGRAVNELIIALNDINFNVIAAATFEDGAATVISDSSLCCIFVDWTSGGNDDESHSQAFALLQDIRRRNKSVPVLLMAEHSCINSLSLETMQLVNEFVWMHEDTSEFIAARAKALIIKYYQQLLPPFTQALFQYTQDNPEYSWAAPGHQGGVAFSKTAVGREFLDFFGENLFRTDTGIERESLGSLLDHSGPIKESEAYAAQVFGAHASYSMLNGTSGSNRAIMAAVVGDKQIALCDRNCHKSIEQGLVLSGALPVFFIPTRNRYGIIGPIPKAQFQPTAIAQKIEQNPLKSLACDSKPVYAVITNCTYDGMCYNAQQAQDLLAKSVDQIHFDEAWYAYARFNPLYRERFAMRGDPADHDALGPTIFATQSTHKLLAALSQASYIHVRNGKKPIEHSRFNESYMLQSTTSPLYAIIAANEVGAAMMEGGQGLALTQEVIDEAVDFRLALARAHDAFAKQGEWFFKPWNTPEITDSKSGKKLPFSQASREQLTTDPACWVLKPGDPWHGFEQLEEDWCMLDPIKAGIMVPGMGDDGKLSEKGIPAAIVTAFLGQRGIVPSRTTDFMVLCLFSVGVTKGKWGTLINVLLEFKQHYDSNTPISVCLPDLAKNYPHQYAHKGLKVLCDEMFAYMKISEMDKLQAEAFSHLPTPVVLPRQAFQDHMAGRCELLPIDKLAGRVSAVGVIPYPPGIPIVMPGESFGSHEEPWLRYILSITKWGQHFPGFEKILEGSEQKNGQYFIWVLKQ

SEQ ID NO: 1823 - DNA, 2145 bp, Salmonella enterica subsp. enterica serovar Typhi
  CDS (1)..(2145)
atgaacgttattgctatcatgaaccacatgggcgtctactttaaagaagagcctattcgtgaactgcatcgtgcactggaaggtttaaatttccgtatcgtctatccaaacgaccgagaagacctgctgaagctgattgaaaataactcccgcctttgcggcgtcattttcgactgggataaatataaccttgagctttgcgaagagattagcaagctgaacgagtatatgccgctgtacgccttcgccaacagctactctacgctggacgtcagcctcaacgatctgagaatgcaggttcgcttctttgaatatgctttaggcgccgcagccgatatcgcggcgaaaattcgccagaataccgatgaatacatcgacaatattctgccgccgctgacaaaagcgctgttcaaatatgtgcgcgaagggaaatatactttctgtacgcctggccacatgggcgggaccgctttccagaaaagccccgtcggcagcatcttttatgatttcttcggcccgaacacgatgaaatccgatatttcgatttccgtttctgaactgggttcgctgctggaccactccggcccgcataaagaagcggaagagtatatcgcccgcgtctttaacgccgaacgtagctacatggtgacgaacggcacctctacggcgaacaaaatcgtcggtatgtactccgcgccggcaggcagcacggtactgattgaccgtaactgccataaatcgctgacccatctgatgatgatgagcgacattacgccgatttatttccgcccaacccgtaacgcctacggtattcttggcggtattccgcaaagcgagttccagcacgccactatcgctaaacgggtaaaagagacgcctaacgcaacctggccggtccatgctgttattactaactcaacctatgacggtctgttgtataacactgactacatcaagaaaactctggatgtgaagtccattcattttgactccgcctgggtgccttataccaatttctcccctatttatcagggtaaatgcggtatgagcggcgaccgtgtggaaggcaaaatcatttatgaaacccagtccacgcataaactgctggcggcgttttcacaggcatccatgattcatgttaaaggcgacattaacgaagaaacctttaacgaagcctacatgatgcataccaccacttctccgcactacggtatcgtagcgtctactgaaaccgcagcggcgatgatgaaaggtaatgcgggtaaacgcctgattaacggctctattgaacgtgcgattaaattccgtaaagaaattaaacgcctgaaaagcgaatctgacggctggttctttgacgtatggcagccggaacatatcgatggagctgagtgctggccgctgcgttcagatagcgcatggcatggcttcaaaaatatcgataacgaacacatgtacctcgacccgatcaaagtcactatcctgacgccggggatgaagaaagacggtacgatggatgagttcggtattccggcaagtctggtcgccaaatatctcgatgaacgcggcatcatcgtagaaaaaaccggtccatacaacctgctgttcctgttcagcattggtatcgacaaaaccaaagctctgagcctgctgcgcgcgctcactgaatttaaacgcgcctttgacctgaacctgcgcgtcaaaaacattctgccggcactgtaccgcgaagcgcctgagttttatgaaaatatgcgcatccaggaactggcgcagaatattcataaactggtcgaacatcataatctgccggacttaatgtaccgtgcgtttgaagtgctgccgaaaatggtgatgacgccgtatactgcgttccagaaagagctgcatggcgaaacggaagaggtgtatcttgaagagatggttggacgcgtcaacgccaacatgatccttccttaccctccgggagtgccgctggtgatgcctggtgaaatgatcaccgaggaaagccgtccggtactggaattcctgcaaatgctgtgcgaaatcggcgcccactatccgggcttcgaaaccgatatccacggcgcctatcgtcaggcagacggacgttacaccgttaaggtgctgaaagaaaatacgaaataa

SEQ ID NO: 1824 - protein, 714 aa, Salmonella enterica subsp. enterica serovar Typhi
MNVIAIMNHMGVYFKEEPIRELHRALEGLNFRIVYPNDREDLLKLIENNSRLCGVIFDWDKYNLELCEEISKLNEYMPLYAFANSYSTLDVSLNDLRMQVRFFEYALGAAADIAAKIRQNTDEYIDNILPPLTKALFKYVREGKYTFCTPGHMGGTAFQKSPVGSIFYDFFGPNTMKSDISISVSELGSLLDHSGPHKEAEEYIARVFNAERSYMVTNGTSTANKIVGMYSAPAGSTVLIDRNCHKSLTHLMMMSDITPIYFRPTRNAYGILGGIPQSEFQHATIAKRVKETPNATWPVHAVITNSTYDGLLYNTDYIKKTLDVKSIHFDSAWVPYTNFSPIYQGKCGMSGDRVEGKIIYETQSTHKLLAAFSQASMIHVKGDINEETFNEAYMMHTTTSPHYGIVASTETAAAMMKGNAGKRLINGSIERAIKFRKEIKRLKSESDGWFFDVWQPEHIDGAECWPLRSDSAWHGFKNIDNEHMYLDPIKVTILTPGMKKDGTMDEFGIPASLVAKYLDERGIIVEKTGPYNLLFLFSIGIDKTKALSLLRALTEFKRAFDLNLRVKNILPALYREAPEFYENMRIQELAQNIHKLVEHHNLPDLMYRAFEVLPKMVMTPYTAFQKELHGETEEVYLEEMVGRVNANMILPYPPGVPLVMPGEMITEESRPVLEFLQMLCEIGAHYPGFETDIHGAYRQADGRYTVKVLKENTK

SEQ ID NO: 1825 - DNA, 1467 bp, Nostoc sp. PCC 7120
  CDS (1)..(1467)
atgcttgatcaaaaccaaacaccactaatagaatctataaaagcttgtactgctcgacatcatgcagcgttttatactcctgggcataagcaggggagggggattgctcaacctttggctgatttgttgggtaaagcggtatttagtgctgatttgacggagttggctgatttagataatttatctgcgccccaaggagtgattcaggaagcccaacaattagcggcggcggcgtttggtgcctcacagacatggtttttggtcaatggttctacttgcggtgtcgaggcggcaattctggctacttgtagaccgggggataaaattattttgcctcggaatgtacattcatcggcgatcgctggtttaattctctctggtgctatcccgatttttatttatcctgaatatgacccagttttagatatcgcccatagcatcacgcctgaggctgtaaaagcagctttgcaacaacatcctgatgctaaagcggtgttgacagtttaccctacatattacggtgtatgtggggatttagaggcgatcgcccaagtcacccaccactacaatattcctttactagtagatgaagcccacggcgcacacttcgcttttcacccagaattacccacctcggccttagccgcaggtgcagatttaactgtacagtcgattcacaaggtactgggtgcaatgacgcaagcttcaatgcttcacatccaaggtgacagaataaatgcggttcgagttagtcaggctttgcagctgctacagtctactagccccagttatgtacttctagcttccctggatgcggctcgtcaacaaatggctttgtctggtaaacagttaatgtcccgtaccttacaactagcgaatgaagccagagaaagaattagtcaaattcctggcttatcagttttacagcctcctaccaagacaccatcaccagggtttacaactttggataaaacacgcttaactgtgactgtttccggcttgggtttaacgggttttgcggcggaagaaattttagatgaacaactgggggtaacggctgaatttgctacgttgcaacatctcacctttattattagcttgggaaacacagctactgatattgagcagttagtccaaggtttcacaactttagcagaaacaacactgcctactaaggcattagtcaacccaaaagttaatagtaatctggaatatttttcagaaatttctccccgtgatgccttttttgccgatagtgaaacgttatccatcgaacaggcgtgcgatggcatttgtgcagaaattgtctgtccttatcccccaggaatccccgtccttatgccaggagaagttatcacaaaacccgccattgaatatttgcaacatatccaaagtttaggcggattcattactggttgtgccgatactagtctgaatactttaaaagttttagtcaatagtcattag

SEQ ID NO: 1826 - protein, 488 aa, Nostoc sp. PCC 7120
MLDQNQTPLIESIKACTARHHAAFYTPGHKQGRGIAQPLADLLGKAVFSADLTELADLDNLSAPQGVIQEAQQLAAAAFGASQTWFLVNGSTCGVEAAILATCRPGDKIILPRNVHSSAIAGLILSGAIPIFIYPEYDPVLDIAHSITPEAVKAALQQHPDAKAVLTVYPTYYGVCGDLEAIAQVTHHYNIPLLVDEAHGAHFAFHPELPTSALAAGADLTVQSIHKVLGAMTQASMLHIQGDRINAVRVSQALQLLQSTSPSYVLLASLDAARQQMALSGKQLMSRTLQLANEARERISQIPGLSVLQPPTKTPSPGFTTLDKTRLTVTVSGLGLTGFAAEEILDEQLGVTAEFATLQHLTFIISLGNTATDIEQLVQGFTTLAETTLPTKALVNPKVNSNLEYFSEISPRDAFFADSETLSIEQACDGICAEIVCPYPPGIPVLMPGEVITKPAIEYLQHIQSLGGFITGCADTSLNTLKVLVNSH

SEQ ID NO: 1827 - DNA, 2163 bp, Yersinia pestis
  CDS (1)..(2163)
atgacactattaaaaatagcaacaagcgcccgcctggcttcttatgtagaaactcagcgcggagtggtgtacctcaatcagactgactttactgatgttgccgcggtggtaatgtcggttgaagatgcaaatgcgggtatattgtcaatgctgcatgaccttggttttgctattcctgcgtttattgccgtgacggcagaacagacggtctctgctgattatttgcccttgattaaaggtgtcattacgcttggtgaagcaaataaagctttttataacgctcaggtagaagctgccgccagtgaatatcaaaagaatctcttaccgccttttttctcaacactgaaaaaatatgtcgagatgaataactcgacctttgcttgccctggccatcaggggggcgaattttttcgcaagcatcctgcaggacgccagttttttgaattctacggtgagacgatttttcgttcagatatgtgtaatgccgatgtcaaattaggtgatttacttatccatgaaggggcggcaaaagatgcacagaaatatgctgctaaggtattcaatgccgataaaacctattttgtcctgaacggtacctcggcggccaacaaggtcgtgaccaacgctttactgacccgtggtgatttagtgttgtttgaccgcaataaccataaatctaaccatcatggtgcgctgatccaggcgggcgcgacgccggtttatctggaaacggcccgtaacccctttggttttattggtggtattgatgcgcactgcttcaatgaagattatttacgtcaacaactgcgtgaagttgctcccgagcgtgcagaagaggctcggccattccgattagcgatcattcaattgggtacctacgacggtacggtatataacgcccgccaagtagttgatagtattggtcatttatgcgattacattttgtttgattctgcttgggtgggttacgaacaatttattccgatgatgaaggatttctcaccgttattactggaattaaatgaaaatgaccctgggattattgtgactcaatcggtacacaagcagcaggccggtttttctcagacctctcaggtacataaaaaagataatcacattaaaggacagaaacgtcactgtaaccataagcgttttaataatgcctttatgttgcatgcatcgaccagtccgttttatccattatttgcggcattggatgttaatgccaaaatacactctggtgacagtggccgccgtatgtggatggattgtgtaaaactcggtattgaaacccgtaaatcgttattggcacgctgttcgatgttacggccttttattcctccagttgttggcggtaaaaattggcaagattatgctactgatgtgattgccaatgatgcgcgcttctttaattttgtcccagatgaacgctggcatggatttgagggatataaccaagatcagtatttggttgatccgtgcaaattattgctgacgacgccgggaattgatgccagtactggccgatatacttcgtttggtattccggcggctattttggcgactttcctgcgtgaaaatggaattgtgccagaaaaatgtgatcttaactcgatcctattcctgctgaccccggcagaaaataccgccaaaatggcacacctggtggatatgttggtgcagtttgaacgctatgttgaacaagatgcgaagctgtgtgatgtattaccgacgatctatcgtaagaatgaagagcgttatcacggttataccttgcgtcagttatgccaagaaatgcatgacctgtacgtcagccatgacgttaagcaattgcaaaaggatatgttccgtaaagccagtttcccgcaggtagtcatgaacccgcaagacgccaatattcagtttatccgcgataatattgagttgattcctattgctgaagctgaaggccgtattgccgccgaaggcgctttgccttatccaccgggtgtgctgtgtgtggtgcccggtgaagtgtggggtggggcggttcagcgttattttctggcgctggaagaggggattaacttactgccgggcttttcacctgagttacagggcgtttatatcgaaaaaggtgatgtgtcttggcggcgtatctttggttatgtgattacgcaatag

SEQ ID NO: 1828 - protein, 720 aa, Yersinia pestis
MTLLKIATSARLASYVETQRGVVYLNQTDFTDVAAVVMSVEDANAGILSMLHDLGFAIPAFIAVTAEQTVSADYLPLIKGVITLGEANKAFYNAQVEAAASEYQKNLLPPFFSTLKKYVEMNNSTFACPGHQGGEFFRKHPAGRQFFEFYGETIFRSDMCNADVKLGDLLIHEGAAKDAQKYAAKVFNADKTYFVLNGTSAANKVVTNALLTRGDLVLFDRNNHKSNHHGALIQAGATPVYLETARNPFGFIGGIDAHCFNEDYLRQQLREVAPERAEEARPFRLAIIQLGTYDGTVYNARQVVDSIGHLCDYILFDSAWVGYEQFIPMMKDFSPLLLELNENDPGIIVTQSVHKQQAGFSQTSQVHKKDNHIKGQKRHCNHKRFNNAFMLHASTSPFYPLFAALDVNAKIHSGDSGRRMWMDCVKLGIETRKSLLARCSMLRPFIPPVVGGKNWQDYATDVIANDARFFNFVPDERWHGFEGYNQDQYLVDPCKLLLTTPGIDASTGRYTSFGIPAAILATFLRENGIVPEKCDLNSILFLLTPAENTAKMAHLVDMLVQFERYVEQDAKLCDVLPTIYRKNEERYHGYTLRQLCQEMHDLYVSHDVKQLQKDMFRKASFPQVVMNPQDANIQFIRDNIELIPIAEAEGRIAAEGALPYPPGVLCVVPGEVWGGAVQRYFLALEEGINLLPGFSPELQGVYIEKGDVSWRRIFGYVITQ

SEQ ID NO: 1829 - DNA, 2271 bp, Salmonella enterica subsp. enterica serovar Typhi
  CDS (1)..(2271)
atgatgaaagtattaattgttgaaagtgagtttctgcatcaggacacctgggttggcaacgcggttgagcgtctggcggatgccttgagccaacaaaatgttaccgtcattaaatcgacatccttcgatgacggctatgccatcttgtccgcgaacgaagccattgactgtctgatgtttagctaccaaatggaacaaccggatgagcacctgagcgtcaggcaattgatcggtaagcttcacgagcgtcagcaaaacgtgcccgttttcctgttaggcgacagggaaaaagcgacggcatcgctggaccgcgacctgctggagcttgtcgatgaattcgcctggattctggaagacaccgctgactttatcgccggacgcgccgttgccgccatgacccggtatcgccagcaactgttaccgccgctgtttaacgcgttgatgaaatacagcgacattcatgaatattcatgggcggcgccgggacaccagggcggcgtcggtttcactaaaacgcctgccggtcgcttttatcacgattattatggcgaaaacctgttccgcagcgatatggggattgagcgtaccacgctcggttcactcctcgaccataccggcgcgtttggcgaaagcgagaaaaacgccgcccgcgtattcggtgctgaccgctcctggtccgtggttgtcgggacctcaggttctaaccgtactattatgcaggcctgtatgacggataatgatgtcgttgtactggatcgtaactgccataaatccatcgaacaggggctgatcctcactggggccaaaccggtatatatggtgccaagccgtaaccgttacggcattatcgggccaatctacccgcaggaaatgcagcctgaaaccttgcagaaaaaaatcagcgccagcccgctgaccaaaaccaaagccggacagaaaccgtcttacagcgtggtgaccaactgtacctatgacggcgtatgctataacgccaaagaggcgcaggatctgctggcaaaaaccagcgatcgcattcacttcgacgaagcatggtacggctatgcgcgcttcaacccgatttattgcgatcactacgcgatgcgcggcgagccaggcgaccataacggtccgaccgtgtttgccacccactccacgcacaaattactgaacgcgctttcacaagcttcctacattcacgtccgtgaaggccgtggcgcggtgaatttctcccgcttcaaccaggcctatatgatgcatgccaccacctctccgttatatgccatctgcgcatccaacgatgtggcggtatcgatgatggacggtaacagcggcctgtccctgactcaagaggtgattgacgaagcggttgatttccgtcaggcgatggcgcgtctttataaagagtttaccgatgaaggcgactggttctttaaaccgtggaataaagacgtcgtcaccgatccacaaaccggtaaaacgtatgacttcgccgacgcgccggcaaaactgctggcaaccgaccagaactgctgggtcatgcgccccggggaaacctggcacggctttaaagacctgccggataactggagtatgctggacccgattaaagtcagtatcctggcgccgggtatgggcgacgatggcgaactggaagcatccggcgtacctgctgcgctggtcacagcatggcttggccgccacggtatcgtgccgacccgcaccaccgacttccagattatgttcctgttctccatgggggtaactcgcgggaaatggggaacgctgatcaacacgctgtgctccttcaaacatcattacgacgcgaatacgccgctggcgcaggtgatgccggaactggtgcaggattatcctgacacttacgcgaacatgggtattcatgacctgggcgataaaatgtttgcctggctacgtgaaaataacccgggcgcccgtctcaatgccgcctattccaccctgccggttgcggagattaccccgcgcgacgcctacaacgcgatcgtgaacaacaatattgaaatggtggcgattgaaaatctaccgggtcgcattgcggcgaactccgttattccttacccgccaggcatcccgatgctgctctccggtgaaaactttggcgatgaaaacagtccgcaggtgggttacttacgctcactgcaatcctgggatcatcacttccctggctttgagcatgaaaccgaaggcacggaaattattgatggcgtatatcacgttatgtgcgtgaaagcctaa

SEQ ID NO: 1830 - protein, 756 aa, Salmonella enterica subsp. enterica serovar Typhi
MMKVLIVESEFLHQDTWVGNAVERLADALSQQNVTVIKSTSFDDGYAILSANEAIDCLMFSYQMEQPDEHLSVRQLIGKLHERQQNVPVFLLGDREKATASLDRDLLELVDEFAWILEDTADFIAGRAVAAMTRYRQQLLPPLFNALMKYSDIHEYSWAAPGHQGGVGFTKTPAGRFYHDYYGENLFRSDMGIERTTLGSLLDHTGAFGESEKNAARVFGADRSWSVVVGTSGSNRTIMQACMTDNDVVVLDRNCHKSIEQGLILTGAKPVYMVPSRNRYGIIGPIYPQEMQPETLQKKISASPLTKTKAGQKPSYSVVTNCTYDGVCYNAKEAQDLLAKTSDRIHFDEAWYGYARFNPIYCDHYAMRGEPGDHNGPTVFATHSTHKLLNALSQASYIHVREGRGAVNFSRFNQAYMMHATTSPLYAICASNDVAVSMMDGNSGLSLTQEVIDEAVDFRQAMARLYKEFTDEGDWFFKPWNKDVVTDPQTGKTYDFADAPAKLLATDQNCWVMRPGETWHGFKDLPDNWSMLDPIKVSILAPGMGDDGELEASGVPAALVTAWLGRHGIVPTRTTDFQIMFLFSMGVTRGKWGTLINTLCSFKHHYDANTPLAQVMPELVQDYPDTYANMGIHDLGDKMFAWLRENNPGARLNAAYSTLPVAEITPRDAYNAIVNNNIEMVAIENLPGRIAANSVIPYPPGIPMLLSGENFGDENSPQVGYLRSLQSWDHHFPGFEHETEGTEIIDGVYHVMCVKA

SEQ ID NO: 1831 - DNA, 2148 bp, Escherichia coli
  CDS (1)..(2148)
atgaacgttattgcaatattgaatcacatgggggtttattttaaagaagaacccatccgtgaacttcatcgcgcgcttgaacgtctgaacttccagattgtttacccgaacgaccgtgacgacttattaaaactgatcgaaaacaatgcgcgtctgtgcggcgttatttttgactgggataaatataatctcgagctgtgcgaagaaattagcaaaatgaacgagaacctgccgttgtacgcgttcgctaatacgtattccactctcgatgtaagcctgaatgacctgcgtttacagattagcttctttgaatatgcgctgggtgctgctgaagatattgctaataagatcaagcagaccactgacgaatatatcaacactattctgcctccgctgactaaagcactgtttaaatatgttcgtgaaggtaaatatactttctgtactcctggtcacatgggcggtactgcattccagaaaagcccggtaggtagcctgttctatgatttctttggtccgaataccatgaaatctgatatttccatttcagtatctgaactgggttctctgctggatcacagtggtccacacaaagaagcagaacagtatatcgctcgcgtctttaacgcagaccgcagctacatggtgaccaacggtacttccactgcgaacaaaattgttggtatgtactctgctccagcaggcagcaccattctgattgaccgtaactgccacaaatcgctgacccacctgatgatgatgagcgatgttacgccaatctatttccgcccgacccgtaacgcttacggtattcttggtggtatcccacagagtgaattccagcacgctaccattgctaagcgcgtgaaagaaacaccaaacgcaacctggccggtacatgctgtaattaccaactctacctatgatggtctgctgtacaacaccgacttcatcaagaaaacactggatgtgaaatccatccactttgactccgcgtgggtgccttacaccaacttctcaccgatttacgaaggtaaatgcggtatgagcggtggccgtgtagaagggaaagtgatttacgaaacccagtccactcacaaactgctggcggcgttctctcaggcttccatgatccacgttaaaggtgacgtaaacgaagaaacctttaacgaagcctacatgatgcacaccaccacttctccgcactacggtatcgtggcgtccactgaaaccgctgcggcgatgatgaaaggcaatgcaggtaagcgtctgatcaacggttctattgaacgtgcgatcaaattccgtaaagagatcaaacgtctgagaacggaatctgatggctggttctttgatgtatggcagccggatcatatcgatacgactgaatgctggccgctgcgttctgacagcacctggcacggcttcaaaaacatcgataacgagcacatgtatcttgacccgatcaaagtcaccctgctgactccggggatggaaaaagacggcaccatgagcgactttggtattccggccagcatcgtggcgaaatacctcgacgaacatggcatcgttgttgagaaaaccggtccgtataacctgctgttcctgttcagcatcggtatcgataagaccaaagcactgagcctgctgcgtgctctgactgactttaaacgtgcgttcgacctgaacctgcgtgtgaaaaacatgctgccgtctctgtatcgtgaagatcctgaattctatgaaaacatgcgtattcaggaactggctcagaatatccacaaactgattgttcaccacaatctgccggatctgatgtatcgcgcatttgaagtgctgccgacgatggtaatgactccgtatgctgcattccagaaagagctgcacggtatgaccgaagaagtttacctcgacgaaatggtaggtcgtattaacgccaatatgatccttccgtacccgccgggagttcctctggtaatgccgggtgaaatgatcaccgaagaaagccgtccggttctggagttcctgcagatgctgtgtgaaatcggcgctcactatccgggctttgaaaccgatattcacggtgcataccgtcaggctgatggccgctataccgttaaggtattgaaagaagaaagcaaaaaataa

SEQ ID NO: 1832 - protein, 715 aa, Escherichia coli
MNVIAILNHMGVYFKEEPIRELHRALERLNFQIVYPNDRDDLLKLIENNARLCGVIFDWDKYNLELCEEISKMNENLPLYAFANTYSTLDVSLNDLRLQISFFEYALGAAEDIANKIKQTTDEYINTILPPLTKALFKYVREGKYTFCTPGHMGGTAFQKSPVGSLFYDFFGPNTMKSDISISVSELGSLLDHSGPHKEAEQYIARVFNADRSYMVTNGTSTANKIVGMYSAPAGSTILIDRNCHKSLTHLMMMSDVTPIYFRPTRNAYGILGGIPQSEFQHATIAKRVKETPNATWPVHAVITNSTYDGLLYNTDFIKKTLDVKSIHFDSAWVPYTNFSPIYEGKCGMSGGRVEGKVIYETQSTHKLLAAFSQASMIHVKGDVNEETFNEAYMMHTTTSPHYGIVASTETAAAMMKGNAGKRLINGSIERAIKFRKEIKRLRTESDGWFFDVWQPDHIDTTECWPLRSDSTWHGFKNIDNEHMYLDPIKVTLLTPGMEKDGTMSDFGIPASIVAKYLDEHGIVVEKTGPYNLLFLFSIGIDKTKALSLLRALTDFKRAFDLNLRVKNMLPSLYREDPEFYENMRIQELAQNIHKLIVHHNLPDLMYRAFEVLPTMVMTPYAAFQKELHGMTEEVYLDEMVGRINANMILPYPPGVPLVMPGEMITEESRPVLEFLQMLCEIGAHYPGFETDIHGAYRQADGRYTVKVLKEESKK

SEQ ID NO: 1833 - DNA, 2835 bp, Escherichia coli
  CDS (571)..(2712)
cccgggggcttatcctggcgtgggcgcagaagagcgtggtcagtctgaagccattgcacgcaacctgcgtgaaatgtctcgcctcggcgtaccggtagtttgtacggttatcggtgaaggtggttctggcggtgcgctggcgattggcgtgggcgataaagtgaatatgctgcaatacagcacctattccgttatctcgccggaaggttgtgcgtccattctgtggaagagcgccgacaaagcgccgctggcggctgaagcgatgggtatcattgctccgcgtctgaaagaactgaaactgatcgactccatcatcccggaaccactgggtggtgctcaccgtaacccggaagcgatggcggcatcgttgaaagcgcaactgctggcggatctggccgatctcgacgtgttaagcactgaagatttaaaaaatcgtcgttatcagcgcctgatgagctacggttacgcgtaattcgcaaaagttctgaaaaagggtcacttcggtggcccttttttatcgccacggtttgagcaggctatgattaaggaaggattttccaggaggaacacatgaacatcattgccattatgggaccgcatggcgtcttttataaagatgagcccatcaaagaactggagtcggcgctggtggcgcaaggctttcagattatctggccacaaaacagcgttgatttgctgaaatttatcgagcataaccctcgaatttgcggcgtgatttttgactgggatgagtacagtctcgatttatgtagcgatatcaatcagcttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccgacgaatatcttgataacattacaccgccgttcacgaaagccttgtttacctacgtcaaagagcggaagtacaccttttgtacgccggggcatatgggcggcaccgcatatcaaaaaagcccggttggctgtctgttttatgattttttcggcgggaatactcttaaggctgatgtctctatttcggtcaccgagcttggttcgttgctcgaccacaccgggccacacctggaagcggaagagtacatcgcgcggacttttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattcttggtgggatcccgcgccgtgaatttactcgcgacagcatcgaagagaaagtcgctgctaccacgcaagcacaatggccggttcatgcggtgatcaccaactccacctatgatggcttgctctacaacaccgactggatcaaacagacgctggatgtcccgtcgattcacttcgattctgcctgggtgccgtacacccattttcatccgatctaccagggtaaaagtggtatgagcggcgagcgtgttgcgggaaaagtgatcttcgaaacgcaatcgacccacaaaatgctggcggcgttatcgcaggcttcgctgatccacattaaaggcgagtatgacgaagaggcctttaacgaagcctttatgatgcataccaccacctcgcccagttatcccattgttgcttcggttgagacggcggcggcgatgctgcgtggtaatccgggcaaacggctgattaaccgttcagtagaacgagctctgcattttcgcaaagaggtccagcggctgcgggaagagtctgacggttggtttttcgatatctggcaaccgccgcaggtggatgaagccgaatgctggcccgttgcgcctggcgaacagtggcacggctttaacgatgcggatgccgatcatatgtttctcgatccggttaaagtcactattttgacaccggggatggacgagcagggcaatatgagcgaggaggggatcccggcggcgctggtagcaaaattcctcgacgaacgtgggatcgtagtagagaaaaccggcccttataacctgctgtttctctttagtattggcatcgataaaaccaaagcaatgggattattgcgtgggttgacggaattcaaacgctcttacgatctcaacctgcggatcaaaaatatgctacccgatctctatgcagaagatcccgatttctaccgcaatatgcgtattcaggatctggcacaagggatccataagctgattcgtaaacacgatcttcccggtttgatgttgcgggcattcgatactttgccggagatgatcatgacgccacatcaggcatggcaacgacaaattaaaggcgaagtagaaaccattgcgctggaacaactggtcggtagagtatcggcaaatatgatcctgccttatccaccgggcgtaccgctgttgatgcctggagaaatgctgaccaaagagagccgcacagtactcgattttctactgatgctttgttccgtcgggcaacattaccccggttttgaaacggatattcacggcgcgaaacaggacgaagacggcgtttaccgcgtacgagtcctaaaaatggcgggataacttgccagagcggcttccgggcgagtaacgtgctgttaacaaataaaggagacgttatgctgggtttaaaacaggttcaccatattgcgattattgcgacggattatgcggtgagcaaagctt

SEQ ID NO: 1834 - protein, 713 aa, Escherichia coli
MNIIAIMGPHGVFYKDEPIKELESALVAQGFQIIWPQNSVDLLKFIEHNPRICGVIFDWDEYSLDLCSDINQLNEYLPLYAFINTHSTMDVSVQDMRMALWFFEYALGQAEDIAIRMRQYTDEYLDNITPPFTKALFTYVKERKYTFCTPGHMGGTAYQKSPVGCLFYDFFGGNTLKADVSISVTELGSLLDHTGPHLEAEEYIARTFGAEQSYIVTNGTSTSNKIVGMYAAPSGSTLLIDRNCHKSLAHLLMMNDVVPVWLKPTRNALGILGGIPRREFTRDSIEEKVAATTQAQWPVHAVITNSTYDGLLYNTDWIKQTLDVPSIHFDSAWVPYTHFHPIYQGKSGMSGERVAGKVIFETQSTHKMLAALSQASLIHIKGEYDEEAFNEAFMMHTTTSPSYPIVASVETAAAMLRGNPGKRLINRSVERALHFRKEVQRLREESDGWFFDIWQPPQVDEAECWPVAPGEQWHGFNDADADHMFLDPVKVTILTPGMDEQGNMSEEGIPAALVAKFLDERGIVVEKTGPYNLLFLFSIGIDKTKAMGLLRGLTEFKRSYDLNLRIKNMLPDLYAEDPDFYRNMRIQDLAQGIHKLIRKHDLPGLMLRAFDTLPEMIMTPHQAWQRQIKGEVETIALEQLVGRVSANMILPYPPGVPLLMPGEMLTKESRTVLDFLLMLCSVGQHYPGFETDIHGAKQDEDGVYRVRVLKMAG

SEQ ID NO: 1835 - DNA, 1446 bp, Clostridium acetobutylicum
  CDS (1)..(1446)
atgtctaagacaccaatcatagatggaataatgaaatatataagtgaaaagaataatctgttttgcactccagggcataagggaggcagaggattcgcaaatagcgaaggtggcagaagcttatatgaaaatatcataaagatagatttaacagaagttgatggacttgataacttacatgatcctcaaggaattatcaaggaatcagaagagagacttagagatttatatgaaagtaaaaaatcatattttcttgttaacggaagtacaagtggtaatctcgctatgatattttcatgttttaatgagggagacaaggtaatagttgaaagaaattgccataaatctatatttaatggaattatacttaggaagcttaatcctgtgtatataaaaaattactttgacgaggatataaatgctcctttatctatagatgaggagtattttttcaagattataagagaaaatatggatgcaaaagggataatacttacatatcctaattactatggagtatgctgtgaccttgaagctatagtgagagaggcaaaaaaatataatatgaaggtattagttgactctgctcatggcgctcattttggtatatcagagaagttaccagaaagtgctgttaagttaggagcagatatggttgttatgagttgtcataaaacgcttccgagtttcacacaaactgcatttcttcatttatgtggagatgtcgaggaaagcaaagttgatttttatgtaagttcatttttgagtacaagcccatcgtatatgtttatgagctcaatggattatgctagatgctatcttgaggaaagaggaaagcatgattatgataacctggtagatttatgtataaagtattcaaaaaagattaatgaaatcaatggattgcatgtattaggtaagagtgatttaaggataaatggtaaggtgcttaattttgatgcaacaagattagttatcaatgtagaggatggttgcagtgggtttaaattatatacgtatttaaaagaaaatagaatacaacctgaaatgtgcgatcatagaaatgttgttttaatttgttcaccatttgacggagaattgcagttacaaaacttatataatacacttagaaaatgcaatattataaaattaaatgacgataataaggtatctgtgcttttgtcatctatgccagaaaataaatttgccccgtatgaggtattgaatttagaaagtgaaaagatcaatattaaagatagtgtgggaaaagtgtgtaaaaaagcattagtgccatatccacctggaataccggtgattatgccaggagaagtaataaatgaaaatgttgttgatattatattgaaagctgttaaagataacattacagttttaggaattgaaaatcgaaataaagaaattaccatagatgtagtttgtgaagattaa

SEQ ID NO: 1836 - protein, 481 aa, Clostridium acetobutylicum
MSKTPIIDGIMKYISEKNNLFCTPGHKGGRGFANSEGGRSLYENIIKIDLTEVDGLDNLHDPQGIIKESEERLRDLYESKKSYFLVNGSTSGNLAMIFSCFNEGDKVIVERNCHKSIFNGIILRKLNPVYIKNYFDEDINAPLSIDEEYFFKIIRENMDAKGIILTYPNYYGVCCDLEAIVREAKKYNMKVLVDSAHGAHFGISEKLPESAVKLGADMVVMSCHKTLPSFTQTAFLHLCGDVEESKVDFYVSSFLSTSPSYMFMSSMDYARCYLEERGKHDYDNLVDLCIKYSKKINEINGLHVLGKSDLRINGKVLNFDATRLVINVEDGCSGFKLYTYLKENRIQPEMCDHRNVVLICSPFDGELQLQNLYNTLRKCNIIKLNDDNKVSVLLSSMPENKFAPYEVLNLESEKINIKDSVGKVCKKALVPYPPGIPVIMPGEVINENVVDIILKAVKDNITVLGIENRNKEITIDVVCED

SEQ ID NO: 1837 - DNA, 1464 bp, Clostridium acetobutylicum
  CDS (1)..(1464)
atgtataaattaaatcaaaatgaaacaccactttttaacgctttgatggaatatgtaaatagagatactattccctttcacgtaccaggacataaaaaaggtaatggaattgataaggaattcaaaaactttatcggtgagaacccttttaaaattgatgtaactgtattcaaattggtagacagcttacaccaccctacaggtcctataaaaaaggctcaagaattagctgctgatgcctacggttccaaggctgctttttattctgtaaacggaacttctggagctatacaaggtatgattctatctgtagtaggtgatggagataaaataatagtgcctagaaacgttcataaatctgtaactgccggaatcattctaagtggtgctgtacctgtatatatgcatccagaagtcgatagaagagttggaatagcccatggtgtatctccagaaactgttggagaaactcttaaaaataatcctgatgcaaaggctgtacttcttataaatcctacatattacggagtatctacagatataaaaaaaatagctgatatagttcacagctatgatatacctctcatcgttgatgaggctcatggacctcatttgagttttaatgatagacttcctgtatcagctttgaaagccggagcagatatgtgtgctcaaagtacacataaaataataggtgctcttactcaaatgtctcttctacatgtaaactcagatagaatagatatgaacagagttcagcaaataatgaatctacttcaaaccacatcaccatcctacatattgatggcttctatggattgcgctagacgacaaatagctcttcacggaaaggaactattagatggcacaatagatttatgcaattatgcaaggcgtgaaataaataaaatacctggcttctattgctttggtgaagaagttttagggaaacccggatcatatgctttcgatccaactaagcttacaattacctgcactgatttaggaataacaggttatgatcttgatatgcttttagccaatgattaccacatacaagtggagctttctgatttatataatgtacttgctgtgggttcttttggtgatacaaaagagaatattgatgctttaattaatgctttaagacaaataagcaaaagtatttcttcaactgttaaaaataagaagaattcatttatcgatattcccgatgtacccgagagaatactttcacctagagatgcatttaatggtgcaaaggaatccatgctaattaaagacagcgtaggtaaaacaagcggagaatttttaatggcttatccgccaggcatacctgtactatgtccaggagaaattataacccaggaaataattgactacgtcagcgacttaaaagctgctggtctatatgttcaaggaacagaagatcctgatgtaaattatataaaggtactaaaataa

SEQ ID NO: 1838 - protein, 487 aa, Clostridium acetobutylicum
MYKLNQNETPLFNALMEYVNRDTIPFHVPGHKKGNGIDKEFKNFIGENPFKIDVTVFKLVDSLHHPTGPIKKAQELAADAYGSKAAFYSVNGTSGAIQGMILSVVGDGDKIIVPRNVHKSVTAGIILSGAVPVYMHPEVDRRVGIAHGVSPETVGETLKNNPDAKAVLLINPTYYGVSTDIKKIADIVHSYDIPLIVDEAHGPHLSFNDRLPVSALKAGADMCAQSTHKIIGALTQMSLLHVNSDRIDMNRVQQIMNLLQTTSPSYILMASMDCARRQIALHGKELLDGTIDLCNYARREINKIPGFYCFGEEVLGKPGSYAFDPTKLTITCTDLGITGYDLDMLLANDYHIQVELSDLYNVLAVGSFGDTKENIDALINALRQISKSISSTVKNKKNSFIDIPDVPERILSPRDAFNGAKESMLIKDSVGKTSGEFLMAYPPGIPVLCPGEIITQEIIDYVSDLKAAGLYVQGTEDPDVNYIKVLK

SEQ ID NO: 1839 - DNA, 2256 bp, Pseudomonas aeruginosa
  CDS (1)..(2256)
atgtataaagacctcaaatttcccgtcctcatcgtccatcgcgacatcaaggccgacaccgttgccggcgaacgcgtgcggggcatcgcccacgaactggagcaggacggcttcagcattctctccaccgccagctccgccgaggggcgcatcgtcgcttccacccaccacggcctggcctgcattctggtcgccgccgaaggtgccggggaaaaccagcgcctgctgcaggatgtggtcgaactgatccgcgtggcccgcgtgcgggcgccgcaattgccgatcttcgccctcggcgagcaggtgaccatcgagaacgcgccggccgagtccatggccgacctgcaccagttgcgcggcatcctctacctgttcgaagacaccgtgccgttcctcgcccgccaggtcgcccgggcggcgcgcaactacctggccgggctgctgccgccattcttccgtgcgctggtcgagcacaccgcgcagtccaactattcctggcatacgccgggccacggcggcggtgtcgcctatcgcaagagtccggtgggacaggcgttccaccagttcttcggggagaacacgctgcgttccgacctgtcggtctcggtccccgagctgggatcgctgctcgaccataccggccccctggccgaggccgaggaccgtgccgcgcgcaatttcggcgccgaccataccttcttcgtgatcaatggcacttccaccgcgaacaagatcgtctggcactccatggtcggtcgcgaagacctggtgctggtggaccgcaactgccacaagtcgatcctccactcgatcatcatgaccggggcgataccgctctacctgactccggaacgcaacgaactggggatcatcgggccgatcccgctgagcgaattcagcaagcagtcgatcgccgcgaagatcgccgccagcccgctggcgcgcggccgcgagccgaaggtgaagctggcggtggtgactaactccacctacgacggcctgtgctacaacgccgagctgatcaagcagaccctcggcgacagcgtcgaggtgttgcacttcgacgaggcttggtacgcctatgccgcgttccacgagttctacgacggacgctatggcatgggcacctcgcgcagcgaggagggacccctggtgttcgccacccactccacgcacaagatgctcgccgccttcagccaggcctcgatgatccacgtgcaggatggcgggacccggaagctggacgtggcgcgcttcaacgaagccttcatgatgcacatctcgacctcgccgcagtacggcatcatcgcttcgctggacgtggcttcggcgatgatggaagggcccgccgggcgttcgctgatccaggagaccttcgacgaggccctcagcttccgccgggccctggccaacgtacggcagaacctggaccggaacgactggtggttcggcgtctggcagccggagcaggtggagggcaccgaccaggtcggcacccatgactgggtgctggagccgagcgccgactggcacggcttcggcgatatcgccgaagactacgtgctgctcgacccgatcaaggtcaccctgaccaccccgggcctgagcgctggcggcaagctcagcgagcaggggattccggccgccatcgtcagccgcttcctctgggagcgcgggctggtggtggagaaaaccggtctctactccttcctggtgctgttctcgatgggcatcaccaagggcaagtggagcaccctggtcaccgaactgctcgaattcaagcgctgttacgacgccaacctgccgctgcttgacgtcttgccctccgtggcccaggccggcggcaagcgctacaacggagtgggcctgcgcgacctcagcgacgccatgcacgccagctaccgcgacaacgccacggcgaaggccatgaagcgcatgtacacggtgctgccggaggtcgcgatgcggccgtccgaggcctacgacaagctggtgcgcggcgaggtcgaggcggtaccgatcgctcggttggaagggcgcatcgcggccgtcatgctggtaccctatccgccgggtatcccgctgatcatgccgggtgagcgcttcaccgaggcgacccgctcgatcctcgactatctcgagttcgcgcggaccttcgagcgcgccttccctggtttcgactccgatgtgcatggcctgcagcatcaggacggaccgtccgggcgctgctataccgttgaatgcataaaggaatga

SEQ ID NO: 1840 - protein, 751 aa, Pseudomonas aeruginosa
MYKDLKFPVLIVHRDIKADTVAGERVRGIAHELEQDGFSILSTASSAEGRIVASTHHGLACILVAAEGAGENQRLLQDVVELIRVARVRAPQLPIFALGEQVTIENAPAESMADLHQLRGILYLFEDTVPFLARQVARAARNYLAGLLPPFFRALVEHTAQSNYSWHTPGHGGGVAYRKSPVGQAFHQFFGENTLRSDLSVSVPELGSLLDHTGPLAEAEDRAARNFGADHTFFVINGTSTANKIVWHSMVGREDLVLVDRNCHKSILHSIIMTGAIPLYLTPERNELGIIGPIPLSEFSKQSIAAKIAASPLARGREPKVKLAVVTNSTYDGLCYNAELIKQTLGDSVEVLHFDEAWYAYAAFHEFYDGRYGMGTSRSEEGPLVFATHSTHKMLAAFSQASMIHVQDGGTRKLDVARFNEAFMMHISTSPQYGIIASLDVASAMMEGPAGRSLIQETFDEALSFRRALANVRQNLDRNDWWFGVWQPEQVEGTDQVGTHDWVLEPSADWHGFGDIAEDYVLLDPIKVTLTTPGLSAGGKLSEQGIPAAIVSRFLWERGLVVEKTGLYSFLVLFSMGITKGKWSTLVTELLEFKRCYDANLPLLDVLPSVAQAGGKRYNGVGLRDLSDAMHASYRDNATAKAMKRMYTVLPEVAMRPSEAYDKLVRGEVEAVPIARLEGRIAAVMLVPYPPGIPLIMPGERFTEATRSILDYLEFARTFERAFPGFDSDVHGLQHQDGPSGRCYTVECIKE

SEQ ID NO: 1841 - DNA, 2853 bp, Mycobacterium leprae
  CDS (1)..(2853)
atgaatcgagacagtggccatccgcgacgacttcgtgtttccgcgctggcggcagtagccaacccgtcatacacgcgcattgacacgtggaacgtgctcgatgacgcctgccgtcacttggctgaggtcgaccgcgccgggctggacaccgcccacgatgttgcgcgtgttaagcgtttgctcgaccgcatcggtgcctacgaacggtactggctgtaccctggtgcggcaaatctggcggcgttccgcggctatcttgccaccatggcgacggttcagcttaccgaagaggtatcgctggccgtccgtctgttgtctgaatatggtgaccgcacagcgctttttgatacttcagcgccgctggccgaccaggagctggtggcccaagccaagcagcaacagttctacaccgtgttgctcgccgacgatgccccatccacggctcccgactgtctggcagagagcttgcgggagctgcgcaatccatccgacgatgtgcagttcgagctccttgttgtgtccagtgttgaggacgccatcaccgcggtcgcgctgaacggcgagattcaggctgcgatcatccgccatgacctgccactgcggtcccgcgaccgggtgccgttgatgaataccttgcttggggccaacgactcggagggcgcactggtcaccattgaccgcccacacgactgggtcgaatgcggtgagtggatcagggagctgcggccccatatcgacctctatctgctcaccgacgagtcgatcgcggcgggcaatgatgacgagcccgatgtctacgaccggacgttttatcgactcaacgacgttaccgacctaaacagcaccgtacttgcaggcttgcgaaaccgtttcgccacaccatttttcgatgccttgcgcgcctacgcagcagcaccggtcggccaattccatgctcttccggtcgcgcgtggtgccagtatctttaactctaggtcgctgcaagacatgggcgagttctacggtcggaacatcttcatggccgagacatcgaccacctctggtggcctggattcgttgctggatccgcacggcaacatcaaaaaagcgatggacaaagccgcagttacttggcgcgccaaccacacctactttgtcaccaacggaacttccacagccaacaaaatcgtcgtacagtcgttgacccggccaggtgacattgtacttatagaccgcaactgccacaagtcgcaccattatggcctggtattggctggtgcatacccgatgtacttggatgcttatccgttgccgcagttcgcgatctatggagcggtatcgctgcgcacaatcaagaaggcgctgctggatctagaggcagtccgacaactggatcgggtccgcatgttgttgctcaccaactgcacttttgatggcgtcgtctgtaacccgcagcgggtaatggaggaggtgctggcgatcaagccagacatttgcttcctatgggacgaggcgtggtatgcgtttgccactgccgtgccgtgggctcgtcagcggaccgcaatggtgtctgctgagcaactcgaacagaagttgtggtctgtcgaatacgccgaggaatatcggaattggtgcgcatcgatggccgagatccctcggtcccagtgggttgaccagcggctactgccggaccccaatcgggcgcggattcgcgtatatgcgacacactctactcacaagtcgctgtcggcgcttcggcaggcgtcgatgattcatgtccgcgatcaagatttcaatgcgctagcccgggatgcgttcggtgaggcattcttgacgcacacctcgacatcgccgaaccaacaacttctcgcgtcgttggatctggcgcgccgccaggttgacatcgagggatttcaactggtccggctggtgtacgacatggcgctggtctttcgtcaccgcgtccgcaaagaccggctgatcagcaaatggttccgtatcctcgatgaatccgacctggtgcccgacgagtaccgggcatcggcggtcagctcgtaccgtcaggttcggcagggtgctctggcggagtggaatgaggcatggcggtccgaccagttcgtgctggatccgacgagggtcaccttgttcgtcgggaagaccggaatgaacggatatgacttccgcgagaagatcttgatggagcgattcggcatacagatcaacaagacatccatcaacagtgtgctgttgatcttcaccatcggtgtcacgtggtcgagcgtgcattatctgctagatgtgttacgccgggtggccagtgactttgacaggattcagaaggtggccagcggggccgacctcgcgctgcatcagcgccatgttgaggagatcacccaggatttgccccacttgcccgacttcagcgagttcgatgttgccttccgtcccgaaaatgccagctcgttcggtgacatgcggtcggccttctacgccgggtacgaagaatcggaccgcgagtacgtgcatatcggcacggccgggcgtcagcttgctgaggggaggaccctggtgtccaccacgttcgtggtgccctacccgcccggcttcccggtactagtccctggtcaggtggtttctaaggagataatctacttcttggctcagctcgacgtgaaggaaattcacggatacaaccatgaactgggattatcagtattcactgagaaagcgttggctcggatgatcgcgaggcgcaacgcggcgtcggccgcggtgggttctgcgttcgcggctttcgagatcccatcggactctgctgctatgggcggggacgtgaacggcgacagagtcgaggctgttgcagaagacgcgtga

SEQ ID NO: 1842 - protein, 950 aa, Mycobacterium leprae
MNRDSGHPRRLRVSALAAVANPSYTRIDTWNVLDDACRHLAEVDRAGLDTAHDVARVKRLLDRIGAYERYWLYPGAANLAAFRGYLATMATVQLTEEVSLAVRLLSEYGDRTALFDTSAPLADQELVAQAKQQQFYTVLLADDAPSTAPDCLAESLRELRNPSDDVQFELLVVSSVEDAITAVALNGEIQAAIIRHDLPLRSRDRVPLMNTLLGANDSEGALVTIDRPHDWVECGEWIRELRPHIDLYLLTDESIAAGNDDEPDVYDRTFYRLNDVTDLNSTVLAGLRNRFATPFFDALRAYAAAPVGQFHALPVARGASIFNSRSLQDMGEFYGRNIFMAETSTTSGGLDSLLDPHGNIKKAMDKAAVTWRANHTYFVTNGTSTANKIVVQSLTRPGDIVLIDRNCHKSHHYGLVLAGAYPMYLDAYPLPQFAIYGAVSLRTIKKALLDLEAVRQLDRVRMLLLTNCTFDGVVCNPQRVMEEVLAIKPDICFLWDEAWYAFATAVPWARQRTAMVSAEQLEQKLWSVEYAEEYRNWCASMAEIPRSQWVDQRLLPDPNRARIRVYATHSTHKSLSALRQASMIHVRDQDFNALARDAFGEAFLTHTSTSPNQQLLASLDLARRQVDIEGFQLVRLVYDMALVFRHRVRKDRLISKWFRILDESDLVPDEYRASAVSSYRQVRQGALAEWNEAWRSDQFVLDPTRVTLFVGKTGMNGYDFREKILMERFGIQINKTSINSVLLIFTIGVTWSSVHYLLDVLRRVASDFDRIQKVASGADLALHQRHVEEITQDLPHLPDFSEFDVAFRPENASSFGDMRSAFYAGYEESDREYVHIGTAGRQLAEGRTLVSTTFVVPYPPGFPVLVPGQVVSKEIIYFLAQLDVKEIHGYNHELGLSVFTEKALARMIARRNAASAAVGSAFAAFEIPSDSAAMGGDVNGDRVEAVAEDA

SEQ ID NO: 1843 - DNA, 2202 bp, Vibrio cholerae
  CDS (1)..(2202)
atggcgctcgtcttactcactgtgcagtgcacagagagcgccttttttcgccttggagatgtccaaatgaatattttcgctatcttgaaccacatgggtgtgttctttaaagaagagcctgttcgccaactgcatgcagcattagaaaaagccggttacgacgtggtttatccggtggatgacaaagatctgatcaagatgattgagatgaacccacgcatttgcggcgtgctgttcgactgggataaatactcgctagagctgtgtgagcgcatcagtaaagtcaatgaaaaactgcctgtgcacgcctttgctaacgagcaatcgacgttagatatttcgctaaccgatctgcgcctcaacgtgcatttcttcgaatacgctctgggcatggccgacgatatcgccatcaagatcaatcaagcgactcaagagtacaaagacgcgatcatgcctccgtttactaaggcgctgttcaaatatgtagaagagggtaaatacaccttctgtactccgggccatatgggcggtactgcgttccagaaaagccctgttggcagcattttctacgatttctacggtccaaataccttcaaagcggacgtatcgatttcgatgccagaactgggctcactgctcgatcactccggtccacacaaagaagcggaagagtacatcgcgcgcacgttcaatgccgatgcttcttacatcgtgaccaacggtacatcgacctcgaacaagatcgtcggtatgttctccgcgcctgcgggtagcacagtgctggtggatcgtaactgccataaatcattgactcacttaatgatgatgacggatgtaacgccaatttacttccgtccaacccgtaacgcttacggcattcttggtggtattccacagaacgaattcagccgtgaagtgattgcagagaaagtggcaaacaccccgggggcgagcgcaccaagctacgcggtgatcaccaactcgacttacgatggcctgctgtacaacactcagttcattaaagagtcgctggattgcaaacacatccacttcgacagtgcatgggtgccttacactaacttcaaccgtatttatgaaggcaagtgcggcatgagtggcgaagcgatgccgggtaaagtgttctacgaaacccagtccacgcacaaactgctggcggcgttctcgcaagcctcgatgattcatgtcaaaggtgagtttgaccgcgagtcgttcaacgaagcctttatgatgcacacctcaacctcaccgcagtacggcattgtggcatcgacggaaactgccgctgcaatgatgcgtggcaacaccggccgtaagcttatgcaggattcgattgatcgtgcgattcgcttccgtaaagagatcaaacgtctgaaaggcgagagcgaaggctggttcttcgatgtgtggcaacccgagaacattgagaccaccgagtgctggaaactcgatccaaaccaagattggcacggcttcaagaatcttgatgacaaccacatgtaccttgaccccatcaaaatcactctgctgactccgggaatgagcaaagatggcgaattggagcagagcggtattccggcatcactggtctctaaataccttgatgaacacggtatcgtggttgagaaaactggcccttacaacctgctgttcctgttctctatcggtattgataagtcaaaagcgatgcagttgctgcgcggcttgacggagttcaaacgcggttacgatctgaacctgaccattcgtaccatgctgccttcactgtaccgtgaagacccagttttctacgaaggcatgcgtattcaagagttggcgcaaggcattcacgacttaactcgtaaataccaattgccagagctgatgtacaaagcgttcgatgtgctgccagagatgaaagtgacgccacacgtggcatggcaacaagagctgcgcggtcaaactgaagagatcctgcttaacgagatggtgggtcgcgtgagcgccaatatgatcctgccttatcctccaggcgtgccattggtactgccaggtgaaatggtgacagacagctctcgccctgtgttggatttcttggaaatgctgtgcgaaatcggcgcgcattacccaggttttgagaccgacattcatggtttgtatcgccaaaaagatggctcttacaccgtaaaagtgctgaaggactaa

SEQ ID NO: 1844 - protein, 733 aa, Vibrio cholerae
MALVLLTVQCTESAFFRLGDVQMNIFAILNHMGVFFKEEPVRQLHAALEKAGYDVVYPVDDKDLIKMIEMNPRICGVLFDWDKYSLELCERISKVNEKLPVHAFANEQSTLDISLTDLRLNVHFFEYALGMADDIAIKINQATQEYKDAIMPPFTKALFKYVEEGKYTFCTPGHMGGTAFQKSPVGSIFYDFYGPNTFKADVSISMPELGSLLDHSGPHKEAEEYIARTFNADASYIVTNGTSTSNKIVGMFSAPAGSTVLVDRNCHKSLTHLMMMTDVTPIYFRPTRNAYGILGGIPQNEFSREVIAEKVANTPGASAPSYAVITNSTYDGLLYNTQFIKESLDCKHIHFDSAWVPYTNFNRIYEGKCGMSGEAMPGKVFYETQSTHKLLAAFSQASMIHVKGEFDRESFNEAFMMHTSTSPQYGIVASTETAAAMMRGNTGRKLMQDSIDRAIRFRKEIKRLKGESEGWFFDVWQPENIETTECWKLDPNQDWHGFKNLDDNHMYLDPIKITLLTPGMSKDGELEQSGIPASLVSKYLDEHGIVVEKTGPYNLLFLFSIGIDKSKAMQLLRGLTEFKRGYDLNLTIRTMLPSLYREDPVFYEGMRIQELAQGIHDLTRKYQLPELMYKAFDVLPEMKVTPHVAWQQELRGQTEEILLNEMVGRVSANMILPYPPGVPLVLPGEMVTDSSRPVLDFLEMLCEIGAHYPGFETDIHGLYRQKDGSYTVKVLKD

SEQ ID NO: 1845 - DNA, 2163 bp, Vibrio cholerae
  CDS (1)..(2163)
atgaattcattaaaaattgctacgagtttatcggttcgctcttgcttcacaacccaacgtgaagtggtggatgtactgaaaaccgacttctgtgacattggtgcggcggtggtttccgtcgaagacgtacaaaacggcatcatagataaaatgaatgcgaccggtttgaaactgccgatctttgttgctgtgtgctgcgaagaccaattcccagatgatttttgcgccgatatcaccggggtatttgagctgtgtgatgccaaagtcgagttctacggtaagcaagtggaaactgccgtgcgtcgttatcaagaaagtttgttgccacctttctttggtacattgaaaaaatacgtggacatgggtaactccacttttgcttgcccaggccatcaaggtggtcagttcttccgtaagcacccggttggtcgccagttttttgatttctttggtgaaaccttgttccgctctgatatgtgtaacgcggacgtacgtttgggcgacttgctgatccatgaaggtgcaccgcatgatgcacaggcttacgccgcgaaagtgtacaacgcggataaaacctacttcgtacttaacgggacttcagcttccaacaaagtggtgtgtaacgccctgctgacaccgggagatctggtgctgtttgatcgcaacaaccataaatccaaccaccacggtgcgttaattcaagcgggtgcgacaccggtttacttagaaacggcgcgtaacccattcggttttatcggtgggattgatacgcactgctttaacgaatcttacctacgtgatgcggtacgtaatgtcgacccaagccgcgcggaagcgaaacgcccattccgtcttgccatcattcagcttggcacttacgacggtacgatttacaacgcgcgtcaggtggtggatcgcatcggtcatttgtgtgactacatcctgtttgactcagcatgggtgggctatgaacagttcattcccatgatgaaagactgctcgccacttcttctcgatctaaagcctgaagatccgggcatcatcgtcactcagtccgtgcataaacagcaggcaggtttctcgcaaacttcgcaaattcacaagaaagatcaccacatcaaaggccaagagcgttactgcaaccataaacgctttaacaatgcctttatgctgcacgcttcaaccagcccattctacccgctgtttgcggcgctcgatgtgaacgccaagatgcacgaaggggacagtggccgctacctatggcgtgaagcggtaaaaaccggtatcgaagcccgtaagcttctaatgaaaaaatgcaaatacatcaagccgttcattccaccaatgatcgaaggtaaaccttggcagtctcaccccaccgagcaaattgccgatgatttacgtttctttgaatttgagccgggccagaaatggcatgcgtttgaaggttacgagcatggtcagtatttcgttgacccttgtaagttcctgctgaccacaccggggattgacccagaaactggcgaatacgagcactttggtattccggccaccatactggccaacttcctgcgtgagaacaacatcatcccagagaagtgcgatttgaactctatcctcttcctgctcaccccagccgaagatatggcgaagatgcagcatttagtggcacaaattgctcgttttgaacgcttgattgaagaagatgcaccactgagcgaagtattgccgaacgtgtaccgcgcgaatcgcgaacgctacaaaggctacaccatccgtcagttgtgtcaggaaatgcacgatctgtatgtcagccatgatgtgaaacagctgcaaaaagagatgttccgcgcgcgttatttcccacgtgcggtaatgaacccacaagaagcgaacttggcctttgtacgtggtcaggttgagctagtcccactgcgtgaagtggaaggccgtatcgccgctgaaggcgcactgccttaccctccgggtgtgttgtgtgtggttccgggagaaatatggggcggttcagtacagcgttacttcctcgctctagaagaaggcattaacttgctgccgggttttgcgcctgaattgcaaggggtgtatttggagccgacaggcgagggacgagtgcaagccatgggctatgtactgaaacgttaa

SEQ ID NO: 1846 - protein, 720 aa, Vibrio cholerae
MNSLKIATSLSVRSCFTTQREVVDVLKTDFCDIGAAVVSVEDVQNGIIDKMNATGLKLPIFVAVCCEDQFPDDFCADITGVFELCDAKVEFYGKQVETAVRRYQESLLPPFFGTLKKYVDMGNSTFACPGHQGGQFFRKHPVGRQFFDFFGETLFRSDMCNADVRLGDLLIHEGAPHDAQAYAAKVYNADKTYFVLNGTSASNKVVCNALLTPGDLVLFDRNNHKSNHHGALIQAGATPVYLETARNPFGFIGGIDTHCFNESYLRDAVRNVDPSRAEAKRPFRLAIIQLGTYDGTIYNARQVVDRIGHLCDYILFDSAWVGYEQFIPMMKDCSPLLLDLKPEDPGIIVTQSVHKQQAGFSQTSQIHKKDHHIKGQERYCNHKRFNNAFMLHASTSPFYPLFAALDVNAKMHEGDSGRYLWREAVKTGIEARKLLMKKCKYIKPFIPPMIEGKPWQSHPTEQIADDLRFFEFEPGQKWHAFEGYEHGQYFVDPCKFLLTTPGIDPETGEYEHFGIPATILANFLRENNIIPEKCDLNSILFLLTPAEDMAKMQHLVAQIARFERLIEEDAPLSEVLPNVYRANRERYKGYTIRQLCQEMHDLYVSHDVKQLQKEMFRARYFPRAVMNPQEANLAFVRGQVELVPLREVEGRIAAEGALPYPPGVLCVVPGEIWGGSVQRYFLALEEGINLLPGFAPELQGVYLEPTGEGRVQAMGYVLKR

SEQ ID NO: 1847 - DNA, 2163 bp, Haemophilus influenzae
  CDS (1)..(2163)
atgccaaatttaaaaattgcatatagtccaaaagttgaacaatatttctctacaaatagagaattagttgagattgctaaaacagactttacagatgttgcagctatcgtattaagttcaagtgatgtaggtgaatacctcgatagaattaaagcaacgaaatttgatgttccagtgtttattgttcaaaccgacgaacaacaggtggatccaaaattctatgattctatttaccatatccaagatttaaacggttatgacatcaaactttatagccgccaaatcgaaactgcagcaaaactttatgaagaaaaaatgttaccgccattcttcaaaatgttaagtgaatatgtggaaatgggtaatatcgctttcgactgtccgggacatcaaggtggtcaatactatcgtaaacatccagctggtcgtttcctttatgacttctacggtgaaaacattttccgttcggacatttgtaatgcggacgtgaaattaggtgacttgttaattcacgaaggggcagcttgtgatgcacaaaaatatgcggctcaagtattcaatgcagataaaacttacttcgtattgaatggtacatcttcttcaaacaaagttgcgttaaatgctgtacttgctcctggcgatttagtgttatttgatcgtaataaccataaatcaaaccaccatggtgcattaattcaagcgggtgctaccccaatttacttagaaactgcacgtaacccatttggtttcattggtggtattgatagtcactgcttcgaagaagattatctgaaatcattaattaaagaagttgcacctgaaaaattaaaccaaaaacgtccattccgtttggcagtgattcaattaggtacttatgacggtacaatttataacgcacgccaagtagtggataaaataggtcacctttgtgattacatcttattcgactctgcatgggtaggttatgaacaattcattccaatgatgaaagactgctcgccattattgcttgaattaaatgaaaatgacccaggtattttagtgacacaatctgttcataaacaacaagcaggtttctcacaaacttcacaaattcacaaaaaagataaacacattaaaggtcaagatcgttatgtaaatcacaaacgtttcaataatgcctttatgttacatgcgtcaactagtccgttctatccgttatttgctacgttagatgtgaatgcgaaaattcaaggtagtgaagctggtcgtcgattatggcatgaatgtgtgaaagtaggtatcgaagcgcgtaaattagtgttaaaccactgtgaattaattcgtccatttattccaaccacaattaaaggtaaaaaatggcaagattatgacacagaggaaatcgcaactaatctcgagttcttcaaattccacccaacagatacatggcataaatttgaaggttatgctgatgaacaatacttcgttgatccatgtaaattcttgcttaccacaccgggtattagcttagaaacaggtgaatatgaagaatttggtgtaccagcaaccattcttgctaactacttacgtgaaaacggtattattccggaaaaatgtgacttgaactcaatcttattcttgctcactccagcagaaaccatcaccaaaatgcaaactttagttgctcaaatcgccttgtttgaaaaacacattaaacaagactctttattaaaatatgtcttaccaactgtgtataaaaacaatgaagatcgttacaaaggttacaccattcgtcaattatgccaagaaatgcatgatctttatgtaagccgaaatgtaaaacaacttcaaaaagatttgttccgcaaagcgacattaccagaatatgtattaaatccacatgatgcaaatattgagttaatacgtaacaaagttgaactcgttccgttgactgatattgttggtcgtgtggctgcggaaggtgcgttaccttaccctccaggtgtgttatgtgtagtgccaggagaaaaatggagcactacagcacaccaatatttccttgcgttagaagaagggatcaacacattacctggtttcgcacctgaaatccaaggggtttacttacaaaaagaccctgatggacgtactcgtgcatatggctatgttttaactgactattaa

SEQ ID NO: 1848 - protein, 720 aa, Haemophilus influenzae
MPNLKIAYSPKVEQYFSTNRELVEIAKTDFTDVAAIVLSSSDVGEYLDRIKATKFDVPVFIVQTDEQQVDPKFYDSIYHIQDLNGYDIKLYSRQIETAAKLYEEKMLPPFFKMLSEYVEMGNIAFDCPGHQGGQYYRKHPAGRFLYDFYGENIFRSDICNADVKLGDLLIHEGAACDAQKYAAQVFNADKTYFVLNGTSSSNKVALNAVLAPGDLVLFDRNNHKSNHHGALIQAGATPIYLETARNPFGFIGGIDSHCFEEDYLKSLIKEVAPEKLNQKRPFRLAVIQLGTYDGTIYNARQVVDKIGHLCDYILFDSAWVGYEQFIPMMKDCSPLLLELNENDPGILVTQSVHKQQAGFSQTSQIHKKDKHIKGQDRYVNHKRFNNAFMLHASTSPFYPLFATLDVNAKIQGSEAGRRLWHECVKVGIEARKLVLNHCELIRPFIPTTIKGKKWQDYDTEEIATNLEFFKFHPTDTWHKFEGYADEQYFVDPCKFLLTTPGISLETGEYEEFGVPATILANYLRENGIIPEKCDLNSILFLLTPAETITKMQTLVAQIALFEKHIKQDSLLKYVLPTVYKNNEDRYKGYTIRQLCQEMHDLYVSRNVKQLQKDLFRKATLPEYVLNPHDANIELIRNKVELVPLTDIVGRVAAEGALPYPPGVLCVVPGEKWSTTAHQYFLALEEGINTLPGFAPEIQGVYLQKDPDGRTRAYGYVLTDY

SEQ ID NO: 1849 - DNA, 2844 bp, Mycobacterium tuberculosis
  CDS (1)..(2844)
atgaacccaaacagcgtccgcccgcgacggctgcatgtctccgcgctggccgcggtggccaacccgtcctacacccgcctggacacctggaacctgctcgatgacgcgtgtcgtcacctggcggaggtcgacctcgccgggctcgacaccacacacgacgtggctcgggcgaagcggctgatggaccgcatcggcgcctatgagcggtactggctgtatccgggggcacagaatctggcgactttccgcgctcatctggatagtcattccacggtgcggcttaccgaggaagtgtcgttggccgtacgactgctgtccgaatacggcgaccgcacagcgctgttcgacacctccgcgtcactggcggagcaggagctggtagcgcaggccaaacagcagcagttctacaccgtgctgctcgccgacgactccccggcgacggctccggacagcttggccgagtgcctgcggcagttgcgcaatccggccgacgaggtgcagttcgagttgctcgtggtggccagcatcgaagatgccatcaccgcggtggcgctgaatggcgagattcaggcggcgatcatccgtcacgacctgccgctgcggtcccgcgaccgggtgccgctgatgaccacgctgctgggcaccgatggcgacgaagcggtggcaaacgagacccacgactgggtggaatgcgccgagtggatccgtgagttgcggccccacatcgacctctatctgctcaccgacgagtcgatcgccgccgagacccaggacgagcccgacgtctacgaccgcaccttctaccggctcaacgacgtcaccgacctgcacagcacggtgctcgcgggtttacgaaaccgttatgccacaccgtttttcgatgcgctgcgggcctatgcggcggcgccggtcggccaatttcatgcccttcccgtcgcgcgcggcgccagcatcttcaactccaagtcactgcacgacatgggcgagttctacggccgcaacatcttcatggccgagacctcgacaacctctggtggactggactcgctgctggacccgcatggcaacatcaagacggcgatggacaaagccgcggtgacctggaacgccaaccagacctacttcgtcaccaacggaacatcgaccgccaacaagatcgtcgtgcaggccctgacccgccccggcgacatcgtgctcatcgaccgcaattgccacaagtcgcaccactacggcctggtacttgccggcgcgtacccgatgtacctcgacgcatatccgctgccgcagtacgcgatttatggtgccgtgccgttgcgcaccatcaagcaggcgctgctggacctcgaggccgccggacagctgcaccgggtgcgcatgctgttgctcaccaactgcacgtttgacggcgtggtgtacaacccgcgccgggtgatggaggaggtgctagcgatcaaaccggacatctgctttttgtgggacgaggcgtggtatgcgtttgcgacggcggtgccctgggcccggcagcggaccgcgatgattgctgccgagcgactcgagcagatgttgtccactgcggaatacgctgaggaataccggaattggtgtgcgtcgatggacggagtggaccgctccgagtgggttgatcaccggctgttgccagaccccaaccgcgctcgggtccgagtgtatgcgacgcattcgactcacaagtcgctgtccgcgctacggcaggcatcgatgatccacgtgcgcgaccaggatttcaaagcgctcacccgggacgcgttcggtgaggcattcttgacccacacctcgacctcgcccaaccagcaacttctcgcctcgttggacttggcgcgccgacaggttgacatcgaagggttcgagctggtccgccatgtttacaacatggcgctggtgttccgccatcgcgtccgcaaagaccggctgatcagcaagtggttccgcatccttgacgagtccgacctggttcccgatgcctttcggtcctcgacggtcagctcgtaccgtcaggtcaggcagggggctctggccgattggaacgaagcctggcggtccgatcaattcgtgctcgatccgacgcggctcaccctgtttatcggggcgaccgggatgaacgggtacgacttccgcgagaagatcctgatggagcgattcggcatccagatcaacaaaacgtctatcaacagcgtgttgctgatcttcacgatcggcgtcacctggtcgagcgtgcactatctgctcgatgtgttgcgtcgggtggcgatcgatctggaccgcagccagaaggcggccagcggggccgaccttgctctacaccgacgccacgtcgaggagatcacgcaggatctgccgcatctaccagatttcagcgagttcgaccttgccttccgccccgacgacgccagctctttcggtgacatgcggtcggctttctacgccggctacgaagaggccgaccgtgagtacgtgcagatcggcttggccgggcgccggctggctgagggcaagactctggtatccaccacgttcgtggtgccctacccgcccggcttcccggtactggtgccgggtcaactggtttccaaggagatcatctactttcttgcccagctcgacgtcaaagagatccacggatacaaccccgacctggggttgtcggtgttcacccaggcggcattggcccggatggaggccgcgcgcaacgccgtcgccacggtaggtgccgcgctgccggccttcgaggtaccgcgggacgcttcggctttgaatggcaccgtcaacggcgacagtgtgctgcagggggtcgccgaagacgcgtga

SEQ ID NO: 1850 - protein, 947 aa, Mycobacterium tuberculosis
MNPNSVRPRRLHVSALAAVANPSYTRLDTWNLLDDACRHLAEVDLAGLDTTHDVARAKRLMDRIGAYERYWLYPGAQNLATFRAHLDSHSTVRLTEEVSLAVRLLSEYGDRTALFDTSASLAEQELVAQAKQQQFYTVLLADDSPATAPDSLAECLRQLRNPADEVQFELLVVASIEDAITAVALNGEIQAAIIRHDLPLRSRDRVPLMTTLLGTDGDEAVANETHDWVECAEWIRELRPHIDLYLLTDESIAAETQDEPDVYDRTFYRLNDVTDLHSTVLAGLRNRYATPFFDALRAYAAAPVGQFHALPVARGASIFNSKSLHDMGEFYGRNIFMAETSTTSGGLDSLLDPHGNIKTAMDKAAVTWNANQTYFVTNGTSTANKIVVQALTRPGDIVLIDRNCHKSHHYGLVLAGAYPMYLDAYPLPQYAIYGAVPLRTIKQALLDLEAAGQLHRVRMLLLTNCTFDGVVYNPRRVMEEVLAIKPDICFLWDEAWYAFATAVPWARQRTAMIAAERLEQMLSTAEYAEEYRNWCASMDGVDRSEWVDHRLLPDPNRARVRVYATHSTHKSLSALRQASMIHVRDQDFKALTRDAFGEAFLTHTSTSPNQQLLASLDLARRQVDIEGFELVRHVYNMALVFRHRVRKDRLISKWFRILDESDLVPDAFRSSTVSSYRQVRQGALADWNEAWRSDQFVLDPTRLTLFIGATGMNGYDFREKILMERFGIQINKTSINSVLLIFTIGVTWSSVHYLLDVLRRVAIDLDRSQKAASGADLALHRRHVEEITQDLPHLPDFSEFDLAFRPDDASSFGDMRSAFYAGYEEADREYVQIGLAGRRLAEGKTLVSTTFVVPYPPGFPVLVPGQLVSKEIIYFLAQLDVKEIHGYNPDLGLSVFTQAALARMEAARNAVATVGAALPAFEVPRDASALNGTVNGDSVLQGVAEDA

SEQ ID NO: 1851 - DNA, 1476 bp, Streptococcus pneumoniae
  CDS (1)..(1476)
atgaaagagttagatcaaaaccaagccccaatttatgaggccttggtgaagttacgcaagaaaaggattgttccctttgatgttccaggtcacaagcgtggacggggaaatccagaacttgtcgaactcttaggagaaaaatgtgtaggcattgatgtcaattcgatgaaacctttggataatttaggccatcctatttcgattattcgtgatgcagaggagctggctgcagatgcttttggagctagccatgcctttctaatgattggtggaacaacttcatcggtgcagactatgattctggcaacctgcaaggcaggagataagattattctgccacgaaatgtccataaatctgctatcaatgcgttggttctatgtggtgccattcccatctatatcgagatgagtgtagatcctaagattggtatcgctttaggtcttgaaaatgaccgagtagcacaggccataaaggaccatccagatgctaaggctatcctaatcaacaatcctacttactacggcatctgttcagacctaaaggggttgacagaaatggctcatgaagctggcatgatggttttagtagatgaagcccacggagcgcatttgcatttcactgataaacttccaatttctgctatggatgcaggggctgatatggcagcagtttccatgcataagtctggtgggagtttgacccaaagctccattttacttatcggggagcagatgaattctgaatacgttcgtcagataattaacctgacccagtctacatctgcctcttacttgttgatggctagtttggatatttcacgtcgcaacttggcccttcgtggtaaagagtcgtttgagaaagtcattgagctatctgagtatgcccgccgtgaaatcaatgctatcggtggctactatgcctactcaaaagagttaatagacggtgtttcggtttgcgattttgacgtaactaagctgtcagtttacactcagggtattggcttaacaggtatcgaggtttatgacctcttgcgagacgaatacgacattcagatcgagtttggtgatatcggcaatatcttggcctatatttccatcggcgaccgcatccaagacatcgagcgcttggttggtgctctggctgatattaagagactctattcaagagatggaaaagatttgatagcaggagaatatattcagcccgagttagtgctgtctccgcaagaagccttctattcagaaagaaaaagtttaactttggatgattctgttggacaggtctgtggagaatttgttatgtgttaccctccaggtattcctatcttggctcctggtgaacgcattacacgagaaattgtcgactatatccaattcgccaaggaacgtggttgctccctccaagggacggaagatccagaggtcaatcatatcaacgttattaagagaaagacaaactataagaaaagtcaatag

SEQ ID NO: 1852 - protein, 491 aa, Streptococcus pneumoniae
MKELDQNQAPIYEALVKLRKKRIVPFDVPGHKRGRGNPELVELLGEKCVGIDVNSMKPLDNLGHPISIIRDAEELAADAFGASHAFLMIGGTTSSVQTMILATCKAGDKIILPRNVHKSAINALVLCGAIPIYIEMSVDPKIGIALGLENDRVAQAIKDHPDAKAILINNPTYYGICSDLKGLTEMAHEAGMMVLVDEAHGAHLHFTDKLPISAMDAGADMAAVSMHKSGGSLTQSSILLIGEQMNSEYVRQIINLTQSTSASYLLMASLDISRRNLALRGKESFEKVIELSEYARREINAIGGYYAYSKELIDGVSVCDFDVTKLSVYTQGIGLTGIEVYDLLRDEYDIQIEFGDIGNILAYISIGDRIQDIERLVGALADIKRLYSRDGKDLIAGEYIQPELVLSPQEAFYSERKSLTLDDSVGQVCGEFVMCYPPGIPILAPGERITREIVDYIQFAKERGCSLQGTEDPEVNHINVIKRKTNYKKSQ

SEQ ID NO: 1853 - DNA, 1476 bp, Bacillus halodurans
  CDS (1)..(1476)
atgtctcgtcaagaacagacccccctcttctcgggagtcgttgctcacgctaaacataaccctgtacaatttcatattcccggtcataaaaaaggagctggtatggacccagcgttccgttcatttatcggtgacaatgctctatcgatcgatttaatcaatataggcccgcttgacgatctacatcatccccatgggatcattaaagaagcacaagagttagccgccgaagcatttggggcagatcatacgtttttttctgtccaagggacaagcggtgccatcatgacgatgattatgtccgttgtcgggcctggtgaaaagatcatcgtgccacgaaatgttcacaagtcgatcatgtctgcgatcgttttttcaggagcgacacctgtgttcatccatccagaaatcgatccccttctagggatttcccatggaatcacgattgaagcggtggaaaaggcgcttgacgctcaccctgatgccaaaggacttcttgttattaacccgacatactttggcattgctgcaaacttaaaaaaaattgtagagctttgccatagcagggacgttcctgttcttgtcgatgaagcgcatggggtgcacattcatttccatgaagcccttcccttatcggcaatgcaggccggagctgatatggcggcaacgagtgttcataagcttggaggttccttgacacagagctccattttaaatgttcgcgaaggcctcgtctctgcgaagcgtgtgcaaacgattataagtatgctaacaacaacctccacgtcctatttgctcctcgcctcccttgatgcggcgagaaagcatttagcgacaaacggtagagatcttattggctataccattcagttggctgatcaggcaagagatcaaattaacgccattgatggcttgtactgtgtcggcaaggagattcttggaacgattgctacctatgattacgatccaacgaaactgatcatttctgtgaagaatcttggaattactggctacgatgcagaagtatggttaagggaacattatcagatcgaggttgagctgtcagatctatataatattctttgcatcgtttcctttggtgacactgagcgggagatggatctgcttgtcaaagctctctctgagctggctgacctgcacaaacatgggatttgtgaacggagtccagtctctgtctacgttccaaatatccctacactcgccatgtctccgcgagatgccttttatgctgaaactgaggtcgttccattcgaagattctgtcggacgtaccattgcagaatttattatggtttaccccccaggaattccaatcctaattcctggtgaaattataaccgaaagcaatctcgcctacattcgtgaaaacaaccgtgccggtcttcctgtgcaaggtccagaagacgacacctttcgaacgttgcgtgtcataaaagagcacgaagccatccgttaa

SEQ ID NO: 1854 - protein, 491 aa, Bacillus halodurans
MSRQEQTPLFSGVVAHAKHNPVQFHIPGHKKGAGMDPAFRSFIGDNALSIDLINIGPLDDLHHPHGIIKEAQELAAEAFGADHTFFSVQGTSGAIMTMIMSVVGPGEKIIVPRNVHKSIMSAIVFSGATPVFIHPEIDPLLGISHGITIEAVEKALDAHPDAKGLLVINPTYFGIAANLKKIVELCHSRDVPVLVDEAHGVHIHFHEALPLSAMQAGADMAATSVHKLGGSLTQSSILNVREGLVSAKRVQTIISMLTTTSTSYLLLASLDAARKHLATNGRDLIGYTIQLADQARDQINAIDGLYCVGKEILGTIATYDYDPTKLIISVKNLGITGYDAEVWLREHYQIEVELSDLYNILCIVSFGDTEREMDLLVKALSELADLHKHGICERSPVSVYVPNIPTLAMSPRDAFYAETEVVPFEDSVGRTIAEFIMVYPPGIPILIPGEIITESNLAYIRENNRAGLPVQGPEDDTFRTLRVIKEHEAIR

SEQ ID NO: 1855 - DNA, 2349 bp, Sinorhizobium meliloti
  CDS (1)..(2349)
atgaaggctccgaccgtccccattccattccacaagctgctcaaggtcgtggcattcgtcgacgaaagcaatctggaaacgaagagacttcttgcgcacattgtcgcggaaaatttcgaagtcgagttgcgcggcagctataacgccgacgtgtccgaggacgcttcggttggtgcctatattgggacggtcgagggcggacggctcgaagatgcccgcaagttcgtccgtgcggtcagagacatcggattccgcacgccgctatgggccctcgcagactcccacggcattgcggacattgcggcgattaaaatggccggtgaagtggacggcttcgtttatcttgggcagcagacaccggcgttctacgcaaagcagatcatttcaagtctggtcaattacggcaagacgctcctcccgccgtttttcggcggcctcatggcttacgatggagaagccaacatcgcgttcgactgtccaggacaccaaggcggacagttttaccggaagtcgcccgcaggccagctctttttcaattatttcggcgaaagcatatttcgcgccgatctttgcaatgccgacgtcgaccttggcgacctgctaatccatgaagggccggcggccgaggcgcagaagaatgcggcaaggattttcggcgcggaccggacctacttcattctgaacggcacaagcacatcgaacaaagtggttacgaacgcggtactgcgcgcaggcgacctcgtgttgttcgaccgcaacaatcacaaatcgcttcatcagggcgcgctggtgcaggcgggagcgataccagtttacctgccgacctcacgcaactcgttcgggatgatcggtgccgtggactgggacgcctgggacgaagcgagcctgcgccggcagatcgaaaggcatcccctggtcgaggacaaggcgcgagccagtgcagagcgaccgttccgactcgcctgcatccaacttgcgacctatgacggcactatttacaacgtccgcaaggtgttggaacagatcggacacctgtgcgactacgtactctgggacgaggcgtggatcggctacaacgctttccacccgttgtttgaagaccacagtccgatgcggatcgacacgcttgatgccgaaatgccggggttgttctcaacgcaatccgtccacaagcaaggggcgggcttttcgcaagcctcgcagattcacaagcgcgacgagcacatccgtgatcagcgccgctacgtcgaacataagcgcttcaacgagtcgcttctcatgcatgtttcgacttcaccattctacccgctattcgcctcgttggacgtcaatgccaagatccacgagggcaaggctggtgaaatgctctgggatcgctgtatcgagctgggtatcgaggcacgcaagaagctcagagaattcacccggtactacgagtcgtcgggtgcggggccccaggagcagtggttcttcgaccccttcgtacccgatgtggtcacgatctcgggctccaaacataccgaggatgttgtcgagtcccgttgggaggcgctcccgacggaggtcatcaaacgggaacagcagtgctggcgcttccgtccaggggcttcatggcatggatattccggctactccgatggctacgcaatggtggatccaaacaagcttacgcttctcactccaggcatagaccgtgcgaccggggagtatcgagacttcggcatcccagcaacgatggttgccaattatcttcgcgaacagcgcatcgttcccgagaagtgcgacctcaacagcatactgtttctgctcacacctgccgaggacgagagcaagctcaacacgctgatagccaagttggtgaagttcaagaacttatgggatcgggacgcacctttggccgaggttctaccaaccgtgtttgcggcgaacagagagcgctatgcaggatacacactccggcaggtctgcgcagagatgcacgacttctatcggcaagcaggggtcaaggaattgcagcgcctctgcttcagggcggagagcatgcccgagcccgcaatgacgccgaaagcggcttatgaagccctcgtggcaaacgaagttgattatgtggcactcgacgaggctttcggcaggatttcggccacgctcgcgttgatctacccgccgggcataggcgtcatagtccccggggagcgctgggacgaaagggcgcggccgatgcacaactatttcctggcattccaagagtccttcaaccgcttccccggcttcaattacgaggtccagggtgtgtttcaggagcgcgttgacggccagatcaaattctacacctacgccgtgcgcgagtaa

SEQ ID NO: 1856 - protein, 782 aa, Sinorhizobium meliloti
MKAPTVPIPFHKLLKVVAFVDESNLETKRLLAHIVAENFEVELRGSYNADVSEDASVGAYIGTVEGGRLEDARKFVRAVRDIGFRTPLWALADSHGIADIAAIKMAGEVDGFVYLGQQTPAFYAKQIISSLVNYGKTLLPPFFGGLMAYDGEANIAFDCPGHQGGQFYRKSPAGQLFFNYFGESIFRADLCNADVDLGDLLIHEGPAAEAQKNAARIFGADRTYFILNGTSTSNKVVTNAVLRAGDLVLFDRNNHKSLHQGALVQAGAIPVYLPTSRNSFGMIGAVDWDAWDEASLRRQIERHPLVEDKARASAERPFRLACIQLATYDGTIYNVRKVLEQIGHLCDYVLWDEAWIGYNAFHPLFEDHSPMRIDTLDAEMPGLFSTQSVHKQGAGFSQASQIHKRDEHIRDQRRYVEHKRFNESLLMHVSTSPFYPLFASLDVNAKIHEGKAGEMLWDRCIELGIEARKKLREFTRYYESSGAGPQEQWFFDPFVPDVVTISGSKHTEDVVESRWEALPTEVIKREQQCWRFRPGASWHGYSGYSDGYAMVDPNKLTLLTPGIDRATGEYRDFGIPATMVANYLREQRIVPEKCDLNSILFLLTPAEDESKLNTLIAKLVKFKNLWDRDAPLAEVLPTVFAANRERYAGYTLRQVCAEMHDFYRQAGVKELQRLCFRAESMPEPAMTPKAAYEALVANEVDYVALDEAFGRISATLALIYPPGIGVIVPGERWDERARPMHNYFLAFQESFNRFPGFNYEVQGVFQERVDGQIKFYTYAVRE

SEQ ID NO: 1857 - DNA, 1476 bp, Streptococcus pneumoniae
  CDS (1)..(1476)
atgaaagagttagatcaaaaccaagccccaatttatgagtccttggtgaagttacgcaagaaaaggattgttccctttgatgttccaggtcacaagcgtggacggggaaatccagaacttgtcgaactcttaggagaaaaatgtgtaggcattgatgtcaattcgatgaaacccttggataatttaggccatcctatttcgattattcgtgatgcagaggagctggctgcagatgcttttggagctagccatgcctttctaatgattggtggaacaacttcatcggtgcagactatgattctggcaacctgcaaggcaggagataagattattctgccacgaaatgtccataaatctgctatcaatgcgttggttctatgtggtgccattcccatctatatcgagatgagtgtagatcctaagattggtatcgctttaggtcttgaaaatgaccgagtagcacaggccataaaggaccatccagatgctaaggctatcctaatcaacaatcctacttactacggcatatgttcagacctaaaggggttgacagaaatggctcatgaagctggcatgatggttttagtagatgaagcccatggagcgcatttgcatttcactggtaaacttccaatttctgctatggatgcaggagctgatatggcagcagtttccatgcataagtctggtgggagtttgacacaaagttcgcttcttttaatcggggagcagatgaatcccgagtacgttcgtcagattataaacctgacacagtctacatctgcctcttacttattgatggctagtttggatatttcacgtcgcaacttggcccttcgtggtaaagagtcgtttgaggaagtcattgagctatccgagtacgctcgtcatgaaatcaatgccattggcggttactatgcttactcaaaagagttaatagatggtgtgtcggtctgtgattttgatgtaaccaagttgtcagtttacactcagggaataggcttaacaggtatcgaggtttatgacctcttgcgagacgaatacgacattcagatcgagtttggtgatatcggcaatatcttggcctatatttccatcggcgaccgcatccaagacatcgagcgcttggttggtgctctggctgatattaagagactctattcacgagatgggaaggacttaatagctggagaatatattcagcccgagttggtgctgtctccacaagaagccttctattcagagagaaaaagtttgaccttagatgagtctgttggacaggtctgtggagaatttgtcatgtgctatcctccagggattcctatcttggctcctggtgaacgcattacacgagaaattgtagactatatccaattcgccaaggaacgtggttgctccctccaagggacggaagatccagaggtcaatcatatcaacgttattaagagaaagacaaactataagaaaagtcaatag

SEQ ID NO: 1858 - protein, 491 aa, Streptococcus pneumoniae
MKELDQNQAPIYESLVKLRKKRIVPFDVPGHKRGRGNPELVELLGEKCVGIDVNSMKPLDNLGHPISIIRDAEELAADAFGASHAFLMIGGTTSSVQTMILATCKAGDKIILPRNVHKSAINALVLCGAIPIYIEMSVDPKIGIALGLENDRVAQAIKDHPDAKAILINNPTYYGICSDLKGLTEMAHEAGMMVLVDEAHGAHLHFTGKLPISAMDAGADMAAVSMHKSGGSLTQSSLLLIGEQMNPEYVRQIINLTQSTSASYLLMASLDISRRNLALRGKESFEEVIELSEYARHEINAIGGYYAYSKELIDGVSVCDFDVTKLSVYTQGIGLTGIEVYDLLRDEYDIQIEFGDIGNILAYISIGDRIQDIERLVGALADIKRLYSRDGKDLIAGEYIQPELVLSPQEAFYSERKSLTLDESVGQVCGEFVMCYPPGIPILAPGERITREIVDYIQFAKERGCSLQGTEDPEVNHINVIKRKTNYKKSQ

SEQ ID NO: 1859 - DNA, 2271 bp, Escherichia coli
  CDS (1)..(2271)
atgatgaaagtattaattgttgaaagcgagtttctccatcaagacacctgggtcggtaacgccgttgagcgtctggcagatgctttaagccagcaaaatgttaccgtgattaaatccacctcctttgatgatggttttgccattctctcttcaaacgaagccattgactgcctgatgttcagctatcaaatggaacatccggacgaacatcaaaacgtcagacaattgatcggtaagcttcatgagcgccaacaaaacgtgccggtcttcctgttgggcgatcgggaaaaagccctcgccgcaatggatcgcgacctgctggagcttgtcgatgaattcgcctggattctggaagataccgccgactttatcgccggacgcgccgttgccgcgatgacccgctaccgccagcagctgttgccgccactgttcagcgcgctgatgaaatatagtgacatccatgaatattcctgggcagcgccaggccaccagggcggcgttggttttaccaaaacacccgccggacgtttctaccatgactactatggtgaaaatctgttccgcaccgacatgggcatcgaacgaacttccctcggttctttgcttgaccatactggcgcatttggcgaaagcgaaaaatatgccgcacgcgtatttggtgccgatcgctcctggtcggtagtcgtcggtacttccggctctaaccgcaccatcatgcaggcttgcatgaccgataacgatgtcgtggtcgttgaccgtaactgccataaatccatcgaacaaggtttgatgctgacaggcgcgaaaccggtctatatggtgccaagccgcaaccgctacggcattatcgggccaatctatccgcaggaaatgcaacctgaaaccttgcagaagaaaatcagtgaaagcccgctgaccaaagacaaagccgggcaaaaaccgtcttactgcgtggtgaccaactgcacctatgacggcgtgtgttataacgctaaagaagcgcaggatctgctggaaaaaacctccgatcgtctgcactttgacgaagcctggtacggctatgcacgtttcaacccgatctatgccgatcactatgccatgcgcggcgaacctggcgatcacaacggtcctaccgttttcgccacccactccacccacaaactgctgaatgcgctgtcacaggcttcttatattcatgtacgtgaaggtcgtggggcgattaacttctcccgcttcaaccaggcctacatgatgcatgccaccacctccccgctgtatgccatctgcgcatccaacgacgtggcggtgtcgatgatggacggcaacagcggcctgtcactgacacaggaagtgattgacgaagcggttgatttccgtcaggcgatggcgcggctatataaagagttcaccgctgacggtagctggttcttcaaaccgtggaacaaagaagtcgtcaccgacccacaaaccggcaaaacctatgactttgctgacgcaccaaccaaactgctgaccaccgttcaggactgctgggtaatgcatccgggcgaaagctggcacggcttcaaagatattccggataactggagtatgctcgacccgattaaagtcagcatccttgctccgggaatgggtgaagatggtgaactggaagaaaccggtgttccggcggcgctggtcactgcctggcttggtcgccacggcattgtacctacccgcaccactgacttccaaattatgttcctgttctctatgggcgtaacccgtgggaaatggggaactctggttaacaccctttgctccttcaaacgccactatgacgccaacacaccgctggcgcaggtgatgccggaacttgttgaacaatatcctgacacttacgcgaacatggggattcacgatctgggtgacaccatgtttgcctggctgaaagaaaacaaccctggcgcacggttgaacgaagcctattccggcctgccggtggcggaagtcaccccgcgtgaagcgtacaacgcgattgtcgacaacaatgtcgaactggtatccattgaaaatctgccaggacgcatcgcggcaaactcagttatcccgtatccgccaggaatcccgatgctgctgtctggtgaaaacttcggcgataaaaacagtccgcaagtaagttatttacgctcgctgcaatcctgggaccaccatttccctggatttgaacacgaaactgaagggactgaaattattgacggtatttaccacgttatgtgcgtgaaagcgtaa

SEQ ID NO: 1860 - protein, 756 aa, Escherichia coli
MMKVLIVESEFLHQDTWVGNAVERLADALSQQNVTVIKSTSFDDGFAILSSNEAIDCLMFSYQMEHPDEHQNVRQLIGKLHERQQNVPVFLLGDREKALAAMDRDLLELVDEFAWILEDTADFIAGRAVAAMTRYRQQLLPPLFSALMKYSDIHEYSWAAPGHQGGVGFTKTPAGRFYHDYYGENLFRTDMGIERTSLGSLLDHTGAFGESEKYAARVFGADRSWSVVVGTSGSNRTIMQACMTDNDVVVVDRNCHKSIEQGLMLTGAKPVYMVPSRNRYGIIGPIYPQEMQPETLQKKISESPLTKDKAGQKPSYCVVTNCTYDGVCYNAKEAQDLLEKTSDRLHFDEAWYGYARFNPIYADHYAMRGEPGDHNGPTVFATHSTHKLLNALSQASYIHVREGRGAINFSRFNQAYMMHATTSPLYAICASNDVAVSMMDGNSGLSLTQEVIDEAVDFRQAMARLYKEFTADGSWFFKPWNKEVVTDPQTGKTYDFADAPTKLLTTVQDCWVMHPGESWHGFKDIPDNWSMLDPIKVSILAPGMGEDGELEETGVPAALVTAWLGRHGIVPTRTTDFQIMFLFSMGVTRGKWGTLVNTLCSFKRHYDANTPLAQVMPELVEQYPDTYANMGIHDLGDTMFAWLKENNPGARLNEAYSGLPVAEVTPREAYNAIVDNNVELVSIENLPGRIAANSVIPYPPGIPMLLSGENFGDKNSPQVSYLRSLQSWDHHFPGFEHETEGTEIIDGIYHVMCVKA

SEQ ID NO: 1861 - DNA, 1443 bp, Bacillus subtilis
  CDS (1)..(1443)
atgaacacacctttatataaagcattaattcaacatgcgagaagaaattctcattcatttcatgttccgggacatcacaatggagatgtcttttttgatgacgctaagtcaatattcgatccgcttctcaccattgatgtaactgaactggcaggactggatgatctccatcatccttctggggtgattaaggaagctcaggagcttgccagtcaattatatggatcggcggaaagtttttttctggtaaatggtacgactgtcggaaacttagcgatgattttatctgtttgtgaacctggtgatacaattctggttcaaagaaactgtcataaatctgtatttcatgctgttgatttgtccggtgctgagccggtttatcttgcacctgacgttgattcagcgatgcatgtgcctacgcatgttccgcttggaacaattaaagaggccctggaagcatatccagatgcgaaaggcttggtactgaccaatccgacatattacggacatagtgctgatttgactgagatcattactgaagcccatcattacgggattcctgttttggtcgatgaagcgcatggcgcacattttattttaggtgagccttttccggtctcagctttaaaaatgggggcagatattgttgttcagtcggcccacaaaacgttgccagccatgacgatgggttcttatttgcatctcaacagcagctgcaggattaacagggatcgggtggcagagtatttaaaccgattacaaagcagcagcccgtcttatccgattatggcttcgttagatattgcccgcgcttatgtacagcatattatagaagaacaaaagctttctgacattctgcagcggatagaaacacttaaacaaacgtttgattcacttacaaatgcagaagctgttaaccctgctaatccactgatcatcacggatccgctaaagctcacaattcgttcaaaacgcgggcattctggctatacgctgcaaagcattttagagcgtgccaacatattcactgagcttgctgatgaaaatcaagttctgctcgttctcccattgggaggaaaacggagaataaacgctgaaatcattagaagcatcgatgaagagattgagaaaacgcctccggatcagacgtttgtttctgcagaatggggtgtgcagcctgttactgtcttgccttatccaaaaaaggtcttacattcgtttaagaaagaatatgtgagctttgaggaagcagctggccggcttaatgcagaagatatcatcccttatcctccgggtatcccgatgattatggcgggagaaagaataacaaaagaaagtgtgcaaaagctcagccgcttgatcagcatgaaaacgcatgttcaagggaatatgaaaatcaaagagaaacaactacttgtttatatagaagaggagaaatcatga

SEQ ID NO: 1862 - protein, 480 aa, Bacillus subtilis
MNTPLYKALIQHARRNSHSFHVPGHHNGDVFFDDAKSIFDPLLTIDVTELAGLDDLHHPSGVIKEAQELASQLYGSAESFFLVNGTTVGNLAMILSVCEPGDTILVQRNCHKSVFHAVDLSGAEPVYLAPDVDSAMHVPTHVPLGTIKEALEAYPDAKGLVLTNPTYYGHSADLTEIITEAHHYGIPVLVDEAHGAHFILGEPFPVSALKMGADIVVQSAHKTLPAMTMGSYLHLNSSCRINRDRVAEYLNRLQSSSPSYPIMASLDIARAYVQHIIEEQKLSDILQRIETLKQTFDSLTNAEAVNPANPLIITDPLKLTIRSKRGHSGYTLQSILERANIFTELADENQVLLVLPLGGKRRINAEIIRSIDEEIEKTPPDQTFVSAEWGVQPVTVLPYPKKVLHSFKKEYVSFEEAAGRLNAEDIIPYPPGIPMIMAGERITKESVQKLSRLISMKTHVQGNMKIKEKQLLVYIEEEKS

SEQ ID NO: 1863 - DNA, 1452 bp, Synechocystis sp
  CDS (1)..(1452)
atggtcaacctcaatcaacaagatttgcccctggtcaatgcgttaaaagccctagctcaacaaccggatacgcctttttatgcgccgggccataaaaggggtcagggtatttcccctagttttaaacaatggttggggccaaacctcttccaagctgatctgccggaattgccggaattagataatctctttgctcccaccggggcgatcgccaaagctcaggagttagccgcggatttatggggggcagaacacacttggttttctgttaacggttccaccgccggtattgtggccgcaattttggccacctgtggggatggggataaaattctcttgcctcggaatgttcaccaagcggcgatcgccggcattatccatgctggggcagtgccaatatttttggaaccggaggttaaccccgattgggatttggctttgggggtgacggaggaaactttaagtaaagcattgcaagaacatgacgatgcaaaagcagtatttttgctcaatcctacctaccacggtgttgtgggggacttacaaaaattaattaaattaagtcatagagttaacctacctgtcattgttgatgaagcccacggtgcccattttgctttccatccatccttacccagaccggctttagaattaggggcggatattgtcatccaatccacccataaaatgctgggagctttgagtcaatgtgccatgatccatggccaaggaaacttaattaatcccccaagaattagtcaatgtttgcaattaattcaatccactagtcccaattatgttttattggcttccctcgatgatgcgcggcaccaaatggccaatggcggcagagaaaagatggcggaattattgaattttaccctccattatcgacaacaattaagtcaaattcctgggttaactttattagaaattaccaaacctttgcccggagctttaatcctcgatcccacccgcattaccgtcgatgtcactgcctggggaatgtcaggatttgaggtagatgatttgttacgggaaaagtttcaaattacagcggaattgcccaccctaaggcagttaagttttatcgttagtattggcaatcaagcccaggatttaggacatttattggaagctttaacccagttagcacctacgaatcctcaacaaccttttcacctaactttacccgtcttacccggtactattctggctatgactccccgccgagcggcccatgctgcccaaaaatcggtaaccgttaatgaagcgattgggaaaattagtgctggtctgctttgcccctatccccccggtattcccgtccttgttcccggagaaattatcaccccggaggcgatcgcctttttgacagaagttttaaatttagggggtaccatcagcggtttagctagtgaggaattaacccatttggctgtggtgaattaa

SEQ ID NO: 1864 - protein, 483 aa, Synechocystis sp
MVNLNQQDLPLVNALKALAQQPDTPFYAPGHKRGQGISPSFKQWLGPNLFQADLPELPELDNLFAPTGAIAKAQELAADLWGAEHTWFSVNGSTAGIVAAILATCGDGDKILLPRNVHQAAIAGIIHAGAVPIFLEPEVNPDWDLALGVTEETLSKALQEHDDAKAVFLLNPTYHGVVGDLQKLIKLSHRVNLPVIVDEAHGAHFAFHPSLPRPALELGADIVIQSTHKMLGALSQCAMIHGQGNLINPPRISQCLQLIQSTSPNYVLLASLDDARHQMANGGREKMAELLNFTLHYRQQLSQIPGLTLLEITKPLPGALILDPTRITVDVTAWGMSGFEVDDLLREKFQITAELPTLRQLSFIVSIGNQAQDLGHLLEALTQLAPTNPQQPFHLTLPVLPGTILAMTPRRAAHAAQKSVTVNEAIGKISAGLLCPYPPGIPVLVPGEIITPEAIAFLTEVLNLGGTISGLASEELTHLAVVN

SEQ ID NO: 1865 - DNA, 2307 bp, Yersinia pseudotuberculosis IP 32953
  CDS (1)..(2307)
atgattgatttaagcagtcacaagaaacgcaacgttttagtggttgacagcaatattcgtgatatcaataccgctaatggtcgggcggtaaacgaacttatcattgcgcttaatgacattaattttaatgtgattgcggcggcgacgtttgaagatggcgcggcaacagtgatctccgactcttcgttgtgctgtatttttgtcgattggacttcgggtggtaatgatgatgaatcccatagtcaggcatttgcattgctacaagacattcgtcgccgtaataaatcagtgcctgtgttattgatggctgagcattcatgtatcaatagcttaagtttggagaccatgcagcttgttaatgaatttgtttggatgcatgaagatacctccgagtttatcgctgctcgtgccaaagcactcatcatcaagtattaccagcagttgctgccgccttttacgcaagcgctgtttcaatatacgcaagataatcctgaatattcatgggctgcccccggtcatcaagggggcgttgccttcagtaagacggcggttggacgcgagtttcttgatttctttggcgagaatctatttcgtacggatactggtattgaacgtgagtcattgggatctttactggatcacagtgggccgataaaagagtcagaagcgtatgccgcacaagtttttggtgcacatgcaagttactcgatgcttaatggcacatcgggctctaatcgcgccattatggccgctgtcgtgggagataagcagatcgcattgtgtgatcgtaactgtcataaatccattgagcagggattggtcctgtcgggtgcattaccggtattttttattccaacccgtaaccgctatggcattattggaccaattcctaaagcacaattccaacccacggctattgcacaaaaaattgaacaaaaccccttaaagtcattggcttgtgatagcaagcccgtctatgcagttatcacgaattgtacctatgacggtatgtgctataacgcccaacaggcacaggatttattggcaaaaagtgttgatcagattcatttcgacgaagcttggtacgcctatgcccgttttaatcccctttatcgggagcgttttgcgatgcgtggtgacccggctgaccatgatgcgctgggaccaactatttttgctacacaatcaacgcataaattattggcagcgctgtcgcaagcttcttatattcatgtgagaaatggcaaaaagccgatagaacattcgcggtttaatgagtcgtatatgttgcagtcaaccacttcgccattgtacgccattattgctgccaatgaagtgggggcggcgatgatggaaggcgggcaggggctagcattgacacaagaggtgatcgatgaagctgttgattttcggttggcgctggctcgtgcacatgatgcttttgcaaaacaaggcgaatggttctttaaaccttggaatacaccggaaataacggatagcaaaagcggtaaaaagttacctttctcccaagcatcacgagagcaactgacaaccgatcccgcctgttgggttctcaagccgggagacccgtggcatggtttcgagcagttggaagaagattggtgcatgttggatccgatcaaggccgggattatggtgccgggaatgggggatgacggtaagttgtcagaaaagggaattcccgcagcgatagtgaccgccttccttgggcagcggggaattgtaccgtcgcggaccacggattttatggtgctgtgcttgttttcggtgggtgtaacgaaaggtaaatggggcacactcattaatgtgttactggaatttaagcagcactacgatagcaatacaccgatatcggtgtgcctacctgacttggcgaaaaattatcctcatcaatacgctcataaggggttaaaagtgttgtgtgatgagatgtttgcttatatgaagatcagtgaaatggataaactgcaagctgaggcatttagccatttgcctacgccagtggtcttaccccgtcaggcttttcaagatcatatggctgggcggtgtgagctactacctatcgataagctcgctgggcgtgttaccgctgtcggggttattccatatccgccgggcatcccaattgtcatgccgggggagagttttggtagccatgaagaaccatggctacgttatatcttaagtatcaccaaatggggtcagcattttcccggcttcgagaagatcttggaagggtccgagcagaagaatgggcaatattttatttgggtactaaagcagtaa

SEQ ID NO: 1866 - protein, 768 aa, Yersinia pseudotuberculosis IP 32953
MIDLSSHKKRNVLVVDSNIRDINTANGRAVNELIIALNDINFNVIAAATFEDGAATVISDSSLCCIFVDWTSGGNDDESHSQAFALLQDIRRRNKSVPVLLMAEHSCINSLSLETMQLVNEFVWMHEDTSEFIAARAKALIIKYYQQLLPPFTQALFQYTQDNPEYSWAAPGHQGGVAFSKTAVGREFLDFFGENLFRTDTGIERESLGSLLDHSGPIKESEAYAAQVFGAHASYSMLNGTSGSNRAIMAAVVGDKQIALCDRNCHKSIEQGLVLSGALPVFFIPTRNRYGIIGPIPKAQFQPTAIAQKIEQNPLKSLACDSKPVYAVITNCTYDGMCYNAQQAQDLLAKSVDQIHFDEAWYAYARFNPLYRERFAMRGDPADHDALGPTIFATQSTHKLLAALSQASYIHVRNGKKPIEHSRFNESYMLQSTTSPLYAIIAANEVGAAMMEGGQGLALTQEVIDEAVDFRLALARAHDAFAKQGEWFFKPWNTPEITDSKSGKKLPFSQASREQLTTDPACWVLKPGDPWHGFEQLEEDWCMLDPIKAGIMVPGMGDDGKLSEKGIPAAIVTAFLGQRGIVPSRTTDFMVLCLFSVGVTKGKWGTLINVLLEFKQHYDSNTPISVCLPDLAKNYPHQYAHKGLKVLCDEMFAYMKISEMDKLQAEAFSHLPTPVVLPRQAFQDHMAGRCELLPIDKLAGRVTAVGVIPYPPGIPIVMPGESFGSHEEPWLRYILSITKWGQHFPGFEKILEGSEQKNGQYFIWVLKQ

SEQ ID NO: 1867 - DNA, 1467 bp, Symbiobacterium thermophilum
  CDS (1)..(1467)
atgaatcagcacgagactccgctgttcaccgggctggtgcggcacgccgagcgcaatccgatccagtttcacattcccggccacaagaagggcacagggatggcgccggaattccgcgcgtacatcggcgagcgcgcactggccattgacctgatcaacatcgcgccgctcgacgacctgcacaacccccacggcatcatccgggaggcgcaggccctggccgccgaggccttcggggcggaccactccttcttcagcgtccagggcaccagcggagcgatcatcgcgatgatcatgaccgtctgcggccccggcgacaagattctggtcccccgcaacgtgcacaagtcggtcctcaccggcattgtgctgtcgggggccctgcccatattcatgaaccccgacctggactacgagctgggcatcgcccatggggtgagcctggaggcggtgcgccacgccctggaccagcaccccgacgccaagggcgtgctggtgatcaacccgacctattacggcgtggcggcggacctgaaggggatcgtcgagctggcccactcccgcggggtgccggtcctggtggacgaggcccacggcgtccacctgtgctttcacgacgagctgccgctctcggccatgcaggccggcgcggacatggcggccacctcggtgcacaagctgggcggttcgctgacgcagaccagcatcctcaacgtgcgcgaggggttcatcaaccccgggcgggtgcaggcgattctgtccatgctgacgaccacttccacctcgtacctgctgctggcctcgctggacgtcgcccgcaagcaactggccacccgggggcgggagctgatcgaccgggcggtccgcctcgccgagcgcgcccgccgggagatcgcggagatccccggcctgtactgcctcgggcccgacgtggtcggccagtcgtcgtcccgcttcgacctcgacccgacgaagctctgcatcaacgtgaaggagctgggcgtgaccggcgtggaggtcgaggcgatcctccgggaggaatttaacattgaagtggaactctcggacctctacaacatcctgtgcatcatctcgctgggcgacacggcggaggacgtggacgcgctggtggccgcgctcggggagatctcccgccgcttctaccggcagcgcccggccaacgtggtgaaggtcaaggtgcctgtgacgcctatcctcgccatgcatccccgcaccgcgttctacgcggagaccgaggtggtgccgatccgcgaggcggagggccgggtgatcgccgagtcgatcatggtgtatccccccgggatccccatcctgctgccgggggagatcgtggcggaggagaacctggattacctggaggagtgcatccaggcggggctgccggtccaggggaccgaggaccccgagatccggatggtaaaggtcgtgaaggacgctcaccgttaa

SEQ ID NO: 1868 - protein, 488 aa, Symbiobacterium thermophilum
MNQHETPLFTGLVRHAERNPIQFHIPGHKKGTGMAPEFRAYIGERALAIDLINIAPLDDLHNPHGIIREAQALAAEAFGADHSFFSVQGTSGAIIAMIMTVCGPGDKILVPRNVHKSVLTGIVLSGALPIFMNPDLDYELGIAHGVSLEAVRHALDQHPDAKGVLVINPTYYGVAADLKGIVELAHSRGVPVLVDEAHGVHLCFHDELPLSAMQAGADMAATSVHKLGGSLTQTSILNVREGFINPGRVQAILSMLTTTSTSYLLLASLDVARKQLATRGRELIDRAVRLAERARREIAEIPGLYCLGPDVVGQSSSRFDLDPTKLCINVKELGVTGVEVEAILREEFNIEVELSDLYNILCIISLGDTAEDVDALVAALGEISRRFYRQRPANVVKVKVPVTPILAMHPRTAFYAETEVVPIREAEGRVIAESIMVYPPGIPILLPGEIVAEENLDYLEECIQAGLPVQGTEDPEIRMVKVVKDAHR

SEQ ID NO: 1869 - DNA, 1410 bp, Symbiobacterium thermophilum
  CDS (1)..(1410)
atggcggaggagcaggcccggacgccgctgttttcggcgctgagggagtacgttgcgcgggtccgggcgccgctgcacgtgcccgggcacaagatgggacgcgccgcgccctcggcgtggcgggagttcctggggccgaatgcactggcgatcgacctgacggaggcgccggggctggacgacctgcacgcgccggagggggtcatcgccgaggcccaggagctggcggcccgggcgttcggcgcgtggcggagttattttctggtgggcggtaccaccgccggcctgcacgccctcatcctcgccgcctgccatccgggagaggcgatcgcggtgccgcgcaacgcgcaccgctccgtgctgggcgccctgattctggccggggtccgtcctcactgggtgagggtggccttcgacccggacctgggcatcgccacgggcccggtcctcacgtcgctggaggaggcgctttccggcgccgcggccgcggtgctggtccatcccacgtattacggcatcgccggagacacggccgccgcgatcgacctgatccaccgcgcggccgtcccggccctggtggacgaggcgcacggcgcccacttcccgttccaccccgcgctgccgccctcggccctggaactgggcgcggacggcgtcgtgcagtcgctgcacaagaccgggggcagcctgacccagtcgtccctgtgccacctggggcacggcagccgcatcgcccccgaacggctgcaggagatgctgcggctcgtgcagtccacaagcccgtcgtacctgctcatggcttccctggacctggcccggcgcgagctggccctcgggggccgggaggcctgggggcgggccctggagctggcccacgaggcgaaacggcgcatcgacgccctgcccgggctccgggtgcgccccaccgacgacccgaccaagctgctcatcgacgtgcggggacggtccatttcgggcttccgggcggcggagcggctctgggaggaggccggcgtcgccgtcgaggcctccgggctgacctacgtgctcgccgtgctctcgcccggggactcccgggagcagatcgacgccctggtcgcggggctggagcggctgtcctccgagggggatgtcccggcccttccgccggagccgccctggcccgaggtggttctgccgccgcgggaggcatacttagcccgtaagaaggcggttccgcttcgccaggcccgggggcgcatcgcggcggagctggtggccccgtacccgccgggcattccggtggtggccccgggtgagcggctgacggctgacgtgctggactacctccggcgcgccgccgatgccggctggcaccttcagggcccggcagaccccgcgctgcgaagcatccaggtcgtggaggagtga

SEQ ID NO: 1870 - protein, 469 aa, Symbiobacterium thermophilum
MAEEQARTPLFSALREYVARVRAPLHVPGHKMGRAAPSAWREFLGPNALAIDLTEAPGLDDLHAPEGVIAEAQELAARAFGAWRSYFLVGGTTAGLHALILAACHPGEAIAVPRNAHRSVLGALILAGVRPHWVRVAFDPDLGIATGPVLTSLEEALSGAAAAVLVHPTYYGIAGDTAAAIDLIHRAAVPALVDEAHGAHFPFHPALPPSALELGADGVVQSLHKTGGSLTQSSLCHLGHGSRIAPERLQEMLRLVQSTSPSYLLMASLDLARRELALGGREAWGRALELAHEAKRRIDALPGLRVRPTDDPTKLLIDVRGRSISGFRAAERLWEEAGVAVEASGLTYVLAVLSPGDSREQIDALVAGLERLSSEGDVPALPPEPPWPEVVLPPREAYLARKKAVPLRQARGRIAAELVAPYPPGIPVVAPGERLTADVLDYLRRAADAGWHLQGPADPALRSIQVVEE

SEQ ID NO: 1871 - DNA, 2154 bp, Erwinia carotovora
  CDS (1)..(2154)
atgaaacagttaaaaattgcggcgaatgcagcggttgccacccgtttaatcacaacgcgcgagattgtcgcgttgagtcagactgacttcactgatgtggcggcggtcgtggtttctattgaggaagcccgtagcggtattctgtcgatattgcagcacaccggttttagtattccggcgtttgtcgaagagcctgatgaagataaagagtcagatgttctgcctgcgggcagcgaatggctgattcttgatgatgaaggtgagcacgcgagcgtgctggaacgtgcggctaaagcctatcaagatgcgttgctgccgccgtttttcgatacgctgaccaagtacgtcaaaatgaagaacacgacgtttgcctgcccagggcatcagggcggtcagttcttccgtaagcatccggcagggcgtcagttttttgagttttacggtgagaacgtttttcgttcggacatctgtaacgccgacgtcaaactgggcgatttgctgatccatgaaggggcggcgaagaaggcacagaagcacgctgcgcgggtgtttaacgccgataagacctatttcgtgttaaacggcacgtcctctgcgaacaaagtcgtgacaaacgcgctgttagcgcgtggcgatctggtgctgtttgaccgtaacaaccataaatccaaccatcacggtgcgctggttcaggcgggggcgacgcctgtctatctggaaaccgtgcgcaatccgtttggctttatcggtggtgtggatgcgcactgctttgacgaaacctatctgcgcaagctgattgcggaagtcgcgccggaacgtgctaacgagccacgcccgttccgtctagctgtcatccagcttggcacctatgacgggaccatttataacgctcgtcaggttgtcgatagcatcgggcacctgtgtgactacattctgtttgactcggcctgggtcggctacgagcagttcatcccgatgatggagcagtgctcgccgctgttgctggatctgaatgagaacgatccgggcatctttgtcacccagtcggtgcataagcagcaggcgggcttctcccagacctcgcagatccacaaaaaagatacgcatatcaaagggcagcgtcgtttttgcaaccataagcaactgaataacgcttttatgctgcatgcgtcgaccagcccgttttacccgctgttcgccgcgttggatgttaatgccaaaatgcacgaaggggccagcgggcgtcgtatgtggatggactgcgtgaagctgggcattgaggcacgtaagcaactgctgacgcgctgttcgctcatcaaaccgtttgtgcctgttacggtaggcggtgcgctctggcaggatcatgatacggagacgatcgcgcaggacgtgcgtttcttcaactttgagccgggcgagaaatggcacgcgttcgaagggtacgcggaagatcagtattttatcgatccgtgcaaattactgctgactacgccgggtattgatgcaattagcggcgattataccgaatttggtattccggcgacgatccttgctaactatctgcgcgagcacggcatcatccctgaaaaatgcgacatgaactcgatcctgttcctgttaacgccagcggaagacacggccaaaatgcaggagctggttaatgcgctggttcattttgaaacgctgatcgctcgtgatgcgccgctgagcgaagtgttgcccagcctgtatcagaaatacaaagagcgctaccgtggttatcgactgcgtcggttgtgtcaggaaatgcatgatttttatgcccagcacaacgtgaaagatctgcaaaaagcgatgttccgcaaaaccgagtttccgtcagtggcgatgttgccgcaggatgccaacagggaatttgtgcgcgggaatatcgagctggttcccatcgttgaagctgaaggacgtatcgcggcggaaggtgcattgccatacccgccgggcgtgctgtgtgtggtaccgggggaagcctggggcggagcggtacagcgctattttctggcgctggaggatgggattaacctgctgcccggtttttcaccggaattgcagggggtttacagcgttgcggaagaagatggccgcaaacggctgtacggctacgtggtagaaaagtaa

SEQ ID NO: 1872 - protein, 717 aa, Erwinia carotovora
MKQLKIAANAAVATRLITTREIVALSQTDFTDVAAVVVSIEEARSGILSILQHTGFSIPAFVEEPDEDKESDVLPAGSEWLILDDEGEHASVLERAAKAYQDALLPPFFDTLTKYVKMKNTTFACPGHQGGQFFRKHPAGRQFFEFYGENVFRSDICNADVKLGDLLIHEGAAKKAQKHAARVFNADKTYFVLNGTSSANKVVTNALLARGDLVLFDRNNHKSNHHGALVQAGATPVYLETVRNPFGFIGGVDAHCFDETYLRKLIAEVAPERANEPRPFRLAVIQLGTYDGTIYNARQVVDSIGHLCDYILFDSAWVGYEQFIPMMEQCSPLLLDLNENDPGIFVTQSVHKQQAGFSQTSQIHKKDTHIKGQRRFCNHKQLNNAFMLHASTSPFYPLFAALDVNAKMHEGASGRRMWMDCVKLGIEARKQLLTRCSLIKPFVPVTVGGALWQDHDTETIAQDVRFFNFEPGEKWHAFEGYAEDQYFIDPCKLLLTTPGIDAISGDYTEFGIPATILANYLREHGIIPEKCDMNSILFLLTPAEDTAKMQELVNALVHFETLIARDAPLSEVLPSLYQKYKERYRGYRLRRLCQEMHDFYAQHNVKDLQKAMFRKTEFPSVAMLPQDANREFVRGNIELVPIVEAEGRIAAEGALPYPPGVLCVVPGEAWGGAVQRYFLALEDGINLLPGFSPELQGVYSVAEEDGRKRLYGYVVEK

SEQ ID NO: 1873 - DNA, 2790 bp, Acinetobacter sp
  CDS (1)..(2790)
atgacgaatacaaattcattaagccagcatcgtagcgtatgggagatacgttctgatagctggattaatctcgtagaagatattgggtatctggcagatcttcagattaataaccaagatcgtgccaaagttttaactcgtttacggctcactctggattttttaattccaattgaaagttattgggcatttccaagcaagcgagtttttgctgaactctgtcagtatattgaacgtgaagattttactaccgctcgacagcttgcacgccgtattcatcgtgccttgtctgcggggacttatcgtcacgataacaaagtgctccaaagtgaacgtgaattaccctctcacattgaaaccacaagtgagcaacaggcacgtctatctcagccttattttgaagtgctcatcgtggatgaaatgtctccagcagaagaggatgcactgcgtcgtcgagtgattagcaagcgctgttctgacgatccatttatttttgatattgtggttgttccgagctttgaagatgccctgattgcatccctaattaatttcaacttacaagctgtggtgattcggcacggctttccagcacgatcggtcaatcatgttgatatgctggaacgtttatttatagatgtcgatcaggatattgaatcccttccagaaatggagcgtggaacactattaggccgccatatcgcgaagttacgtccagaactggatctctatttagtgaccgatgcaggtgtggaaaatattgcttctcatgctggcagtgaaatctttaaacgcattttctttggcgaagaagaccatatcgagctctacaatgcgattatgaaaggtgtgggtgagcgttaccgtacaccattctttaatgcattacgcgattattccaaacaaccaacaggtatgttccatgcactgccactggcacgtggtaaagccattcttaatagcaactggattggtgatctggcacagttttatggcatgaatttatttatggccgaaacatcagccacttcaggcggtctggattcattactggaacctgttggcccattaaaacatgcgcaggaatatgcagcccgtgcatttggtgccaaacggactttctttgcaaccaatggaacctccacctgtaacaagattgtggtgcaatctctggtacgtgaaggtgatattgtactggtagatcgcaactgtcataaatcacatcattatggtttggtgcttacaggcgccagtgccgcctatctcgattcgtatccactcaatgaatactcaatgtatggggcggtgccaatttggcacattaaacaaactttattgagctttaaacgagcaggtacgcttgatcgcgttaaactggttctactcaccaattgtacctttgatggtgttgtctatgacgtagaacgggtgatgatggaatgcctggccattaaacctgatctgatttttttatgggatgaagcatggtttgcttttgcaagttgtcatcccatttatcgccaacgcacagccatggccaatgccgctaagctggctgaacgttttaaaacgcctgaatatgcccgagaatatgccgagtggaaagacagtattgactgggaagatgatcaacagctcatcaacactcgtctcatgccagaccctgctttggcacgtgttcgcgtttattcaacgcattcgacacacaagaccttaactgcactgcgtcagggttccatgattcatatctgggatcaggattttaaagaaaagagcgaagaagcttttattgaagcttacatgacccatacttcaacttcggccaattatcagattctggcatcgctggatgtaggacggcgtcaggttgaaatggaaggttatcaactggtacagcgacagcttgaacttgcgatgagcctgcgcgaacaggtcatgcatcaccccttactcaagcgtcatttccacttcttgcgcgttggcaatatcattccaactgcttaccgtgaatctggagtcaatagctattttgatgaaggtaaaggctgggcaaatttagagaaagcgtggagcatggatgagtttgtcatggatcctacccgcgcaacgctgatgattggtatggtcgggatggatggagataccttcaaaaataccgaactcatgaataaatacgggattcaaatcaataagacctctcgtaatactgttctgtttattatcaatattggaaccacacgttctgcaattgcttatctgattgaagtgctggtcaagattgcacgtgatgtagatcgtcgtgtagctgacatgagctcagccgagcgtcgcattcacttaaaacgtgttaactctctcactcaagagcaaccaccattacctgatttctctgctttccatcgtgcatttcggggtcaaagtctaaacccagccattcaaacccgtgacggtaatattcgtcaggcattttttctgtcctatgaagattcgagctgtgaatatattgatatgcaggaagcagccgtagctattgcatcaggtcgtgaactggtttcagccctgtttgtaattccatatccgcctggctttccaattttagtacctgggcaggtcatcagctctgaaattttaaaattcatggcagcactggatgtgaaagaaattcatggtttccgccctgaactcggatttcgtgtctttacacaagaaacgcttgatcgagttctacacgcaaaagaatcttttgaatcgattatgcaatatcagcaaatcaataacttacgtgctggatag

SEQ ID NO: 1874 - protein, 929 aa, Acinetobacter sp
MTNTNSLSQHRSVWEIRSDSWINLVEDIGYLADLQINNQDRAKVLTRLRLTLDFLIPIESYWAFPSKRVFAELCQYIEREDFTTARQLARRIHRALSAGTYRHDNKVLQSERELPSHIETTSEQQARLSQPYFEVLIVDEMSPAEEDALRRRVISKRCSDDPFIFDIVVVPSFEDALIASLINFNLQAVVIRHGFPARSVNHVDMLERLFIDVDQDIESLPEMERGTLLGRHIAKLRPELDLYLVTDAGVENIASHAGSEIFKRIFFGEEDHIELYNAIMKGVGERYRTPFFNALRDYSKQPTGMFHALPLARGKAILNSNWIGDLAQFYGMNLFMAETSATSGGLDSLLEPVGPLKHAQEYAARAFGAKRTFFATNGTSTCNKIVVQSLVREGDIVLVDRNCHKSHHYGLVLTGASAAYLDSYPLNEYSMYGAVPIWHIKQTLLSFKRAGTLDRVKLVLLTNCTFDGVVYDVERVMMECLAIKPDLIFLWDEAWFAFASCHPIYRQRTAMANAAKLAERFKTPEYAREYAEWKDSIDWEDDQQLINTRLMPDPALARVRVYSTHSTHKTLTALRQGSMIHIWDQDFKEKSEEAFIEAYMTHTSTSANYQILASLDVGRRQVEMEGYQLVQRQLELAMSLREQVMHHPLLKRHFHFLRVGNIIPTAYRESGVNSYFDEGKGWANLEKAWSMDEFVMDPTRATLMIGMVGMDGDTFKNTELMNKYGIQINKTSRNTVLFIINIGTTRSAIAYLIEVLVKIARDVDRRVADMSSAERRIHLKRVNSLTQEQPPLPDFSAFHRAFRGQSLNPAIQTRDGNIRQAFFLSYEDSSCEYIDMQEAAVAIASGRELVSALFVIPYPPGFPILVPGQVISSEILKFMAALDVKEIHGFRPELGFRVFTQETLDRVLHAKESFESIMQYQQINNLRAG

SEQ ID NO: 1875 - DNA, 1482 bp, Bacillus thuringiensis
  CDS (1)..(1482)
atgtatagattgtcccaatacgaaacaccattgtttaccgctttagttgagcacagtaagcgaaatccaattcaattccatattccaggtcataaaaaagggcaaggcatggatcctgaatttcgcgaatttattgggcataatgcattagcaattgatttaattaacattgcgccgctcgatgatttacatcatccaaaaggtatgattaaagaagcacaagatttagcagccgctgcatttggcgcggatcatactttcttttctattcaaggtacaagtggcgcaataatgacaatggtgatgagcgtttgcggtcctggtgacaaaatactagtgccacgaaacgtgcataaatcagtaatgtcagctattattttctcaggtgcaaaacctattttcatgcatcctgaaatcgatccaaaacttggtatttcacatggaatcacaatccaatctgtcaaaaaagcacttgaagagcactcagatgcgaaaggcttacttgttattaatccaacatactttggctttgctgcggacttagaacagattgtacaattagcacattcttacgatatccctgtactcgttgatgaggctcatggtgttcatattcattttcacgatgaattgccgatgtcagcgatgcaagccggtgcagatatggcagcaacgagtgttcacaaattaggtggatctttaacgcaaagttctattcttaatgtaaaagaaggccttgtgaacgtaaaacatgttcaatctattattagcatgcttacgactacatcaacgtcttacatcttgttagcctccctagatgttgctagaaaacgtcttgctacagaaggaaaggcgctcatagaacaaacaatacaattagcggaacaagttcgtaatgctataaatgatattgaacatctttactgtccagggaaagaaatgctaggtacggatgctacttttaactatgatcctacaaagataattgtatctgtaaaagatttaggtattacaggccatcaggctgaagtatggcttagagagcaatataacattgaagtagaactctcagatttatacaacatactatgtcttgtcacttttggggatacagaaagtgagacgaatacacttattgcagcattacaagatttatcagcaacatttaaaaataaagctgataaaggtgttcgaatacaagtagaaattccagaaatacctgtgttagcactttctcctcgagatgctttttattcggaaacagaagtcatcccatttgaaaatgcagcaggtcgtattatagctgatttcgttatggtttatccgccagggattccaatctttactccgggggaaattattacacaagacaacttagagtatattcgtaaaaacttagaagcaggtttacctgtacaaggtcctgaagatatgacattacaaacattacgcgtgatcaaagagtacaagcctatcagttga

SEQ ID NO: 1876 - protein, 493 aa, Bacillus thuringiensis
MYRLSQYETPLFTALVEHSKRNPIQFHIPGHKKGQGMDPEFREFIGHNALAIDLINIAPLDDLHHPKGMIKEAQDLAAAAFGADHTFFSIQGTSGAIMTMVMSVCGPGDKILVPRNVHKSVMSAIIFSGAKPIFMHPEIDPKLGISHGITIQSVKKALEEHSDAKGLLVINPTYFGFAADLEQIVQLAHSYDIPVLVDEAHGVHIHFHDELPMSAMQAGADMAATSVHKLGGSLTQSSILNVKEGLVNVKHVQSIISMLTTTSTSYILLASLDVARKRLATEGKALIEQTIQLAEQVRNAINDIEHLYCPGKEMLGTDATFNYDPTKIIVSVKDLGITGHQAEVWLREQYNIEVELSDLYNILCLVTFGDTESETNTLIAALQDLSATFKNKADKGVRIQVEIPEIPVLALSPRDAFYSETEVIPFENAAGRIIADFVMVYPPGIPIFTPGEIITQDNLEYIRKNLEAGLPVQGPEDMTLQTLRVIKEYKPIS

SEQ ID NO: 1877 - DNA, 1422 bp, Bacillus thuringiensis
  CDS (1)..(1422)
atgaatcaaaatcgcatacctttatatgaagcattaatagagtttaaagaaagaagaccgttatcctttcatgttccaggtcataaaaatggtttaaacttccctcaggaggtagtagaggagtttaaagatatactatctatcgatgtaactgagttgtcaggattagatgatttacatagtccgtttgaatgtatagatgaggcacaacaattattagctgatgtatatggagtgaacaaaagttattttttaattaatggttcaacagtcgggaatctagcaatgattttgtcttgttgtggggaacatgatattgttcttgtacaaagaaattgtcataaatcgattattaatggtttaaaattagcgggagcaaatcctatttttttagatccatggattgatgaagcttataacgtaccagtgggaattcatgatgagattattaaggaagcgattgaaaaatacccaaatgcgaaagcactcattttaacgcatcctaattattatggtatggggatggatctagaggcaagcattgcttatgcacatacacataaaatccctgtgctagtagatgaagcacatggggctcatttttgtttaggcggggcatttccacagtcagcgttagcatatggtgcagatattgtagttcattctgcgcataaaacattacccgcgatgacgatgggatcctatttacatataaatagtcgtttagtgaaagaagaaaaagtttctacttatttaagtatgctacaatctagtagtccatcgtatccaattatggcttctcttgatattgcacgctttacaatagcacgtataaaagaaaagggacatgatgaaattgtcgagtttttacaggaatttaaagaagaattgagtactattccacaaatagctattttacaatatccattacaagacgggctaaagattcccgtacagacgcgttgtcagttatcaggatacgaattacagtctgtatttgaaaaggtcggtatatatacagaaatggcagatccatataatgtcttatttattttgcctttgcaagtaaataagaaatatatgaaggctatagagatgatccgagtagcattgcaatactatgaggtgaaagacaagacggaatctattcgttatacttataaaggagaaatttctcccctgccgtatacatataaacaactggaagaatacgaaacaaaagtagtacctatagaagaagcagttgggatggtagcagcggaaatggtaattccgtatccacctggtattccattgattatgtatggagaaagaattacttcagaacataaagaacaaattatgtatttagaaaaagcaggtgctcgttttcaaggtagcacgaaatatatgaaagtgtatgatatagaaagtaggttttag

SEQ ID NO: 1878 - protein, 473 aa, Bacillus thuringiensis
MNQNRIPLYEALIEFKERRPLSFHVPGHKNGLNFPQEVVEEFKDILSIDVTELSGLDDLHSPFECIDEAQQLLADVYGVNKSYFLINGSTVGNLAMILSCCGEHDIVLVQRNCHKSIINGLKLAGANPIFLDPWIDEAYNVPVGIHDEIIKEAIEKYPNAKALILTHPNYYGMGMDLEASIAYAHTHKIPVLVDEAHGAHFCLGGAFPQSALAYGADIVVHSAHKTLPAMTMGSYLHINSRLVKEEKVSTYLSMLQSSSPSYPIMASLDIARFTIARIKEKGHDEIVEFLQEFKEELSTIPQIAILQYPLQDGLKIPVQTRCQLSGYELQSVFEKVGIYTEMADPYNVLFILPLQVNKKYMKAIEMIRVALQYYEVKDKTESIRYTYKGEISPLPYTYKQLEEYETKVVPIEEAVGMVAAEMVIPYPPGIPLIMYGERITSEHKEQIMYLEKAGARFQGSTKYMKVYDIESRF

SEQ ID NO: 1879 - DNA, 2358 bp, Rhodopseudomonas palustris
  CDS (1)..(2358)
atggactacttcaggcgtttcaccttcctgttctcggcaccgactttcgaggcggatgatctcgaaggcattcggttcaatcagatcgtcgcggagatcgagcggtccggcttcgagatcgtcaaggcgcgcaagctggaagatgccgagatcgcggtgcagaccgacgccgcgattggctgcatggtggtcgactggggcaagaagggcctcgagggcaagaccgccgcgctgatcaacctgatgcgccggcgcggtctcgatttcccgatcgtgctgctgatccgccgcaagaggttcgaggaagtgccggtcgaggtgctcgatttcatcgacggctacgtgtttctgtccgaggagacgccgaccttcatcgcccgcaacctgatcagccggctgaagcaatatgccgacacgctgaagacgccgttcttcggcgcgctggtcgactatgcggaggagggcaaccagctctggacctgccccggccacaacggcggcatgttctacagccgcagcccgatcgggcgggtgttcatcgagcatctcggcgaggcggtgttccgcgatgacctcgataattcggtgctcgaccttggcgatctgttgacccacgaggggccggcgctgcgcgcgcagaaggaagccgcgcagatcttcggtgccgagaagacctatttcgtgctcaacggcacctcgacctccaacaaggtcgccctcggcgcgctcgtctccgacggcgatctgatcctgttcgatcgcaacaatcacaaggcggcccatcacggcgcgctgatgatgggcggcggcattcccgtctacattcccacggttcgcaacgcctggggcctgatcgggccgatggcgtgggacgcgctggacgagacggcgctgcgcgaacgcattcgcagccatccgctggtcaaggaccctgaggcctggcgcaagccgcgcccgttccgcgtcgcggtggtcgaacagtgcacctacgacggcaccatccacagcgccgagatgatcctgcgccgcatcgggcatttgtgcgattacatcctgttcgacgaagcctgggccggcttcatgaagtttcatccgctgtatgccggccgcttcgcgatggggctggcgaacctcggcgacgatgcgcccggcatcatcgcgacgcagtcgacccacaagcagctcgccagtttctcccaggcgtcgcagatccacatcaaggatcgccacatccgcggccagaagcggcgggtcgagcatcggcgcttcaacgagagcttcatgcagcacgcctcgacgtcgccgttctatccgctgttcgcctcgctcgatgtcggcgcgcagatgatgaagggccgctccggcgaagtgctatgggacgatacgatccggcttggcatcgagctgcgcaagaagatccgcgcggtgcggagggagttcgaggagaaggaggcgcgggcggagcggcgctggttcttcgatccgttcgtgcccgatcgggtgacgatcgcggacgccgcccgtgaaggcgcggtgcacgatgtcgcctgggaggccgtgagcaccgaccagctcgcgaccgacccgacattctggcagatcgcgccgggcgcggcctggcacggctttgccgatatggcgcctggcttcgccatgaccgacccgaacaagctgacgctgctgacgccgggcttcgaccgggccaccggccgctatgccgagcacggcgtgccggcgccggtggtggcgcaatatctgcgcgagaaccgcattgttccggaaaagaacgatctcaactcgctgctatttctgctgacgccgggcgtcgaggcgagcaaggccggtacgctgatcagcggcctcgtcgcgttcaagaagctgcacgacgacaacgcgccgctcgacgaggtgatcccggaattcagccggcgccggcccgctcgctatgccggggtacggctgcgcgatttgtgcgggcagatgcaccggttcttccgcgacgccgatgtcagcgcgctgcaggccaagcagtttctgcccgaacatctacccgagatcgcgatgtcgccgcacgatgcggcgcgctgcctggtccgcaatgacgtcgactatctgccgatcagccagatcgcgggccggatcgccaccacgccgttcgtggtctatccgccggggatcgcgaccatcgtgcccggcgagcggctgagcgagcgagccaagccgatgctcgattacttgcagatgttcgagcgcagcttcaacgaattccccggcttcgaagtcgagattcagggcgtctatcgcgaattcgatgaattgggccgggttcgtctctacacctacgtcgtggccgaataa

SEQ ID NO: 1880 - protein, 785 aa, Rhodopseudomonas palustris
MDYFRRFTFLFSAPTFEADDLEGIRFNQIVAEIERSGFEIVKARKLEDAEIAVQTDAAIGCMVVDWGKKGLEGKTAALINLMRRRGLDFPIVLLIRRKRFEEVPVEVLDFIDGYVFLSEETPTFIARNLISRLKQYADTLKTPFFGALVDYAEEGNQLWTCPGHNGGMFYSRSPIGRVFIEHLGEAVFRDDLDNSVLDLGDLLTHEGPALRAQKEAAQIFGAEKTYFVLNGTSTSNKVALGALVSDGDLILFDRNNHKAAHHGALMMGGGIPVYIPTVRNAWGLIGPMAWDALDETALRERIRSHPLVKDPEAWRKPRPFRVAVVEQCTYDGTIHSAEMILRRIGHLCDYILFDEAWAGFMKFHPLYAGRFAMGLANLGDDAPGIIATQSTHKQLASFSQASQIHIKDRHIRGQKRRVEHRRFNESFMQHASTSPFYPLFASLDVGAQMMKGRSGEVLWDDTIRLGIELRKKIRAVRREFEEKEARAERRWFFDPFVPDRVTIADAAREGAVHDVAWEAVSTDQLATDPTFWQIAPGAAWHGFADMAPGFAMTDPNKLTLLTPGFDRATGRYAEHGVPAPVVAQYLRENRIVPEKNDLNSLLFLLTPGVEASKAGTLISGLVAFKKLHDDNAPLDEVIPEFSRRRPARYAGVRLRDLCGQMHRFFRDADVSALQAKQFLPEHLPEIAMSPHDAARCLVRNDVDYLPISQIAGRIATTPFVVYPPGIATIVPGERLSERAKPMLDYLQMFERSFNEFPGFEVEIQGVYREFDELGRVRLYTYVVAE

SEQ ID NO: 1881 - DNA, 2837 bp, Shigella boydii
  CDS (165)..(2435)
ttagccgtcgataataagcagtgaaaataatttaaaataatcacataacgcattgtttataaaaataaatatttcaaaaatgtttgtttttcacgcgctttacagcccgaaaaggccggaagatacttgcccgcaacgaagattccttcataaccgggtaagcaatgatgaaagtattaattgttgaaagcgagtttctccatcaagacacctgggtcggtaacgccgttgagcgtctggcagatgctttaagccagcaaaatgttaccgtgattaaatccacctcctttgatgatggttttgccattctctcttcaaacgaagccattgactgcctgatgttcagctatcaaatggaacatccggacgaacatcaaaacgtcagacaattgatcggtaagcttcatgagcgccaacaaaacgtgccggtcttcctgttgggcgatcgggaaaaagccctcgccgcaatggatcgcgacctgctggagcttgtcgatgaattcgcctggattctggaagataccaccgactttatcgccggacgcgccgttgccgctatgacccgctaccgccagcagctgttgccgccactgttcagcgcgctgatgaaatatagcgacatccatgaatattcctgggcagcgccaggccaccagggcggcgttggttttaccaaaacacccgccggacgtttctaccatgactactatggagaaaatctgttccgcaccgatatgggcatcgaacgaacttccctcggttctttgcttgaccatactggcgcatttggggaaagcgaaaaatatgccgcacgcgtatttggtgccgatcgctcctggtcggtagtcgtcggtacttccggctctaaccgcaccatcatgcaggcttgcatgaccgataacgatgtcgtggtcgttgaccgtaactgccataaatccatcgaacaaggcttgatgctgacaggcgcgaaaccggtctacatggtgccaagccgcaaccgctacggcattatcgggccaatctatccgcaggaaatgcaacctgaaaccttgcagaagaaaatcagtgaaagcccgctgactaaagacaaagccgggcaaaaaccgtcttactgcgtggtgaccaactgcacctatgacggcgtgtgttataacgctaaagaagcgcaggatctgctggaaaaaacctccgatcgtctgcactttgacgaagcctggtacggctatgcacgtttcaacccgatctatgccgatcactatgccatgcgcggcgaacctagcgatcacaacggtcctaccgttttcgccacccactccacccacaaactgctgaatgcgctttcacaggcttcttatattcatgtacgtgaaggtcgtggggcgattaacttctcccgcttcaaccaggcctacatgatgcatgccaccacctccccgctgtatgccatctgcgcatccaacgacgtggcggtgtcgatgatggacggcaacagcggcctgtcactgacgcaggaagtgatcgacgaagcggttgatttccgtcaggcgatggcgcggctgtataaagagttcaccgctgacggtagctggttcttcaaaccgtggaacaaagaagtcgtcaccgacccacaaaccggcaaaacctatgactttgctgacgcaccaaccaaactgctgaccaccgttcaggactactgggtaatgcatccgggcgaaagctggcacggcttcaaagatattccggataactggagtatgctcgacccgattaaagtcagcatccttgctccgggaatgggtgaagatggtgaactggaagaaaccggtgttccggcggcgctggtcactgcctggcttggtcgccacggcattgtgcctacccgcaccactgacttccaaattatgttcctgttctctatgggcgtaacccgtgggaaatgggggactctggttaacaccctttgctccttcaaacgccactatgacgccaacacaccgctggcgcaggtgatgccggaacttgttgaacaatatcctgacacttacgcgaacatggggattcacgatctgggtgacaccatgtttgcctggctgaaagaaaacaaccctggcgcacggttgaacgaagcctattccggcctgccggtggcggaaatcaccccgcgtgaagcgtacaacgcgattgtcgacaacaatgtcgaattggtatccattgaaaatctgccaggacgcatcgcggcaaactcagttatcccatatccgccaggaatcccgatgctgctgtctggtgaaaacttcggcgataaaaacagtccgcaagtaagttatttacgctcgctgcaatcctgggaccaccatttccctggatttgaacacgaaactgaagggactgaaattattgacggtatttaccacgttatgtgtgtgaaagcgtaaccactattccgctgaaggcgtaattgtttaaataacattacgccgcctggccttaggccttttgagtatggcaacgttttcataaaaattgctgcaaacaaaaatgtcatactttttgcgcggccccaccccgcgcttttttttgcctgttatttaccctgtaaaaaaatatgtacatgagaaattactataaaaatttgtaatattagtaaaactcgttatttttatgtatgtttatattcgtcatacaattatataaccatttcccggtatcgctttgctttagcgagaactggtcttttattcgcactcaggagtacatgtatgaggatttgcagcgaccaaccttgtattgttttattgactgaaaaagatgtctggataagggtgaatgggaaagaa

SEQ ID NO: 1882 - protein, 756 aa, Shigella boydii
MMKVLIVESEFLHQDTWVGNAVERLADALSQQNVTVIKSTSFDDGFAILSSNEAIDCLMFSYQMEHPDEHQNVRQLIGKLHERQQNVPVFLLGDREKALAAMDRDLLELVDEFAWILEDTTDFIAGRAVAAMTRYRQQLLPPLFSALMKYSDIHEYSWAAPGHQGGVGFTKTPAGRFYHDYYGENLFRTDMGIERTSLGSLLDHTGAFGESEKYAARVFGADRSWSVVVGTSGSNRTIMQACMTDNDVVVVDRNCHKSIEQGLMLTGAKPVYMVPSRNRYGIIGPIYPQEMQPETLQKKISESPLTKDKAGQKPSYCVVTNCTYDGVCYNAKEAQDLLEKTSDRLHFDEAWYGYARFNPIYADHYAMRGEPSDHNGPTVFATHSTHKLLNALSQASYIHVREGRGAINFSRFNQAYMMHATTSPLYAICASNDVAVSMMDGNSGLSLTQEVIDEAVDFRQAMARLYKEFTADGSWFFKPWNKEVVTDPQTGKTYDFADAPTKLLTTVQDYWVMHPGESWHGFKDIPDNWSMLDPIKVSILAPGMGEDGELEETGVPAALVTAWLGRHGIVPTRTTDFQIMFLFSMGVTRGKWGTLVNTLCSFKRHYDANTPLAQVMPELVEQYPDTYANMGIHDLGDTMFAWLKENNPGARLNEAYSGLPVAEITPREAYNAIVDNNVELVSIENLPGRIAANSVIPYPPGIPMLLSGENFGDKNSPQVSYLRSLQSWDHHFPGFEHETEGTEIIDGIYHVMCVKA

SEQ ID NO: 1883 - DNA, 1380 bp, Listeria monocytogenes
  CDS (1)..(1380)
atgaggaatcaatctaaaatgcctttagtggaacggttagatgctcatgctaagtcttgcccaatatcactccatgtgccaggacacaaaagcggagccatttatccagatgcatggcaaaaatttttgaaatgggacgtaacagaaattactggaatggatgatttgcatcacccagaagatgtgattttggaagcagaggagttacttgcggaatgttatggaagcaaaaaaagctactttttagtcaatgggacaagcggaggaagcttggcagttattatggcgacgttgaagcacggggagaaagttttagtgccaagagatgcgcataaatcaatcttgcatggaatcgaactggcaggcggagaaccgattttcttaaccccagcgacaaacaaagaagttggcgtcgcgagtggcgtgacaaccgaacttctcgaagaaacattacataatcacccagatataaaactatgtattttcacttatccgagctattatggaacgacttttaacttgcataaatgtattcaaattgcgcatgattttggtgcggttgtgtttgttgatgaagcgcacggagcacattttttaacaagttctgaatttccgaaaagtgcagtggagcttggtgcggatgtggttgttcagtcggcgcataagacgttgccggcgctaacgatgggttcctatttacatgtggtgaatgatttaccgatttttgaaaaactaccttattacctgcaagtattccaaacgagcagcccatcttatttaattatggcgtcacttgatgcggcgaggaaatatgcggcaacttacacagcggcggacgtcgaagctttttggaaaatgcgtgccagatggattaaatggctgacgaagaataaatttgacgttattttgccagatgatccgcttaaaatcatcgtgcgcaaaacaggctacacgggctacgaactgcaagcaatttttgaagaaagctcttatttcccagagcttgccgatgagtcacaggtattactgattttaccattaattaaaaaagggattgatttcacgcctattagccggattcattctccggtgaaaaaagaaatcgcgaaagaaccatatgaaatgtcagcgccttttgcgtcaggtcttgcgctaacttatgaagaaatgcacgcacgcgcgaccgaattcgtattactagatgaagctacgacacgcgtttcggctgaaacaatctcgctctatccgccgggaattccagcaatcatccgcggagaaagcatcacagaaaagcatattcgcgaactaaaaaacattcgcacacgccactaccaaggcggcgaaaaactagccgagaattacatccgtgtattccgctaa

SEQ ID NO: 1884 - protein, 459 aa, Listeria monocytogenes
MRNQSKMPLVERLDAHAKSCPISLHVPGHKSGAIYPDAWQKFLKWDVTEITGMDDLHHPEDVILEAEELLAECYGSKKSYFLVNGTSGGSLAVIMATLKHGEKVLVPRDAHKSILHGIELAGGEPIFLTPATNKEVGVASGVTTELLEETLHNHPDIKLCIFTYPSYYGTTFNLHKCIQIAHDFGAVVFVDEAHGAHFLTSSEFPKSAVELGADVVVQSAHKTLPALTMGSYLHVVNDLPIFEKLPYYLQVFQTSSPSYLIMASLDAARKYAATYTAADVEAFWKMRARWIKWLTKNKFDVILPDDPLKIIVRKTGYTGYELQAIFEESSYFPELADESQVLLILPLIKKGIDFTPISRIHSPVKKEIAKEPYEMSAPFASGLALTYEEMHARATEFVLLDEATTRVSAETISLYPPGIPAIIRGESITEKHIRELKNIRTRHYQGGEKLAENYIRVFR

SEQ ID NO: 1885 - DNA, 1482 bp, Bacillus cereus
  CDS (1)..(1482)
atgtatagattgtcccaatacgaaacaccattgtttaccgctttagttgagcacagtaagcgaaatccaattcaattccatattccagggcataaaaaaggacagggcatggatcctgaatttcgcgaatttattgggcataatgcattagcaattgatttaattaatattgcgccgctcgatgatttacatcatccaaaaggtatgattaaagaagcacaggatttagcagccgctgcatttggtgcggatcatactttcttttctattcaaggtacaagtggcgcaattatgacaatggtgatgagcgtttgcggtcctggtgacaaaatactagtaccacgaaacgtgcataaatcagtaatgtcagctattattttctcaggtgcaaaacctattttcatgcatcctgaaattgatccaaaacttggtatttcacatggaatcacaattcaatctgtcaaaaaggcacttgaagagcactcagatgcgaaaggcctacttgttattaacccaacatactttggctttgctgcggacttagaacagattgtacaattagcacattcttacgatatccctgtactcgttgatgaggctcatggtgttcatattcattttcacgatgaactgccgatgtcagcgatgcaagccggtgcagatatggcagcaacaagtgttcacaaattaggtggatctttaacgcaaagttctattcttaatgtaaaagaaggccttgtgaacgtaaaacatgttcaatctattattagcatgcttacgactacatcaacgtcttacatcttgttagcctccctagatgttgctagaaaacgtcttgctacagaaggaacggcactcatagaacaaacaatacaattagcggaacaagttcgtgatgctataaatgatatcgaacatctttactgtccagggaaagaaatgctaggtacggatgctacttttaactatgatcctacaaagataattgtatctgtaaaagatttaggtattacaggccatcaggctgaagtatggcttagagagcaatataacattgaagtagagctctcagatttatacaacatactatgtcttgtcacttttggggatacagaaagtgagacaaatacacttattgcagcattacaagatttatcagcaacatttaaaaataaagctgataaaggtgttcaagtgcaagtagaaattccagaaatacctgttttagcactttctcctcgagatgctttttattcggaaacagaagtcatcccatttgaaaatgcagcaggtcgtattatagctgatttcgttatggtttatccgccagggattccaatctttactccgggggaaattattacacaagataacttagagtatattcgtaaaaacttagaagcaggtttacctgtacaaggtcctgaagatatgacattacaaacattacgcgtgattaaagagtacaagcctatcagttga

SEQ ID NO: 1886 - protein, 493 aa, Bacillus cereus
MYRLSQYETPLFTALVEHSKRNPIQFHIPGHKKGQGMDPEFREFIGHNALAIDLINIAPLDDLHHPKGMIKEAQDLAAAAFGADHTFFSIQGTSGAIMTMVMSVCGPGDKILVPRNVHKSVMSAIIFSGAKPIFMHPEIDPKLGISHGITIQSVKKALEEHSDAKGLLVINPTYFGFAADLEQIVQLAHSYDIPVLVDEAHGVHIHFHDELPMSAMQAGADMAATSVHKLGGSLTQSSILNVKEGLVNVKHVQSIISMLTTTSTSYILLASLDVARKRLATEGTALIEQTIQLAEQVRDAINDIEHLYCPGKEMLGTDATFNYDPTKIIVSVKDLGITGHQAEVWLREQYNIEVELSDLYNILCLVTFGDTESETNTLIAALQDLSATFKNKADKGVQVQVEIPEIPVLALSPRDAFYSETEVIPFENAAGRIIADFVMVYPPGIPIFTPGEIITQDNLEYIRKNLEAGLPVQGPEDMTLQTLRVIKEYKPIS

SEQ ID NO: 1887 - DNA, 1422 bp, Bacillus cereus
  CDS (1)..(1422)
atgaatcaaaatcgcatacctttatatgaagcattaatagagtttaaagaaagaaggccgttatcttttcatgttccaggtcataaaaatggtttaaacttccctcaaggggcagtagaggagtttaaagatatactatctatcgatgtaactgagttatcagggttagatgatttacatagtccgtttgaatgtatagatgaggcacaacaattattagctgatgtatatgaagtggaaaaaagttattttttaattaatggttcaacagtcgggaacttagcaatgattttgtcttgctgtagggaacatgatattgttcttgtacaaagaaattgtcataaatcaattattaatggtttaaaattagcaggagcaaatccaatttttttagattcatggattgatgaagcttataacgtacccgtgggaattcatgatgagattattaaggaagcaattgaaaaatacccaaatgcgaaagcacttattttaacacatcctaattattatggtatggggatggatttagaggcaagcattgcttatgcacatgcacataaaattcctgtgttagtagatgaagcgcatggagctcatttttgtttaggcggggcatttccaaagtcagctttagcatatggtgcagatattgtagttcattccgcacataaaacattacctgcgatgacgatgggatcctatttacatataaatagccgcttagtgaaagaagaaagagtttctacttatttaagtatgctacaatctagtagtccatcgtatccaattatggcttctcttgatattgcacgctttacgatagcgcgtataaaagaaaagggacatgatgaaattgtcgagtttttacgggagtttaaagaagaattgtcttctatcccacaaatagctattttacaatatccattacaagacgagctaaaagttaccgtacagacgcgttgtcagttatcaggatacgaattacagtctgtattagaaaaggttggtatatataccgaaatggcagatccatataatgtcttatttattttacctttgcaagtaaataagacgtatatgaaggctgtagagatgatccgggcggcattgcaatcttatgaggtgaaagacaagacggaatctattcgttatacttataaaggagaaatttctcctttaccgtatacatataaacaactggaaggatatgaaacaaaagtagtatctgtagaagaagcagttgggatgatagcggcggaaatggtaattccatatccacctggtattccattgattatgtatggggaaagaattacttcagaacataaagagcaaattatgcatttagagagagcaggcgcccgttttcaaggtagcacgaaatatatgaaagtgtatgatatagaaagtaggttttag

SEQ ID NO: 1888 - protein, 473 aa, Bacillus cereus
MNQNRIPLYEALIEFKERRPLSFHVPGHKNGLNFPQGAVEEFKDILSIDVTELSGLDDLHSPFECIDEAQQLLADVYEVEKSYFLINGSTVGNLAMILSCCREHDIVLVQRNCHKSIINGLKLAGANPIFLDSWIDEAYNVPVGIHDEIIKEAIEKYPNAKALILTHPNYYGMGMDLEASIAYAHAHKIPVLVDEAHGAHFCLGGAFPKSALAYGADIVVHSAHKTLPAMTMGSYLHINSRLVKEERVSTYLSMLQSSSPSYPIMASLDIARFTIARIKEKGHDEIVEFLREFKEELSSIPQIAILQYPLQDELKVTVQTRCQLSGYELQSVLEKVGIYTEMADPYNVLFILPLQVNKTYMKAVEMIRAALQSYEVKDKTESIRYTYKGEISPLPYTYKQLEGYETKVVSVEEAVGMIAAEMVIPYPPGIPLIMYGERITSEHKEQIMHLERAGARFQGSTKYMKVYDIESRF

SEQ ID NO: 1889 - DNA, 1458 bp, Mycobacterium paratuberculosis
  CDS (1)..(1458)
atggaccaatccgacgcacctttgctcaacgcgctggccgactatcgcgacaagaaccggtacgggttcgcgccgcccgggcaccggcagggccgcggcaccgacgatcgggtcctcgcggtgctgggccgcgagccctttctcgacgacgtgctggccagcggcgggctcgacgaccgtcgcgccagcaacggctacctgcagcgcgcggaggacctgatggccgaggccgtcggcgccgagatcgcctggttctccacctgcggcagctccctgtcggtgcgcgcggcgatgatggcggtggccggtgggcagggcagcctgctggtcggccgggacagccacaagtcgatcgtggcggggctgatcttctccggggtgcagccgcgctggatcactccccgctgggacgccgagcgccacttttctcatccgccctcgccgcagcaggtcgaagaggcctgggacaagcatcccgatgccgccggtgcgctggtcgtcagccccagcccgtacggcacctgcgccgacatcgccggcatcgccgaggtgtgtcatcggcggggcaagccgttgatcctcgacgaggcgtggggggcgcatctgccgttccacgaggacctgccaacctgggcgatggatgccggcgccgacgtgtgcgtggtcagcgtgcacaagatgggcgccggtttcgagcagggctcggtgttccacgtccagggcgacctcatcgaccgggaccgcctctcggcgtgcgcggatctgctgatgaccaccagccccaacgtcctgatctacgcggcgatggatggctggcgccggcagatggtgcagcacggtcaccaattgctcggcgctgcattggatttggcgcggcaggtgcgcgacgagatcgagctcattcccgatgtggaggtgctcgacgacgagctgctgggcgtgcaggcgtcccacgacctggaccgcatgcaggtgctgatcgacgtatgcggcaccggcacatcgggttatcaggccgccgactggctgcgcgagcacgcgcgcatcgacgtgggcatgagcgaccaccgccgcatcctggccaccttgtccatggccgacgacaaggagacgttgggtcgtctcaccgatgcgctgcgggcgtggcgcaccgcggcgcaggacttcgaccccgccccccggatcgcgctgccgtcgccgtccgaaatgcagttggagacggtcgaattgccacgcgacgcgtttttcggacgggtgcaggaggtgccgaccaaaaccgccgccggccggatcgccgccgaacagatcacgccctatcccccgggcatccccgccgtcgtccccggcgagcggctcaatgatgctgtgctggactacctttgctccggggtggccgcggggatgaacctgcccgacgcggccgatccgtcgctgcagaccatccgggtgctcgcctga

SEQ ID NO: 1890 - protein, 485 aa, Mycobacterium paratuberculosis
MDQSDAPLLNALADYRDKNRYGFAPPGHRQGRGTDDRVLAVLGREPFLDDVLASGGLDDRRASNGYLQRAEDLMAEAVGAEIAWFSTCGSSLSVRAAMMAVAGGQGSLLVGRDSHKSIVAGLIFSGVQPRWITPRWDAERHFSHPPSPQQVEEAWDKHPDAAGALVVSPSPYGTCADIAGIAEVCHRRGKPLILDEAWGAHLPFHEDLPTWAMDAGADVCVVSVHKMGAGFEQGSVFHVQGDLIDRDRLSACADLLMTTSPNVLIYAAMDGWRRQMVQHGHQLLGAALDLARQVRDEIELIPDVEVLDDELLGVQASHDLDRMQVLIDVCGTGTSGYQAADWLREHARIDVGMSDHRRILATLSMADDKETLGRLTDALRAWRTAAQDFDPAPRIALPSPSEMQLETVELPRDAFFGRVQEVPTKTAAGRIAAEQITPYPPGIPAVVPGERLNDAVLDYLCSGVAAGMNLPDAADPSLQTIRVLA

SEQ ID NO: 1891 - DNA, 2853 bp, Mycobacterium paratuberculosis
  CDS (1)..(2853)
atgatccgatacagcacccagccgcgacggctgcgggtgtccgcgctggcggccgtggccaacccgtcgtacgcccgggtggacacctggaacctgctcgacgacgcctgccggcacctcgccgaggtcgacctggccgggctggacaagacgcacgacgtggcccgggtgaagcgcctgctggaccgcatcgccgcctacgagcgctactggctgtaccccggcgcggagaacctggcgatcttccgcgcccacctggacagcctgtccacggtgcggctcaccgaggaggtctccctggcggtgcggctgttgagcgaatacggcgatcgcgcagggcttttcgacacgtcggcgccgctggacgaccaggagctggtggcccaggccaagcaacagcatttctacaccgtgctgctggccgacgacgcccccagcaccgcaccggacagcctggccgaatgcctgcgggcgctgcgcaacccgtccgacgacgtgcagttcgagatcctggtggtgcccagcgtcgaggacgccatcaccgcggtcgcgctgaacggggagatccaggccgcgatcatccgcgacgacctgccgctgcgctcccgcgaccggctgccgctgatgaacaccctgctcgggcccaacgaggacgcggacggcgtcatccccgaccgcgccaacgactgggtggagtgcggcgagtggatccgcgagctgcgcccgcacatcgacctgtatctgctcaccgacgaatcgatcgcggcgggcgacgacaccgaacccgacgtctacgaccgcaccttctaccggctcaacgacgtcaccgacctgcacagcacggtgctcgccgggctgcggaaccgttatgccacaccgtttttcgacgcgctgcgggcgtacgcggcggccccggtcggccagttccacgcgctgccggtggcgcgcggggccagcatcttcaactcccgctcgctgcaggacatgggggagttctacggccgcaacatcttcatggccgaaacctccaccacctccggcggcctggactcgctgctggacccgcacggcaacatcaagaaggcgatggacaaggcggccaagacctggaacgccgaccacacctacttcgtcaccaacggcacgtcgaccgccaacaagatcgtcgtgcagtcactgacccggcccggcgacatcgtgctgatcgaccgcaactgccacaagtcgcaccactacgggctggtgctggccggggcgtacccgctgtacctggacgcctatccgttgccgcagttcgcgatctacggggcggtgtcgctgcgcaccatcaagcagaccctgctggacctggaggcggccgggcagttgcaccgggtgcggatgctgctgctgaccaactgcaccttcgacggcgtggtctacaacccgctgcaggtcatgcaggaggtgctggcgatcaagccggacatctgctttttgtgggacgaggcgtggtacgcgttcgccaccgccgtgccgtgggccaggcagcgcaccgcgatggtggccgccgagcggctcgagcagatgctggcctcgccggattacgttgagcaataccggaaatgggccgcgtcgatgcagggcgtggaccgttcggagtggatcgagcgggagctgctgcccgaccccgccaccgcccgggtgcgggtctacgccacccattccacgcacaagtcgctctcggcgctgcgccaggcgtcgatgatccacgtgcgggaccaggatttcaacgcgctcacccgcgacgcgttcggtgaggcgtttttgacccacacctcgacctcgcccaaccagcagctgctggcgtcgctggatctggcccgccgccaggtcgacatcgagggcttccagctggtccggcaggtctacgacatggcgctggtgttccggcaccgggtccgcaaggaccggttgatcagcaagtggttccgcatcctcgacgagtccgacctggtgcccgaggagttccgggcgtcgtcggtgagctcctaccgcgaggttcggcagggggcgctggccgagtggaacgaggcgtggcgctccgaccagttcgtgctggacgccacccgggtcaccctgttcgtcggcgccaccggcatgaacgggtacgacttccgggagaagatcctgatggaacgcttcggcatccagatcaacaagacctcgatcaacagcgtgctgctgatcttcaccatcggcgtcacctggtccagcgtccactatctgctcgacgtgttacgaagggtggcaacggatttcgatcgcatccagaaggaggccagtgccgccgaccgggcgctgcaacgacgccacgtcgaggagatcaccgaggaccttccgcacctgcccgacttcagcgaatttgacgtcgccttccggccggtcgacgaatgcaacttcggcgacatgcggtcggcgttctacgccgggtacgaggagtccgaccgcgagcacgtgctgatcggcacggccgggcggcggctggccgagggcaagaacctggtgtcgaccaccttcgtggtgccctacccgccgggtttcccggtgctggtgcccggccaggtggtgtccaaggagatcgtctacttcctggcccagctcgacgtgaaggaaatccacggctacaacccggatttggggctgtcggtgttcaccgacaccgcgctggcgcggatggaggcgcagcgcaacgccgcgaccgccgcggtgggttcggtgaccgcggccttcgagttgcccgcggacgcctccggcggcaacggggcgcacaacggcgccggcgcggtgccgtcggtcgccgacggcggctga

SEQ ID NO: 1892 - protein, 950 aa, Mycobacterium paratuberculosis
MIRYSTQPRRLRVSALAAVANPSYARVDTWNLLDDACRHLAEVDLAGLDKTHDVARVKRLLDRIAAYERYWLYPGAENLAIFRAHLDSLSTVRLTEEVSLAVRLLSEYGDRAGLFDTSAPLDDQELVAQAKQQHFYTVLLADDAPSTAPDSLAECLRALRNPSDDVQFEILVVPSVEDAITAVALNGEIQAAIIRDDLPLRSRDRLPLMNTLLGPNEDADGVIPDRANDWVECGEWIRELRPHIDLYLLTDESIAAGDDTEPDVYDRTFYRLNDVTDLHSTVLAGLRNRYATPFFDALRAYAAAPVGQFHALPVARGASIFNSRSLQDMGEFYGRNIFMAETSTTSGGLDSLLDPHGNIKKAMDKAAKTWNADHTYFVTNGTSTANKIVVQSLTRPGDIVLIDRNCHKSHHYGLVLAGAYPLYLDAYPLPQFAIYGAVSLRTIKQTLLDLEAAGQLHRVRMLLLTNCTFDGVVYNPLQVMQEVLAIKPDICFLWDEAWYAFATAVPWARQRTAMVAAERLEQMLASPDYVEQYRKWAASMQGVDRSEWIERELLPDPATARVRVYATHSTHKSLSALRQASMIHVRDQDFNALTRDAFGEAFLTHTSTSPNQQLLASLDLARRQVDIEGFQLVRQVYDMALVFRHRVRKDRLISKWFRILDESDLVPEEFRASSVSSYREVRQGALAEWNEAWRSDQFVLDATRVTLFVGATGMNGYDFREKILMERFGIQINKTSINSVLLIFTIGVTWSSVHYLLDVLRRVATDFDRIQKEASAADRALQRRHVEEITEDLPHLPDFSEFDVAFRPVDECNFGDMRSAFYAGYEESDREHVLIGTAGRRLAEGKNLVSTTFVVPYPPGFPVLVPGQVVSKEIVYFLAQLDVKEIHGYNPDLGLSVFTDTALARMEAQRNAATAAVGSVTAAFELPADASGGNGAHNGAGAVPSVADGG

SEQ ID NO: 1893 - DNA, 2100 bp, Lactobacillus johnsonii
  CDS (1)..(2100)
atgaattttctaaaaattgcattaagcaatcaacttaaaaataatgattttaattcatggcaaactactaatttgaacgatgaaactcaagctagtgaacttgccgctattgttgtagcagagactgataaaagtagtcttaaaactgctcaagatttacaaaaaaaatcagggcttggaattcctattattaaagtttcacatgaaacaatttctaataatgaaaaaaatcaaataattgatgccgcaaatcaatacacagcagaaatggttcctggctttttaactgatttggtcaatttcgcagaagatcgtccaattagttttacgacaccaggtcatcataatggcttatattacgaaaaacatccggcgggggtagtatttaatcgcttctttggtaaaaacctcatgtttgcggataccagtgatacagtaccagaattaggcgatactatgacccacgaagggacgcctttaactgctgagcaaaaagctgccgaaacttatcatgctgataaagtttatttctgtactaatggaacaacgagtgcaaattcaatttgtgcaagtgcactattaactaaagatgacctagttctttttgatcgaaataatcataaatccctctataacagtgccttagtaatgactggtgccaaacctgtatatattccaactgatcgtaatgcacttggattaattggagaaatggatcctgactttttaaatgaagaaaaaattcgagctgaaattgctaaagttgaccctgaaaaagctaaagctaagcgtccatttagactagctatcattcaatcagaaacatatgatggtcttttttacgacgcgaagtggatgattgataaaattggtaaactatgcgattacattctttttgattgtgcttggggtggattcgaacagtttgttccaattatgaatcacctgtctcccctcaacttagactttgggtcagaagatccgggtattttagtaactcaatcacttcataaacaacaagccggaatgggccaagcctcacaaattttgaaaaaggatgctcatattaaaggtcagaaacgttacgttgatcataagcactttaaccacgcttatcttaaatttgttacctcaagttactcttatccactttatgcctcactcaccgttaactcatatttaaccagcggtgagggtaataaaaaatggtgggaccaaatcttacgcttaggaattgaatggcggaaagaattaattaaaaaatcaaaattatttaagccactagtaattgataattttgaaaatattagtactgatgagttagctacaaatgaaaagtactggaatttagattccactaatctgtggcatggatttagcaaaattgcgtctggtcaggccatgatcgatcctctaaaaattactgttgtaactcccggaattgatgttaaaaatgcaaaatatgaagaaataggtattcctggaccagttgttgcagaatttttaatggagaagcggattattcgtgcaaaagatgacctatattctcttcttttcttattaacgccgggagatactaaggctgaattagatatcttgctgaatgcattcttagaatttgaacaatattataacgaggatgcacctctagacaaagtgctccctaagctaactaaagtatacggcgatcgctacaaaggttataccttaaaacagctctgccaagaaatgcatgaatattaccggggaaataatacctttaccctccagcaagaattatttgcgaaaccagatatgcaaaattatcaaatgactcccgagcatgctgactatctctttatgaaaaatgaaagtgaattagttaacttagaagatgttaaaggtcgcattgctgctgaaggtgccttaccttacccaccaggcgtgttcattgttgcgcccggcgaaaaatggagcgatattgatcaaaaatattttgaagttttagtaggtgctatcgagcgtttcccaggctttgtacctgaaattcagggagtctactgggatcaaaaatcagatggtaaaataagagtacaagcagaagtattaaaggagaattag

SEQ ID NO: 1894 - protein, 699 aa, Lactobacillus johnsonii
MNFLKIALSNQLKNNDFNSWQTTNLNDETQASELAAIVVAETDKSSLKTAQDLQKKSGLGIPIIKVSHETISNNEKNQIIDAANQYTAEMVPGFLTDLVNFAEDRPISFTTPGHHNGLYYEKHPAGVVFNRFFGKNLMFADTSDTVPELGDTMTHEGTPLTAEQKAAETYHADKVYFCTNGTTSANSICASALLTKDDLVLFDRNNHKSLYNSALVMTGAKPVYIPTDRNALGLIGEMDPDFLNEEKIRAEIAKVDPEKAKAKRPFRLAIIQSETYDGLFYDAKWMIDKIGKLCDYILFDCAWGGFEQFVPIMNHLSPLNLDFGSEDPGILVTQSLHKQQAGMGQASQILKKDAHIKGQKRYVDHKHFNHAYLKFVTSSYSYPLYASLTVNSYLTSGEGNKKWWDQILRLGIEWRKELIKKSKLFKPLVIDNFENISTDELATNEKYWNLDSTNLWHGFSKIASGQAMIDPLKITVVTPGIDVKNAKYEEIGIPGPVVAEFLMEKRIIRAKDDLYSLLFLLTPGDTKAELDILLNAFLEFEQYYNEDAPLDKVLPKLTKVYGDRYKGYTLKQLCQEMHEYYRGNNTFTLQQELFAKPDMQNYQMTPEHADYLFMKNESELVNLEDVKGRIAAEGALPYPPGVFIVAPGEKWSDIDQKYFEVLVGAIERFPGFVPEIQGVYWDQKSDGKIRVQAEVLKEN

SEQ ID NO: 1895 - DNA, 3625 bp, Vibrio parahaemolyticus
  CDS (1451)..(3625)
gacttgagtagaatagatttggagatgttatgtcatcgaatacgaaaaaaatcggcctaattgcctgtacgggtgtagtcgccggtaacatgatgggtagtggtattgcactgttaccttccagcctagcttcagtaggctctgtttcaattttcagctggctgatctgtttgatcggtgcactgagccttgcgtttgtttacgctcgtctggcaaccaaaaaccctcaagaaggtggtcctatcgcttatgcgggcgaagtttccccagtctttggtttccaaacgggcgtgctttattaccacgcgaactggattggtaacctagctattgctattacaggtgtttcttacctttcagtattcttccctgtgcttaatgacccaatcccagcgggtattgcgacgattgcatcggtatggatcttcactttcgtcaacctacttggtggtagctgggtaagccgtctatgtacgcttggtcttgttctaattctaattccagttgttggtaccgctctatttggttggacgcacttcgacactgcgctatacagccaaaactggaacgtatctgcgggtactgatagccatgcgattgtgactgcggttcttatctgtctatggtcattcgttggtgtggaatcagctgcagtatcgacaggtatggtagaaaaccctaaacgtactgtaccgctagcaaccatgctgggtactggtattgcaggtgtgatttacatcctatcaactcaaatgatcagcggcatgttccctgcttctgaagttgcggcatcaggtgcgccatttgcattggctaccactgagctattcggtagctggactgcaccattcgtatcagcattcactgcactagcatgttttacttcgctaggttcttggatgatgctggtgggcgaagctggtaaacgtgcagcaagcgatggcaacttccctaaaatctacggcgaaactgacaaaaacggtgtgcctaagaaaggtctaatccttgcgtcaatcaagatgacagcattaatggttgtactgatgttcttcagctctaaaacagcacatgcatcagacctgttcaaccaactaacgactgatgcagttctactaactatgctgccttacttctactcaagcattaacttgattcgcttcgaaggtatgacaacacgcaacggcttcgtaatgctgttctctggtgtagcttgtttgttctgcttcattgcccttgctggtgcagaaggcggtacgctaacagcaaccttcatcgtgtctctcgttatcttgatgttctacagcaaaaaagccggcttagctcagtacatgaagctacacgctgacgacatgcctgctcaagcaagcaactaatccccaaacgctggcacttcggtgccagccaataaaaaacaaattcactcggcgctcaccttactcactgcctgtaaatggcagagagcgccttcattcgccttggagatgtccaaatgaatattttcgctatcttgaaccacatgggtgtgttctttaaagaagagccagttcgtcaacttcacgctgctcttgagaaagcgggctacgaagtggtttacccagtagatgataaagacttgatcaaaatgattgagatgaacccgcgcatttgcggtgtgctgttcgactgggataaatactcactagagctatgtgaacgtattagccaaatcaacgaaaaactgcctgttcacgcatttgctaacgaacagtctactctcgatatttcactaacagacctacgtctgaacgtgagcttcttcgagtacgctttaggtatggctgacgacatcgctatcaaaatcaaccaagcgacagaggcatacaaagatgccatcatgcctccattcactaaagcgctattcaaatacgtagaagaaggtaaatacaccttctgtactccaggtcacatgggcggtactgcattccagaaaagccctgctggtagcatcttctatgatttttacggtccaaatacattcaaagcggacgtatcaatctcaatgcctgagctaggttctctactagaccactcaggtccacataaagatgcagaagaatacatcgcacgtacattcaatgcagacagctcgtacatcgtaactaacggtacgtctacatcgaacaaaatcgttggtatgtactcagcacctgcgggcagcacagtactgattgaccgtaactgtcacaaatctctgactcacctaatgatgatgagcgacgtgacaccaatctacttccgtccaactcgtaacgcatacggcatccttggtggtattccacaaagcgaattcagccgtgatgtcattgcagagaaagtggcgaaaacaccaggtgcaacagcgccaagttacgcagtagtgactaactcaacttacgatggtctgttgtacaacacacaattcatcaaagagtcgctagactgtaaacacatccacttcgacagtgcttgggtgccttacactaacttcaacccaatttacgaaggtaaatgtggtatgagtggtgaagcgatgccaggcaaagtgttctacgagacacaatcaacacacaaactgttggcagcgttctcacaagcttcaatgattcacgtgaaaggtgactttgatagagagtctttcaacgaagcattcatgatgcacacttcaacttcacctcagtacggcattgttgcttctactgaaactgcagcggcaatgatgcgcggcaacactggtaagaagttgacgcaagactctatcgatcgcgcaattcgcttccgtaaagagatcaaacgcctagaagcagaaagtgacagctggttcttcgatgtatggcaaccagaaaacatcgataccacagaatgttggaaactagaccctagcgatacatggcacggcttcaagaacatggatgacaaccacatgtatcttgacccaatcaaagtcacgctactgactccggggatgaataaagaaggcgaactagaagaatcaggtattcctgcttcgctggtggctaaattcctagacgagcgcggcatcgtggtagagaaaacaggtccatacaacttgttgttcctattctcaattggtatcgacaaatcaaaagcaatgcaattgctacgcggtctgactgaatttaaacgtggctacgacttaaacctaaccatcaagagcttcctaccttcgctatataacgaagatccaagcttctatgaaggcatgcgcgttcaagaattggcacaagcaattcataacctaactaagaaatacaacctaccagagctaatgtacaaagcgttcgatgttcttccagaaatgaaagtaacaccacacgcagcatggcaagaagagcttcgcggtaacgtagaagaaatcaaactggaagaaatggttggtcgcgtaagtgcgaacatgatccttccctaccttccatatgtgccactagtacttcctggtgaaatggtgactcaagagtctcgccctgtgctggacttcctagagatgctttgtgagatcggggcgcattacccaggtttcgaaaccgatatccacggtctgtaccaacaaaaagatggtagctacaccgtaaaagtattgaagaactaa

SEQ ID NO: 1896 - protein, 724 aa, Vibrio parahaemolyticus
MAESAFIRLGDVQMNIFAILNHMGVFFKEEPVRQLHAALEKAGYEVVYPVDDKDLIKMIEMNPRICGVLFDWDKYSLELCERISQINEKLPVHAFANEQSTLDISLTDLRLNVSFFEYALGMADDIAIKINQATEAYKDAIMPPFTKALFKYVEEGKYTFCTPGHMGGTAFQKSPAGSIFYDFYGPNTFKADVSISMPELGSLLDHSGPHKDAEEYIARTFNADSSYIVTNGTSTSNKIVGMYSAPAGSTVLIDRNCHKSLTHLMMMSDVTPIYFRPTRNAYGILGGIPQSEFSRDVIAEKVAKTPGATAPSYAVVTNSTYDGLLYNTQFIKESLDCKHIHFDSAWVPYTNFNPIYEGKCGMSGEAMPGKVFYETQSTHKLLAAFSQASMIHVKGDFDRESFNEAFMMHTSTSPQYGIVASTETAAAMMRGNTGKKLTQDSIDRAIRFRKEIKRLEAESDSWFFDVWQPENIDTTECWKLDPSDTWHGFKNMDDNHMYLDPIKVTLLTPGMNKEGELEESGIPASLVAKFLDERGIVVEKTGPYNLLFLFSIGIDKSKAMQLLRGLTEFKRGYDLNLTIKSFLPSLYNEDPSFYEGMRVQELAQAIHNLTKKYNLPELMYKAFDVLPEMKVTPHAAWQEELRGNVEEIKLEEMVGRVSANMILPYLPYVPLVLPGEMVTQESRPVLDFLEMLCEIGAHYPGFETDIHGLYQQKDGSYTVKVLKN

SEQ ID NO: 1897 - DNA, 2142 bp, Shigella flexneri
  CDS (1)..(2142)
atgaacatcattgccattatgggaccgcatggcgtcttttataaagatgagcccatcaaagaactggagtcggcgctggtggcgcaaggctttcagattatctggccacaaaacagcgttgatttgctgaaatttatcgaacataaccctcgaatttgcggcgtgatttttgactgggatgagtacagtctcgatttatgcagcgatatcaatcaacttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccaacgaatatcttgataacattacgccgccgttcacgaaagccttgtttacctacgtcaaagagcggaagtacaccttttgtacgccggggcatatgggcggcaccgcatatcaaaaaagcccggttggctgtctgttttatgattttttcggcgggaatacccttaaggctgatgtctctatttcggtcaccgagcttggttcgttgcttgaccacaccgggccacacctggaagcggaagagtacatcgcgcggacttttggcgcggaacagagttatatcgttaccaacggaatatcgacgtcgaacaaaattgtgggtatgtacgccgcgccatccggcagtacgctgttgatcgaccgcaactgccataaatcactggcgcatctgttgatgatgaacgatgtagtgccagtctggctgaaaccgacgcgtaatgcgttggggattctgggggggatcccgcgccgtgaatttactcgcgacagcatcgaagagaaagtcgctgccactacgcaagcacaatggccggttcatgcggtgatcaccaactccacctatgatggtttgctctacaacaccgactggatcaaacagacgctggatgtcccgtcgatccacttcgattccgcctgggtgccgtatactcattttcatccaatctaccagggtaaaagtggtatgagcggcgagcgtgttgcgggaaaagttttcttcgaaacgcaatcgacccacaaaatgctggcggcgttatcgcaggcttcactgatccacattaaaggcgagtatgacgaagaggcgtttaacgaagcctttatgatgcataccaccacctcgcccagttatcccattgttgcttcggttaagacggcggcggcgatgctgcgtggtaatccgggcaaacggctgattaaccgttcggtggagcgggcgctgcattttcgcaaagaggtccagcggctgcgggaagagtctgacggttggtttttcgatatctggcaaccgccgcaggtggatgaagccgaatgcaggcccgttgcgcctggcgaacaatggcacggctttaacgatgcggatgccgatcatatgtttctcgatccggttaaagtcactattttgacaccggggatggacgaacagggcaatatgagtgaggaggggatcccggcggcgctggtagcaaaattcctcgacgaacgtgggatcgtagtagagaaaaccggcccttataacctgctgtttctctttagtattggcatcgataaaaccaaagcaatgggattattgcgtgggttgacggaatttaagcgctcttacgatctcaacctgcggatcaaaaatatgctgcccgatctctatgctgaagatcccgatttctaccgcaatatgcgtattcaggatctggcgcaagggatccataagctgattcgtaaacacgatctttccggtttgatgttgcgggcattcgatactttgccggaaatgatcatgacgccacatcaggcatggcagagacagattaaaggtgaagtagaaaccattgcgctggaacaactggtcggtagagtatcggcaaatatgatcctgccttatccaccgggcgtaccgctgttgatgccaggagaaatgctgaccaaagagagccgcacggtactcgattttctactgatgctttgttccgtagggcaacattaccccggttttgaaacggatattcacggcgcgaaacaggacgaagacggcgtttaccgcgtacgagtcctaaaaatggcgggataa

SEQ ID NO: 1898 - protein, 713 aa, Shigella flexneri
MNIIAIMGPHGVFYKDEPIKELESALVAQGFQIIWPQNSVDLLKFIEHNPRICGVIFDWDEYSLDLCSDINQLNEYLPLYAFINTHSTMDVSVQDMRMALWFFEYALGQAEDIAIRMRQYTNEYLDNITPPFTKALFTYVKERKYTFCTPGHMGGTAYQKSPVGCLFYDFFGGNTLKADVSISVTELGSLLDHTGPHLEAEEYIARTFGAEQSYIVTNGISTSNKIVGMYAAPSGSTLLIDRNCHKSLAHLLMMNDVVPVWLKPTRNALGILGGIPRREFTRDSIEEKVAATTQAQWPVHAVITNSTYDGLLYNTDWIKQTLDVPSIHFDSAWVPYTHFHPIYQGKSGMSGERVAGKVFFETQSTHKMLAALSQASLIHIKGEYDEEAFNEAFMMHTTTSPSYPIVASVKTAAAMLRGNPGKRLINRSVERALHFRKEVQRLREESDGWFFDIWQPPQVDEAECRPVAPGEQWHGFNDADADHMFLDPVKVTILTPGMDEQGNMSEEGIPAALVAKFLDERGIVVEKTGPYNLLFLFSIGIDKTKAMGLLRGLTEFKRSYDLNLRIKNMLPDLYAEDPDFYRNMRIQDLAQGIHKLIRKHDLSGLMLRAFDTLPEMIMTPHQAWQRQIKGEVETIALEQLVGRVSANMILPYPPGVPLLMPGEMLTKESRTVLDFLLMLCSVGQHYPGFETDIHGAKQDEDGVYRVRVLKMAG

SEQ ID NO: 1899 - DNA, 2181 bp, Vibrio vulnificus
  CDS (1)..(2181)
atgaagcgtttagttattggtgttagtaattacatgccagaagattttagtttattagctgaatctttagatgaacaatttaatcgtcatcttcatcctttagagcaagtagaattaaccgatgttggtgctgccattattacgtcggcagatattaaggctggtctacacaaagtgatttctgaaacgggttatggcattccggttttcttggtcacagatgaaaacccagtgtcagccgaagattacgtatggttaaccggcgttatcgatttagaaagacaatccattgaatactactgtcgccaaatcaatgaagcggtaaccaaatacgaatgccgcctattgccgcctttcttcaaacaactgacgcactacgtggaaatgggcaactctgcattcgactgtccaggacaccaaggcggtcagttcttcaaaaaacacccagcaggtaaacagttctacgatttcttcggtgaaaacctattccgtagtgacttgtgtaacgcggacgtagatttaggtgacttgttgatccacgaaggctctgcccaccaagctcaagcgcacgcagcaaaagtgttcaactcagacaaaacttacttcgtactcaacggcacttcggcttcaaacaaagtggtttgtaacgcgttagtgaccgagggtgacttggtgatgtttgaccgtaacaaccacaaatcaaaccaccacggcgcattaatccaagcgggcggtatgccagtttacctagaaacggcgcgtaacccttggggctttattggtggcatggatgagcactgttttgatgaagaatacatccgtgcccaaatcgccaaagtatcacccgaacgtgcgcgtgatgcgcgtccattccgtcttgcgatcatccaattgggtacttacgacggtaccatctacaacgcacgctacgtgatggataagattggtcatctatgtgactacatcctgtttgactcggcatgggtaggctacgagcagttcattcctatgatgaaagactgttcgccactgctactggatctgaaaccagaagatgcgggtgtgatcgtgactcagtctgttcacaagcagcaagcaggcttctctcaaacctcgcaaatccacaaaaaagaccaccacatcaaaggtcaggctcgctactgcaaccacaaacgcttcaacaacgcgtttatgatgcacgcgtcaacctcacctttctacgcactgttctccgcattggatgtgaacgcgaagatccacgatggtgaagcgggtctgcgcctatggcgtgatgcggttaagacaggtatcgaagcgcgtaaagaaatcctcaaaagttgtgagctgatccgtccgttcattccagaccaagttgatggtcaaccatggggcagctacgacacggatgtcatcgccaccaacaagaaattcttcatgtttgagccaaacgcaagctggcataaattcgaaggttacggcgaaggccaatacttcgttgacccatgtaaattgctactcaccacagccggtattgccgaagatggtagctacgcagactttggtattcctgccacgctattggcgaacttcctacgtgagaacggcatcatccctgagaagtgtgacttgaactctatcttgttccttcttactccagcagaggacatgggtaagatccgtcatcttgtggcgcaaattaaccgcttcgagaaattcattcgtgatgatgcgccgctaaacatcgtgctgcctcgcgtttacgaagcgaacaaagagcgctaccgtggctacaccattcgtcagctatgtcaggaaatgcatgacatgtacaaagagctgaacgtgaaacagctacaaaaagcgatgttccgtagcgagtacttcccaaccatggtgcacaaaccggatgtggcaacacgcaaatacttccgcggcgagtgtgattacttgccgctgaaagaagcggtcggtcgtgtcgctgcagaaggtgcgcttccttaccctccaggcattatctgtgtgatcacgggcgaaatctggactcaacaagtggtcgattacttcttatctctagaagaaggcatcaaccgattcccaggcttcgcaccagagattcaaggtgtgtacctagaagacgtcaatggccgcaccaccgcccattgctacgcccttaaagattaa

SEQ ID NO: 1900 - protein, 726 aa, Vibrio vulnificus
MKRLVIGVSNYMPEDFSLLAESLDEQFNRHLHPLEQVELTDVGAAIITSADIKAGLHKVISETGYGIPVFLVTDENPVSAEDYVWLTGVIDLERQSIEYYCRQINEAVTKYECRLLPPFFKQLTHYVEMGNSAFDCPGHQGGQFFKKHPAGKQFYDFFGENLFRSDLCNADVDLGDLLIHEGSAHQAQAHAAKVFNSDKTYFVLNGTSASNKVVCNALVTEGDLVMFDRNNHKSNHHGALIQAGGMPVYLETARNPWGFIGGMDEHCFDEEYIRAQIAKVSPERARDARPFRLAIIQLGTYDGTIYNARYVMDKIGHLCDYILFDSAWVGYEQFIPMMKDCSPLLLDLKPEDAGVIVTQSVHKQQAGFSQTSQIHKKDHHIKGQARYCNHKRFNNAFMMHASTSPFYALFSALDVNAKIHDGEAGLRLWRDAVKTGIEARKEILKSCELIRPFIPDQVDGQPWGSYDTDVIATNKKFFMFEPNASWHKFEGYGEGQYFVDPCKLLLTTAGIAEDGSYADFGIPATLLANFLRENGIIPEKCDLNSILFLLTPAEDMGKIRHLVAQINRFEKFIRDDAPLNIVLPRVYEANKERYRGYTIRQLCQEMHDMYKELNVKQLQKAMFRSEYFPTMVHKPDVATRKYFRGECDYLPLKEAVGRVAAEGALPYPPGIICVITGEIWTQQVVDYFLSLEEGINRFPGFAPEIQGVYLEDVNGRTTAHCYALKD

SEQ ID NO: 1901 - DNA, 2307 bp, Photorhabdus luminescens
  CDS (1)..(2307)
atgattaatttagacattaacgaacaaaacaaaattatggtcgtcagcagccatgtatttagaccgacgacggcgaatggtcgagcctttaccgagttaatagaagcattaaaaaagaacaatttcgctgttatcctggcggctacattccaagatggcatagctaccgtttcttctgattcctcactatgctgtatttttgttgattggacttcaggagataataactatgaatctcataaacaagtgttagaattactgaaagagatacgcaaacacaatacaaccattccggtattgttgaccgcggaatattccagcatcgacacactgacacttgaagtcatgggattggcagatgaatttgtctggatgcttgaagacacggctggatttatcgcctctcgcgccagttcgctaattaagaaatattatgcgcaattattaccgcctttcactcgtgcattactgcaatacactcaagaatcaccagaatattcctggactgctcctggacatcaaggcggtgttgcactgactaagacagcggcaggaagagaattaattaatttctttggggaaaatttatttcgaagtgatattggaatagaaagaaaaatacttggctcactgctagatcatacaggtgcgattaaagaatcagaagaatatgccgcaacgatttttggtgcccatcaaagctattgcgtgcttaacggcacttcgggttctaaccgtattatcatgggtgccgttattggtgagaaagagattattatatgcgatcgcaattgccataaatcgattggacaaggtttaataatgactggggctttgcccgtatatcttattcctcaacgcaaccgctatggtattattggccccattcccagagatcaatttcaaccagaatatatccaacaactcattgatcaacacccattaaaagcgatcgcaatagacaataagcctgtttatgcggtcatcaccaactgtacttatgatggaatatgttatcacgcagaacaagcacaagatttactagcaaaaagtgttgatcaaattcattttgatgaagcctggtttgcttatgcgcgttttaatcctatgtataaacatcgttactcaatgcgtgatgacccaaatgattttgacaataatggcccgacaatatttgccactcaatccacgcataagatgttagcagcgctatcacaatcatcctatatccatatccgcaatggcaaaaaacccattgaacattcccgtttcaacgagtcttatatgatgcactccacaacttcaccgctatattcgcttatcgccactaatgaaattgcagcggccatgatggatggcccacaggggcaaagactgatacaaaacgctatcaatgaagccgtagacttccgtctgacattagcaaaaacccatcatcaatttaaacaaaaagatgattggtttttcttaccctggaatgccagagagattattagcgcagatagcggtaaattaattcccttccatgaagcaaacagagaacaattagcaacggatccttcctgttgggtattaaaagagggagaaaaatggcatggatttaccaatctatcagcagaatggtgcctgctagatccaacaaaagttggtattttatgcccaggaatgaatgataatgatgaattgctggaaaatggcattccagccgaaattctttccgcttatctcagccagcatgacattgtgccggcgcgtaccaccgattttattgttctttgcctgttttctatcggcgtcaccaaaggtaaatggggaacattaatcaatgtattgttgaatttcaagaaacactatgacgctaatacttcacttaaacaatgtttgccaaaactcgcgaagcaataccctgaatattatgaaaacatggggctcaaagatatttcggataaaatatttgggtatataaaagaatatgaaatggatattgagcaaaagaaatcatttagccaattacctgagatagtgaaactcccccgacaagcacaccttgatcatatggcaggccgtactgaacatttaccacttaatgaactcgccgggcgcatatcggctgtaagtgtcattccttatccaccaggtataccaataatcctaccgggagaacgttttggtgatgaacatgccccccggttacaatatattcgccaactcggtgaatggaataacaagttccccggctttgaaaaaatcctggaaggcgcagagatgataaacggcgagtaccatatatgggtactaaaagagtga

SEQ ID NO: 1902 - protein, 768 aa, Photorhabdus luminescens
MINLDINEQNKIMVVSSHVFRPTTANGRAFTELIEALKKNNFAVILAATFQDGIATVSSDSSLCCIFVDWTSGDNNYESHKQVLELLKEIRKHNTTIPVLLTAEYSSIDTLTLEVMGLADEFVWMLEDTAGFIASRASSLIKKYYAQLLPPFTRALLQYTQESPEYSWTAPGHQGGVALTKTAAGRELINFFGENLFRSDIGIERKILGSLLDHTGAIKESEEYAATIFGAHQSYCVLNGTSGSNRIIMGAVIGEKEIIICDRNCHKSIGQGLIMTGALPVYLIPQRNRYGIIGPIPRDQFQPEYIQQLIDQHPLKAIAIDNKPVYAVITNCTYDGICYHAEQAQDLLAKSVDQIHFDEAWFAYARFNPMYKHRYSMRDDPNDFDNNGPTIFATQSTHKMLAALSQSSYIHIRNGKKPIEHSRFNESYMMHSTTSPLYSLIATNEIAAAMMDGPQGQRLIQNAINEAVDFRLTLAKTHHQFKQKDDWFFLPWNAREIISADSGKLIPFHEANREQLATDPSCWVLKEGEKWHGFTNLSAEWCLLDPTKVGILCPGMNDNDELLENGIPAEILSAYLSQHDIVPARTTDFIVLCLFSIGVTKGKWGTLINVLLNFKKHYDANTSLKQCLPKLAKQYPEYYENMGLKDISDKIFGYIKEYEMDIEQKKSFSQLPEIVKLPRQAHLDHMAGRTEHLPLNELAGRISAVSVIPYPPGIPIILPGERFGDEHAPRLQYIRQLGEWNNKFPGFEKILEGAEMINGEYHIWVLKE

SEQ ID NO: 1903 - DNA, 1404 bp, Gloeobacter violaceus
  CDS (1)..(1404)
atggaaaccactccgctctgggatgcgctgagggccgtcgctctagcctcgggcacgggctttcacaccccgggccacaacggcggggcgggcctgccgccagccctcaaacactggccggattggggccgtctggacctgaccgaacttgcaggactcgacaacctgcacgctcccaccggggtgatcgcccacgcgcaacggctcgcggcggcagtttggggagccgagcgcagttggtttctggtcaacggtgcgaccgccggaatccaggcgatgctgcttgcggcactcgggcaggggcagaaggtgctcgtgcccagaaactgtcaccaaagtatcgtgcacgccctggtgctgagcggcgcggtgccggtgttcgtccaacctgtatgggacaggcgctggcagttggcccacggactgacggcgacgacggtggaagccgccctggccgtccacccggacatccgggcggtggtggcggtgcacccgacgtacttcggggcggtgggcgagacgcgggccatcgccagggtcgcccacgcaaaagggattgcgctgttggtcgatgccgcccacggcgcccatctgcgcttccatccggacttgcccgagtgcgcactcgcagcgggagcggacttggtcgtccattccgcccacaagacactgcccgccctcacccaggcggcactccttcaccagcagggcaccctggtggacccggccagggtggagatggctctgaaccttctgcaaaccaccagcccgagctacttgctgatggcctcgctcgatctggcccgcgcccacatggtccgccacggccgcgagcagctcgggcacatcctggagatggcccatagactgcgacacaaactgcccttcgcggtgctcgggggcgacggaacgcctggcttcgatccgacccgcctggtcatcgacgtgggtgagaaaggctggagcggtcacgccgctgagacctggctggagcaaaacgcccaggtgcgtgcggagatggccacccaccgccacctggtcttcatcctcaatagcgcccacaccgaattcgacggcgagcaactgcaagcatcccttctggccctggcaacggcccaaccgaccggggcaacgccgccggatctgcttccaccgccgcttccggagctgcgctattcaccccgcgaagctttcggccgctcccaccggagcgttcccctagccgcggcagccggactgaccagtgcggccgatgtctgcacctacccgcccggagtgccggtgctgctgccgggggaagtggttgccgcccagagcgtcgagtatttgggcgccgccattgacactggggccgagacagtcgggatcgacgggcgcggacacatccgggtcactattgactaa

SEQ ID NO: 1904 - protein, 467 aa, Gloeobacter violaceus
METTPLWDALRAVALASGTGFHTPGHNGGAGLPPALKHWPDWGRLDLTELAGLDNLHAPTGVIAHAQRLAAAVWGAERSWFLVNGATAGIQAMLLAALGQGQKVLVPRNCHQSIVHALVLSGAVPVFVQPVWDRRWQLAHGLTATTVEAALAVHPDIRAVVAVHPTYFGAVGETRAIARVAHAKGIALLVDAAHGAHLRFHPDLPECALAAGADLVVHSAHKTLPALTQAALLHQQGTLVDPARVEMALNLLQTTSPSYLLMASLDLARAHMVRHGREQLGHILEMAHRLRHKLPFAVLGGDGTPGFDPTRLVIDVGEKGWSGHAAETWLEQNAQVRAEMATHRHLVFILNSAHTEFDGEQLQASLLALATAQPTGATPPDLLPPPLPELRYSPREAFGRSHRSVPLAAAAGLTSAADVCTYPPGVPVLLPGEVVAAQSVEYLGAAIDTGAETVGIDGRGHIRVTID

SEQ ID NO: 1905 - DNA, 2259 bp, Chromobacterium violaceum
  CDS (1)..(2259)
atgcgttttcacttccccatcgtgatcatcgacgaggacttccgctcggaaaacaccagcggctccggcattcgcgaactggccgccgccatggaggcggaaggcatgagcgtgatcggctacaccagctacggcgacctcacctccttcgcccagcagcaaagccgcgccgccggcttcatcctgtcgatagacgacgaggaattccagaccgaggacacggcgcaagaagcgctgggcaatctgtacggcttcgtcgccgaaatccgccgccgcaacccggacatcccggtctacctgtacggcgagacccgcaccgcccgccacatccccaacgacatcctgcgcgagctgcacggcttcatccacatgcacgaggacacgccggagttcgtcgcccgccacatcatccgcgaggccaagagctatctggacaagctggcgccgccgttcttccgcgcgctggtggactacgcctacgacggctcctactcctggcactgccccggccactccggcggcgtcgccttcctgaagagcccggtcggccagatgttccaccagttcttcggcgagaacatgctgcgcgccgacgtctgcaacgcggtggacgagctgggccagctgctggaccacaccggcccggtggcggcgtccgagcgcaacgcggcgcgcatcttcaatgccgaccacctgttcttcgtcaccaacggcacctccacctcgaacaagatcgtctggcacagctgcgtcgccgccggcgacatcgtgctggtggaccgcaactgccacaagtccaatctgcacgccatcatcatgaccggggccatcccggtgttcctgatgccgacgcgcaaccactacggcatcatcggcccgatcccgaagtccgagttccagccggacaatatcaagaagaagatcctggccaatccgttcgcgcgcgagatgctggaaaagcaccccaaccgcaagccgcgcatcctgacgctgacccagtccacctacgacggcatcctgtacaacgtcgaggagatcaagggcctgctggacggcgaggtggacacgctgcacttcgacgaagcctggctgccgcacgcctgcttccacgacttctaccgcgacttccacgccatcggcgaaggccggccccgctgcgaggacagcctggtgttctccacccagtccacccacaagctgttggccggcatcagccaggcctcgcagatcctggtgcaggatccgcagaaccggcagctcgacaccgcctggttcaacgaagcctacctgatgcacacctcgaccagcccgcaatactcgatcatcgccagctgcgacgtggccgccgcgatgatggagcagccgggcggccagtcgctggtggaagaatcgctggtggaggcgatggaattccgccgcgcgatgcgcaaggtggacgaggaatacggccgcgactggtggttcagcgtatggggcccggacgatctgtccgacgacggcatctgcgaccagaccgactggacgctgcgccccgacgagcgctggcacggcttcgccggcatcgaggacggcttcaacatgctggacccgatcaaggccaccgtgctgacgccgggcctggacgtggacggcagcttcgaggaaatgggcatcccggccgccatcgtcaccaagtatctgaccgaacacggcgtggtcgtcgagaaaaccggcctgtacagcttcttcatcatgttcaccatcggcatcaccaagggccgctggaacacgctgatctcgctgctgcagcagttcaaggacgatttcgacaagaaccagccgatgtggcgcgtgatgccggaattcgtcgccaagcatccgcagtacgagcgcgtcggcctgcaggacctgtgccagcgcatccacggcctgtacgccaagcacgacgtggcgcggctgaccaccgacatctacctgtccgacatggagccggcgatgcgcccggccgacgccttcgccaagatggcgcaccgcgagatcgagcgcgtgccggtggaccagctggaaggccgcgtcaccgcggtgctgctgaccccctacccgccgggcatcccgctgctgatcccgggcgagcgcttcaacaagaccatcgtcgactacctgcgcttcgcccaggccttcaaccgcgagctgccgggcttcgaaaccgacgtccacggcctggtggcggtggaggtgcaggaccgcaaggtgtactgcgtggactgcgtcaagcaataa

SEQ ID NO: 1906 - protein, 752 aa, Chromobacterium violaceum
MRFHFPIVIIDEDFRSENTSGSGIRELAAAMEAEGMSVIGYTSYGDLTSFAQQQSRAAGFILSIDDEEFQTEDTAQEALGNLYGFVAEIRRRNPDIPVYLYGETRTARHIPNDILRELHGFIHMHEDTPEFVARHIIREAKSYLDKLAPPFFRALVDYAYDGSYSWHCPGHSGGVAFLKSPVGQMFHQFFGENMLRADVCNAVDELGQLLDHTGPVAASERNAARIFNADHLFFVTNGTSTSNKIVWHSCVAAGDIVLVDRNCHKSNLHAIIMTGAIPVFLMPTRNHYGIIGPIPKSEFQPDNIKKKILANPFAREMLEKHPNRKPRILTLTQSTYDGILYNVEEIKGLLDGEVDTLHFDEAWLPHACFHDFYRDFHAIGEGRPRCEDSLVFSTQSTHKLLAGISQASQILVQDPQNRQLDTAWFNEAYLMHTSTSPQYSIIASCDVAAAMMEQPGGQSLVEESLVEAMEFRRAMRKVDEEYGRDWWFSVWGPDDLSDDGICDQTDWTLRPDERWHGFAGIEDGFNMLDPIKATVLTPGLDVDGSFEEMGIPAAIVTKYLTEHGVVVEKTGLYSFFIMFTIGITKGRWNTLISLLQQFKDDFDKNQPMWRVMPEFVAKHPQYERVGLQDLCQRIHGLYAKHDVARLTTDIYLSDMEPAMRPADAFAKMAHREIERVPVDQLEGRVTAVLLTPYPPGIPLLIPGERFNKTIVDYLRFAQAFNRELPGFETDVHGLVAVEVQDRKVYCVDCVKQ

SEQ ID NO: 1907 - DNA, 1251 bp, Chromobacterium violaceum
  CDS (1)..(1251)
atgatcttccagaccctgctggcgccgggcgacaagctgctgctggatcgcaactgtcacaaatcggtccaccacggcgtgatcctgtccggcgcgcggccggtatacctggactcgtcggtcaaccgccagtacgggattttcgggccggtgcccaagaccacgatttaccaggcgatagacgacaatccggacgcgcgagtgctgatcctcacctcctgcacctacgacggcctgcgctacgacctgaagcccatcatcgaggccgcgcacgagaagggcatcaaggtgatcgtcgacgaggcctggtacggcttcgcccgcttccaccccgcgttccggccgacggcgctggagtccggcgcggactacgtgacgcagagcacgcacaaggtgctgtcggcgttctcgcaggccagcatgatccacgtcaacgacccgcgcttcgacgagcatttgttccgagagaacttcaacatgcacgcgtccaccagccctcagtacagcctgatcgccagcctggacgtggcgcgcaagcaggcggtgatggagggctaccgcttgttggaccgcacgctgaagctggcgcaggagctgcgcgagaagatcaattccaccggcgccttccgcgtgctggagctggacgatctgctgccggaagaggtgagggaggacggcatcctgctggatccgaccaagctgaccgtggacttcagccgctccggcttcaccgccgacgaactgcagcaggcgctgttcgagcgttacaacattcaggtggagaagtcgacgttcagcaccatcacgctgctgctgaccatcggcaccacccgcagcaagctgtcccgactttacgacgcgatgctgaggctggccaaggagggccgtgcgccgcggccgctggggcgcatgccggagattccgcacttctcccggctggcctgcctgccgcgcgacgccttctacgaggccggcgagcgcctgccgctgctggacgacgacggccggccgaatccggcattgagcgggcgggtgtgctgcgaccagatcgtgccgtatccgcccggcatcccggtgctggtgccggggcaggtggtggacgacaccatcctggcctacctggcgcggctgcagaaaacgcagaagagcatcgagatgcacggcttggcggaggatggcggcgagttttacctgcgggtgctgaagccgcaggagctggcggaattgcccggccgcagtttgttcaattga

SEQ ID NO: 1908 - protein, 416 aa, Chromobacterium violaceum
MIFQTLLAPGDKLLLDRNCHKSVHHGVILSGARPVYLDSSVNRQYGIFGPVPKTTIYQAIDDNPDARVLILTSCTYDGLRYDLKPIIEAAHEKGIKVIVDEAWYGFARFHPAFRPTALESGADYVTQSTHKVLSAFSQASMIHVNDPRFDEHLFRENFNMHASTSPQYSLIASLDVARKQAVMEGYRLLDRTLKLAQELREKINSTGAFRVLELDDLLPEEVREDGILLDPTKLTVDFSRSGFTADELQQALFERYNIQVEKSTFSTITLLLTIGTTRSKLSRLYDAMLRLAKEGRAPRPLGRMPEIPHFSRLACLPRDAFYEAGERLPLLDDDGRPNPALSGRVCCDQIVPYPPGIPVLVPGQVVDDTILAYLARLQKTQKSIEMHGLAEDGGEFYLRVLKPQELAELPGRSLFN

SEQ ID NO: 1909 - DNA, 2352 bp, Fusobacterium nucleatum subsp
  CDS (1)..(2352)
atgtctaaattagaccaaaataagacaccattatttacagtattaaaagatgaatatgtgagaagaaatatacttccatttcatgttcctggacataaaagaggaaggggagttgataaagaattttttaattttatgggagaagctcctttttcaatagatgtaacaatttttaaaatggttgatggtttacatcatccaaaaagttgtataaaagaagctcaagaattacttgcagatgcttatggagttaaacatagtttttttgcagtaaatggaacttctggtgcaatacaagcaatgataatgtcagttataaaagcaggagaaaaaatattagtaccaagaaatgtgcataaatcagtttcagcaggaattattttaagtggttctgaacctgtatatatgaatcctgaaattgatgaaaatttaggaattgccttaggagttaaaccacaaactgttgaaaatatgctaaaacaagatcctgatatagcagcagttcttattataaatccaacttattatggggtggcaacagatattaaaaaaatagctgatatagttcatagctatgatatacctcttattgtagatgaagctcatggaccacatctacatttccatgatgagttaccaatttcagctgttgatgctggagcagatatttgtactcaaagtacacataaaattttaggtgctatgactcaaatgtcagttatccatgtaaattctgatagagttaatgttgaaaaagtaaaacaaattttaagtttacttcatacaacttctccatcatatccattaatggcatctcttgattgttcaagaaggcaaatagctacacaaggtcaagagctacttacaagaactattgagcttgctaagtattttagaagagaggctaatagaatcccaggaatttattgttttggagaagaacttattggaaaagatggttttttcgcttttgatccaacaaagattacaatatctgcaaaagaattaggactaaaaggtggagaacttgaaagcctacttgtagatgattataatattcaaatggaattatcagattactataacactttgggacttattacaataggagatacggaagaaagtgtaaacaaattacttgatgctttaagagatataagtagaagattttttggaaaagggaaaacattggaaaaaaatattataaagcttcctgaaactcctgaattagtattaatgccaagagaagctttttacagtgaaaagaataaagttccatttaaagaaagtgttggaaaaatttctggtgaaatgataatggcatatcctcctggtattccaataatcattgcaggagaaagaattagccaagatatagttgattatattgaagaattaaaagaagctaatttacatattcaaggtatggaggaccctgaacttgaaactataaatgtaattgaagaagaagatgctatttacttatatactgaaaagatgaaaaatgttcttattggagtacaaacaaatcttggagttaacaagacaggaactgaatttggacctgatgatttaattcaagcatacccagatacttttgatgaaatggaattaatttctgtcgaaagacaaaaggaagatttcaatgataaaaaattgaaattcaaaaatacagttttagatacttgtgaaaaaatagctaagagagttaatgaagctgtaattgatggatatagaccaatacttgttggaggagaccactcaatttcattaggaagtgtatcaggtgtttctctagaaaaagaaattggaattttatggataagtgctcatggagatatgaacactcctgaaagtacacttacaggtaatattcatggaatgccattagctttacttcaaggtttaggagatagagaacttgtaaactgtttctatgaaggtgctaaacttgacagcagaaacatagtcatctttggtgcaagagaaattgaagtagaagaaagaaaaattattgaaaaaactggtgtaaaaattgtttactatgatgatattctaagaaaaggtatagacaatgttttagatgaaataaaagattatttaaaaattgataatttgcatattagtatagatatgaatgtatttgacccagaaattgctcctggtgtatctgtacctgttagaagaggaatgtcttatgatgaaatgtttaaatcattgaaatttgtatttaaaaattactcagttacatcagcagatattacagaatttaacccattaaatgatattaatggaaaaactgctgaacttgtaaatggtatagtgcaatatatgatgaacccagattattaa

SEQ ID NO: 1910 - protein, 783 aa, Fusobacterium nucleatum subsp
MSKLDQNKTPLFTVLKDEYVRRNILPFHVPGHKRGRGVDKEFFNFMGEAPFSIDVTIFKMVDGLHHPKSCIKEAQELLADAYGVKHSFFAVNGTSGAIQAMIMSVIKAGEKILVPRNVHKSVSAGIILSGSEPVYMNPEIDENLGIALGVKPQTVENMLKQDPDIAAVLIINPTYYGVATDIKKIADIVHSYDIPLIVDEAHGPHLHFHDELPISAVDAGADICTQSTHKILGAMTQMSVIHVNSDRVNVEKVKQILSLLHTTSPSYPLMASLDCSRRQIATQGQELLTRTIELAKYFRREANRIPGIYCFGEELIGKDGFFAFDPTKITISAKELGLKGGELESLLVDDYNIQMELSDYYNTLGLITIGDTEESVNKLLDALRDISRRFFGKGKTLEKNIIKLPETPELVLMPREAFYSEKNKVPFKESVGKISGEMIMAYPPGIPIIIAGERISQDIVDYIEELKEANLHIQGMEDPELETINVIEEEDAIYLYTEKMKNVLIGVQTNLGVNKTGTEFGPDDLIQAYPDTFDEMELISVERQKEDFNDKKLKFKNTVLDTCEKIAKRVNEAVIDGYRPILVGGDHSISLGSVSGVSLEKEIGILWISAHGDMNTPESTLTGNIHGMPLALLQGLGDRELVNCFYEGAKLDSRNIVIFGAREIEVEERKIIEKTGVKIVYYDDILRKGIDNVLDEIKDYLKIDNLHISIDMNVFDPEIAPGVSVPVRRGMSYDEMFKSLKFVFKNYSVTSADITEFNPLNDINGKTAELVNGIVQYMMNPDY

SEQ ID NO: 1911 - DNA, 2196 bp, Shigella flexneri
  CDS (1)..(2196)
atggggcagggttttccaccttgtccggtattcttacttccccgaaacgggtttgcgcttatgaaatcaatgaatattgccgccagtagtgaactggtatcccgactttcttctcatcgccgcgtggtggcgttgggagatactgattttacggacgtcgcggcagtcgtcattaccgctgcggatagtcgcagtggcattcttgcgttgcttaagcgcaccggttttcatctaccggtgtttttgtattccgaacatgctgttgaattacctgcgggcgttacggcggtaatcaacggcaacgagcagcagtggctggagctggaatccgcagcctgtcagtatgaagagaatttgctgccaccgttttatgacacgctgacgcagtacgttgagatgggcaacagcacctttgcttgccctggacatcaacatggtgcgttctttaaaaagcatcctgccggacgccatttttacgatttctttggtgagaacgtctttcgcgccgatatgtgtaacgctgacgtaaaattgggcgatctgcttattcatgaaggatcggcgaaagatgcgcagaaattcgcagccaaagtctttcatgccgataaaacctattttgtgctgaacggcacatcggcagcgaataaagtggtgacgaatgcgctgttaacgcgtggcgatctggtgctcttcgaccgtaacaaccataagtcgaatcatcacggcgcgctgattcaggcggggacgacgccggtctatctggaagcttcacgtaacccgtttggtttcattggcggtattgatgcgcactgttttaatgaagagtatctgcgccagcaaattcgcgacgttgcgccagaaaaagccgacctgccgcgcccgtttcgcctgacgattattcagctgggaacctatgacggcactgtctataacgcccgtcaggtgatcgataccattgggcatctgtgtgattacattctgtttgattccgcgtgggtcggttacgaacagtttatctcgatgatggcggatagctcgccgctgctgttagaacttaacgaaaacgatccggggatttttgtgacccagttggtgcacaaacagcaggctggattctcacagacgtcgcagatccataaaaaagataaccatatccgcggacaggcgcgtttttgcccgcataagcggttgaataacgcctttatgctccatgcttctaccagccctttctatccgctgtttgctgcactggatgttaacgccaaaattcatgaaggggagagtgggcgtcggctgtgggctgagtgcgttgagttgggtattgagtcgcgcaaggctattcttgcgcgctgtaagctgttccgcccgtttatcccgcccgttgttgatggcaaattgtggcaggattatccgacatcagtgttagccagcgaccgccgttttttcagttttgagccgggggcgaagtggcacggctttgaaggatatgccgcggatcagtattttgttgatccgtgcaagctgttactcactacaccaggtatcaatgccgaaaccggcgaatatagcgactttggcgttccggcgacgattctggcgcactatctgcgtgagaacggcattgtgccggagaagtgcgatctcaactccattctgttcttattaactccggcggaaagccacgagaagctggcacaactggtggcgatgctggcgcaatttgaacagcatattgaggatgactcgtcgctggctgaggtgttgccgagcgtttataacaaatatccggtgcgctatcgcgactacaccctgcgccagttgtgtcaggagatgcacgatctgtatgtcagtttcgacgtcaaagacctacaaaaagcgatgttccgccagcagagtttcccgtcagtggtgatgaacccccaggatgcgcatagcgcttatattcgcggtgaagtggagttggtgcggattcgtgatgccgaagggcgaattgcggcagaaggggcgttgccttatccacctggcgtgctttgcgtggtacccggggaagtctggggtggggcggttcaacgttatttccttgcgctggaagaaggcgtgaatttgttgccgggattttcgccggagttgcaaggtgtctatagcgaaaccgatgcggatggcatgaaacgattgtacggttatgtgttgaagtaa

SEQ ID NO: 1912 - protein, 731 aa, Shigella flexneri
MGQGFPPCPVFLLPRNGFALMKSMNIAASSELVSRLSSHRRVVALGDTDFTDVAAVVITAADSRSGILALLKRTGFHLPVFLYSEHAVELPAGVTAVINGNEQQWLELESAACQYEENLLPPFYDTLTQYVEMGNSTFACPGHQHGAFFKKHPAGRHFYDFFGENVFRADMCNADVKLGDLLIHEGSAKDAQKFAAKVFHADKTYFVLNGTSAANKVVTNALLTRGDLVLFDRNNHKSNHHGALIQAGTTPVYLEASRNPFGFIGGIDAHCFNEEYLRQQIRDVAPEKADLPRPFRLTIIQLGTYDGTVYNARQVIDTIGHLCDYILFDSAWVGYEQFISMMADSSPLLLELNENDPGIFVTQLVHKQQAGFSQTSQIHKKDNHIRGQARFCPHKRLNNAFMLHASTSPFYPLFAALDVNAKIHEGESGRRLWAECVELGIESRKAILARCKLFRPFIPPVVDGKLWQDYPTSVLASDRRFFSFEPGAKWHGFEGYAADQYFVDPCKLLLTTPGINAETGEYSDFGVPATILAHYLRENGIVPEKCDLNSILFLLTPAESHEKLAQLVAMLAQFEQHIEDDSSLAEVLPSVYNKYPVRYRDYTLRQLCQEMHDLYVSFDVKDLQKAMFRQQSFPSVVMNPQDAHSAYIRGEVELVRIRDAEGRIAAEGALPYPPGVLCVVPGEVWGGAVQRYFLALEEGVNLLPGFSPELQGVYSETDADGMKRLYGYVLK

SEQ ID NO: 1913 - DNA, 2271 bp, Bordetella pertussis
  CDS (1)..(2271)
atgaaattccgcttccccattttcatcatcgacgaagactatcgctccgagaacgcctcggggctgggcattcgcgcgctggcttcggcgatcgaggccgagggcgtggaggtcatcggggtgaccagctacggcgacctgagctcgtttgcccagcagcaaagccgcgccagcgccttcatcctgtcgatcgacgatgaggagttcgacgtcgattctccggaagacgtggcgggcgcgatcaagaacctgcgcacgttcatcggcgagctgcgtttccgcaacgccgacatccccatctacctgtacggcgagacgcgcacgtcggaacacatcccgaacgacatcctgcgcgagctgcacggcttcatccacatgttcgaggacacgccggagttcgtggcgcgccacatcatccgcgaagcgcgcagctacgtggacggcctgccgccgccgttcttccgcgagctggtcaaatatgcccaggacggttcgtattcctggcactgcccggggcactcgggcggcgtggcgttcctcaagagcccggtgggccagatgttccaccagttcttcggcgagaacatgctgcgcgccgacgtctgcaacgcggtcgacgagctgggccagctgctggaccacaccggcccggtggccgagtccgagctgaatgccgcgcgcattttccatgccgaccactgcttcttcgtcaccaacggcacctcgacgtcgaacaaggtcgtctggcatgccaacgtggccgccggcgacgtggtggtggtggaccgcaactgccacaagtcgatcctgcacgccatcaccatgaccggcgcgatcccggtgttcctgcgccccacgcgcaaccacctgggcatcatcggaccgatcccgctcgacgaattcgacccggaaaacatccgccgcaagatcgaggccaacccgttcgcgcgcgaggcgctgaacaagaagccgcgcatcctcacgctgacgcagagcacctatgacggcgtcatctacaacgtcgagatgatcaaggaaaagctgggcacctacgtcgacacgctgcatttcgacgaggcctggctgccgcacgcggccttccacgagtactaccgcgacatgcacgcgatcggcccggaccgcccgcgcagccaggacgccatggtgttcgccacgcactccacgcacaagctgctggccggcatctcgcaggcctcgcagatcatcgtgcaggagtccgagagccgcaagctggaccgcaacctcttcaacgaggcctacctgatgcatacgtcgacctcgccgcagtacgcgatcatcgcgtcgtgcgacgtggccgccgccatgatggagccgccgggcggcaccgccctggtcgaggaaagcatccgcgaggccatggactttcgccgcgccatgcgcaaggtggcctccgagttcggcaaggacgactggtggttcaaggtgtggggccccaaccgcctcgcgcccgagggcatcggccatcgcgacgactgggtgctggagtcgggcgaccactggcacggctttggcgacctggcgccgggcttcaacatgctcgacccgatcaaggccaccatcatcaccccgggcctggacatgtcgggcagcttcggcgaaagcggcataccggccgcgctggtgtcgaagtacctggccgagcacggcgtcgtggtggagaagaccggcctgtattcgttcttcatcctgttcaccatcggtatcaccaagggccgctggaacaccctgctgaccgcgctgcagcagttcaaggacgactacgaccgcaaccagcccctgtggcgcatcctgcccgagttctgccgcggtcaccgccgctacgagcgcatgggcctgcgcgacctatgccagcagatccacgaggcctatcgcgaacgcgacgtggcgcgcctgaccaccgagatgtacctgagcgacatggtgccggcgctcaagccctcggacgccttcgcccgcatggcgcaccgcgaagtcgagcgcgtcgagatcgaccagctcgaaggccgcgtgaccggcgtgctgctcacgccgtacccgccgggcattccgctgctgatcccgggcgagcgcttcaaccggaccatcgtgcaatacctgcagttcgcgcgcgagttcaacgagcgcttccccggcttcgagacctacatccacggcctggccgacgaagagggccccgatggcgccaagcgctattacgtcgactgcctgaaggacgccggcgagcagtaa

SEQ ID NO: 1914 - protein, 756 aa, Bordetella pertussis
MKFRFPIFIIDEDYRSENASGLGIRALASAIEAEGVEVIGVTSYGDLSSFAQQQSRASAFILSIDDEEFDVDSPEDVAGAIKNLRTFIGELRFRNADIPIYLYGETRTSEHIPNDILRELHGFIHMFEDTPEFVARHIIREARSYVDGLPPPFFRELVKYAQDGSYSWHCPGHSGGVAFLKSPVGQMFHQFFGENMLRADVCNAVDELGQLLDHTGPVAESELNAARIFHADHCFFVTNGTSTSNKVVWHANVAAGDVVVVDRNCHKSILHAITMTGAIPVFLRPTRNHLGIIGPIPLDEFDPENIRRKIEANPFAREALNKKPRILTLTQSTYDGVIYNVEMIKEKLGTYVDTLHFDEAWLPHAAFHEYYRDMHAIGPDRPRSQDAMVFATHSTHKLLAGISQASQIIVQESESRKLDRNLFNEAYLMHTSTSPQYAIIASCDVAAAMMEPPGGTALVEESIREAMDFRRAMRKVASEFGKDDWWFKVWGPNRLAPEGIGHRDDWVLESGDHWHGFGDLAPGFNMLDPIKATIITPGLDMSGSFGESGIPAALVSKYLAEHGVVVEKTGLYSFFILFTIGITKGRWNTLLTALQQFKDDYDRNQPLWRILPEFCRGHRRYERMGLRDLCQQIHEAYRERDVARLTTEMYLSDMVPALKPSDAFARMAHREVERVEIDQLEGRVTGVLLTPYPPGIPLLIPGERFNRTIVQYLQFAREFNERFPGFETYIHGLADEEGPDGAKRYYVDCLKDAGEQ

SEQ ID NO: 1915 - DNA, 2271 bp, Bordetella parapertussis
  CDS (1)..(2271)
atgaaattccgcttccccattttcatcatcgacgaagactatcgctccgagaacgcctcggggttgggcattcgcgcgctggcttcggcgatcgaggccgagggcgtggaggtcatcggggtgaccagctacggcgacctgagctcgtttgcccagcagcaaagccgcgccagcgccttcatcctgtcgatcgacgatgaggagttcgacgtcgattctccggaagacgtggcgggcgcgatcaagaacctgcgcacgttcatcggcgagctgcgtttccgcaacgccgacatccccatctacctgtacggcgagacgcgcacgtcggaacacatcccgaacgacatcctgcgcgagctgcacggcttcatccacatgttcgaggacacgccggagttcgtggcgcgccacatcatccgcgaagcgcgcagctacgtggacggcctgctgccgccgttcttccgcgagttggtcaaatatgcccaggacggttcgtattcctggcactgcccggggcactcgggcggcgtggcgttcctcaagagcccggtgggccagatgttccaccagttcttcggcgagaacatgctgcgcgccgacgtctgcaacgcggtcgacgaactgggccagctgctggaccacaccggcccggtggccgagtccgagctgaatgccgcgcgcattttccatgccgaccactgcttcttcgtcaccaacggcacctcgacgtcgaacaaggtcgtctggcatgccaacgtggccgccggcgacgtggtggtggtggaccgcaactgccacaagtcgatcctgcacgccatcacgatgaccggcgcgatcccggtgttcctgcgccccacgcgcaaccacctgggcatcatcggtccgatcccgctcgacgaattcgacccggagaacatccgccgcaagatcgaggccaacccgttcgcgcgcgaggcgctgaacaagaagccgcgcatcctcacgctgacgcagagcacctatgacggcgtcatctacaacgtcgagatgatcaaggaaaagctgggcacctacgtcgacacgctgcatttcgacgaggcctggctgccgcacgcggccttccacgagtactaccgcgacatgcacgcgatcggcccggaccgcccgcgcagccaggacgccatggtgttcgccacgcactccacgcacaagctgctggccggcatctcgcaggcctcgcagatcatcgtgcaggagtccgagagccgcaagctggaccgcaacctcttcaacgaggcctacctgatgcatacgtcgacctcgccgcagtacgcgatcatcgcgtcgtgcgacgtggccgccgccatgatggagccgccgggcggcaccgccctggtcgaggaaagcatccgcgaggccatggactttcgccgcgccatgcgcaaggtggcctccgagttcggcaaggacgactggtggtttaaggtgtggggccccaaccgcctcgcgcccgagggcatcggccatcgcgacgactgggtgctggagtcgggcgaccactggcacggctttggcgacctggcgccgggcttcaacatgctcgacccgatcaaggccaccatcatcaccccgggcctggacatgtcgggcagcttcggcgaaagcggcataccggccgcgctggtgtcgaagtacctggccgagcacggcgtcgtggtggagaagaccggcctgtattcgttcttcatcctgttcaccatcggtatcaccaagggccgctggaacaccctgctgaccgcgctgcagcagttcaaggacgactacgaccgcaaccagcccctgtggcgtatcctgcccgagttctgccgcggtcaccgccgctacgagcgcatgggcctgcgcgacctgtgccagcagatccacgaggcctatcgcgaacgcgacgtggcgcgcctgaccaccgagatgtacctgagcgacatggtgccggcgctcaagccctcggacgccttcgcccgcatggcgcaccgcgaagtcgagcgcgtcgagatcgaccagctcgaaggccgcgtgaccggcgtgctgctcacgccgtacccgccgggcattccgctgctgatcccgggcgagcgcttcaaccggaccatcgtgcaatacctgcagttcgcgcgcgagttcaacgagcgcttccccggcttcgagacctacatccacggcctggccgacgaagagggccccgatggcgccaagcgctattacgtcgactgcctgaaggacgccggcgagcagtaa

SEQ ID NO: 1916 - protein, 756 aa, Bordetella parapertussis
MKFRFPIFIIDEDYRSENASGLGIRALASAIEAEGVEVIGVTSYGDLSSFAQQQSRASAFILSIDDEEFDVDSPEDVAGAIKNLRTFIGELRFRNADIPIYLYGETRTSEHIPNDILRELHGFIHMFEDTPEFVARHIIREARSYVDGLLPPFFRELVKYAQDGSYSWHCPGHSGGVAFLKSPVGQMFHQFFGENMLRADVCNAVDELGQLLDHTGPVAESELNAARIFHADHCFFVTNGTSTSNKVVWHANVAAGDVVVVDRNCHKSILHAITMTGAIPVFLRPTRNHLGIIGPIPLDEFDPENIRRKIEANPFAREALNKKPRILTLTQSTYDGVIYNVEMIKEKLGTYVDTLHFDEAWLPHAAFHEYYRDMHAIGPDRPRSQDAMVFATHSTHKLLAGISQASQIIVQESESRKLDRNLFNEAYLMHTSTSPQYAIIASCDVAAAMMEPPGGTALVEESIREAMDFRRAMRKVASEFGKDDWWFKVWGPNRLAPEGIGHRDDWVLESGDHWHGFGDLAPGFNMLDPIKATIITPGLDMSGSFGESGIPAALVSKYLAEHGVVVEKTGLYSFFILFTIGITKGRWNTLLTALQQFKDDYDRNQPLWRILPEFCRGHRRYERMGLRDLCQQIHEAYRERDVARLTTEMYLSDMVPALKPSDAFARMAHREVERVEIDQLEGRVTGVLLTPYPPGIPLLIPGERFNRTIVQYLQFAREFNERFPGFETYIHGLADEEGPDGAKRYYVDCLKDAGEQ

SEQ ID NO: 1917 - DNA, 1422 bp, Bacillus cereus
  CDS (1)..(1422)
atgaatcaaaatcgtatgcctttatatgaggcgttaatagagtttaaagaaagagggccgttatcctttcatgttcctggtcataagaatggtttaaacttccctcaggaggcaataagagagtttaaaggtattctatctattgatgtaactgaattagcaggactagatgatttgcatagtccgtttgaatgtatagatgaggcacaacaattattggctgaagtttataatacaaagagaagttattttttaattaatggttcaacagtcgggaacttagcaatgattttgtcttgttgcggggaacatgatattgttcttgtacaaagaaattgtcataaatcaattattaatggtttaaaacttgcgggagcaaatcccatttttttagatccatggattgatgaagcttataacgtaccagtgggagttcgtaatgaaattattaagaacgcaattggaaagtatccaaatgcgaaagcacttattttaacgcatcctaattattatggtatggggatggatttagaggcaagcatcgcttttgcacatgcacataaaatccctgttttggtagatgaggcacatggggcacatctatgtttgggagaaccatttccgaagtcagcattaacatatggtgcagatattgtagttcattctgcacataaaacattacccgcaatgacaatgggttcctatttacatataaatagtcatttagtagacgaagataaggttactacttatttaagtatgctacaatctagtagtccatcgtatccaattatggcttccttggatatagcacgctttacaatggcgcgtataaaagaagaaggtcacagtgaaattgttgagtttttacgaagatttaaggaacaattacgttctattccccaaatcgccattttagaatatccgttgcaagatgagttaaaggtcaccgtacaaactcgttgtcagttatcagggtacgaattacagtctgtatttgaaaaggtcggtatatatacagagatggctgatccgtacaatgtcctatttattttacccttacaagtaaatgagggatatatgaaggttatagagatgatccgagtagcattgcaacattatgaggtgaaagacaagagggaatctattcgttatacttataatggtgaattctctcttttaccgtatacgtataaacaactagacggatatgaaacaaagatagtatctatagaagaggctgttggaatgatagcggcggaaatggtgattccgtatccacctggaattccattaattatgtatggagagagaattacttcagagcataaagagcaaattatgtatttagaaagagcaggagctcgttttcaaggtaatacgaaatatatgaaagtgtatgatatagaaagtaggttttag

SEQ ID NO: 1918 - protein, 473 aa, Bacillus cereus
MNQNRMPLYEALIEFKERGPLSFHVPGHKNGLNFPQEAIREFKGILSIDVTELAGLDDLHSPFECIDEAQQLLAEVYNTKRSYFLINGSTVGNLAMILSCCGEHDIVLVQRNCHKSIINGLKLAGANPIFLDPWIDEAYNVPVGVRNEIIKNAIGKYPNAKALILTHPNYYGMGMDLEASIAFAHAHKIPVLVDEAHGAHLCLGEPFPKSALTYGADIVVHSAHKTLPAMTMGSYLHINSHLVDEDKVTTYLSMLQSSSPSYPIMASLDIARFTMARIKEEGHSEIVEFLRRFKEQLRSIPQIAILEYPLQDELKVTVQTRCQLSGYELQSVFEKVGIYTEMADPYNVLFILPLQVNEGYMKVIEMIRVALQHYEVKDKRESIRYTYNGEFSLLPYTYKQLDGYETKIVSIEEAVGMIAAEMVIPYPPGIPLIMYGERITSEHKEQIMYLERAGARFQGNTKYMKVYDIESRF

SEQ ID NO: 1919 - DNA, 1422 bp, Bacillus anthracis
  CDS (1)..(1422)
atgaatcaaaatcgcatacctttatatgaagcattaatagagtttaaagaaagaagacggttatcctttcatgttccaggtcataaaaatggtttaaacttccctcaggaggtagtagaggagtttaaagatatactatctatcgatgtaactgagttgtcaggattagatgatttacatagtccgtttgaatgtatagatgaggcacaacaattattagctgatgtatatggagtgaacaaaagttattttttaattaatggttcaacagtcgggaatctagcaatgattttgtcttgttgtggggaacatgatattgttcttgtacaaagaaattgtcataaatcgattattaatggtttaaaattagcgggagcaaatcctatttttttagatccatggattgatgaagcttataacgtaccagtgggaattcatgatgagattattaaggaagcgattgaaaaatacccaaatgcgaaagcgctcattttaacgcatcctaattattatggtatggggatggatctagaggcaagcattgcttatgcacatacacataaaatccctgtgctagtagatgaagcacatggggctcatttttgtttaggcggggcatttccacagtcagcgttagcatatggtgcagatatggtagttcattctgcgcataaaacattacccgcgatgacgatgggatcctatttacatataaatagtcgtttagtgaaagaagaaaaagtttctacttatttaagtatgctacaatctagtagtccatcgtatccaattatggcttctcttgatattgcacgctttacaatagcacgtataaaagaaaagggacatgatgaaattgtcgagtttttacaggaatttaaagaagaattgagtactattccacaaatagctattttacaatatccattacaagacgggctaaagattaccgtacagacgcgttgtcggttatcaggatacgaattacagtctgtatttgaaaaggtcggtatatatacagaaatggcagatccatataatgtcttatttattttgcctttgcaagtaaataagaaatatatgaaggctatagagatgatccgagtagcattgcaatactatgaggtgaaagacaagacggaatctattcgttatacttataaaggagaaatttctcccctgccgtatacatataaacaactggaagaatacgaaacaaaagtagtacctatagaagaagcagttgggatggtagcagcggaaatggtaattccgtatccacctggtattccattgattatgtatggagaaagaattacttcaggacataaagaacaaattatgtatttagaaaaagcaggtgctcgttttcaaggtagcaggaaatatatgaaagtgtatgatatagaaagtaggttttag

SEQ ID NO: 1920 - protein, 473 aa, Bacillus anthracis
MNQNRIPLYEALIEFKERRRLSFHVPGHKNGLNFPQEVVEEFKDILSIDVTELSGLDDLHSPFECIDEAQQLLADVYGVNKSYFLINGSTVGNLAMILSCCGEHDIVLVQRNCHKSIINGLKLAGANPIFLDPWIDEAYNVPVGIHDEIIKEAIEKYPNAKALILTHPNYYGMGMDLEASIAYAHTHKIPVLVDEAHGAHFCLGGAFPQSALAYGADMVVHSAHKTLPAMTMGSYLHINSRLVKEEKVSTYLSMLQSSSPSYPIMASLDIARFTIARIKEKGHDEIVEFLQEFKEELSTIPQIAILQYPLQDGLKITVQTRCRLSGYELQSVFEKVGIYTEMADPYNVLFILPLQVNKKYMKAIEMIRVALQYYEVKDKTESIRYTYKGEISPLPYTYKQLEEYETKVVPIEEAVGMVAAEMVIPYPPGIPLIMYGERITSGHKEQIMYLEKAGARFQGSRKYMKVYDIESRF

SEQ ID NO: 1921 - DNA, 2271 bp, Shigella flexneri
  CDS (1)..(2271)
atgatgaaagtattaattgttgaaagcgagtttctccatcaagacacctgggtcggtaacgccgttgagcgtctggcagatgctttaagccagcaaaatgttaccgtgattaaatccacctcctttgatgatggttttgccattctctcttcaaacgaagccattgactgcctgatgttcagctatcaaatggagcatccggacgaacatcaaaacgtcagacaattgatcggtaagcttcatgagcgccaacaaaacgtgccggtcttcctgttgggcgatcgggaaaaagccctcgccgcaatggaccgggatctgctggagcttgtcgatgaattcgcctggattctggaagataccgccgactttatcgccggacgcgccgttgccgcgatgacccgctaccgccagcagctgttgccgccactgttcagcgcgctgatgaaatatagtgacatccatgaatattcctgggcagcgccaggccaccagggcggcgttggttttaccaaaacacccgccggacgtttctaccatgactactatggtgaaaatctgttccgcaccgacatgggcatcgaacgaacttccctcggttctttgcttgaccatactggcgcatttggcgaaagcgaaaaatatgccgcacgcgtatttggtgccgatcgctcctggtcggtagtcgtcggtacttccggctctaaccgcaccatcatgcaggcttgcatgaccgataacgatgtcgtggtcgttgaccgtaactgccataaatccatcgaacaaggtttgatgctgacaggcgcgaaaccggtctatatggtgccaagccgcaaccgctacggcattatcgggccaatctatccgcaggaaatgcaacctgaaaccttgcaaaagaaaatcagtgaaagcccgctgaccaaagacaaagccgggcaaaaaccgtcttactgcgtggtaaccaactgcacctatgacggcgtgtgttataacgctaaagaagcgcaggatctgctggaaaaaacctccgatcgtctgcactttgacgaagcctggtacggctatgcacgtttcaacccgatctatgccgatcactatgccatgcgcggcgaacctggcgatcacaacggtcctaccgttttcgccacccactccatccacaaactgctgaatgcgctgtcacaggcttcttatattcatgtacgtgaaggtcgtggggcgattaacttctcccgcttcaaccaggcctacatgatgcatgccaccacctccccgctgtatgccatctgcgcatccaacgacgtggcggtgtcgatgatggacggcaacagcggcctgtcactgacacaggaagtgattgacgaagcggttgatttccgtcaggcgatggcgcggctatataaagagttcaccgctgacggtagctggttcttcaaaccgtggaacaaagaagtcgtcaccgacccacaaaccggcaaaacctatgactttgctgacgcaccaaccaaactgctgaccaccgttcaggactgctgggtaatgcatccgggcgaaagctggcacggcttcaaagatattccggataactggagtatgctcgacccaattaaagtcagcatccttgctccgggaatgggtgaagatggtgaactggaagaaaccggtgttccggcggcgctggtcactgcctggcttggtcgccacggcattgtgcctacccgcaccactgacttccaaattatgttcctgttctctatgggcgtaacccgtgggaaatgggggactctggttaacaccctttgctccttcaaacaccactatgacgccaacacaccgctggcgcaggtgatgccggaacttgttgaacaatatcctgacacttacgcgaacatggggattcacgatctgggtgacaccatgtttgcctggctgaaagaaaacaaccctggcgcacggttgaacgaagcctattccggcctgccggtggcggaaatcaccccgcgtgaagcgtacaacgcgattgtcgacaacaatgtcgaactggtatccattgaaaatctgccaggacgcatcgcggcaaactcagttatcccgtatccgccaggaatcccgatgctgctgtctggtgaaaacttcggcgataaaaacagtccgcaagtaagttatttacgctcgctgcaatcctgggaccaccatttccctagatttgaacacgaaactgaagggactgaaattattgacggtatttaccacgttatgtgcgtgaaagcgtaa

SEQ ID NO: 1922 - protein, 756 aa, Shigella flexneri
MMKVLIVESEFLHQDTWVGNAVERLADALSQQNVTVIKSTSFDDGFAILSSNEAIDCLMFSYQMEHPDEHQNVRQLIGKLHERQQNVPVFLLGDREKALAAMDRDLLELVDEFAWILEDTADFIAGRAVAAMTRYRQQLLPPLFSALMKYSDIHEYSWAAPGHQGGVGFTKTPAGRFYHDYYGENLFRTDMGIERTSLGSLLDHTGAFGESEKYAARVFGADRSWSVVVGTSGSNRTIMQACMTDNDVVVVDRNCHKSIEQGLMLTGAKPVYMVPSRNRYGIIGPIYPQEMQPETLQKKISESPLTKDKAGQKPSYCVVTNCTYDGVCYNAKEAQDLLEKTSDRLHFDEAWYGYARFNPIYADHYAMRGEPGDHNGPTVFATHSIHKLLNALSQASYIHVREGRGAINFSRFNQAYMMHATTSPLYAICASNDVAVSMMDGNSGLSLTQEVIDEAVDFRQAMARLYKEFTADGSWFFKPWNKEVVTDPQTGKTYDFADAPTKLLTTVQDCWVMHPGESWHGFKDIPDNWSMLDPIKVSILAPGMGEDGELEETGVPAALVTAWLGRHGIVPTRTTDFQIMFLFSMGVTRGKWGTLVNTLCSFKHHYDANTPLAQVMPELVEQYPDTYANMGIHDLGDTMFAWLKENNPGARLNEAYSGLPVAEITPREAYNAIVDNNVELVSIENLPGRIAANSVIPYPPGIPMLLSGENFGDKNSPQVSYLRSLQSWDHHFPRFEHETEGTEIIDGIYHVMCVKA

SEQ ID NO: 1923 - DNA, 2136 bp, Shigella flexneri
  CDS (1)..(2136)
atgaaatcaatgaatattgccgccagtagtgaactggtatcccgactttcttctcatcgccgcgtggtggcgttgggagatactgattttacggacgtcgcggcagtcgtcattaccgctgcggatagtcgcagtggcattcttgcgttgcttaagcgcaccggttttcatctaccggtgtttttgtattccgaacatgctgttgaattacctgcgggcgttacggcggtaatcaacggcaacgagcagcagtggctggagctggaatccgcagcctgtcagtatgaagagaatttgctgccaccgttttatgacacgctgacgcagtacgttgagatgggcaacagcacctttgcttgccctggacatcaacatggtgcgttctttaaaaagcatcctgccggacgccatttttacgatttctttggtgagaacgtctttcgcgccgatatgtgtaacgctgacgtaaaattgggcgatctgcttattcatgaaggatcggcgaaagatgcgcagaaattcgcagccaaagtctttcatgccgataaaacctattttgtgctgaacggcacatcggcagcgaataaagtggtgacgaatgcgctgttaacgcgtggcgatctggtgctcttcgaccgtaacaaccataagtcgaatcatcacggcgcgctgattcaggcggggacgacgccggtctatctggaagcttcacgtaacccgtttggtttcattggcggtattgatgcgcactgttttaatgaagagtatctgcgccagcaaattcgcgacgttgcgccagaaaaagccgacctgccgcgcccgtttcgcctgacgattattcagctgggaacctatgacggcactgtctataacgcccgtcaggtgatcgataccattgggcatctgtgtgattacattctgtttgattccgcgtgggtcggttacgaacagtttatctcgatgatggcggatagctcgccgctgctgttagaacttaacgaaaacgatccggggatttttgtgacccagttggtgcacaaacagcaggctggattctcacagacgtcgcagatccataaaaaagataaccatatccgcggacaggcgcgtttttgcccgcataagcggttgaataacgcctttatgctccatgcttctaccagccctttctatccgctgtttgctgcactggatgttaacgccaaaattcatgaaggggagagtgggcgtcggctgtgggctgagtgcgttgagttgggtattgagtcgcgcaaggctattcttgcgcgctgtaagctgttccgcccgtttatcccgcccgttgttgatggcaaattgtggcaggattatccgacatcagtgttagccagcgaccgccgttttttcagttttgagccgggggcgaagtggcacggctttgaaggatatgccgcggatcagtattttgttgatccgtgcaagctgttactcactacaccaggtatcaatgccgaaaccggcgaatatagcgactttggcgttccggcgacgattctggcgcactatctgcgtgagaacggcattgtgccggagaagtgcgatctcaactccattctgttcttattaactccggcggaaagccacgagaagctggcacaactggtggcgatgctggcgcaatttgaacagcatattgaggatgactcgtcgctggctgaggtgttgccgagcgtttataacaaatatccggtgcgctatcgcgactacaccctgcgccagttgtgtcaggagatgcacgatctgtatgtcagtttcgacgtcaaagacctacaaaaagcgatgttccgccagcagagtttcccgtcagtggtgatgaacccccaggatgcgcatagcgcttatattcgcggtgaagtggagttggtgcggattcgtgatgccgaagggcgaattgcggcagaaggggcgttgccttatccacctggcgtgctttgcgtggtacccggggaagtctggggtggggcggttcaacgttatttccttgcgctggaagaaggcgtgaatttgttgccgggattttcgccggagttgcaaggtgtctatagcgaaaccgatgcggatggcatgaaacgattgtacggttatgtgttgaagtaa

SEQ ID NO: 1924 - protein, 711 aa, Shigella flexneri
MKSMNIAASSELVSRLSSHRRVVALGDTDFTDVAAVVITAADSRSGILALLKRTGFHLPVFLYSEHAVELPAGVTAVINGNEQQWLELESAACQYEENLLPPFYDTLTQYVEMGNSTFACPGHQHGAFFKKHPAGRHFYDFFGENVFRADMCNADVKLGDLLIHEGSAKDAQKFAAKVFHADKTYFVLNGTSAANKVVTNALLTRGDLVLFDRNNHKSNHHGALIQAGTTPVYLEASRNPFGFIGGIDAHCFNEEYLRQQIRDVAPEKADLPRPFRLTIIQLGTYDGTVYNARQVIDTIGHLCDYILFDSAWVGYEQFISMMADSSPLLLELNENDPGIFVTQLVHKQQAGFSQTSQIHKKDNHIRGQARFCPHKRLNNAFMLHASTSPFYPLFAALDVNAKIHEGESGRRLWAECVELGIESRKAILARCKLFRPFIPPVVDGKLWQDYPTSVLASDRRFFSFEPGAKWHGFEGYAADQYFVDPCKLLLTTPGINAETGEYSDFGVPATILAHYLRENGIVPEKCDLNSILFLLTPAESHEKLAQLVAMLAQFEQHIEDDSSLAEVLPSVYNKYPVRYRDYTLRQLCQEMHDLYVSFDVKDLQKAMFRQQSFPSVVMNPQDAHSAYIRGEVELVRIRDAEGRIAAEGALPYPPGVLCVVPGEVWGGAVQRYFLALEEGVNLLPGFSPELQGVYSETDADGMKRLYGYVLK

SEQ ID NO: 1925 - DNA, 2127 bp, Escherichia coli
  CDS (1)..(2127)
atgaataccatattgattggtagtaagtcttttgacaataaatatgtggcagaaatcatttctcatttacatacaaaaaattttggcactgaactggctggttgtagtgagaaaattgaaaccattataagaaacaacgcaagaatcgctgcagtattactggatttggatgattcgaatgatattcttgacaaaattcgcatgctgaatgaacatctgccagtcttcttacttaagaccgatgatgttgccattaaaaaattttgttttgattcattcgacggaaatgtacatcttattgattgttgcctttattctgttgacgaaattgttaataaaatccagaaaataattaatgactatattgatgcaatattaccacctttaacaaaagcattatttaactatgtgaaggaaggtaaatatactttctgtacgccaggacacatgggaggaacagcttaccagaaatcgcctgcaggtagtttgttctatgatttttttggtgaaaataccatgaaatcagatatttcagtgtctgtcggagaactggggtcgctgcttgatcactcaggacctcattcagaagccgaaaagtatattgctgaaacttttaatgctgacagaagctatattgttacgaacggaacgtcgacagctaataaaattgttgggcaattctccgtacctgcaggatgtactgcactgattgacaggaattgccacaaatctctcacacatatgttgatgatgagtgacatcatcccgatatatctgaaacctacacgaaatgcatatggcattctgggggggatccccagaacggaattctcttctgattcgattaagcagaaaatggctgttacgccaggtgcaacatggccagttcatgccgttatcactaactctacttatgatggtctgttttataataccgactggatcaaagaacatctggatgtaaaatctattcattttgattccgcatgggtgccatataccaatttcagtccgatttattctggcaaaacgggtatgggtggcaagcgtattgaaggaaaagtaatatatgaaacgcagtcaacgcataagctgttagccgctttttcacaggcatccatgattcatgttaaaggtgatattaatgaagaaacctttaatgaagcctatatgatgcaaacctccacctctcctcattacggtattgtcgcctccactgaaatggctgcggctatgatgaaaggcaatcctggcaaacgtcttattcaggaatccatggaacgtgctctggcttttcgtaaggaaatccaggcccgctttgaaaacagtgacacttggttttttaaagtatggcaacctgagaacattaatgaggtagattgctggccattggataaaaacgatcaatggcatggattcaaagatattgatcaagaacatatgtatcttgaccccattaaagtaactttattgacgccgggtcttgataaatacgggaaaattgaagaacaaggtatacccgcagcattagtttcaaaattcctagatgatcgtggtattattgtcgaaaaaacaggtccatataacattttgttcctgttcagcattgggattgatgatactaaggctcttagtcttctgcatggtttgtatgaatttaaggagcggtacgatcgtaatgagctggtcaaagatattctgccagggatctgggccgaatcgccagctttttacaacaatatgagaattcaggagctggcacagggaattcataatctgattcgcaagcataatctgccggagttaatgttccgggctttcgatgtcctgccagaaatggtaatgaaacctcagcaggctttccaggcagaacttcgtggtgaaacggaggaatgtttcattgaagacttggtagggaaaattaatgctaatatgattcttccgtatccaccaggagtacctttagttcttcccggagaaatgattacagagagcaatcgtccggttctggagtttttgttaatgctttgtgaaattggtaaccactatcctggttttgaaaccgatattcatggtctgtatcgaaaggcggataacaggtatactgcaaaagtcattaaaaaataa

SEQ ID NO: 1926 - protein, 708 aa, Escherichia coli
MNTILIGSKSFDNKYVAEIISHLHTKNFGTELAGCSEKIETIIRNNARIAAVLLDLDDSNDILDKIRMLNEHLPVFLLKTDDVAIKKFCFDSFDGNVHLIDCCLYSVDEIVNKIQKIINDYIDAILPPLTKALFNYVKEGKYTFCTPGHMGGTAYQKSPAGSLFYDFFGENTMKSDISVSVGELGSLLDHSGPHSEAEKYIAETFNADRSYIVTNGTSTANKIVGQFSVPAGCTALIDRNCHKSLTHMLMMSDIIPIYLKPTRNAYGILGGIPRTEFSSDSIKQKMAVTPGATWPVHAVITNSTYDGLFYNTDWIKEHLDVKSIHFDSAWVPYTNFSPIYSGKTGMGGKRIEGKVIYETQSTHKLLAAFSQASMIHVKGDINEETFNEAYMMQTSTSPHYGIVASTEMAAAMMKGNPGKRLIQESMERALAFRKEIQARFENSDTWFFKVWQPENINEVDCWPLDKNDQWHGFKDIDQEHMYLDPIKVTLLTPGLDKYGKIEEQGIPAALVSKFLDDRGIIVEKTGPYNILFLFSIGIDDTKALSLLHGLYEFKERYDRNELVKDILPGIWAESPAFYNNMRIQELAQGIHNLIRKHNLPELMFRAFDVLPEMVMKPQQAFQAELRGETEECFIEDLVGKINANMILPYPPGVPLVLPGEMITESNRPVLEFLLMLCEIGNHYPGFETDIHGLYRKADNRYTAKVIKK

SEQ ID NO: 1927 - DNA, 1563 bp, Oryza sativa
  CDS (1)..(1563)
atgcggcatgttgtagtacaatgtgccacttcatgggacactccaagaacgtctactactaatggttcacatgctgaaccttcagcagttgtcaaagctggtactgcccctctgattcaggcactgaaatcaactgcaaatcaagatgtttcttgctttcactttcctggacataatagagggaaagcttctcctccttcattgtcagaacttattggctcaaggacatttttgcatgacttacctgagctacctgagcttgatgatctcttctcccctaaaggtgtgattttagatgctcagaagcgagcagctgaactatttggatcatttaaaacatggttcctggtcaatggaagtacatgtggaatccaggcctcagtgatggctacctgttcccctggtgactacctcatcatacctcgaaattgtcatatttcagtgatctctgcactggttttgtctggtgctgtgcccaaatatatagtacctgagtacaattccgggtgggacattgctgggggtattaccccatcgcaggtggataaagtggttaaggaactggaggaggacagaaagaaggtaggtgctgttcttgttacatcaccaacctatcatggcatatgcagcaatatacaaggaattgtcaatgtttgccacctgcaaggcattcctgttatagttgacgaggcgcatggtgcccatttcaggtttcacagaaattttccaagcagcgcaactgagcaaggtgccgacttggttgtgcaatccacacacaaggttctgtgctcgcttacacagtcctcaatgcttcacatggctggagatcttgtggatgcagataaagtaagccaatgcctccaattgctccagagctcaagcccaagttaccttctactctcttctttggatgccgcaagggctcagctgagtgagaatgcagaatcttttgatgaaccagtatctatggctttagaaacaaaacatcagctgaggattatcccaggaatatctgttttggacttatcaagctttctttctgattttcctgctattgatcccttgcgtatcacattaagtgcttcagatctgcaattatctggatatgaagcagatgattttttagctgaggagcatcaaattgtatctgagctggtcggtacacaggccgtgacatttgcagtcaacttagggaccagaaggcatgatgttcagaggcttgtacattctgtaaagcatctgtcagaaaaatacttctctgaaaatgggtccagttccagaaaagagaatcctgctagtagcccactggacaagttctccatcaagttgacaccaagggaggccttctttttaaagaagaggagagtgtccatcgaggatagccttggtgagatttgtggtgagcttatctgcccttatccaccaggtatcccggtgctgatcccaggtgagatagtaacgcaggattcactgtcatacttgatggatgtcagggacaacggcatagcaatcagtggagcagctgatggtgagctcaagtccattatggtatgcaacgtgtga

SEQ ID NO: 1928 - protein, 520 aa, Oryza sativa
MRHVVVQCATSWDTPRTSTTNGSHAEPSAVVKAGTAPLIQALKSTANQDVSCFHFPGHNRGKASPPSLSELIGSRTFLHDLPELPELDDLFSPKGVILDAQKRAAELFGSFKTWFLVNGSTCGIQASVMATCSPGDYLIIPRNCHISVISALVLSGAVPKYIVPEYNSGWDIAGGITPSQVDKVVKELEEDRKKVGAVLVTSPTYHGICSNIQGIVNVCHLQGIPVIVDEAHGAHFRFHRNFPSSATEQGADLVVQSTHKVLCSLTQSSMLHMAGDLVDADKVSQCLQLLQSSSPSYLLLSSLDAARAQLSENAESFDEPVSMALETKHQLRIIPGISVLDLSSFLSDFPAIDPLRITLSASDLQLSGYEADDFLAEEHQIVSELVGTQAVTFAVNLGTRRHDVQRLVHSVKHLSEKYFSENGSSSRKENPASSPLDKFSIKLTPREAFFLKKRRVSIEDSLGEICGELICPYPPGIPVLIPGEIVTQDSLSYLMDVRDNGIAISGAADGELKSIMVCNV

SEQ ID NO: 1929 - DNA, 2181 bp, Vibrio parahaemolyticus
  CDS (1)..(2181)
atgaaacgtttaattataggtgttagtaattacatgccagaagacttcagtttattagctgaatctttagatgaacaatttaatcgtcatttacaacctttagagcaagttgaattaaccgacgttggtgcggctattattacttcagcagacattaaagcaggtctgcataaaatgatttctgaaacgggttacggtattccagttttcttagtaacggatgaaaacccagtttcggcagaagattacgtttggctaactggcgttatcgatttagaaagacaatctattgagtactactgtcgtcaaatcaacgaagcagtaaccaagtacgaatgtcgtctgcttcctcctttcttcaagcaattaacgcactatgttgagatgggtaactcagcgtttgactgtccgggacaccaaggtggtcagttcttcaaaaaacacccagctggtaaacaattctacgatttctttggcgaaaacctgttccgtagtgacttgtgtaacgcggacgtggatttaggtgacttgctgatccacgaaggttctgcacaccaagcgcaagcgcacgctgcaaaagtatttaacgcggacaaaacttacttcgtactcaacggtacttctgcttcaaacaaagtggtgtgtaacgcgctagtaactgaaggtgatttggtactgttcgaccgtaacaaccacaaatcgaaccaccacggtgcgttaatccaagcgggtggtatgccagtttacttagaaacggcgcgtaacccttggggcttcatcggtggtatggatgagcactgtttcgatgaagaatacattcgtgctcaaatcgcgaaagtggatccagaacgtgcacgcgatgaacgtcctttccgtcttgctattatccagcttggtacttacgacggtactatctataacgctcgctacgtgatggataagatcggtcatctttgtgactacatcctgtttgactctgcgtgggttggttatgagcagttcatccctatgatgaaagactgttcaccactgctgctggatttgaaaccagaagacgcaggtgtgatcgtgactcagtctgttcacaaacaacaagctggtttctctcaaacatcgcaaatccacaaaaaagaccgccatatcaaaggtcaagctcgttactgtaaccacaaacgctttaacaacgcgtttatgatgcacgcatcgacttcaccattctacgcactgttctctgcgcttgatgtgaacgcgaagatccacgacggcgaagccggtctgcgtttatggcgcgatgcggttaagactggtatcgaagcgcgtaaagaaatccttaagagttgtgaattgattcgtccgttcattccagacgaagtcgaaggtcaaccttggggcagctacgacactgacgtgatcgcaacgaacaagaaattcttcatgtttgagccaaacgcaagctggcacaaatttgaaggttacggtgaaggtcaatacttcgttgacccatgtaaattgttgctaactactgcgggtattgcagaagacggcagctacgcagatttcggtattcctgcaacgctattggcgaacttccttcgtgaaaacggcatcatccctgagaagtgtgacttgaactctatcttgttcctactcactcctgcggaagatatgggtaagatccgtcaccttgtggctcaaattaaccgattcgaaaaattcatccgtgatgatgcgcctctaagtatcgtacttccaagcgtctacgaagcgaataaagaacgctaccgtggctacaccatccgtcagctatgtcaggaaatgcatgacatgtacaaagagctgaacgtgaaacagctacaaaaagcgatgttccgcagcgagtacttcccacaaatggttcacaaaccagacgtggcaacacgcaaatacttccgtggtgaatgcgattacctaccacttaaagaggccgttggtcgcgtagccgctgagggtgcacttccttaccctccaggcatcatctgtgtgatcactggtgaaatctggaccccacacgtggtggattacttcctatctctagaagaaggcatcaaccgcttcccaggcttcgcgccagaaattcaaggcgtgtaccttgaagatgttaacggtcgcactaccgcacattgttatgtcctaaaagattaa

SEQ ID NO: 1930 - protein, 726 aa, Vibrio parahaemolyticus
MKRLIIGVSNYMPEDFSLLAESLDEQFNRHLQPLEQVELTDVGAAIITSADIKAGLHKMISETGYGIPVFLVTDENPVSAEDYVWLTGVIDLERQSIEYYCRQINEAVTKYECRLLPPFFKQLTHYVEMGNSAFDCPGHQGGQFFKKHPAGKQFYDFFGENLFRSDLCNADVDLGDLLIHEGSAHQAQAHAAKVFNADKTYFVLNGTSASNKVVCNALVTEGDLVLFDRNNHKSNHHGALIQAGGMPVYLETARNPWGFIGGMDEHCFDEEYIRAQIAKVDPERARDERPFRLAIIQLGTYDGTIYNARYVMDKIGHLCDYILFDSAWVGYEQFIPMMKDCSPLLLDLKPEDAGVIVTQSVHKQQAGFSQTSQIHKKDRHIKGQARYCNHKRFNNAFMMHASTSPFYALFSALDVNAKIHDGEAGLRLWRDAVKTGIEARKEILKSCELIRPFIPDEVEGQPWGSYDTDVIATNKKFFMFEPNASWHKFEGYGEGQYFVDPCKLLLTTAGIAEDGSYADFGIPATLLANFLRENGIIPEKCDLNSILFLLTPAEDMGKIRHLVAQINRFEKFIRDDAPLSIVLPSVYEANKERYRGYTIRQLCQEMHDMYKELNVKQLQKAMFRSEYFPQMVHKPDVATRKYFRGECDYLPLKEAVGRVAAEGALPYPPGIICVITGEIWTPHVVDYFLSLEEGINRFPGFAPEIQGVYLEDVNGRTTAHCYVLKD

SEQ ID NO: 1931 - DNA, 4026 bp, Vibrio parahaemolyticus
  CDS (1779)..(3914)
gatagaggttgataacttttatcgcgattaccgacgagttgatgagagtttatctatcggtagaaggtttgatgtttttcttataactgcatgaataatatggttttatatttttgtgtttatcatatttatctcaacttgatgttgattaactaatcattttattgataacgccaagtttatttttttcccgatttttgggcgtagtcttcacttcgaaatttagcgaggtcgagcaggtatccacttcatagcatctcgctaataaccgttcagtttgagtcacgttgacttgagtggaatagatttggagatgttatgtcatcgaatacgaaaaaaatcggcctaattgcctgtacgggtgtagtcgccggtaacatgatgggtagtggtattgcactgttaccttccagcctagcttcagtaggctctgtttcaattttcagctggctgatctgtttgatcggtgcactgagccttgcgtttgtttacgctcgtctggcaatcaaaaaccctcaagaaggtggtcctatcgcttatgcgggcgaagtttccccagtctttggtttccaaacgggcgtgctttattaccacgcgaactggattggtaacctagctattgctattacaggtgtttcttacctttcagtattcttccctgtgcttaatgacccaatcccagcgggtattgcgacgattgcatcggtatggatcttcactttcgtcaacctacttggtggtagctgggtaagccgtctatgtacgcttggtcttgttctaattctaattccagttgttggtaccgctctatttggttggacgcacttcgacactgcgctatacagccaaaactggaacgtatctgcgggtactgatagccatgcgattgtgactgcggttcttatctgtctatggtcattcgttggtgtggaatcagcagcagtatcgacaggtatggtagaaaaccctaaacgtactgtaccgctagcaaccatgctgggtactggtatcgcaggtgtgatttacatcctatcaactcaaatgatcagcggcatgttccctgcttctgaagttgcggcatcaggtgcgccatttgcattggcaaccactgagctattcggtagctggactgcaccattcgtatcagcattcactgcactagcatgttttacttcgctaggttcttggatgatgctggtgggcgaagctggtaaacgtgcagcaagcgatggcaacttccctaaaatctacggcgaaactgacaaaaacggtgtgcctaagaaaggtttaatccttgcgtcaatcaagatgacagcattaatggttgtactgatgttcttcagctctaaaacagcacacgcatcagacctgttcaaccagctaacgactgatgcagttctactaactatgctgccttacttctactcaagcattaacttgatccgctttgaaggtatgacaacacgcaacggcttcgtaatgctgttctctggtgtggcttgtctgttctgcttcattgcccttgctggtgcagaaggcggtacgctaacagcaaccttcatcgtgtctctcgttatcttgatgttctacagcaaaaaagccggcttagctcagtacatgaagctacacgctgacgacatgcctgctcaagcaagcaactaatccccaaacgctggcacttcggtgccagccaataaaaaacaaattcactcggcgctcaccttactcactgcctgtaaatggcagagagcgccttcattcgccttggagatgtccaaatgaatattttcgctatcttgaaccacatgggtgtgttctttaaagaagagccagttcgtcaacttcacgctgctcttgagaaagcgggctacgaagtggtttacccagtagatgataaagacttgatcaaaatgattgagatgaacccacgcatttgcggtgtgctgttcgactgggataaatactcactagagctatgtgaacgtattagccagatcaacgaaaaactgcctgttcacgcatttgctaacgaacagtctactctcgatatttcactaacagacctacgtctaaacgtgagcttcttcgagtacgctttaggtatggctgacgacatcgctatcaaaatcaaccaagcgactgaggcatacaaagatgccatcatgcctccattcactaaagcgctattcaaatacgtagaagaaggtaaatacaccttctgtactccaggtcacatgggcggtactgcattccagaaaagccctgctggtagcatcttctatgatttttacggtccaaacacattcaaagcggacgtatcaatctcaatgcctgagttaggttctctactagaccactcaggtcctcataaagatgcagaagaatacatcgcacgtaccttcaatgcagacagttcttacatcgtaactaacggtacgtctacatcgaacaaaatcgtgggcatgtactcagcacctgcgggcagcacagtactgattgaccgtaactgtcacaaatctctgactcacctaatgatgatgagcgacgtgacaccaatctacttccgcccaactcgtaacgcatacggcatccttggtggtattccacaaagcgaattcagccgtgatgtcattgcagagaaagtggcgaaaacaccaggtgcaacagcgccaagttacgcagtagtgactaactcaacttacgatggtctgttgtacaacacacaattcatcaaagagtcgctagactgtaaacacatccacttcgacagtgcttgggtgccttacactaacttcaacccaatttacgaaggtaaatgtggtatgagtggtgaagcgatgccaggcaaagtgttctacgagacacaatcaacacacaaactgttggcagcgttctcacaagcttcaatgattcacgtgaaaggtgactttgataaagagtctttcaacgaagcattcatgatgcacacttcaacttcacctcagtacggcattgttgcttctactgaaactgcagcggcaatgatgcgcggcaacactggtaagaagttgatgcaagactctatcgatcgcgcaattcgcttccgtaaagagatcaaacgcctagaagcagaaagtgacagctggttcttcgatgtatggcaaccagaaaacatcgataccacagaatgttggaaactagaccctagcgatacatggcacggcttcaagaacatggatgacaaccacatgtatcttgacccaatcaaagtaacgctactgactccagggatgaacaaagaaggcgaactagaagaatcaggtattcctgcttcgctggtggctaaattcctagacgagcgcggcatcgtggttgagaaaacaggcccatacaacttgttgttcctattctcaatcggtatcgacaaatcaaaagcaatgcaattactacgcggtctgactgaatttaaacgtggctacgacttgaacctaaccatcaagagcttccttccttcgctatataacgaagatccaagcttctatgaaggcatgcgcgttcaagaattggcacaagcaattcatgacctaactaagaaatacaacctaccagagctaatgtacaaagcgttcgatgttcttccagaaatgaaagtaacaccacacgcagcatggcaagaagagcttcgcggtaacgtagaagaaatcaaactggaagaaatggttggtcgcgtaagtgcgaacatgatccttccttatcctccaggtgtgccactagtacttcctggtgaaatggtgactcaagagtctcgccctgtgctggacttcctagagatgctttgtgagatcggggcgcattacccaggtttcgaaaccgatatccacggtctgtaccaacaaaaagatggtagctacaccgtaaaagtattgaagaactaagttcctctcgaagatgacgccattgggaatgcaagcatgctccactcttacgagctcaatgtgtcatcgaacaaccacgacatttagatatacccctagctaatctgtcgta

SEQ ID NO: 1932 - protein, 711 aa, Vibrio parahaemolyticus
MNIFAILNHMGVFFKEEPVRQLHAALEKAGYEVVYPVDDKDLIKMIEMNPRICGVLFDWDKYSLELCERISQINEKLPVHAFANEQSTLDISLTDLRLNVSFFEYALGMADDIAIKINQATEAYKDAIMPPFTKALFKYVEEGKYTFCTPGHMGGTAFQKSPAGSIFYDFYGPNTFKADVSISMPELGSLLDHSGPHKDAEEYIARTFNADSSYIVTNGTSTSNKIVGMYSAPAGSTVLIDRNCHKSLTHLMMMSDVTPIYFRPTRNAYGILGGIPQSEFSRDVIAEKVAKTPGATAPSYAVVTNSTYDGLLYNTQFIKESLDCKHIHFDSAWVPYTNFNPIYEGKCGMSGEAMPGKVFYETQSTHKLLAAFSQASMIHVKGDFDKESFNEAFMMHTSTSPQYGIVASTETAAAMMRGNTGKKLMQDSIDRAIRFRKEIKRLEAESDSWFFDVWQPENIDTTECWKLDPSDTWHGFKNMDDNHMYLDPIKVTLLTPGMNKEGELEESGIPASLVAKFLDERGIVVEKTGPYNLLFLFSIGIDKSKAMQLLRGLTEFKRGYDLNLTIKSFLPSLYNEDPSFYEGMRVQELAQAIHDLTKKYNLPELMYKAFDVLPEMKVTPHAAWQEELRGNVEEIKLEEMVGRVSANMILPYPPGVPLVLPGEMVTQESRPVLDFLEMLCEIGAHYPGFETDIHGLYQQKDGSYTVKVLKN

SEQ ID NO: 1933 - DNA, 1461 bp, Clostridium tetani
  CDS (1)..(1461)
atgtacagattaaatcaatcagaaactccattatttgatgcgttaatggaatatgtgaatagacaaactataccttttcacgttcctggtcataaaaaaggagtaggaatagatgaggaatttaaaaattttataggtgagaatccttttaaaatcgatgttactgtttttaaactagtggatagcttacatcatcctacaggtcctataaaaaaagctcaagcattagcttctgatgcatatggctctgatgcttcatttttttgtattcatggtacctctggtgctatacaggcaatgataatgtctgtggtgaaatctggtgataaaataattatcccaagaaatgtccataaatcagtaacttctggcattatattaagtggggctacccccatttatatgcaaccagaattagataaaagagttggtatcgctcatggcgttactcctgaaactgtagaaaaaacattaaaagaaaatcctgacgctaaagcagttttaataattaatccaacttattatggcgttgctactgatattaagaaaatagcagatatagttcataattatgatattcctttaattgtagatgaagctcatggtcctcatttagcttttaacgatacacttccaatatcagctattgaagctggtgctgatatttgttgccaaagtacacataaaataataggtgctctaactcaatgttcattacttcacgttcgttctaaaagtatagatgtaaatagagttcagcaaatgttaagtttacttcaaactacatctccttcatatatattaatggcttcacttgactgtgctagaagacaaatagctttaaatggtaaggaattattagataaatccatagctttatctaactatgcccgtgaagaaataaataaaattcctggcttctattgtttcggtaaagaaattgttggaagacctggtgtttttgctatagatcctactaaaataactataacctgtagagatttaggtattactggttttgaattagatatgattttatctaaccaatatcacattcaactagaattatcagatttatataatggtcttgctgtaggctcctttggagatacaaaggaaaatatagatgcactaattaatgcactaaaagaaataagtaaagagtatgtaaataatgagaataaaaaatctgactttatagatataccagctataccaaagcaagttcaaattcctagagatgcttttaatagtgaaaaagtagttcttcctttaaaagatagtgaaggaagagttagtggggaatttttaatggcttatcctcctggaatacctgtactttgccctggggaaataattactcaagaaataattgattatatacaaaaattaaaagatactggtctttatgtacaaggtacagaagatttagaagtgaattttataaaagttgtaaaataa

SEQ ID NO: 1934 - protein, 486 aa, Clostridium tetani
MYRLNQSETPLFDALMEYVNRQTIPFHVPGHKKGVGIDEEFKNFIGENPFKIDVTVFKLVDSLHHPTGPIKKAQALASDAYGSDASFFCIHGTSGAIQAMIMSVVKSGDKIIIPRNVHKSVTSGIILSGATPIYMQPELDKRVGIAHGVTPETVEKTLKENPDAKAVLIINPTYYGVATDIKKIADIVHNYDIPLIVDEAHGPHLAFNDTLPISAIEAGADICCQSTHKIIGALTQCSLLHVRSKSIDVNRVQQMLSLLQTTSPSYILMASLDCARRQIALNGKELLDKSIALSNYAREEINKIPGFYCFGKEIVGRPGVFAIDPTKITITCRDLGITGFELDMILSNQYHIQLELSDLYNGLAVGSFGDTKENIDALINALKEISKEYVNNENKKSDFIDIPAIPKQVQIPRDAFNSEKVVLPLKDSEGRVSGEFLMAYPPGIPVLCPGEIITQEIIDYIQKLKDTGLYVQGTEDLEVNFIKVVK

SEQ ID NO: 1935 - DNA, 1416 bp, Clostridium tetani
  CDS (1)..(1416)
atgtcaaaattaccacttgtagaaggggtattaaattatataaaaaagaaaaatatttatttttctatgccaggtcataagcaaggtgaaggttttttatctacagatataggtaaggagataaaagaacaaattttaaaactagatatcaccgaagtaaacggtgtagacaatctgcataatcctacaggtatcataaaagaatcccaaataaaattaagtgaactttatggtagtaagaagtcttattttttagttaatggaagtagtagcggaaatatgattatgatattttcttcttttgaagaaggagacaaaataataattgatagaaattgtcataaatcaatatttaatacaattataataagaaagttaaaagctatatatgtaaagaataaaattcataaaggttttaaccttccactttctgttgatagtagccatattataaaaacaattaaagaaaataaagatgccaaaggaataattataacttatcctaattactatgggatttgttgtgatttagagaaaattattatagaagctaaaaagcacaacatgaaagtgttaattgactgtgcccatggagcacattttgttgcaaacgaaaaattacctaagaatcctgttaaactaggagcggatatggtagttatgagtagtcataaaacacttccaagtttaactcaaacagcatttttacatgttaacaatgaagaacttatagataaggtagatttttactttgatacttttataagtacaagtccttcatatttatttttagtttctatggattattctaggtattatttagaagaatatggagaagaaacttatgaaaaattaataaaattattaaagatatataaacaaaagataaattctctaaaacacctacatataatagatcaggtagatattatgtcagaatatactttagataaaagtagatatattctacacatagaagaaggttatagtgcaaatttattaatggactatcttttaaaaaataatatacaatgtgaaatgaatgatacttataatattgttataatagtatctccttttcatgtagaaaaggaaattaaatatttatatgaagttttattaaactgcgatttttctaagtttaaaattaaagaaatggacatattaaatcataatatacctaaaaaaaagctagaaccttttgaagttttgaataaaggtaaaaaaatagtagaagtagaagaatctttagattgtgtatgtgcagaaaatatagtaccatatccaccaggtattccaattattatgatgggagaaataatggatgaagaaactatagaagttataaaatattatgaagacaatggaatagaagttattggtttacatgaaaatcagatcaatgtggttaaataa

SEQ ID NO: 1936 - protein, 471 aa, Clostridium tetani
MSKLPLVEGVLNYIKKKNIYFSMPGHKQGEGFLSTDIGKEIKEQILKLDITEVNGVDNLHNPTGIIKESQIKLSELYGSKKSYFLVNGSSSGNMIMIFSSFEEGDKIIIDRNCHKSIFNTIIIRKLKAIYVKNKIHKGFNLPLSVDSSHIIKTIKENKDAKGIIITYPNYYGICCDLEKIIIEAKKHNMKVLIDCAHGAHFVANEKLPKNPVKLGADMVVMSSHKTLPSLTQTAFLHVNNEELIDKVDFYFDTFISTSPSYLFLVSMDYSRYYLEEYGEETYEKLIKLLKIYKQKINSLKHLHIIDQVDIMSEYTLDKSRYILHIEEGYSANLLMDYLLKNNIQCEMNDTYNIVIIVSPFHVEKEIKYLYEVLLNCDFSKFKIKEMDILNHNIPKKKLEPFEVLNKGKKIVEVEESLDCVCAENIVPYPPGIPIIMMGEIMDEETIEVIKYYEDNGIEVIGLHENQINVVK

SEQ ID NO: 1937 - DNA, 2766 bp, Bradyrhizobium japonicum
  CDS (1)..(2766)
atggggagagacatgcccaaggacgccaagcctgcgcagcagcgcatcgatcagttcttctccgggcccggcggacgggcggacaattggcgcgatctggtcgacgcggccaaagcatggtcccgcggcggagaccgtgcgaagtatgacgctgcgctggccgatctcttcgtgacggaggaatttcacggctatcctggcctgcagctcatggcagccttgcgggaggcagccacgactggcgatgcggcaacttcgctggcgctcgccacgcggttgacgcaggccctgacgacgagatccttccgtcagcatgcgggcgactggaatacgaatgacgaaggcaacggcgagacgcccgatctggtgccgcagatgttcggtccgcacgcggcgcgccgtccctatttcgagacgctgatcgtcaccggcctcacgtccggcagttggcccgcactcgccaacgaatggcgcaagcttcggcgtccggttgatcagtttgtctacgagccggttatcgtcggcagcctcgaggacgccttctgcgccacgatcctgaacccgaacctcgcagccgtcgtcatcaacgaaggcttcgcgctacgctcacgtcacgacgcgcccgtgctccgccccctgacttcgtcggcgggattgaaggacgagtccgacgcttcggcgctgcggctcgcccatatcatcaagcacgtccgccccgagcttgacctctatctgatgtccaatcgcaacgtggaggagatggccggaaatcccgaggccgatgtcgtccgccggatcttctattcggtcgaggaactgcttgagctgcatctctcgatccttgaaggcgtgcaggatcgctacgacacgccgttcttcgacaatctgaagaaatatgcgcagcgtccgatcggaacgttccatgcgctgccgatcgcgcgcggcaaatcggtcttcaagtcggactggatccgcgacatgggcgagttctacggcctgaacctgttcctggccgaaagtagcgcaaccaccggcggcctggacagcctgttggagccgaccggcaacatcaagaaggcgcaggacaaggccgcgcgcgcgcttggcgccgatcgcgtattcttcgtgaccaatggcacctcgacgtcgaacaagatggcggtgcaggcgctgatcgggccgggcgatatcgccatcgtcgatcgcaattgccacaaatcgcatcactacgggatggtgctggccggcgcgcagccgctctatgtcgaagccttccctatgacggaatattcgatgtacggcgccgtgccgctgaagaccatcaagcaggctttgttgagcgctagggccgacggccggctcgaccgcgtcaagctgctggatctgaccaactgcactttcgacggccacatctacaatacccgccgggtgatggaggagtgccttgccatcaagcccgacctgatcttcctgtgggacgaggcctggttcggcttcgcgcgcttctcgccgttcctgcgacggcgcaccgcgatgggcgccgctagcgagatcgaagcctggatgcgcgatccgagatcggtcgcggcctacgagacgcagcaggccgagctcggcaagagtccttcggaccaggtgctgctcaagacccggctgatccccgatccacgtcagattcgccttcgcgtgtaccagaccaattcgacccacaagtcgatgtcggcgatccggcagggctcgatgctggcggtcaaggacgtcgaattccacacggtcgagcagcagttcaaggaagccgtgttcacgcacgcctccaccagtccgaaccagcagctgatcgcgagcctggatgtctcgcggcgccagatggagctggagggttacggtctcgtggccaatgcgatcgagatcgcgctggccatccgacaggcagtcaacaccaatccgctgatctcgaaatatttccgtatcctcggtgccgacgccatggtgccggcgcaatatcgccaaagcgggttcaccgattatctggcggccggcacgaactgggcgagtgcccttaagagcctggacgacgacgagttttgcctcgatccaacccgcatgacgctggtgtgcggcacagccggcttcgacggcacgcagttcaagggcatcctcgcgaacgactacaacatccaggtcaacaagacctcgcgcaattcggtgctgctccagtccaacatcaacaacacgcgcagcgacgtggcacatctcgtcagggtgctggcggagatcgccggcgaggtcgaccgtggcctgacccagggcggagccaatgcgaagagggccttcgaggcgcgggtcaagagcttgatgaccgacgtgcccgacttgccgaacttctcgcacttccaccagagcttccgcggcgacgccggcgccaagaccaacgaaggcgatatccgcagcggcttctacgcggcctatgacgcggctggttgcgaattcattcgcctcgccgaccccgagatcgaccggcgcctgaaggccggtcccgacctcgtctcagccagtttcgtgatcccgtatccgccgggcttcccgatcatggtgccgggacaggtcatcacccaggaaaccatcgacttcatgcggaagctcgatgtgaaggagatccatggctacgacgccaaggaaggcctgaagctcgtgcgggccgaggccttggcgaagatcggcaggcccaaacccggcgcgcagccgaagctgaaggccgcctcataa

SEQ ID NO: 1938 - protein, 921 aa, Bradyrhizobium japonicum
MGRDMPKDAKPAQQRIDQFFSGPGGRADNWRDLVDAAKAWSRGGDRAKYDAALADLFVTEEFHGYPGLQLMAALREAATTGDAATSLALATRLTQALTTRSFRQHAGDWNTNDEGNGETPDLVPQMFGPHAARRPYFETLIVTGLTSGSWPALANEWRKLRRPVDQFVYEPVIVGSLEDAFCATILNPNLAAVVINEGFALRSRHDAPVLRPLTSSAGLKDESDASALRLAHIIKHVRPELDLYLMSNRNVEEMAGNPEADVVRRIFYSVEELLELHLSILEGVQDRYDTPFFDNLKKYAQRPIGTFHALPIARGKSVFKSDWIRDMGEFYGLNLFLAESSATTGGLDSLLEPTGNIKKAQDKAARALGADRVFFVTNGTSTSNKMAVQALIGPGDIAIVDRNCHKSHHYGMVLAGAQPLYVEAFPMTEYSMYGAVPLKTIKQALLSARADGRLDRVKLLDLTNCTFDGHIYNTRRVMEECLAIKPDLIFLWDEAWFGFARFSPFLRRRTAMGAASEIEAWMRDPRSVAAYETQQAELGKSPSDQVLLKTRLIPDPRQIRLRVYQTNSTHKSMSAIRQGSMLAVKDVEFHTVEQQFKEAVFTHASTSPNQQLIASLDVSRRQMELEGYGLVANAIEIALAIRQAVNTNPLISKYFRILGADAMVPAQYRQSGFTDYLAAGTNWASALKSLDDDEFCLDPTRMTLVCGTAGFDGTQFKGILANDYNIQVNKTSRNSVLLQSNINNTRSDVAHLVRVLAEIAGEVDRGLTQGGANAKRAFEARVKSLMTDVPDLPNFSHFHQSFRGDAGAKTNEGDIRSGFYAAYDAAGCEFIRLADPEIDRRLKAGPDLVSASFVIPYPPGFPIMVPGQVITQETIDFMRKLDVKEIHGYDAKEGLKLVRAEALAKIGRPKPGAQPKLKAAS

SEQ ID NO: 1939 - DNA, 2517 bp, Bradyrhizobium japonicum
  CDS (1)..(2517)
atgatagtcggactcgcggaagctcctcctcacccgaattgctgcgcaatccgcctctccccgcaagcggggagaggcgaaacgccagccgcagctcctgtcatccaactgtcatcgaatgtgccgagagctgtgtctccagtacattcgggacagacaatggactatttcaagcgcttcaacttcctgttcgccgcacccgtgttcgacgccgacgacctcgaaggcgtccgcttcaaccagatcatcgaggaaatccagcgctccggcttcgaggtcgtccgggcccgcaagctggaggacgcggagatcgcggtgcagaccgacgccgcgatcggctgcatggtggtggactggggcaagaagggcctggagggcaagacctcggcgctgatcaatttgatgcggcgccgcggcctcgacttcccgatcatcctgctgatccggcgcaagcggttcgaggatctgccggtcgaggtgctcgacttcatcgacggctatgtcttcctctccgaggagacgccgaccttcatcgccaagaacctgatcagccggctcaagcaatatgccgagacgctgaagacgccgttcttcggcgcgctggtcgactatgccgaggaaggcaaccagctctggacctgtccgggccacaatggcggcgtgttctacaatcgcagcccgatcggccgggtgttcgtcgagcatctcggcgaatccgtgttccgcgacgacctcgacaattccgtgctcgacctcggcgacctccttacccatgagggcccggcgctgaaggcgcagaaggaggcagcggcgatcttcggcgcggagaagacctatttcgtgctcaacggcacctcgacctcgaacaaggtcgcgctcggcgcgctcgtcaccgacggcgatctcgtgctgttcgaccgcaacaaccacaaggccgctcatcacggcgcgctgatgatcaatggcggcatcccggtctacgtcccgaccattcgcaacgcctggggcctgatcggcccgatgcgctgggacgtgctcgacgagaaggcgctgcgcgaggcgatccgcaaccatccgctggttagggatcgcgacgcctggcgcaaggaacggccgttccgcgtcgccgtggtcgaacagtgcacctatgacggctcgatccacagcgccgagatgatcctgaagcgcatcggccatctctgcgaatacatcctgttcgacgaggcctgggccggcttcatgaaattccacccgctctatgccggccgcttcgccatgggcctcgcgaaccttcccccggaagcgcccggcatcatcgcgacgcagtcgacccacaagcaactcgcgagcttctcgcaggcctcgcaaatccacatcaaggaccgtcacatccgcggccagaagcggcgcgtcgagcatcgccgcttcaacgaaagcttcatgcagcacgcttccacgtcaccgttctatccgctgttcgcatccctcgacgtcggcgcgcagatgatgaaggggcgctccggcgaagtgctgtgggacgacacgatccggctcggcatcgagctgcgcaagaagatccgcgcaatgcggcgtgagttcgaggagaaggagcagaaccccgatcggcgctggttcttcgagcccttcgtcccggatcgcgtcgccatccccgacgtcagtcgccccggcgccgcccacaatgtcgcctgggagacgctgtccaccgacgagctcgccaccaatcccgccttgtggcaactctctccggataccaactggcacggctttcccgatctcgcggaaggctttgccatgaccgatccgaacaagctgacgctgctcacgcctggcttcgatcgcaccaccggcgcctatgccgagcacggcatccccgcccccgtcgtcgcgcaatatctgcgcgagaaccgcatcgtgcccgagaagaacgacctcaactccctgctcttcctgctcactcccggcgtcgaggcgagcaaggccggcacgctgatctccggcctcgtcgccttcaagaggctgcacgacgacaatgcgttgctggcggacgcaatcccggaattctaccagcggcggcaggcgcgctatgccggcgtgcggctgcgcgatctctgcggcgacatgcaccgtttcttccgcgccgccgatgtcagcgcgctccaggcgcggcagttcatgcccgagcacatgcctgagatcgcgatgtcgccccgcgatgccgcccgctatttgttccgcaacgacgtcgactatctgccgatcgaggcgatcgcgggccgcatcgccaccacgcccttcgtagtctatccgcccggcatcgccaccatcgtgcccggcgagcggctgacggaacgcgccaagcccatggtcgattatctcaagatgttcgagacctgcttcaacacgttcccgggcttcgacgtcgaaatccagggcgtctacaaggagatcgatgcccagggccgtatcgggctctatacttacgtcgttgccgagtag

SEQ ID NO: 1940 - protein, 838 aa, Bradyrhizobium japonicum
MIVGLAEAPPHPNCCAIRLSPQAGRGETPAAAPVIQLSSNVPRAVSPVHSGQTMDYFKRFNFLFAAPVFDADDLEGVRFNQIIEEIQRSGFEVVRARKLEDAEIAVQTDAAIGCMVVDWGKKGLEGKTSALINLMRRRGLDFPIILLIRRKRFEDLPVEVLDFIDGYVFLSEETPTFIAKNLISRLKQYAETLKTPFFGALVDYAEEGNQLWTCPGHNGGVFYNRSPIGRVFVEHLGESVFRDDLDNSVLDLGDLLTHEGPALKAQKEAAAIFGAEKTYFVLNGTSTSNKVALGALVTDGDLVLFDRNNHKAAHHGALMINGGIPVYVPTIRNAWGLIGPMRWDVLDEKALREAIRNHPLVRDRDAWRKERPFRVAVVEQCTYDGSIHSAEMILKRIGHLCEYILFDEAWAGFMKFHPLYAGRFAMGLANLPPEAPGIIATQSTHKQLASFSQASQIHIKDRHIRGQKRRVEHRRFNESFMQHASTSPFYPLFASLDVGAQMMKGRSGEVLWDDTIRLGIELRKKIRAMRREFEEKEQNPDRRWFFEPFVPDRVAIPDVSRPGAAHNVAWETLSTDELATNPALWQLSPDTNWHGFPDLAEGFAMTDPNKLTLLTPGFDRTTGAYAEHGIPAPVVAQYLRENRIVPEKNDLNSLLFLLTPGVEASKAGTLISGLVAFKRLHDDNALLADAIPEFYQRRQARYAGVRLRDLCGDMHRFFRAADVSALQARQFMPEHMPEIAMSPRDAARYLFRNDVDYLPIEAIAGRIATTPFVVYPPGIATIVPGERLTERAKPMVDYLKMFETCFNTFPGFDVEIQGVYKEIDAQGRIGLYTYVVAE

SEQ ID NO: 1941 - DNA, 2181 bp, Vibrio vulnificus
  CDS (1)..(2181)
atgaagcgtttagttattggtgttagtaattacatgccagaagatttcagtttattagctgaatctttagatgaacaatttaatcgtcatcttcatcctttagagcaagtcgaattaaccgatgttggtgctgccattattacgtcggcagatattaaggctggtctacacaaagtgatttctgaaacgggttatggcattccggttttcttggtcacagatgaaaacccagtgtcagccgaagattacgtatggttaaccggcgttatcgatttagaaagacaatccatcgaatactactgtcgccaaatcaatgaagcggtaaccaaatacgaatgccgcctattgccgcctttcttcaaacaactgacgcactacgtggaaatgggcaactctgcattcgactgtccaggacaccaaggcggtcagttcttcaaaaaacacccagcaggtaaacagttctacgatttcttcggtgaaaacctattccgtagtgacttgtgtaacgcggacgtagatttaggtgacttgttaatccacgaaggctctgcccaccaagctcaagcgcacgcagcaaaagtgttcaactcagacaaaacttacttcgtactcaacggcacttcggcttcaaacaaagtggtgtgtaacgcgttagtgaccgagggggacttggtgatgtttgaccgtaacaaccacaaatcaaaccaccacggcgcattaatccaagcgggcggtatgccagtttacctagaaacggcgcgtaacccttggggctttattggtggtatggatgagcactgttttgatgaagaatacatccgtgcccaaatcgccaaagtatcacccgaacgtgcgcgtgatgaacgtccattccgtcttgcgatcatccaattgggcacttacgacggtaccatctacaacgcacgctacgtgatggataagattggtcatctgtgtgactacatcctatttgactcagcatgggtgggttacgagcagttcattccgatgatgaaagactgttctccattgctactggatctgaaaccagaagatgcgggtgtgatcgtgactcagtctgttcacaagcaacaagctggcttttctcaaacctcgcaaatccacaaaaaagaccaccacatcaaaggtcaggctcgctactgcaaccacaaacgcttcaacaacgcgtttatgatgcacgcgtcaacttcaccattctatgcgctgttctccgcattggatgtgaacgccaagatccacgatggtgaagcgggtctgcgtctatggcgtgatgcggttaagacaggtatcgaagcgcgtaaagaaatccttaagagttgtgaattgattcgtccgttcattccagaccaagtcgaaggtcaaccttggggcagctacgacactgacgtgatcgcaacgaataagaaattcttcatgtttgagccaaacgcaagctggcacaaatttgaaggttacggtgaaggtcaatacttcgttgacccatgtaaattgttgctaactactgcgggtattgcagaagacggcagctacgcagactttggtattcctgccacgctattggcgaacttcctacgtgagaacggcatcatccctgagaagtgtgacttgaactctatcttgttccttctcactccagcagaggacatgggtaagatccgtcatcttgtggcgcaaattaaccgcttcgaaaaattcattcgtgatgatgcgccgctaaacatcgtgctgcctcgcgtttacgaagcgaataaagagcgctaccgcggctacaccatccgtcagctatgtcaggaaatgcatgacatgtacaaagagctgaacgtgaaacagctacaaaaagcgatgttccgtagcgaatacttcccaactatggtgcacaaaccagatgtggcgacacgcaaatacttccgtggcgagtgtgattacttgcctctgaaagaagcggtaggtcgtgtcgcagcagaaggtgcgcttccttaccctccaggcattatctgtgtgatcacaggcgaaatctggactcaacaagtggtcgattacttcttatctctagaagaaggcatcaaccgattcccaggcttcgcacccgagattcaaggtgtgtacctagaagacgtcaatggccgcaccaccgcccattgctacgcccttaaagattaa

SEQ ID NO: 1942 - protein, 726 aa, Vibrio vulnificus
MKRLVIGVSNYMPEDFSLLAESLDEQFNRHLHPLEQVELTDVGAAIITSADIKAGLHKVISETGYGIPVFLVTDENPVSAEDYVWLTGVIDLERQSIEYYCRQINEAVTKYECRLLPPFFKQLTHYVEMGNSAFDCPGHQGGQFFKKHPAGKQFYDFFGENLFRSDLCNADVDLGDLLIHEGSAHQAQAHAAKVFNSDKTYFVLNGTSASNKVVCNALVTEGDLVMFDRNNHKSNHHGALIQAGGMPVYLETARNPWGFIGGMDEHCFDEEYIRAQIAKVSPERARDERPFRLAIIQLGTYDGTIYNARYVMDKIGHLCDYILFDSAWVGYEQFIPMMKDCSPLLLDLKPEDAGVIVTQSVHKQQAGFSQTSQIHKKDHHIKGQARYCNHKRFNNAFMMHASTSPFYALFSALDVNAKIHDGEAGLRLWRDAVKTGIEARKEILKSCELIRPFIPDQVEGQPWGSYDTDVIATNKKFFMFEPNASWHKFEGYGEGQYFVDPCKLLLTTAGIAEDGSYADFGIPATLLANFLRENGIIPEKCDLNSILFLLTPAEDMGKIRHLVAQINRFEKFIRDDAPLNIVLPRVYEANKERYRGYTIRQLCQEMHDMYKELNVKQLQKAMFRSEYFPTMVHKPDVATRKYFRGECDYLPLKEAVGRVAAEGALPYPPGIICVITGEIWTQQVVDYFLSLEEGINRFPGFAPEIQGVYLEDVNGRTTAHCYALKD

SEQ ID NO: 1943 - DNA, 2109 bp, Vibrio vulnificus
  CDS (1)..(2109)
atgggtgtgttctttaaagaagagccagttcgccaattgcatgcagcacttgaaaaagccggttatgaagttgtttatccagtggatgacaaagatttgatcaagatgatcgaaatgaacccgcgcatttgtggtgtgctgtttgactgggataaatactcgcttgagctttgtgagcgtattagccaaatcaacgaaaaactgccagtacacgcgtttgctaacgagcaatcaacgctggatatttcgcttaccgatctacgcctaaacgtgcatttctttgaatacgcattgggcatggcggacgacatcgccatcaagatcaaccaagcgacacaagaatacaaagacgcgattacaccgccattcaccaaagcgctgtttaaatacgtggaagaaggcaaatacaccttctgtactccaggtcacatgggtggtacggcttttcaaaaaagtccagtcggcagcattttctacgatttctacggtccaaatactttcaaagcggacgtgtcgatttctatgccagagctaggctcactgcttgaccattcaggtccacacaaagaagcggaagagtacattgcgcgtacgttcaacgctgacgcatcgtacatcgtgacgaacggtacttcgacgtcaaacaaaattgtcggcatgttctctgcgccagcgggcagcacggtattggttgaccgtaactgtcataaatcattgactcacctaatgatgatgacggacgtaacacctatttacttccgcccaacccgtaacgcttacggcattcttggtggtattccacaaagtgaattcagccgtgaagtgatcgcagaaaaagtggctaaaacaccaggtgcgagcgcgccaagctacgcggtgattaccaactcaacttacgatggtttgttgtacaacacacaattcatcaaagagtctctcgactgtaaacacatccactttgatagtgcgtgggtgccttacactaacttcaaccgtatttacgaaggcaaatgcggcatgagtggcgaagcgatgccaggcaaagtgttctacgaaacacaatccactcacaaactgttggcggcgttctcgcaagcgtcaatgattcacgtaaaaggtgaatttgaccgtgagtcgttcaacgaagcctttatgatgcacacttccacctcgcctcaatacggcattgtggcatcaacagaaaccgcggcggcaatgatgcgtggtaacacgggccgtaagttgatgcaagattcaatcgaccgtgcgattcgtttccgtaaagagatcaaacgcttaaaaggtgaaagtgacggttggttctttgatgtttggcaaccagagaacattgagacaaccgaatgctggaaacttgaccctaaccaagactggcatggcttcaagaacatggacgatgaccacatgtatcttgacccaatcaaaatcactttgctgactcctggaatgagcaaagatggtgagttggaaaccagtggtattcctgcttcattggtggcgaaatatcttgatgaacgtggcattgtggtagaaaaaacaggcccttacaacttgttgttcttgttctcaattggtatcgacaaatcaaaagcgatgcaattgctacgtggtttgactgagttcaaacgtggttacgatctgaacctaacgattcgcaccatgctgcctgcgctgtaccgtgaagatccagcgttctacgaaggcatgcgtattcaagagctggcacaaggcattcacgatctgactcgtaagtaccgtctaccagaattgatgtacaaagcgttcgatgtgctaccagagatgaaagtcacgccacacgcagcttggcaacaagagcttcgtggtcaaaccgaagagatcttgctgaatgatatggtgggccgcgtgagtgccaacatgatccttccttaccctccaggtgtgcctctagtgctaccaggtgaagtggtgacagaaagctctcgtccagtactggatttcttggaaatgttgtgtgaaatcggcgcacattacccaggcttcgagaccgacatccacggcctataccgccaaaaagatggccgttacaccgtaaaagtactgaaagactga

SEQ ID NO: 1944 - protein, 702 aa, Vibrio vulnificus
MGVFFKEEPVRQLHAALEKAGYEVVYPVDDKDLIKMIEMNPRICGVLFDWDKYSLELCERISQINEKLPVHAFANEQSTLDISLTDLRLNVHFFEYALGMADDIAIKINQATQEYKDAITPPFTKALFKYVEEGKYTFCTPGHMGGTAFQKSPVGSIFYDFYGPNTFKADVSISMPELGSLLDHSGPHKEAEEYIARTFNADASYIVTNGTSTSNKIVGMFSAPAGSTVLVDRNCHKSLTHLMMMTDVTPIYFRPTRNAYGILGGIPQSEFSREVIAEKVAKTPGASAPSYAVITNSTYDGLLYNTQFIKESLDCKHIHFDSAWVPYTNFNRIYEGKCGMSGEAMPGKVFYETQSTHKLLAAFSQASMIHVKGEFDRESFNEAFMMHTSTSPQYGIVASTETAAAMMRGNTGRKLMQDSIDRAIRFRKEIKRLKGESDGWFFDVWQPENIETTECWKLDPNQDWHGFKNMDDDHMYLDPIKITLLTPGMSKDGELETSGIPASLVAKYLDERGIVVEKTGPYNLLFLFSIGIDKSKAMQLLRGLTEFKRGYDLNLTIRTMLPALYREDPAFYEGMRIQELAQGIHDLTRKYRLPELMYKAFDVLPEMKVTPHAAWQQELRGQTEEILLNDMVGRVSANMILPYPPGVPLVLPGEVVTESSRPVLDFLEMLCEIGAHYPGFETDIHGLYRQKDGRYTVKVLKD

SEQ ID NO: 1945 - DNA, 2163 bp, Shewanella oneidensis
  CDS (1)..(2163)
atgaaatcattaaaagttgccgcaagcttatctgttagatcttgttttgatatagacagagaagttgtcaatgtattaaccactgatttttgcgatgtgggtgcggctgtagtctctgttgatgatgttaaagatggtattgttgaaaaaattaaaaataccggattaaaactgcctattttcgtatcagtttgctgcgaagaaaccttcccagatgatatttgttcctcgattaccggggtatttgaactctgcggtagcaataccgatttctatggtaagcaggtcgaaaccgctatcaagaaatatgagcaagctctattaccgcccttctttggcactctgaaaaaatacgtcgaaatgggtaactccacctttgcctgcccaggccatcagggcggacaattctttcgtaaacatcccgtaggtcgccaatttttcgatttctttggcgaaaccattttccgctccgacatgtgtaatgctgacgtaaaactcggtgatctgttaatccacgaaggtgcaccactggatgcacaaaaatatgcggcaaaagtctttaacgccgataaaacctactttgtgcttaacggcacttcctcctcgaataaagtcgccaccaatgcgctgcttgctaaaggtgatttagtattattcgaccgtaataaccacaaatccaaccaccatggtgcgttaattcaagccggcgcaacaccgatttacttagaaaccgcccgtaaccccttcggctttattggcggtatcgacgcccactgcttcaaagaagcttatttaagggaacaaattcgcgaagttgcaccagaacgtgccgatgaaaaacgcccgttccgtttagcgattatccaactcggcacctacgacggcaccatctacaatgctcgccaagtggttgatcgtattggtcatctatgtgattacatcctgtttgactcggcttgggttggctatgaacagtttattcctatgatgaatgactgctcgccactgctgctggaactgacgcctgaagatcccggtattatcgtgactcaatcagtacataaacagcaggcaggtttctcacaaacgtcgcaaatccataaaaaagataaacatatcaaaggccaagcgagatattgcaaccataaacgtttcaacaatgcctttatgatgcacgcctccaccagccacttctatccactgtttgccgcattagatgtgaacgctaagatgcacgaaggtgccagcggccgttatctgtggcgtgaagccgtcaaagccgggattgaagcccgtaagttactgcttaaaaaatgtaagtatatcaagccatttatccccagcatgatcgatggccgccaatggcaggattacccaaccgagcaaatggccgatgatttgcgcttctttgaatttgaaccaggacaaaaatggcactcattcgagggctatgaaaaaggccaatatttcgttgacccttgtaagttcctattaaccacaccaggtattgatgccgaaaccggtaaatatactgagtttggtattccagcgactattttggctaacttcttacgtgaaaataatattattcccgagaagtgcgacttaaattcgatattattcctaatgacacctgcggaagatatggcaaaaatgcagcacttagtgtcgcaaatatcccgcttcgagaaattagtcgatgaagatgcgccattatcggaagtattgccaaacgtctataacgccaataaagcccgttataaagactacaccattcgccaactctgccaagaaatgcacaacctttatgtcagccatgacgtaaaacaactgcaaaaagaaatgttccgccatgctcacttcccaaccaaggtgatggacccgcaggaagccaatcttgaatttattcgtggcaatgtcgaattagtgccactgtcgcaaatcgaaggtcgaattgccgcagaaggcgccctgccatatccaccaggggtgttatgtatggtgccaggtgaaatatggggtggcgcagtacaacgttatttcttagctctcgaagaaggcatcaacttattacccggattctcccctgaattacaaggtgtttatctcgaaagcacccctgacggaaaaatccaagccttaggttatgtgttaaataaataa

SEQ ID NO: 1946 - protein, 720 aa, Shewanella oneidensis
MKSLKVAASLSVRSCFDIDREVVNVLTTDFCDVGAAVVSVDDVKDGIVEKIKNTGLKLPIFVSVCCEETFPDDICSSITGVFELCGSNTDFYGKQVETAIKKYEQALLPPFFGTLKKYVEMGNSTFACPGHQGGQFFRKHPVGRQFFDFFGETIFRSDMCNADVKLGDLLIHEGAPLDAQKYAAKVFNADKTYFVLNGTSSSNKVATNALLAKGDLVLFDRNNHKSNHHGALIQAGATPIYLETARNPFGFIGGIDAHCFKEAYLREQIREVAPERADEKRPFRLAIIQLGTYDGTIYNARQVVDRIGHLCDYILFDSAWVGYEQFIPMMNDCSPLLLELTPEDPGIIVTQSVHKQQAGFSQTSQIHKKDKHIKGQARYCNHKRFNNAFMMHASTSHFYPLFAALDVNAKMHEGASGRYLWREAVKAGIEARKLLLKKCKYIKPFIPSMIDGRQWQDYPTEQMADDLRFFEFEPGQKWHSFEGYEKGQYFVDPCKFLLTTPGIDAETGKYTEFGIPATILANFLRENNIIPEKCDLNSILFLMTPAEDMAKMQHLVSQISRFEKLVDEDAPLSEVLPNVYNANKARYKDYTIRQLCQEMHNLYVSHDVKQLQKEMFRHAHFPTKVMDPQEANLEFIRGNVELVPLSQIEGRIAAEGALPYPPGVLCMVPGEIWGGAVQRYFLALEEGINLLPGFSPELQGVYLESTPDGKIQALGYVLNK

SEQ ID NO: 1947 - DNA, 1419 bp, Oceanobacillus iheyensis
  CDS (1)..(1419)
atgaagttggatcaatcttatatgccattcgtagatcatttaagaaatttcagttcaaagagaccggtatcattccatgttccagggcataagcatggggcggtttttcctgaagcagctagagaattatttggctctattttatctgtagatgtaactgaaatagcaggaatggatgacttgcatgcaccaagtgagatcatcgcagaagcagaaaaactagcaacagattatttcaattctgaccatacattttttttagttggaggatctacatcaggtaatctagcaatgattatggcagcatgtaatccgggagatgaggtaatcgtccaacggaattgtcataaatcaattatgaatggcttagaacttgcaggtgcaaagccaatatttatagctccagagtggagagatgatttacaacgatataccgcaccaacatatgatagcataaaacaagcaatgttgaggtttccgaatgcaaaggctcttattctcacctatccagattactttggggcggtttttgatattcagtccatgattgaattagcacacacctatcatattccagtatttgttgatgaagcacatggcgtccatttttcatcatctgaaatgtttccacaatcggctttacagttaggagcagatgttgtagtacaatccgcacataaaatggctccagctatgacaatggctgcatatttacatattggcacttcacgtgtagaaaaacatcgacttgcttattatttgcaaatgttacagtcgagtagtccatcttatccgataatggcttctttggatgtagcaagattttatttagcgcaattatcaaaagaaaaaatccgaggtatcttaaatagtgtagaaaacgtaagaaacatattctccggggcatcattttgggaattggtacctcatgatgatccgttaaaattaacgttccacgtgaaacatggctataaaataagtgagatagaatcgatgctcgaatatcatggaatttatccagagttaacgacagaaaatcaattcttattcatacatggtttagcgccttttgtagaacaagattatttgaaaaaaacaatacaattgatagaggaagaattaaaaaaatcagtgaaacatgctacaatagaaggggcaaagctttttaccaatcctatagaggaactagcattgtcataccaagaaatgaaacacattacatcacttcttgtcccatttgctcaaagtgaaggtgaaattgcagcagaggcagtgatcccatatccccctggtattccagtcatactcaaaggcgagagaattacgaaggcgcatattacaaagattcagcttttgattcaacaaggagtaaccattcagcaacgggaagaaggaatacgtatatataggaaggcatga

SEQ ID NO: 1948 - protein, 472 aa, Oceanobacillus iheyensis
MKLDQSYMPFVDHLRNFSSKRPVSFHVPGHKHGAVFPEAARELFGSILSVDVTEIAGMDDLHAPSEIIAEAEKLATDYFNSDHTFFLVGGSTSGNLAMIMAACNPGDEVIVQRNCHKSIMNGLELAGAKPIFIAPEWRDDLQRYTAPTYDSIKQAMLRFPNAKALILTYPDYFGAVFDIQSMIELAHTYHIPVFVDEAHGVHFSSSEMFPQSALQLGADVVVQSAHKMAPAMTMAAYLHIGTSRVEKHRLAYYLQMLQSSSPSYPIMASLDVARFYLAQLSKEKIRGILNSVENVRNIFSGASFWELVPHDDPLKLTFHVKHGYKISEIESMLEYHGIYPELTTENQFLFIHGLAPFVEQDYLKKTIQLIEEELKKSVKHATIEGAKLFTNPIEELALSYQEMKHITSLLVPFAQSEGEIAAEAVIPYPPGIPVILKGERITKAHITKIQLLIQQGVTIQQREEGIRIYRKA

SEQ ID NO: 1949 - DNA, 2154 bp, Escherichia coli O6
  CDS (1)..(2154)
atgactatgaacgttattgcaatattgaatcacatgggggtttattttaaagaagaacccatccgtgaacttcatcgcgcgcttgaacgtctgaacttccagattgtttacccgaacgaccgtgacgacttattaaaactgatcgaaaacaatgcgcgtctgtgcggcgttatttttgactgggataaatataatctcgagctgtgcgaagaaattagcaaaatgaacgagaacctgccgttgtacgcgttcgctaatacgtattccactctcgatgtaagcctgaatgacctgcgtttacagattagcttctttgaatatgcgctgggtgctgctgatgatattgctaacaagatcaagcagaccactgacgaatatatcaacactattctgcctccgctgaccaaagcactgtttaaatatgttcgtgaaggtaaatatactttctgtactcctggtcacatgggtggtactgcattccagaaaagcccggtaggtagcctgttctatgatttctttggtccgaacaccatgaaatctgatatttccatttcagtatctgaattgggttctctgctggatcacagtggtccacacaaagaagcagaacagtatatcgctcgcgtctttaacgcagaccgcagctacatggtgaccaacggtacttccactgcgaacaaaattgttggtatgtactctgctccggcaggcagcaccattctgattgaccgtaactgccacaaatcgctgacccacctgatgatgatgagcgatgttacgccaatctatttccgcccgacccgtaacgcttacggtattcttggtggtatcccacagagtgaattccagcacgctaccattgctaagcgcgtgaaagaaacaccaaacgcaacctggccggtacatgctgtaattaccaactctacctatgatggtctgctgtacaacaccgacttcatcaagaaaacactggatgtgaaatccatccactttgactccgcgtgggtgccttacaccaacttctcaccgatttacgaaggtaaatgcggtatgagcggtggccgtgtagaagggaaagtgatttacgaaacccagtctactcacaaactgctggcggcgttctctcaggcttccatgatccacgttaaaggtgacgtaaacgaagaaacctttaacgaagcctacatgatgcacaccaccacctctccgcactacggtatcgtggcgtccactgaaaccgctgcggcgatgatgaaaggcaatgcaggtaaacgtctgatcaatggttccattgaacgtgcgatcaaattccgtaaagagatcaaacgtctgagaacggaatctgatggctggttctttgatgtatggcagccggatcatatcgatacgactgaatgctggccgctgcgttctgacagcacatggcacggcttcaaaaacatcgataacgagcacatgtatcttgacccgatcaaagtcaccctgctgactccggggatggaaaaagacggcaccatgagcgactttggtattccggccagcatcgtggcgaaatacctcgacgaacatggcatcgttgttgagaaaaccggtccgtataacctgctgttcctgttcagcatcggtatcgataagaccaaagcactgagcctgctgcgtgctctgactgacttcaaacgtgcgttcgacctgaacctgcgtgtgaaaaacatgctgccgtctctgtatcgtgaagatcctgaattctatgaaaacatgcgtattcaggaactggctcagaatatccacaaactgattgttcaccacaatctgccggatctgatgtatcgcgcatttgaagttctgccgactatggtaatgactccgtatgctgcgttccagaaagagctgcacggtatgaccgaagaagtttacctcgacgaaatggtcggtcgtattaacgccaatatgatccttccgtatccgccgggagttcctctggtaatgccgggtgaaatgatcaccgaagaaagccgtccggttctggagttcctgcagatgctgtgtgaaatcggcgctcactatccgggctttgaaaccgatattcacggtgcataccgtcaggctgatggccgctataccgttaaagtattgaaagaagaaagcaaaaaataa

SEQ ID NO: 1950 - protein, 717 aa, Escherichia coli O6
MTMNVIAILNHMGVYFKEEPIRELHRALERLNFQIVYPNDRDDLLKLIENNARLCGVIFDWDKYNLELCEEISKMNENLPLYAFANTYSTLDVSLNDLRLQISFFEYALGAADDIANKIKQTTDEYINTILPPLTKALFKYVREGKYTFCTPGHMGGTAFQKSPVGSLFYDFFGPNTMKSDISISVSELGSLLDHSGPHKEAEQYIARVFNADRSYMVTNGTSTANKIVGMYSAPAGSTILIDRNCHKSLTHLMMMSDVTPIYFRPTRNAYGILGGIPQSEFQHATIAKRVKETPNATWPVHAVITNSTYDGLLYNTDFIKKTLDVKSIHFDSAWVPYTNFSPIYEGKCGMSGGRVEGKVIYETQSTHKLLAAFSQASMIHVKGDVNEETFNEAYMMHTTTSPHYGIVASTETAAAMMKGNAGKRLINGSIERAIKFRKEIKRLRTESDGWFFDVWQPDHIDTTECWPLRSDSTWHGFKNIDNEHMYLDPIKVTLLTPGMEKDGTMSDFGIPASIVAKYLDEHGIVVEKTGPYNLLFLFSIGIDKTKALSLLRALTDFKRAFDLNLRVKNMLPSLYREDPEFYENMRIQELAQNIHKLIVHHNLPDLMYRAFEVLPTMVMTPYAAFQKELHGMTEEVYLDEMVGRINANMILPYPPGVPLVMPGEMITEESRPVLEFLQMLCEIGAHYPGFETDIHGAYRQADGRYTVKVLKEESKK

SEQ ID NO: 1951 - DNA, 2271 bp, Escherichia coli O6
  CDS (1)..(2271)
atgatgaaagtattaattgttgaaagcgagtttctccatcaagacacctgggtcggtaacgccgttgagcgtctggcagatgctttaagccagcaaaatgttaccgtgattaaatccacctcctttgatgatggttttgccattctctcttcaaacgaagccattgactgcctgatgttcagctatcaaatggaacatccggacgaacatcaaaacgtcagacaattgatcggtaagcttcatgagcgccaacaaaacgtgccggtcttcctgttgggcgatcgggaaaaagccctcgccgcaatggaccgggatctgctggagcttgtcgatgaattcgcctggattctggaagatactgccgactttatcgccggacgcgccgttgccgcgatgacccgctaccgccagcagctgttgccgccactgttcagcgcgctgatgaaatatagcgacatccatgaatattcctgggcagcgccaggccaccagggcggcgttggttttactaaaacacccgccggacgtttctaccatgactactatggtgaaaatctgttccgcaccgacatgggcatcgaacgcacttccctcggttctttgcttgaccatactggcgcatttggcgaaagcgaaaaatatgccgcacgcgtatttggtgccgatcgctcctggtcggtagtcgtcggtacttccggctctaaccgcaccatcatgcaggcttgcatgaccgataacgatgtcgtggtcgttgaccgtaactgccataaatccatcgaacaaggcttgatgctgacaggcgcgaaaccggtctacatggtgccaagccgcaaccgctacggcattatcgggccaatctatccgcaggaaatgcaacctgaaaccttgcagaagaaaatcagtgaaagcccgctgaccaaagacaaagtcgggcaaaaaccgtcttactgcgtggtgaccaactgtacctatgacggcgtgtgttataacgctaaagaagcgcaggatctgctggaaaaaacctccgatcgtctgcactttgacgaagcctggtacggctatgcacgtttcaacccgatctatgccgatcactatgccatgcgcggcgaacctggcgatcacaacggtcctaccgttttcgccacccactccacccacaaactgctgaatgcgctgtcccaggcctcttatattcatgtacgtgaaggtcgtggggcgattaacttctcccgcttcaaccaggcctacatgatgcatgccaccacctccccgctgtatgccatctgcgcatccaacgacgtggcagtgtcgatgatggacggcaacagcggcctgtcactgacccaggaagtgatcgacgaagcggttgatttccgtcaggcgatggcgcggctgtataaagagttcaccgctgacggtagctggttcttcaaaccgtggaacaaagaagtcgtcaccgacccacaaaccggcaaaacctatgactttgctgacgcaccaaccaaactgctgaccaccgttcaggactgctgggtcatgcatccgggcgaaagctggcacggcttcaaagatattccggataactggagtatgctcgacccgattaaagtcagcatccttgctccgggaatgggtgaagatggtgaactggaagaaatcggtgttccggcggcgctggtcacagcctggcttggtcgccacggcattgtgcctacccgtaccactgacttccagattatgttcctgttctctatgggcgtgacccgtgggaaatgggggactctggttaacaccctttgctccttcaaacgccactatgatgccaacacaccgctggcgcaggtgatgccggaacttgttgaacaatatcctgacacttacgcgaacatggggattcacgatctgggtgacaccatgtttgcctggctgaaagaaaacaaccctggcgcacggttgaatgaagcctattctggcctaccggtggcggaaatcaccccgcgtgaagcgtacaacgcgattgtcgacaacaatgtcgaactggtatccattgaaaatctgccaggacgtatcgcggcaaactcagttatcccgtatccgccaggaatcccgatgctgctgtctggtgaaaacttcggcgataaaaacagtccgcaagtaagttatttacgctcactgcaatcctgggaccatcatttccctggatttgaacacgaaacagaagggacagaaattattgacggtatttaccacgttatgtgtgtgaaagcgtaa

SEQ ID NO: 1952 - protein, 756 aa, Escherichia coli O6
MMKVLIVESEFLHQDTWVGNAVERLADALSQQNVTVIKSTSFDDGFAILSSNEAIDCLMFSYQMEHPDEHQNVRQLIGKLHERQQNVPVFLLGDREKALAAMDRDLLELVDEFAWILEDTADFIAGRAVAAMTRYRQQLLPPLFSALMKYSDIHEYSWAAPGHQGGVGFTKTPAGRFYHDYYGENLFRTDMGIERTSLGSLLDHTGAFGESEKYAARVFGADRSWSVVVGTSGSNRTIMQACMTDNDVVVVDRNCHKSIEQGLMLTGAKPVYMVPSRNRYGIIGPIYPQEMQPETLQKKISESPLTKDKVGQKPSYCVVTNCTYDGVCYNAKEAQDLLEKTSDRLHFDEAWYGYARFNPIYADHYAMRGEPGDHNGPTVFATHSTHKLLNALSQASYIHVREGRGAINFSRFNQAYMMHATTSPLYAICASNDVAVSMMDGNSGLSLTQEVIDEAVDFRQAMARLYKEFTADGSWFFKPWNKEVVTDPQTGKTYDFADAPTKLLTTVQDCWVMHPGESWHGFKDIPDNWSMLDPIKVSILAPGMGEDGELEEIGVPAALVTAWLGRHGIVPTRTTDFQIMFLFSMGVTRGKWGTLVNTLCSFKRHYDANTPLAQVMPELVEQYPDTYANMGIHDLGDTMFAWLKENNPGARLNEAYSGLPVAEITPREAYNAIVDNNVELVSIENLPGRIAANSVIPYPPGIPMLLSGENFGDKNSPQVSYLRSLQSWDHHFPGFEHETEGTEIIDGIYHVMCVKA

SEQ ID NO: 1953 - DNA, 2370 bp, Escherichia coli O6
  CDS (1)..(2370)
atgaaatttaaccacaatcttttatttatttcctcacaatatcttgatggcgacaacccttcgcagcaggtactggaagagcttcaaaccgaactcgcggaacgcggttttaaaattcatatcacgcaccagatctctgatggattaaaaatcatcgaaaaaagcccccaatacagcgggattggtttttactgggagccagacaatccgacctttgcagaagagctacagcactttatcagcatattccgcaaaagaaatgccacgacgccgctgataattttctcagaacagaatattaccgatcgtatcccactcgacgtcttaaaagaggtcagcgaatatgtttatctgttctctgaatccgcagccttcactgccaatcgactgtactccttagtccaccgctatgcggataagcttcttcctccctactttaaaacccttaaggactttaccgaggacggtgactattactgggactgcccggggcatatggggggaatggcctatctgaaacatcctgttggcattgagttcattaacttctttggcgaaaacatgatgcgcgctgatattggcgtggctaccgcggagatgggggattatctgatccacgccggaccgcctaaaaaatcggaagaaattgcggcccgactgtttggctctgattggaccttctacggtgtttccggctcatcggggtcgaaccgtattgtggcccaggctgcggttggcgcagatgaaattgccattattgaccgaaattgccacaagtcacttaatcatggcctgaccttgtctcaggcaaggccggtttacctgaaacctacccgcaacgcgtgggggctgattgggcctatcccgaccggacgcctgaagaaggccagtattgatgcgctggtggcaaacagccgactggcatctggtgcggtcagccagtccccgtcctacgccgtggtaaccaactgcacctatgatggcttctgttataacgtgaacgatgtagtcagacacctgggtgaaagcgcaccgcgcatccattttgatgaagcatggtatgcctatgcgcgtttccatccgctataccagagtcgctatgcaatggacgcggaggaaacgccaaatcgtccaaccctattcgccgtacagtccacccataaaatgctgccctcactctccatggcctcaatgattcatgtgaagaaaagcgatcgcgcgccgcttaatttcgatgactttaacgatgcctttatgatgcacggcacgacctcaccctactacccgatcattgcatcaattgatgtggcagtaagcatgatggagggtgaatccggttattcgcttgtgcaggagtcaattgaagaagcgattgccttccgtaaagccgtggtcagcgtcaagcgccagctccaggagcaggaaggtggtgacgcctggttcttcgatgtgcttcagccaaccgaagtgcaggacagcgattctgggcagcgatacagttttgaagaggcacccgtatcgctgctgagccacagcgccgactgctggtcgctgcgctccggtgagcgctggcacggttttgccgatgatgatctggtcgaaaccaacagtatgctcgatccagtaaaagtgaccctgacttgtccagggatcggcccgaagggagaataccagaaaaacggtattccgggatatttgctgacccgttttctcgatgaccgtcgcattgaaattgcccgtactggtgactacaccgtgctgatcctgttctccgtcggcatcaccaaaggcaaatggggaactctgattgaaagcctgctggcctttaaaaagcattacgacaatgacgatctggccacagatgctatcccgtcgctgaaagcgcattctccacactacgacacgctaaccctcaaggagctatgtcagataatgcatgaaaaaatggatgagctggagctgatgtcgcatatcaacgacgcggtaaacaccgatccggaaccagttatgaccccggcagaagcctatcagaaagtcgtacgctacaaaaccgagcatatccggctggatgattttagcggcagaattgccgccagcatgctcgtcccatatcccccaggcattcctgtactgatgccgggcgaacggatgccgcaaggtaacaagggcattattggctatctgcgcgccctgcaggaattcgataagcaattcccaggttttgaacatgagatccagggcgttaacgtcgatgaaaacggggacttctgggtcagagcgattgtggaagaagaacgcgatgggcagtcgctacccggccacataacctttaaacgccaggtctctggtattaaaaagggccgccagtag

SEQ ID NO: 1954 - protein, 789 aa, Escherichia coli O6
MKFNHNLLFISSQYLDGDNPSQQVLEELQTELAERGFKIHITHQISDGLKIIEKSPQYSGIGFYWEPDNPTFAEELQHFISIFRKRNATTPLIIFSEQNITDRIPLDVLKEVSEYVYLFSESAAFTANRLYSLVHRYADKLLPPYFKTLKDFTEDGDYYWDCPGHMGGMAYLKHPVGIEFINFFGENMMRADIGVATAEMGDYLIHAGPPKKSEEIAARLFGSDWTFYGVSGSSGSNRIVAQAAVGADEIAIIDRNCHKSLNHGLTLSQARPVYLKPTRNAWGLIGPIPTGRLKKASIDALVANSRLASGAVSQSPSYAVVTNCTYDGFCYNVNDVVRHLGESAPRIHFDEAWYAYARFHPLYQSRYAMDAEETPNRPTLFAVQSTHKMLPSLSMASMIHVKKSDRAPLNFDDFNDAFMMHGTTSPYYPIIASIDVAVSMMEGESGYSLVQESIEEAIAFRKAVVSVKRQLQEQEGGDAWFFDVLQPTEVQDSDSGQRYSFEEAPVSLLSHSADCWSLRSGERWHGFADDDLVETNSMLDPVKVTLTCPGIGPKGEYQKNGIPGYLLTRFLDDRRIEIARTGDYTVLILFSVGITKGKWGTLIESLLAFKKHYDNDDLATDAIPSLKAHSPHYDTLTLKELCQIMHEKMDELELMSHINDAVNTDPEPVMTPAEAYQKVVRYKTEHIRLDDFSGRIAASMLVPYPPGIPVLMPGERMPQGNKGIIGYLRALQEFDKQFPGFEHEIQGVNVDENGDFWVRAIVEEERDGQSLPGHITFKRQVSGIKKGRQ

SEQ ID NO: 1955 - DNA, 2136 bp, Escherichia coli O6
  CDS (1)..(2136)
atgaaatcaatgaatattgccgccagtagtgaactggtatcccgactttctactcatcgccgcgtggtggcgttgggagatactgattttacggacgtcgcggcagtcgtcattaccgctgcggatagtcgcagtggcattcttgcattgcttaagcgcaccggttttcatctaccggtgtttttgtattccgaacatgctgttgaattacctgcgggcgttacggcggtaatcaacggcaacgagcagcagtggctggagctggaatccgcagcctgtcagtatgaagagaatttgctgccaccgttttatgacacgctgacgcagtacgttgagatgggtaatagcacctttgcttgccctggacatcaacatggtgcgttctttaaaaagcatcctgccggacgccatttttacgatttctttggcgagaacatctttcgcgccgatatgtgtaacgctgacgtaaaattgggcgatctgcttattcatgaaggatcggcgaaagatgcgcagaaatttgcagccaaagtctttcatgccgataaaacctattttgtgctgaacggcacatcggcagcgaataaagtggtgacgaatgcgctgttaacgcgtggcgatctggtgctcttcgaccgtaacaaccataagtcgaatcatcatggcgcgttgattcaggcgggggcgacaccggtctatctggaagcttcacgtaacccgtttggtttcattggcggtattgatgcgcactgttttaatgaagagtatctgcgccagcaaattcgcgacgttgcgccagaaaaagccgacctgccgcgcccgtttcgcctggcgattattcagctgggaacctatgacggcactgtctataacgcccgtcaggtgatcgataccgttgggcatctgtgtgattacattctgtttgattccgcgtgggtcggttacgaacagtttatcccgatgatggcggatagctcgccgctgctgttagaacttaacgaaaacgatccggggatctttgtgactcagtcggtgcacaaacagcaggcgggattctcacagacgtcgcagatccataaaaaagataaccatatccgtggacaggcgcgtttttgcccgcataagcggttgaataatgcctttatgctccatgcttctaccagcccgttctatccgctgttcgccgccctggacgttaacgccaaaattcatgaaggggagagtgggcgtcggctgtgggctgagtgcgttgagttgggtattgagtcgcgcaaggctattcttgcgcgctgtaagctgttccgcccgtttatcccgcccgttgttgatggcaaattgtggcaggattatccgacgtcagtgttagccagcgaccgccgttttttcagttttgagccgggggcgaattggcacggctttgaaggatatgccgcggatcagtattttgttgatccgtgcaagctgttactcaccacgccgggtatcgatgccgaaaccggcgaatatagcgactttggcgttccggcgacgattctggcgcactacctgcgtgagaacggcattgtgccggagaagtgcgatctcaactccattctgttcttattaactccggcggaaagccacgagaagctggcacaactggtggcgatgctggcgcagtttgaacagcatattgaggatgattcgccgctggctgaggtgttgccgagcgtttataacaaatatccggtgcgctatcgcgactacaccctgcgccagttgtgtcaggagatgcacgatttgtatgtcagtttcgacgtcaaagacctacaaaaagcgatgttccgccagcagagtttcccgtcagtggtgatgaatccccaggatgcgcatagcgcttatattcgcggtgaagtggagttggtgcggattcgtgatgccgaagggcgaattgcggcagaaggggcgttgccttatccacctggcgtgctttgcgtggtacccggggaagtctggggtggggcggttcaacgttatttccttgcgctggaagaaggcgtgaatttgttgccgggattttcgccggagttgcaaggtgtctatagcgaaaccgatgcggatggcatgaaacggttgtacggttatgtgttgaagtaa

SEQ ID NO: 1956 - protein, 711 aa, Escherichia coli O6
MKSMNIAASSELVSRLSTHRRVVALGDTDFTDVAAVVITAADSRSGILALLKRTGFHLPVFLYSEHAVELPAGVTAVINGNEQQWLELESAACQYEENLLPPFYDTLTQYVEMGNSTFACPGHQHGAFFKKHPAGRHFYDFFGENIFRADMCNADVKLGDLLIHEGSAKDAQKFAAKVFHADKTYFVLNGTSAANKVVTNALLTRGDLVLFDRNNHKSNHHGALIQAGATPVYLEASRNPFGFIGGIDAHCFNEEYLRQQIRDVAPEKADLPRPFRLAIIQLGTYDGTVYNARQVIDTVGHLCDYILFDSAWVGYEQFIPMMADSSPLLLELNENDPGIFVTQSVHKQQAGFSQTSQIHKKDNHIRGQARFCPHKRLNNAFMLHASTSPFYPLFAALDVNAKIHEGESGRRLWAECVELGIESRKAILARCKLFRPFIPPVVDGKLWQDYPTSVLASDRRFFSFEPGANWHGFEGYAADQYFVDPCKLLLTTPGIDAETGEYSDFGVPATILAHYLRENGIVPEKCDLNSILFLLTPAESHEKLAQLVAMLAQFEQHIEDDSPLAEVLPSVYNKYPVRYRDYTLRQLCQEMHDLYVSFDVKDLQKAMFRQQSFPSVVMNPQDAHSAYIRGEVELVRIRDAEGRIAAEGALPYPPGVLCVVPGEVWGGAVQRYFLALEEGVNLLPGFSPELQGVYSETDADGMKRLYGYVLK

SEQ ID NO: 1957 - DNA, 2208 bp, Escherichia coli O6
  CDS (1)..(2208)
atgaacaaaatgtcagaattaaaaattgccgttagccgttcttgcccggattgcttttccactcatcgtgaatgcgtgaatattgacaaaagtaattatattgacgttgccgctattattttatcagtcaatgatgttgaacgtggaaaactcgatgaaatagacgctactggctatggcattcctgtttttattgcaacggaaaatgaagaacgtgtaccagcagaatatctgccacgtatttctggtgtcttcgagcattgcgaatcacggaaagagttttatggacgtcagttagaaaccgctgccagccattatgaaacgcaactgcgcccgcccttcttccgcgcactggtcgattatgtcaatcagggcaatagcgcttttgactgcccgggtcatcagggaggtgagtttttccgtcgccatccggcaggcaatcagttcgtggaatattttggcgaaatgctcttccgctccgacttgtgtaatgccgacgttgcaatgggtgatcttctgattcatgaaggtgcgccatgcattgcacagcaacatgcggctaaagtgtttaatgccgataaaacgtactttgttttaaacggcacctcctcctccaacaaagtggttttaaacgccctgctgacaccgggtgatctggtgctgtttgaccgcaataaccataagtctaaccatcacggggccttgctacaggctggtgcaacaccggtttatctggaaacagcacgtaacccgtatggttttatcggtggcattgatgcgcactgcttcgaagaaagttatctgcgtgaactgattacagaagttgcaccgcaacgggcaaaagaagcgcgtccgttccgcctcgctgtgattcagttaggcacctacgacggtactatttataacgcccgccaggtggtggataaaatcggtcatctgtgtgactacatcctgtttgactcagcatgggtcggctatgaacagtttattccgatgatggcggactgttcgccgctgctgctggagcttaatgagaacgatccgggtattctggttacgcaatctgtgcataaacaacaggctggtttttctcagacttcacaaattcataaaaaagacagccatatcaaagggcaacagcgttatgtaccgcacaaacgcatgaacaacgcctttatgatgcacgcctccaccagcccgttctatccgctgtttgccgcactggatatcaacgccaaaatgcatgaaggtgtcagcggtcgtaatatgtggatggattgtgtggttaacggtattaatgcccgcaaattgatcctcgataactgccagcacattcgcccgttcgttcctgaactggtggatggtaaaccctggcagtcgtatgaaacagcgcaaattgcggttgatctgcgcttctttaaatttgtacccggtgagcactggcattcttttgaaggctacgcagagaaccaatactttgtcgatccgtgcaaactgttgctgacaactccaggtattgatgcacgtaacggcgaatatgaagcgttcggtgtacctgcaacgattcttgctaacttcctgcgcgaaaatggcgtagtgccggaaaaatgcgatcttaactccatcctcttcctgctgactccggcagaagatatggccaaactgcagcaacttgttgccctgctggtacgcttcgaaaaactactggaagctgatgcgcctctggcggaagtactgccttccatctacaaacagcatgaagagcgctacgccggttataccctgcgtcagttgtgccaggaaatgcatgatttgtatgcccgtcacaacgtgaaacaactgcaaaaagagatgttccgtaaggaacacttccctcgcgtcagcatgaatccgcaagaagccaactacgcctacttacgcggtgaagtggagctggttcgtctgccggatgcagaaggccgtatcgctgccgaaggtgcgcttccttatcctccgggtgtgctgtgtgttgttcctggtgaaatctggggtggtgctgttttgcgttacttcagcgctctggaagaaggcatcaacctgctgccaggttttgcaccggagctgcagggtgtctatatcgaagaacatgatggtcgtaagcaagtttggtgctatgtcatcaagcctcgtgatgcgcaaagcaccctgttgaaaggggaaaaattatga

SEQ ID NO: 1958 - protein, 735 aa, Escherichia coli O6
MNKMSELKIAVSRSCPDCFSTHRECVNIDKSNYIDVAAIILSVNDVERGKLDEIDATGYGIPVFIATENEERVPAEYLPRISGVFEHCESRKEFYGRQLETAASHYETQLRPPFFRALVDYVNQGNSAFDCPGHQGGEFFRRHPAGNQFVEYFGEMLFRSDLCNADVAMGDLLIHEGAPCIAQQHAAKVFNADKTYFVLNGTSSSNKVVLNALLTPGDLVLFDRNNHKSNHHGALLQAGATPVYLETARNPYGFIGGIDAHCFEESYLRELITEVAPQRAKEARPFRLAVIQLGTYDGTIYNARQVVDKIGHLCDYILFDSAWVGYEQFIPMMADCSPLLLELNENDPGILVTQSVHKQQAGFSQTSQIHKKDSHIKGQQRYVPHKRMNNAFMMHASTSPFYPLFAALDINAKMHEGVSGRNMWMDCVVNGINARKLILDNCQHIRPFVPELVDGKPWQSYETAQIAVDLRFFKFVPGEHWHSFEGYAENQYFVDPCKLLLTTPGIDARNGEYEAFGVPATILANFLRENGVVPEKCDLNSILFLLTPAEDMAKLQQLVALLVRFEKLLEADAPLAEVLPSIYKQHEERYAGYTLRQLCQEMHDLYARHNVKQLQKEMFRKEHFPRVSMNPQEANYAYLRGEVELVRLPDAEGRIAAEGALPYPPGVLCVVPGEIWGGAVLRYFSALEEGINLLPGFAPELQGVYIEEHDGRKQVWCYVIKPRDAQSTLLKGEKL

SEQ ID NO: 1959 - DNA, 2142 bp, Escherichia coli O6
  CDS (1)..(2142)
atgaacatcattgccattatgggaccgcatggcgtcttttataaagatgagcccatcaaagaactggagtcggcgctggtggcgcaaggctttcagattatctggccacaaaacagcgttgatttgctgaagtttatcgaacataacccacgaatttgcggcgtgatttttgactgggatgagtacagtctcgatttatgtagcgatatcaatcaacttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccaacgaatatcttgataacattacgccgccgttcacgaaagccttgtttacctacgtcaaagagcggaagtacaccttttgtacgccggggcatatgggcggcaccgcatatcaaaaaagcccggttggctgtctgttttatgattttttcggcgggaataccctcaaggcggacgtctctatttcggtcaccgagcttggttcgttgctcgaccacaccgggccacacctggaagcggaagagtacatcgcgcggacgtttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattctgggtgggatcccgcgcggtgaatttactcgcgacagcatcgaagagaaagtcgctgccaccacgcaggcacaatggccggttcatgcggtgatcaccaactccacctatgatggcttgctctacaacaccgactggatcaaacagacgctggatgtcccgtcgattcacttcgattctgcctgggtgccgtacacccattttcatccaatctaccagggtaaaagtggtatgagcggcgagcgtgttgcaggaaaagtgatcttcgaaacgcagtcgacccacaaaatgctggcggcgttatcgcaggcgtcgctgatccacattaaaggtgagtatgacgaagaggcgtttaacgaagcctttatgatgcataccaccacctcgcccagttatcccattgttgcttctgttgagacggcggcggcgatgttgcgtggtaatccgggcaaacggctgattaaccgttcagtagaacgagctctgcattttcgcaaagaggtccagcggctgcgggaagagtctgacggctggtttttcgatatctggcaaccgccgcaggtggatgaagccgaatgctggcccgttgcgcctggcgaacagtggcacggctttagcgatgcggatgccaatcacatgtttctcgatccggttaaagtcactattttgacaccggggatggacgagcagggcaatatgagcgaggaggggatcccggcggcgctggtggcaaaattcctcgacgaacgtgggatcgtagtagagaaaaccggcccttataacctgctgtttctctttagtattggcatcgataaaaccaaagcaatgggattattgcgtgggttgacggaatttaagcgctcttacgatctcaacctgcggatcaaaaatatgctgcccgatctctatgcagaagatcccgatttctaccgcaatatgcgtattcaggatctggcgcaagggatccataagctgattcgtaaacacgatcttcccggtttgatgttgcgggcatttgataccttgccggagatgatcatgacgccacatcaggcatggcagagacagattaaaggcgaagtagaaaccattgcgctggaacaactggtcggtagagtatcggcaaatatgatcctgccttatccacccggcgtaccgctgctgatgccgggagaaatgcttaccgaagagagccgcacggtactcgattttctactgatgctttgttccgtagggcaacattaccccggttttgaaacggatattcacggcgcgaaacaggacgaagacggtgtttaccgcgtacgagtcctaaaaatggcaggataa

SEQ ID NO: 1960 - protein, 713 aa, Escherichia coli O6
MNIIAIMGPHGVFYKDEPIKELESALVAQGFQIIWPQNSVDLLKFIEHNPRICGVIFDWDEYSLDLCSDINQLNEYLPLYAFINTHSTMDVSVQDMRMALWFFEYALGQAEDIAIRMRQYTNEYLDNITPPFTKALFTYVKERKYTFCTPGHMGGTAYQKSPVGCLFYDFFGGNTLKADVSISVTELGSLLDHTGPHLEAEEYIARTFGAEQSYIVTNGTSTSNKIVGMYAAPSGSTLLIDRNCHKSLAHLLMMNDVVPVWLKPTRNALGILGGIPRGEFTRDSIEEKVAATTQAQWPVHAVITNSTYDGLLYNTDWIKQTLDVPSIHFDSAWVPYTHFHPIYQGKSGMSGERVAGKVIFETQSTHKMLAALSQASLIHIKGEYDEEAFNEAFMMHTTTSPSYPIVASVETAAAMLRGNPGKRLINRSVERALHFRKEVQRLREESDGWFFDIWQPPQVDEAECWPVAPGEQWHGFSDADANHMFLDPVKVTILTPGMDEQGNMSEEGIPAALVAKFLDERGIVVEKTGPYNLLFLFSIGIDKTKAMGLLRGLTEFKRSYDLNLRIKNMLPDLYAEDPDFYRNMRIQDLAQGIHKLIRKHDLPGLMLRAFDTLPEMIMTPHQAWQRQIKGEVETIALEQLVGRVSANMILPYPPGVPLLMPGEMLTEESRTVLDFLLMLCSVGQHYPGFETDIHGAKQDEDGVYRVRVLKMAG

SEQ ID NO: 1961 - DNA, 1488 bp, Thermoanaerobacter tengcongensis
  CDS (1)..(1488)
atgaaaaagctagatcaaactcaaacccctttatttgacgctctaatggaatatgtgaataataatacaattcccttccacgtaccgggacacaaaaaaggggagggaatggccaaaaaatttctagactttgttggaaaaaatgtgctctcaatggatgtaactgtgtttcagcaagtagacagcttgcacaaaccaacaggtcctatcaaatacgctcaagagttggcagcagaagcttttggagcagacgcaacatttttctcaatacacggaacctctggagccatccaagctatgattttaagcgtaatgggagaagatgaaaaaatcattgtaccaagaaacattcacaagtctgtgacctccggaatcatattaagtggcgctataccaatttacatgcagccagaaattgacaaaaatatcggggttgccttgaacgtcacccctgagacggtcgaaaaaactttaagacagcatcctgatgcaaaagcggttttaatcatcaacccaacttattacggagtttctacagacatagtaaaaattgctgaaattgtccacgattatggagcaattttaatggtagatgaagctcatggccctcaccttaaatttaacgaaaaattgcccatttcggctatggaagcaggagccgatatatgcgctcaaagcactcataaaattattggttctatgacacaaagttcaatgcttcatgtaaaaggagacaggatagatataaacagggtaaagcaggtgatgagcttattacagaccacaagcccttcatatatactcctggcgtcactggacgtagcaagaatgcaaatggctacagaaggaaaggaacttctggacaggactatcgaattagctgaatacgccagaagagagataaataaaattaaagggctttactgctttggcgaagaaatagtaggtcgcgatggcgcttatgattttgaccctacaaaagtgaccataactgccaaaggattaggtataactgggcatcaactggaaagaatcttagcagaaaaatactacattcaagtagagctttcggacatgtacaatgtcctctgcgtattctcaattggagacacaaaagaaaaagtagattacttgcttcgcgctttaagagagataagcgacgaattgtacgacgaaaacatagaagtagcaaagccaatagatattccagaaattcccgaattagtagtttcacctagatatgcctttaacgctcctacagtggctcttcctctgagagaaagtgtagggcagataagcgcagaatttttaatggcatatccacctggaataccagtgctctgccctggcgaaagaataacaatggaaattatagaatacgtcgaaaaaatgaaagaggcaaatttaagcattcaaggcacagaagacccagaggcaaattatataaaggtggtaaattacagacaggctctaaatgtaatcgcataa

SEQ ID NO: 1962 - protein, 495 aa, Thermoanaerobacter tengcongensis
MKKLDQTQTPLFDALMEYVNNNTIPFHVPGHKKGEGMAKKFLDFVGKNVLSMDVTVFQQVDSLHKPTGPIKYAQELAAEAFGADATFFSIHGTSGAIQAMILSVMGEDEKIIVPRNIHKSVTSGIILSGAIPIYMQPEIDKNIGVALNVTPETVEKTLRQHPDAKAVLIINPTYYGVSTDIVKIAEIVHDYGAILMVDEAHGPHLKFNEKLPISAMEAGADICAQSTHKIIGSMTQSSMLHVKGDRIDINRVKQVMSLLQTTSPSYILLASLDVARMQMATEGKELLDRTIELAEYARREINKIKGLYCFGEEIVGRDGAYDFDPTKVTITAKGLGITGHQLERILAEKYYIQVELSDMYNVLCVFSIGDTKEKVDYLLRALREISDELYDENIEVAKPIDIPEIPELVVSPRYAFNAPTVALPLRESVGQISAEFLMAYPPGIPVLCPGERITMEIIEYVEKMKEANLSIQGTEDPEANYIKVVNYRQALNVIA

SEQ ID NO: 1963 - DNA, 1419 bp, Thermoanaerobacter tengcongensis
  CDS (1)..(1419)
atgtcaactcctttgtacgatgctctcatggaatacgtgaaaaaggaaactgtaccttttcacatgcccggccataaacaaggaagagtattgccaaaagagtacattgaaaatttagcaaaaattgatttgacagaggtgccaggacttgacaaccttcacaatcccgatggtccaatccttgaagctgagaagcttgcagcaaagacctttgggtcaaaacaagctttctttttggtaaatggcagtactgctggaatatatgcggccatgtatgcagtgctaaaccctacggataaagtgcttgtgatgaggaattctcataaatctgtttacaacggagttgtgcttactcaatcgattcccgtgtatttgctgcccgagatagactatgaaaatggaattgcgatgggaattgatgtagaaaggctagaggaggttttgcaaaaagaaagagatgtaaaagctgtagtagtgacataccctaattattacggtttttgcagtgatattgaaaaaattgtggatattgtgcataagtacggtaaaattttgattgtagatgaagctcatggggctcactttcctttttcaaacaatttgcctaagtcctccataaaagcaggagcggatattgtagtacagagcctgcacaagactcttacttcttttactcaaacttctatactccatttaaattctgatagggtagatgtggatcggttaaaatattctttaagcctttttcaatctacatctccttcttatattctcatgtcttcaattgacatggcaagagaatacatggagaaagaaggcaaaaaaagactagaagaagttattcaattagccctatatgtaagaagagagattgataaaatggaaggtattagatgtttaggagaagatatagttggacggtacggcattgtggattttgatgttacaaagctcactataagtgtaaagaatttgggaattgaagggcctgaagcagaggattttttgaggagagaatgcaatatacaagttgaaatgtcggatgtttacaatatattagcgatggttactgtaggggatgatgaaaaaagggtaaaaatgcttttagaaggtttaaaaaagctttcaaaaaacaggaagagggttaaatttggggatagaattctttttccttctttgcctgaaatggagttgactccttcggaagctgtgaggaaaaagaaggtgagggtaccctttgaaaaggcggaaggggcgatttctgcagattttgtgacaccttatccgccaggagttcctctcatatgtccaggagagaggattgaaaaagatatggtaaaatatatagaagtattgtataataaaggtattaaggttttgggtatacaggataatttactgtcggtgtgtgagatatga

SEQ ID NO: 1964 - protein, 472 aa, Thermoanaerobacter tengcongensis
MSTPLYDALMEYVKKETVPFHMPGHKQGRVLPKEYIENLAKIDLTEVPGLDNLHNPDGPILEAEKLAAKTFGSKQAFFLVNGSTAGIYAAMYAVLNPTDKVLVMRNSHKSVYNGVVLTQSIPVYLLPEIDYENGIAMGIDVERLEEVLQKERDVKAVVVTYPNYYGFCSDIEKIVDIVHKYGKILIVDEAHGAHFPFSNNLPKSSIKAGADIVVQSLHKTLTSFTQTSILHLNSDRVDVDRLKYSLSLFQSTSPSYILMSSIDMAREYMEKEGKKRLEEVIQLALYVRREIDKMEGIRCLGEDIVGRYGIVDFDVTKLTISVKNLGIEGPEAEDFLRRECNIQVEMSDVYNILAMVTVGDDEKRVKMLLEGLKKLSKNRKRVKFGDRILFPSLPEMELTPSEAVRKKKVRVPFEKAEGAISADFVTPYPPGVPLICPGERIEKDMVKYIEVLYNKGIKVLGIQDNLLSVCEI

SEQ ID NO: 1965 - DNA, 2352 bp, Fusobacterium nucleatum
  CDS (1)..(2352)
atgtctaaattagaccaaaataagacaccattatttacagtattaaaagatgaatatgtgagaagaaatatacttccatttcatgttcctggacataaaagaggaaaaggagttgatgaagaattttataacttcatgggagaggctcctttttcaatagatgtaacaatttttaaaatggttgatggtcttcatcatccaaaaagttgtattaaagaatctcaagaattagttgcagatgcttatggggttaaacatagtttctttgcagtaaatggaacttctggtgctatacaagcaatgataatgtcagttgtaaaagcaggggaaaaaatattagtaccaagaaatgttcataaatcagtttcagcaggaattattttaagtggttctgaacctgtgtatatgaatcctgaaattgatgaaaatttaggaattgctttaggtgttaaaccacaaacagttgaaaatatgttaaaacaagatccagacatagcagctgttcttattataaatccaacttattatggggtagcaacagatattaaaaagatagcagacatagttcatagctatgatatacctcttattgtagatgaagctcatggaccacatttacactttcatgatgaattaccagtttcagctgttgatgctggagcagatatctgtactcaaagtacacataaaattttaggtgctatgactcaaatgtctcttattcatgtaaattcagatagagttaatgttgaaaaagtaaaacaaattttaagtttactccatacaacttctccatcatatccattgatggcatctcttgattgtgcaagaaggcaaatagctacacaagggcaagaattgcttacaagaactattgagcttgctaaatattttagaagagaagctaatagaatacctggaatttattgttttggagaagaacttgttggaaaagatggtttctttgcttttgacccaacaaaaattacaatatctgcaaaagaactaggacttaagggtggagagcttgaaagcctacttgtagatgactacaatattcaaatggaattatcagactactataacactttagggcttattacaataggagatacagaagaaagtgtaaataaattgctagatgctttaagagatataagcagaagattttttggaaaaggaaaaacattagaaaaaaatattataaaacttcctgaaactcctgaattagtattaatgccaagagaagctttttacagtgaaaagaataaagttccatttaaagaaagtgttggaaaaatatctggtgaaatgataatggcatatccacctggtatcccaataattattgcaggagaaagaataagtcaagatataattgatcatattgaagaattaaaagaagctgatttacatattcaaggtatggaagacccagaacttgaaaccataaatgtaattgaagaagaagacgctatttacttatacactgaaaagatgaaaaatgttcttattggagtgcaaacaaatcttggagttaataaaacaggaactgaatttggaccagatgatttaattcaagcttatccagatacttttgatgaaatggaattaatttctgttgaaagacaaaaagaagacttcaatgataaaaaattaaaattcaaaaatacagttttagatacttgtgaaaagatagctaagagagttaatgaagctgtaattgatggatatagaccaatacttgttggaggagaccactcaatttcattaggaagtgtatcaggtgtttctctagaaaaagaaattggagttttatggataagtgctcatggagatatgaatacccctgaaagtacacttacaggaaatattcatggaatgccattagctttacttcaaggtctaggagatagggaacttgtaaattgtttctatgaaggagctaaacttgacagcagaaatattgttatctttggtgcaagagaaattgaagttgaagaaagaaaaattattgaaaaaactggtgtaaagattgtttattatgatgatattctaagaaaaggtatagataatgttttagacgaagtgaaagattatctaaaaattgataatttacatatcagtatagatatgaatgtatttgacccagaaattgctcctggtgtatctgtacctgttagaagaggaatgtcttatgatgaaatgtttaaatcattgaaatttgcatttaaaaattactcagttacatcagcagatattacagaatttaatccattgaatgatattaacggaaaaactgctgaacttgtaaatggtatagtacaatatatgatgaacccagattattaa

SEQ ID NO: 1966 - protein, 783 aa, Fusobacterium nucleatum
MSKLDQNKTPLFTVLKDEYVRRNILPFHVPGHKRGKGVDEEFYNFMGEAPFSIDVTIFKMVDGLHHPKSCIKESQELVADAYGVKHSFFAVNGTSGAIQAMIMSVVKAGEKILVPRNVHKSVSAGIILSGSEPVYMNPEIDENLGIALGVKPQTVENMLKQDPDIAAVLIINPTYYGVATDIKKIADIVHSYDIPLIVDEAHGPHLHFHDELPVSAVDAGADICTQSTHKILGAMTQMSLIHVNSDRVNVEKVKQILSLLHTTSPSYPLMASLDCARRQIATQGQELLTRTIELAKYFRREANRIPGIYCFGEELVGKDGFFAFDPTKITISAKELGLKGGELESLLVDDYNIQMELSDYYNTLGLITIGDTEESVNKLLDALRDISRRFFGKGKTLEKNIIKLPETPELVLMPREAFYSEKNKVPFKESVGKISGEMIMAYPPGIPIIIAGERISQDIIDHIEELKEADLHIQGMEDPELETINVIEEEDAIYLYTEKMKNVLIGVQTNLGVNKTGTEFGPDDLIQAYPDTFDEMELISVERQKEDFNDKKLKFKNTVLDTCEKIAKRVNEAVIDGYRPILVGGDHSISLGSVSGVSLEKEIGVLWISAHGDMNTPESTLTGNIHGMPLALLQGLGDRELVNCFYEGAKLDSRNIVIFGAREIEVEERKIIEKTGVKIVYYDDILRKGIDNVLDEVKDYLKIDNLHISIDMNVFDPEIAPGVSVPVRRGMSYDEMFKSLKFAFKNYSVTSADITEFNPLNDINGKTAELVNGIVQYMMNPDY

SEQ ID NO: 1967 - DNA, 1431 bp, Clostridium perfringens
  CDS (1)..(1431)
atgagaaatattcctataattaatggaatatcaatgtacttaagagaagaaatagtacctttttctatgccaggtcataagaatggacgaggctttaagggatttgaagaaatacttttaaaaggtgatttaactgaagttgaaggattagataatttgcagcatccagagggaataattaaagaagctgaggataaactttctaatttatataaaagtaaaaagagttattttttagttaatggaagtacttgtggaaatttaataatgatattttctttgtttaaagaaggagataaagttttagtagaaagaaactgtcacaaaagtataatgaatggaataataatgagaaaattaaaaccagtttttataaataatatatttcattcaaaattaaaagcaccagtaggaattgatttaaatcatttaaaagagcaaataagtttaaataaagatttaaaaggaataatattaacttaccctaattattatggcgtaggagttaatatagatgagactataaaaatagctagagaagcaaatttaaaagtaggaatagattcagctcatggagcacactttggatttaacaagttattgcctgaaagtgtacaagaattaaaggctgatatagttgtaatgagtgctcataaaactttaccaagtttaacacagactgcttggatgcatgttaacaatgaagattttattgaagaaatagaattttataaaaatatttttatgagtactagcccttcatatatgtttatgatgagtttagattattcaagaaactttttagaagaacatggtgaagaggcatataataacttatttaagatcatagaggattttaaaaatcatattaaggacttatcatattttaaaatattagataaggaatttttaattaatgggttagaaaaaaatattaagataaatgatattaagatagataatagtagaatagtactaaacttaagggaaaatttaaatggtaataaactattagattatttaagaagtaaaaatatacaatgtgaaatgagtgataataaaaatgttgttttaataccgtcaccatttaatactgaagaagattttaaaattttaaaagatgctttaaaatcttgtgatataaattgtcttaaagatgaagaaatagatttttatttaacagatttaccagagaaaaaattagaaccttttgaagttttggatttagaatatgaaagaattaatataaatgatgctgtaggtaaaattgtggcagagagtatagttccatacccaccaggagttcctatgataataatgggagaagtgatagaagaaagacatattaaattacttaatgagtatatgaaaagcaaggtagatttaataggtataaaggataaaaaagttaaggtaataaagaataagtaa

SEQ ID NO: 1968 - protein, 476 aa, Clostridium perfringens
MRNIPIINGISMYLREEIVPFSMPGHKNGRGFKGFEEILLKGDLTEVEGLDNLQHPEGIIKEAEDKLSNLYKSKKSYFLVNGSTCGNLIMIFSLFKEGDKVLVERNCHKSIMNGIIMRKLKPVFINNIFHSKLKAPVGIDLNHLKEQISLNKDLKGIILTYPNYYGVGVNIDETIKIAREANLKVGIDSAHGAHFGFNKLLPESVQELKADIVVMSAHKTLPSLTQTAWMHVNNEDFIEEIEFYKNIFMSTSPSYMFMMSLDYSRNFLEEHGEEAYNNLFKIIEDFKNHIKDLSYFKILDKEFLINGLEKNIKINDIKIDNSRIVLNLRENLNGNKLLDYLRSKNIQCEMSDNKNVVLIPSPFNTEEDFKILKDALKSCDINCLKDEEIDFYLTDLPEKKLEPFEVLDLEYERININDAVGKIVAESIVPYPPGVPMIIMGEVIEERHIKLLNEYMKSKVDLIGIKDKKVKVIKNK

SEQ ID NO: 1969 - DNA, 1455 bp, Clostridium perfringens
  CDS (1)..(1455)
atgaaaagactttctcaagaaaatgctcctatttatgaagcattaaaatggtacaagaatcaaagaattgttccttttgatgtaccaggtcataaacaaggaagaggaaatacagaattaagagaatttttaggtgaagattgtgtttcagtagatgtaaattcaatgaaacccttagataatctttgtcatccaacttctgtaataaaggatgcagaagaattagcagctgaggcctttggtgctgataaggcatttttcatggttaatggaaccacatcagctgtacaagccatgataatgagtgtttgcaaagatggagataagattataatgcctaggaatgtgcatagatctgcaataaattctttaataataacaggggtaactcctgtgtatataaatccaggaattcatggtagacttggaatttctctaggaatggcaatggaagatataaaaaaggccattaaggaaaatccagatgctaaggctatttttgttaataacccaacatactatgggatttgctctaatttaagagaaatagttaagttagctcatgaaaataatatgtatgtcttagttgatgaagctcatggaactcatttttattttgataaaagacttccagtatcagctatggaggcaggggcagatatggcagctgttagcatacataaaacaggaggctcattaactcagagttctatgttgcttatgaagtgtaatagaattaagccagattatgtgagaacaataataaacttaacacaaacaactagtggttcttatttacttttatcttctttagatattgctagaagaaatttagccttaaatggagaaaaaatatttgaagaggttgttggaatagctgaatatgcaagagaagaaataaataagataggtggttattacgctttctcaaaagaaataaataatggtgatgatatttatgattttgatgtaactaagcttactataaacactttagaaactggacttgctggaatagaagtttatgacatattaagagatgattatggaattcaaatagagcttggagatgtggctaatattcttgccataatatcagttggagatactagatataacattgagagattagtttcagctttaagtgagattaagagaattcatgaaaaagataaaaaagatatttttgaccacgaatatatagatcctatagttaaggttaagccaaaagaggctttttatgctgataagaagaaggttcttttaagagaaagtgaaggattaatttctggagaatttgtaatgtgttatccaccaggaattccaatacttgccccaggagagcttataactaaggagactatagactatattgagtattctaagaaaaagggaagtttagttacaggccctgaagatatggaaattgaatatataaatgttttagattgttag

SEQ ID NO: 1970 - protein, 484 aa, Clostridium perfringens
MKRLSQENAPIYEALKWYKNQRIVPFDVPGHKQGRGNTELREFLGEDCVSVDVNSMKPLDNLCHPTSVIKDAEELAAEAFGADKAFFMVNGTTSAVQAMIMSVCKDGDKIIMPRNVHRSAINSLIITGVTPVYINPGIHGRLGISLGMAMEDIKKAIKENPDAKAIFVNNPTYYGICSNLREIVKLAHENNMYVLVDEAHGTHFYFDKRLPVSAMEAGADMAAVSIHKTGGSLTQSSMLLMKCNRIKPDYVRTIINLTQTTSGSYLLLSSLDIARRNLALNGEKIFEEVVGIAEYAREEINKIGGYYAFSKEINNGDDIYDFDVTKLTINTLETGLAGIEVYDILRDDYGIQIELGDVANILAIISVGDTRYNIERLVSALSEIKRIHEKDKKDIFDHEYIDPIVKVKPKEAFYADKKKVLLRESEGLISGEFVMCYPPGIPILAPGELITKETIDYIEYSKKKGSLVTGPEDMEIEYINVLDC

SEQ ID NO: 1971 - DNA, 2280 bp, Ralstonia solanacearum
  CDS (1)..(2280)
atgaaattccgttttcccgtcatcatcatcgacgaggacttccgctccgagaacatctccgggtcgggcattcgcgcgctggcgcaggccatcgaagaagagggcatggaggtcacgggcctgaccagctatggcgacctgacctcgttcgcgcagcagtcgagccgggcgtccaccttcatcgtctcgatcgacgacgatgagttcatcaacccggacaacgacaagccggaaccggaagcggtggaaaacctgcgcagcttcgtggccgaagtgcgccgccgcaacgccaacatccccatcttcctgtacggcgagacgcgcacctcgcgccacctgcccaacgacatcctgcgcgagctgcacggcttcatccacatgttcgaggacacgccggagttcgtggcgcgccacatcatccgcgaagcccgcaactacctggattcgctgccgccgccgttcttcaaggcgctgatcgactacgcgcaggacagctcctactcgtggcactgcccggggcactcgggcggcgtggcgttcctcaagagcccggtgggccaggtgttccaccagttcttcggcgagaacatgctgcgcgccgacgtctgcaacgcggtggacgagctcggccagctgctcgaccacaccggcccggtggcggcctccgagcgcaatgccgcgcgcatcttcggctcggaccacatgttcttcgtcaccaacggcacgtccacctcgaacaagatggtgtggcacgccaacgtggcgcccggcgacatcgtggtggtggaccgcaactgccacaagtcgatcctgcacgcgatcatgatgacgggcgcgatccccgtgttcctgatgccgacgcgcaaccactacggcatcatcggcccgattccgcagagcgagttcgagcccgagaccatcgcccgcaagatcgccgagcatccgttcgccagccaggccgcgaacaagaagccgcgcatcctgaccctcacgcagggcacgtacgacggcgtgctgtacaacgccgagcgcatcaagcacatgctgtcgaccgagatcgacacgctgcacttcgacgaggcctggctgccgcacgcctcgttccacccgttctaccgcgacatgcacgccatcggccagggccgcgcgcgcagcaaggacgcgctggtgttcgccacgcagagcacgcacaagctgctggccggcctgtctcaggcttcgcagatcctcgtgcaggattccgagacgcgcaagctcgacacgtaccgcttcaacgaggcgtacctgatgcacacctcgaccagcccgcagtactcgatcatcgcctcgtgcgacgtggccgcggcgatgatggaagcgccgggcggcaccgcgctggtggaagagagcatcgccgaggccctggacttccgccgcgccatgcgcaaggtggagcaggagtacgtcggcacgaatggtggcaacggccgcggcgacgactggtggttcaaggtctggggcccgaacgacctgtccgatgaaggcatcgaggagcgcgaggcctggatgctcaaggccaacgagcgctggcacggcttcggcgacctggccgaggacttcaacctgctcgacccgatcaaggccaccatcatcaccccgggcctggacgtggacggcaagttcagcgagtcgggcatcccggcggccatcgtcacgaagtacctcgccgagcacggcatcatcgtcgagaagaccgggctgtactcgttcttcatcatgttcaccatcggcatcaccaagggccgctggaactcgatggtgaccgagctgcagcagttcaaggacgactacgacaacaaccagccgctgtggcgcgtgctgccggagttcgtgcggcagtatccgcaatacgagcgcatcggcctgcgcgagctgtgcgacgccatccacagcgtctacaaggccaacgacgtggcccgcgtgaccaccgagatgtacctctccaacatggagccggcgatgaagccgtcggacgcatgggccaagatggcgcaccgcgagaccgagcgcgtggccatcgacgacctggagggccgcatcaccgccatcctgctgacgccgtatccgccgggcattccgctgctgatcccgggcgagcgcttcaaccggaccatcgtgcagtacctgcagttcgcgcgcgagttcaacaagctgttcccgggcttcgagaccgatatccacgggctggtggaggaggagattgagggtcgggttgggtactttgtcgactgcgtgaggtga

SEQ ID NO: 1972 - protein, 759 aa, Ralstonia solanacearum
MKFRFPVIIIDEDFRSENISGSGIRALAQAIEEEGMEVTGLTSYGDLTSFAQQSSRASTFIVSIDDDEFINPDNDKPEPEAVENLRSFVAEVRRRNANIPIFLYGETRTSRHLPNDILRELHGFIHMFEDTPEFVARHIIREARNYLDSLPPPFFKALIDYAQDSSYSWHCPGHSGGVAFLKSPVGQVFHQFFGENMLRADVCNAVDELGQLLDHTGPVAASERNAARIFGSDHMFFVTNGTSTSNKMVWHANVAPGDIVVVDRNCHKSILHAIMMTGAIPVFLMPTRNHYGIIGPIPQSEFEPETIARKIAEHPFASQAANKKPRILTLTQGTYDGVLYNAERIKHMLSTEIDTLHFDEAWLPHASFHPFYRDMHAIGQGRARSKDALVFATQSTHKLLAGLSQASQILVQDSETRKLDTYRFNEAYLMHTSTSPQYSIIASCDVAAAMMEAPGGTALVEESIAEALDFRRAMRKVEQEYVGTNGGNGRGDDWWFKVWGPNDLSDEGIEEREAWMLKANERWHGFGDLAEDFNLLDPIKATIITPGLDVDGKFSESGIPAAIVTKYLAEHGIIVEKTGLYSFFIMFTIGITKGRWNSMVTELQQFKDDYDNNQPLWRVLPEFVRQYPQYERIGLRELCDAIHSVYKANDVARVTTEMYLSNMEPAMKPSDAWAKMAHRETERVAIDDLEGRITAILLTPYPPGIPLLIPGERFNRTIVQYLQFAREFNKLFPGFETDIHGLVEEEIEGRVGYFVDCVR

SEQ ID NO: 1973 - DNA, 2271 bp, Salmonella typhimurium
  CDS (1)..(2271)
atgatgaaagtattaattgttgaaagtgagtttctgcatcaggacacctgggttggcaacgcggttgagcgtctggcagatgccttgagccaacaaaatgttaccgtcattaaatcgacatccttcgatgacggctatgccatcttgtccgcgaacgaagccattgactgtctgatgtttagctaccaaatggaacaaccggatgagcacctgagcgtcaggcaattgatcggtaagcttcacgagcgtcagcaaaacgtgcccgttttcctgttaggcgacagggaaaaagcgacggcatcgctggaccgcgacctgctggagcttgtcgatgaattcgcctggattctggaagacaccgctgactttatcgccggacgcgccgttgccgccatgacccggtatcgccagcaactgttaccgccgctgtttaacgcgttgatgaaatacagcgacattcatgaatattcatgggcggcgccgggacaccagggcggcgtcggtttcactaaaacgccttccggtcgcttttatcacgattattatggcgaaaacctgttccgcagcgatatggggattgagcgtaccacgctcggttcactcctcgaccataccggcgcgtttggcgaaagcgagaaaaacgccgcccgcgtattcggtgctgaccgctcctggtccgtagttgtcgggacctcaggttctaaccgtactattatgcaggcctgtatgacggataatgatgtcgttgtactggatcgtaactgccataaatccatcgagcaggggctgatcctcactggggccaaaccggtatatatggtgccaagccgtaaccgttacggcattattgggccaatctacccgcaggaaatgcagcctgaaaccttgcagaaaaaaatcagcgccagcccgctgaccaaaactaaagccggacagaaaccgtcttacagcgtagtgaccaactgtacctatgacggcgtatgctataacgccaaagaggcgcaggatctgctggcaaaaaccagcgatcgcattcacttcgacgaagcatggtacggctatgcgcgcttcaacccgatttattgcgatcactacgcgatgcgcggcgagccaggcgaccataacggtccgaccgtgtttgccacccactccacgcacaaactactgaatgcgctttcacaagcttcctacattcacgtccgtgaaggccgtggcgcggtgaatttctcccgcttcaaccaggcctatatgatgcatgccaccacctctccgttatatgccatctgcgcatccaacgatgtggcggtatcgatgatggacggtaacagcggcctgtccctgactcaagaggtgattgacgaagcggttgatttccgtcaggcgatggcgcgtctttataaagagtttaccgatgaaggcgactggttctttaaaccgtggaataaggacgtcgtcaccgatccacaaaccggtaaaacgtatgacttcgccgacgcgccggcaaaactgctagccactgaccagaactgctgggtcatgcgccccggggaaacctggcacggctttaaagacctgccggataactggagtatgctggacccgattaaagtcagtatcctggcgccgggtatgggcgacgatggcgaactggaagcatccggcgtacctgctgcgctggtcacagcatggcttggccgccacggtatcgtgccgacccgcaccaccgactttcagattatgttcctgttctctatgggggtaactcgcgggaaatggggaacgctgatcaacacgctgtgctccttcaaacatcattacgacgcgaatacgccgctggcgcaggtgatgccggaactggtgcaggattatcctgacacttacgcgaacatgggtattcatgacctgggcgataaaatgtttgcctggctacgtgaaaataacccgggcgcccgtctcaacgccgcctattccaccctgccggttgcggagattaccccgcgcgacgcctacaacgcgattgtgaacaacaatattgaaatggtggcgattgaaaatctaccgggtcgcattgcggcgaactccgttattccttacccgccaggcatcccgatgctgctctccggcgaaaactttggcgatgaaaacagtccgcaggtgggttacttacgctcactgcaatcctgggatcatcacttccctggctttgagcatgaaaccgaaggcacggaaattattgatggcgtatatcacgttatgtgcgtgaaagcctaa

SEQ ID NO: 1974 - protein, 756 aa, Salmonella typhimurium
MMKVLIVESEFLHQDTWVGNAVERLADALSQQNVTVIKSTSFDDGYAILSANEAIDCLMFSYQMEQPDEHLSVRQLIGKLHERQQNVPVFLLGDREKATASLDRDLLELVDEFAWILEDTADFIAGRAVAAMTRYRQQLLPPLFNALMKYSDIHEYSWAAPGHQGGVGFTKTPSGRFYHDYYGENLFRSDMGIERTTLGSLLDHTGAFGESEKNAARVFGADRSWSVVVGTSGSNRTIMQACMTDNDVVVLDRNCHKSIEQGLILTGAKPVYMVPSRNRYGIIGPIYPQEMQPETLQKKISASPLTKTKAGQKPSYSVVTNCTYDGVCYNAKEAQDLLAKTSDRIHFDEAWYGYARFNPIYCDHYAMRGEPGDHNGPTVFATHSTHKLLNALSQASYIHVREGRGAVNFSRFNQAYMMHATTSPLYAICASNDVAVSMMDGNSGLSLTQEVIDEAVDFRQAMARLYKEFTDEGDWFFKPWNKDVVTDPQTGKTYDFADAPAKLLATDQNCWVMRPGETWHGFKDLPDNWSMLDPIKVSILAPGMGDDGELEASGVPAALVTAWLGRHGIVPTRTTDFQIMFLFSMGVTRGKWGTLINTLCSFKHHYDANTPLAQVMPELVQDYPDTYANMGIHDLGDKMFAWLRENNPGARLNAAYSTLPVAEITPRDAYNAIVNNNIEMVAIENLPGRIAANSVIPYPPGIPMLLSGENFGDENSPQVGYLRSLQSWDHHFPGFEHETEGTEIIDGVYHVMCVKA

SEQ ID NO: 1975 - DNA, 2136 bp, Salmonella typhimurium
  CDS (1)..(2136)
atgaaatcaatgaatattgccgccagcggtgaactcattccccgtctctccacccaccgaaacgtagtggcgctggacagtaccgactttaccgatgtggccgcagtcgtcattaccactgccgacagccgtagcggtattctggcgttgcttaaacgcaccggttttcacctgccggtgtttatgcttgcggatgaacccgtcagcgcgcctgtcggcgttacggcggtaatagtcgggaacgcgcaggaatggctggagctggaaaacgctgcctgtcgctacgaagcggaacttctgccgcccttttatggcaccctgacccagtatgtcgacatggggaatagtacttttgcttgcccggggcaccagcatggcgaattttttagaaaacatcccgcaggccgccatttttatgacttttttggtgaaaacctgtttcgtgcggatatgtgtaacgccgatgtgaaacttggcgatctgctaatacatgaaggttctgccaaacacgcgcagaaatttgcggcaaaagtgtttaatgcggataaaacctactttgtgctgaatgggacttcggcggcgaataaagtggtcaccaacgccctgctgacgcgcggcgatctggtgctgtttgatcgtaataatcacaaatccaaccaccacggcgccctgattcaggccggggcgacgccagtctatcttgaagcggcgcgtaacccgtttggttttatcggtggcattgatgcgcactgttttgatgaaacgtacctgcgcgaccagattcgtgacgtgatgccggaaagcgccgatgcgtcgcgtccgttccgcctggcgatcattcagctgggtacctatgacggcactatttacaacgcccgtcaggtggtggataaaatcgggcatctctgcgattacattctgtttgactccgcgtgggtaggctatgagcagtttatcaatatgatggcggatacctcgccgttgcggctggagcttaatgaaaacgaccctgggatctttgtgacccaatcggtacataagcaacaggcggggttctcacaaacctcgcagatccacaaaaaagataaccatattcgcggccaggcgcgtttttgcccgcacaaacgcctgaacaacgccttcatgttgcatgcttcaaccagtccgttctacccgctgtttgcggcgctggatgtcaatgccaaaatccacgaaggggagagcggtcgccgcctgtgggcggagtgcgttgcgctgggcattgacgcgcgtaaagccattctcgcccgttgcaaactgcttcagccctttatcccactggtggttgacggcaagccgtggcaggcatatccgacggagaccattgccagcaatcgtcgtttcttcagttttgaacccggggcgaaatggcatggctttgagggctatgcggatgaccagtattttgtcgacccctgtaaactgttactgaccacgccaggtattgatgccgatagtgggcgatacaccgaattcggcatcccggcgaccattctcgcccactatctgcgtgagaacggtattgtgcctgagaagtgcgatctcaactcgattctgttcttgctgacacccgccgagagcgaagagaagctggcgcgactggtcgcgatgctggcgcaatttgaacggcacattgaagacgatacgccgcttgcggatgtattgccgacggtttttcagaaatacccggtgcgctaccgcgattacaccctgcgtgagctatgtcaggagatgcacaacctgtacgttagctttgacgttaaggatctgcaaaaagcgatgttccgcaaagaaagcctgccgcatgtggcgatgaacccacaggatgccaacagcgcctttattcgcggcgatgtagagctggtgcgtatcagcgaggcgggcgggcgtattgctgccgagggggcattgccatacccgccgggcgtactgtgcgtggtgccgggggagatttggggcggcgcggcgcagcgttattttttggcgctggaagagggcatcaatctgttgcctggtttttcgccggaattgcagggggtatatagcgagaccgatgccgatggaattcaacgcttgtacggatatgttttaaagtaa

SEQ ID NO: 1976 - protein, 711 aa, Salmonella typhimurium
MKSMNIAASGELIPRLSTHRNVVALDSTDFTDVAAVVITTADSRSGILALLKRTGFHLPVFMLADEPVSAPVGVTAVIVGNAQEWLELENAACRYEAELLPPFYGTLTQYVDMGNSTFACPGHQHGEFFRKHPAGRHFYDFFGENLFRADMCNADVKLGDLLIHEGSAKHAQKFAAKVFNADKTYFVLNGTSAANKVVTNALLTRGDLVLFDRNNHKSNHHGALIQAGATPVYLEAARNPFGFIGGIDAHCFDETYLRDQIRDVMPESADASRPFRLAIIQLGTYDGTIYNARQVVDKIGHLCDYILFDSAWVGYEQFINMMADTSPLRLELNENDPGIFVTQSVHKQQAGFSQTSQIHKKDNHIRGQARFCPHKRLNNAFMLHASTSPFYPLFAALDVNAKIHEGESGRRLWAECVALGIDARKAILARCKLLQPFIPLVVDGKPWQAYPTETIASNRRFFSFEPGAKWHGFEGYADDQYFVDPCKLLLTTPGIDADSGRYTEFGIPATILAHYLRENGIVPEKCDLNSILFLLTPAESEEKLARLVAMLAQFERHIEDDTPLADVLPTVFQKYPVRYRDYTLRELCQEMHNLYVSFDVKDLQKAMFRKESLPHVAMNPQDANSAFIRGDVELVRISEAGGRIAAEGALPYPPGVLCVVPGEIWGGAAQRYFLALEEGINLLPGFSPELQGVYSETDADGIQRLYGYVLK

SEQ ID NO: 1977 - DNA, 2199 bp, Salmonella typhimurium
  CDS (1)..(2199)
atgtcagaattaaaaattgccgttagccgtcattgcccggattgtttttctacacaccgtaatattgtaaatgttgatgagagtcgtttcatcgacgtggctgccatcgtgttatccattgacgacattgaacacggaaaactcgatgaaatcgacgcaacgggttacggtattcccgtgtttgtcgcgacacatgacgaagggcgcgtaccgcctgagtatttgccgcgtatctctggtgtattcgaatataatgaatcccgtactgccttctatggtcgccagttggaaaccgcagcaagccactacgaaacgcagttacgtccgccgtttttccgcgcgctggtggattatgtcaaccagggcaacagcgcatttgactgcccggggcatcagggcggcgaattcttccgccgtcatcctgccggtaatcagttcgtggaatactttggcgaaacgctcttccgctccgacctatgcaacgcggacgtggcgatgggcgatctgctgattcacgaaggcgcgccttgcattgcgcagcaacatgcggcgaaagtctttaacgccgataagacctactttgtgctgaacgggacctcctcctctaacaaagtcgtactcaacgcgctgttaacgccgggcgatctggtactgtttgaccgtaacaaccacaaatctaaccaccacggcgcattattgcaggcgggcgcaacgccagtttatctggaaaccgcgcgtaacccgtatggttttatcggcgggatcgacgctcactgcttcgaagaagattacctgcgcgagctgattagcgaagtcgcgccgcagcgtgcccgcgaagcacgtccattccgtctggccgtcatccagttaggcacctacgacggtaccatttataacgcccgtcaggtcgtcgataaaattggtcatctgtgcgactacatcctgtttgactccgcctgggtcggctatgaacaatttattccgatgatggccgattgttcgccgctgctgctggaactgaacgaaaacgatccgggtattctggtgacgcagtccgttcacaaacaacaagccggtttctcccagacctcgcagatccataaaaaagatagccatatcaaagggcaatcgcgctacgttccgcataagcgcatgaacaacgcctttatgatgcacgcctccaccagcccgttctatccgctgttcgccgcgctggacgttaacgccaaaatgcacgaaggcgtcagcggtcgcaatatgtggatggattgcgtggttaacggcatcgatgcccgtaaattgatcctcgaaaactgtcatcacatccgtccgttcgtaccggaactgattgatggtaagccgtggcagtcatacccgacgtcagagatcgccagcgatctgcgcttcttccacttcgttccgggagaacactggcatgcgtttgaaggctatgccgaacatcagtactttgtcgacccttgcaaactgctgctcaccacaccgggcattaatgcagcgagcggcgaatatgaagactttggcgttcctgccacgatcctcgccaacttcctgcgcgagaacggcgttgtgccggaaaaatgcgacctcaactccattctgttcctgctgacgccggcagaagacatggcgaagttacaacagcttgtcgccctgctggctcgtttcgaaaaactgctggaagctgatgcgccgttagcggaagtattaccgtccatctacaaacagcatgaagcgcgttatgccggctataccctgcgtcagctttgccaggagatgcacgatctctatgcgcggcacaacgtgaaacagctgcaaaaagagatgttccgtaaatcgcatttcccgaaagtcagtatgaatccgcaagaggccaactatgcctatctgcgcggcgaggtcgaactggttcgcctgccggaagcggaaggtcgtatcgcggctgaaggcgctctgccttacccgccgggagtgctgtgtgtagttccgggtgaaatctggggcggttctgtcctgcgttacttcagcgccctggaagaagggatcaacctgctgccgggctttgcgcctgaactgcagggcgtttatatcgaagaacacgacggccgtaagcaggtctggtgctacgtcattaaacctcgtgacgcacagcgctccctgctgaaggaggaaaaattatga

SEQ ID NO: 1978 - protein, 732 aa, Salmonella typhimurium
MSELKIAVSRHCPDCFSTHRNIVNVDESRFIDVAAIVLSIDDIEHGKLDEIDATGYGIPVFVATHDEGRVPPEYLPRISGVFEYNESRTAFYGRQLETAASHYETQLRPPFFRALVDYVNQGNSAFDCPGHQGGEFFRRHPAGNQFVEYFGETLFRSDLCNADVAMGDLLIHEGAPCIAQQHAAKVFNADKTYFVLNGTSSSNKVVLNALLTPGDLVLFDRNNHKSNHHGALLQAGATPVYLETARNPYGFIGGIDAHCFEEDYLRELISEVAPQRAREARPFRLAVIQLGTYDGTIYNARQVVDKIGHLCDYILFDSAWVGYEQFIPMMADCSPLLLELNENDPGILVTQSVHKQQAGFSQTSQIHKKDSHIKGQSRYVPHKRMNNAFMMHASTSPFYPLFAALDVNAKMHEGVSGRNMWMDCVVNGIDARKLILENCHHIRPFVPELIDGKPWQSYPTSEIASDLRFFHFVPGEHWHAFEGYAEHQYFVDPCKLLLTTPGINAASGEYEDFGVPATILANFLRENGVVPEKCDLNSILFLLTPAEDMAKLQQLVALLARFEKLLEADAPLAEVLPSIYKQHEARYAGYTLRQLCQEMHDLYARHNVKQLQKEMFRKSHFPKVSMNPQEANYAYLRGEVELVRLPEAEGRIAAEGALPYPPGVLCVVPGEIWGGSVLRYFSALEEGINLLPGFAPELQGVYIEEHDGRKQVWCYVIKPRDAQRSLLKEEKL

SEQ ID NO: 1979 - DNA, 2142 bp, Salmonella typhimurium
  CDS (1)..(2142)
atgaacatcatcgccattatggggccgcacggggtttattataaagatgaacccatcaaggagcttgagcgtgcattacaatccctgggatttcaaattatctggccgcaaaatagcgttgacttgttgaagtttattgaacataacccgcgcatctgcggcgttatttttgactgggatgaatacagtctcgacctttgtagcgaaatcaaccagctaaatgaataccttcctctctacgcctttatcaataccaactccacgctggacgttagcgttcacgatatgcgcatggcgctgtggttttttgagtatgcattggggctggctgaagatatcgcgacgcgcattcatcaatatacaaacgaatatctcgataatattacgccgccgtttaccaaagcgctttttacctacgccaaagaaggaaaatataccttttgtacgccgggtcatatggcgggaacggcgtatcagaaaagcccgccaggctgcctgttttatgacttttttggcggcaataccttaaaagctgatgtgtcgatttcggtgactgaactgggatcgctgctggatcacaccgggccgcatctggaagcggaagagtatatcgcccgtacttttggcgccgagcagagctatatggtgacgaacggtacgtcgacctcgaataaaattgtcggtatgtatgccgcgcctgcgggaagtacgctacttattgatcgtaattgtcataaatcgctggcgcatttgctgatgatgagcgatgtggtgcctctctggttgaagccgacgcgcaatgcgctcggcattctcggcggtattccccgaagggaatttacccgtgcaagcatcgaaagcaagatagaggagacccctcaggcgcaatggccggtgcatgcggttatcaccaattcgacttacgatggtctgctgtataacactaactggatcaagcaaatgctggacgttccctcgatccattttgattccgcctgggtaccctatacccatttccatccgatctaccaggggaaaagcgggatgagcggcgatcgggtgcccggaaaagtgattttcgaaacgcaatccacccataaaatgctggcggctttttcgcaggcgtcgcttattcatatcaaaggggaatatgacgaagagacgtttaacgaagcgtttatgatgcacacttccacatcgccgagctatcccattgtcgcctctatcgagaccgcagcggcgatgctgcgcggcaatccagggaaaagattgattaatcgttcggtggaacgggcgctccattttcgtaaagaggtacagcggctacgtgaagagtccgatagctggttctttgatatctggcagccggaagaggttgatgaggccgaatgctggccggtcacgccgggagaaacctggcatggcttcaccgatgccgatgacgatcatatgttcctcgatccggttaaggtgacaatcctgacgccggggatggatgaacagggcaacatgagcgaagaggggatacccgccgcgctggtggcgaagttccttgatgagcgaggcgtggtggtggaaaaaaccgggccgtataatctgctgtttttgttcagcatagggattgataagacccgtgcgatggggctgctgcgcggactgacggaatttaaacgcgcctacgatcttaacctgcgcgtcaaaaatatgttgccggatctgtatgcggaagatccggatttttatcgcaatatgcgcattcaggatctggcgcaggggatccataaactgatccgccagcacgatcttccggggctgatgctgcgggcgttcgaggttttaccggagatgatcatgaccccgcaccaggcctggcagcgtcagatcaaaggtgaggtggaaaccgtggcgctcgatcaactgccagggcgcgtttccgcgaatatgatcctgccttatccgccaggcgttccgctgttgatgcccggcgagaggatcacgcaacagagtcgggccgtgctcgattttctgctgatgctctgctcgattggccagcattatcccggttttgaaacggatattcacggcgcgaaacggaatgaagacggggtgtaccaggtacgagtcttaaaacacgcctgctag

SEQ ID NO: 1980 - protein, 713 aa, Salmonella typhimurium
MNIIAIMGPHGVYYKDEPIKELERALQSLGFQIIWPQNSVDLLKFIEHNPRICGVIFDWDEYSLDLCSEINQLNEYLPLYAFINTNSTLDVSVHDMRMALWFFEYALGLAEDIATRIHQYTNEYLDNITPPFTKALFTYAKEGKYTFCTPGHMAGTAYQKSPPGCLFYDFFGGNTLKADVSISVTELGSLLDHTGPHLEAEEYIARTFGAEQSYMVTNGTSTSNKIVGMYAAPAGSTLLIDRNCHKSLAHLLMMSDVVPLWLKPTRNALGILGGIPRREFTRASIESKIEETPQAQWPVHAVITNSTYDGLLYNTNWIKQMLDVPSIHFDSAWVPYTHFHPIYQGKSGMSGDRVPGKVIFETQSTHKMLAAFSQASLIHIKGEYDEETFNEAFMMHTSTSPSYPIVASIETAAAMLRGNPGKRLINRSVERALHFRKEVQRLREESDSWFFDIWQPEEVDEAECWPVTPGETWHGFTDADDDHMFLDPVKVTILTPGMDEQGNMSEEGIPAALVAKFLDERGVVVEKTGPYNLLFLFSIGIDKTRAMGLLRGLTEFKRAYDLNLRVKNMLPDLYAEDPDFYRNMRIQDLAQGIHKLIRQHDLPGLMLRAFEVLPEMIMTPHQAWQRQIKGEVETVALDQLPGRVSANMILPYPPGVPLLMPGERITQQSRAVLDFLLMLCSIGQHYPGFETDIHGAKRNEDGVYQVRVLKHAC

SEQ ID NO: 1981 - DNA, 2136 bp, Vibrio vulnificus
  CDS (1)..(2136)
atgaatattttcgctatcttgaaccacatgggtgtgttctttaaagaagagccagttcgccaattgcatgcagcacttgaaaaagccggttatgaagttgtttatccagtggatgacaaagatttgatcaagatgatcgaaatgaacccgcgcatttgtggtgtgctgtttgactgggataaatactcgcttgagctttgtgagcgtattagccaaatcaacgaaaaactgccagtacacgcgtttgctaacgagcaatcaacgctggatatttcgcttaccgatctacgcctaaacgtgcatttctttgaatacgcattgggcatggcggacgacatcgccatcaagatcaaccaagcgacacaagaatacaaagacgcgattacaccgccattcaccaaagcgctgtttaaatacgtggaagaaggcaaatacaccttctgtactccaggtcacatgggtggtacggcttttcaaaaaagtccagtcggcagcattttctacgatttctacggtccaaatactttcaaagcggacgtgtcgatttctatgccagagctaggctcactgcttgaccattcaggtccacacaaagaagcggaagagtacattgcgcgtacgttcaacgctgacgcatcgtacatcgtgacgaacggtacttcgacgtcaaacaaaattgtcggcatgttctctgcgccagcgggcagcacggtattggttgaccgtaactgtcataaatcattgactcacctaatgatgatgacggacgtaacacctatttacttccgcccaacccgtaacgcttacggcattcttggtggtattccacaaagtgaattcagccgtgaagtgatcgcagaaaaagtggctaaaacaccaggtgcgagcgcgccaagctacgcggtgattaccaactcaacttacgatggtttgttgtacaacacacaattcatcaaagagtctctcgactgtaaacacatccactttgatagtgcgtgggtgccttacactaacttcaaccgtatttacgaaggcaaatgcggcatgagtggcgaagcgatgccaggcaaagtgttctacgaaacacaatccactcacaaactgttggcggcgttctcgcaagcgtcaatgattcacgtaaaaggtgaatttgaccgtgagtcgttcaacgaagcctttatgatgcacacttccacctcgcctcaatacggcattgtggcatcaacagaaaccgcggcggcaatgatgcgtggtaacacgggccgtaagttgatgcaagattcaatcgaccgtgcgattcgtttccgtaaagagatcaaacgcttaaaaggtgaaagtgacggttggttctttgatgtttggcaaccagagaacattgagacaaccgaatgctggaaacttgaccctaaccaagactggcatggcttcaagaacatggacgatgaccacatgtatcttgacccaatcaaaatcactttgctgactcctggaatgagcaaagatggtgagttggaaaccagtggtattcctgcttcattggtggcgaaatatcttgatgaacgtggcattgtggtagaaaaaacaggcccttacaacttgttgttcttgttctcaattggtatcgacaaatcaaaagcgatgcaattgctacgtggtttgactgagttcaaacgtggttacgatctgaacctaacgattcgcaccatgctgcctgcgctgtaccgtgaagatccagcgttctacgaaggcatgcgtattcaagagctggcacaaggcattcacgatctgactcgtaagtaccgtctaccagaattgatgtacaaagcgttcgatgtgctaccagagatgaaagtcacgccacacgcagcttggcaacaagagcttcgtggtcaaaccgaagagatcttgctgaatgatatggtgggccgcgtgagtgccaacatgatccttccttaccctccaggtgtgcctctagtgctaccaggtgaagtggtgacagaaagctctcgtccagtactggatttcttggaaatgttgtgtgaaatcggcgcacattacccaggcttcgagaccgacatccacggcctataccgccaaaaagatggccgttacaccgtaaaagtactgaaagactga

SEQ ID NO: 1982 - protein, 711 aa, Vibrio vulnificus
MNIFAILNHMGVFFKEEPVRQLHAALEKAGYEVVYPVDDKDLIKMIEMNPRICGVLFDWDKYSLELCERISQINEKLPVHAFANEQSTLDISLTDLRLNVHFFEYALGMADDIAIKINQATQEYKDAITPPFTKALFKYVEEGKYTFCTPGHMGGTAFQKSPVGSIFYDFYGPNTFKADVSISMPELGSLLDHSGPHKEAEEYIARTFNADASYIVTNGTSTSNKIVGMFSAPAGSTVLVDRNCHKSLTHLMMMTDVTPIYFRPTRNAYGILGGIPQSEFSREVIAEKVAKTPGASAPSYAVITNSTYDGLLYNTQFIKESLDCKHIHFDSAWVPYTNFNRIYEGKCGMSGEAMPGKVFYETQSTHKLLAAFSQASMIHVKGEFDRESFNEAFMMHTSTSPQYGIVASTETAAAMMRGNTGRKLMQDSIDRAIRFRKEIKRLKGESDGWFFDVWQPENIETTECWKLDPNQDWHGFKNMDDDHMYLDPIKITLLTPGMSKDGELETSGIPASLVAKYLDERGIVVEKTGPYNLLFLFSIGIDKSKAMQLLRGLTEFKRGYDLNLTIRTMLPALYREDPAFYEGMRIQELAQGIHDLTRKYRLPELMYKAFDVLPEMKVTPHAAWQQELRGQTEEILLNDMVGRVSANMILPYPPGVPLVLPGEVVTESSRPVLDFLEMLCEIGAHYPGFETDIHGLYRQKDGRYTVKVLKD

SEQ ID NO: 1983 - DNA, 2163 bp, Pasteurella multocida
  CDS (1)..(2163)
atgctaaatttaaaaattgcatatagcccattaattcgaccttattttcatacaaatagagaactcgtttctgttcaagaaacagatttcaccgacattggtgcaattatcctgagttctgaagatattgaagattatattgatagtatacaagcaactgaatttaatattccggtctttgttgctgtcattgaaggtcaatttttagatcctcaattctttgacaaagtctatcacgttcaagatctcaacaactacgacatcaacctatacagtcgccaaattgaaactgcggcgcggttttacgaagaaaaaatcctcccacctttctttaaaatgctaagtgaatatgtggaaatggggaattctgcttttgattgtccgggacaccaaggtggacaatatttccgtaaacatcctgcaggacgttatctctatgatttctacggtgaaaatattttccgctcagatatctgtaatgccgatgtaaaattaggcgatttgctaatccatgaaggagccgcttgtgatgctcaaaaacacgctgctcaagtctttaatgctgataaaacctacttcgtcttaaatgggacatcttctgcaaataaagtcgtcaccaatgcgttactcacaccgggtgatcttgtgctctttgatcgtaacaatcacaaatctatccatcacggtgcattaattcaagctggtgctacccctgtttatttggaaactgcgcgtaatccatttggttttatcggtgggatcgatagccattgttttgatgaagattatttgaaatctttaattaaagatgttgcgcctgaaaaactaacacaagcacgtcctttccgtttagccgttattcagctcggcacttatgacggaaccatctataatgcgcgccaagtcgtagataaaattggtcatttatgtgactacatcttgtttgattctgcgtgggtaggttatgaacaattcattccaatgatgaaagattgctcaccgctcttgcttgaattaaatgaaaatgatcccggcatcatcgtgacacaatcagtacacaaacaacaagccggcttctcacaagcctcacaaattcacaaaaaagacaagcacattaaaggtcaacagcgctactgtaatcataaacgctttaataatgcattcatgttacacgcctccaccagcccattctaccctctttttgccacacttgatgtcaatgcaaaaattcaaggtacccctgcgggtattcgtttatggcatgactgtgtcaaaatcgggatagaagcacgtaaaatggtgctgaatagttgtgatctgatcaaaccgtttattccgccttatgtcaatggcaaaaaatggcaagactacgatacagaagaaatggcaaatgatttaacattcttcaaattccatgctgatgataaatggcatcaatttgaaggctatgtagataaccaatattttgttgatccatgtaaattcatgctaacgacgccgggtattgatattgaaacaggtgaatacgaagacttcggtgtccctgctacgattcttgctaattatttacgtgaaaacggcattattccggaaaaatgtgacttaaactcaattctcttcttattaacgccagcagaaaccctcaccaaaatgcaaagtttggttgcacaaattgcggcatttgaacaacacatcaaaaaagattccttactaaaagaagtcttaccaagtgtttatcacaacaatgaaaaacgctatgaaggttataccatccgtcgtctttgccaagaaatgcatgatttgtatgtcagccgtaacgtgaaaactttacaacgcaacttattcagaaaagcgaccttgcctgaatatgtgatgaatccacatcaagctaatcttgaatttgttcgtaatcgtgtagaactggttccactaaccgaaatcgttaatcgcattgcggcagaaggagcacttccttatccaccgggtgtgctttgtgtcgtaccgggtgaaaaatggagtcagactgcacaggaatatttcttagcactcgaagaaggcattaatttattaccaggtttcgcaccagaaattcaaggggtatatctacaacaagatgcagatggacgtattcgtgcttatggctacgtattaactgaaaactaa

SEQ ID NO: 1984 - protein, 720 aa, Pasteurella multocida
MLNLKIAYSPLIRPYFHTNRELVSVQETDFTDIGAIILSSEDIEDYIDSIQATEFNIPVFVAVIEGQFLDPQFFDKVYHVQDLNNYDINLYSRQIETAARFYEEKILPPFFKMLSEYVEMGNSAFDCPGHQGGQYFRKHPAGRYLYDFYGENIFRSDICNADVKLGDLLIHEGAACDAQKHAAQVFNADKTYFVLNGTSSANKVVTNALLTPGDLVLFDRNNHKSIHHGALIQAGATPVYLETARNPFGFIGGIDSHCFDEDYLKSLIKDVAPEKLTQARPFRLAVIQLGTYDGTIYNARQVVDKIGHLCDYILFDSAWVGYEQFIPMMKDCSPLLLELNENDPGIIVTQSVHKQQAGFSQASQIHKKDKHIKGQQRYCNHKRFNNAFMLHASTSPFYPLFATLDVNAKIQGTPAGIRLWHDCVKIGIEARKMVLNSCDLIKPFIPPYVNGKKWQDYDTEEMANDLTFFKFHADDKWHQFEGYVDNQYFVDPCKFMLTTPGIDIETGEYEDFGVPATILANYLRENGIIPEKCDLNSILFLLTPAETLTKMQSLVAQIAAFEQHIKKDSLLKEVLPSVYHNNEKRYEGYTIRRLCQEMHDLYVSRNVKTLQRNLFRKATLPEYVMNPHQANLEFVRNRVELVPLTEIVNRIAAEGALPYPPGVLCVVPGEKWSQTAQEYFLALEEGINLLPGFAPEIQGVYLQQDADGRIRAYGYVLTEN

SEQ ID NO: 1985 - DNA, 2139 bp, Moritella japonica
  CDS (1)..(2139)
atgaacattattgctattttaaaccacatgggcgtgttctttaaagaagagcctattcgtcaattacacaaatcgttagaagcatgtggatatgaagttgtttatccgcttgatgataacgacctagttaaaatgattgaaatgaatccacgtatctgtggtgctatctttgattgggataaatattctttagaattatgtgaaaaaattaataacttaaatgagaaacttccagttttcgcatttgcaaatgaacaatcagtacttgatatttcactcacagaccttcgcttaaatgtgtctttctttgaatatatgctaggtatgggtgatgatattgctctaaaaatcaatcaagcaattgacctttataaagatgaaataatgcctccatttactaaagcattatttaaatatgtagaagaaggtaagtatactttctgtacgccgggtcacatgggtggtactgcattccagaaaagcccagcaggtagtattttttatgatttttatggaccgaatgcttttaaagcggatgtatcaatctctatgcctgaattaggttcattattggatcactctggtccacataaagaagctgaagagtacattgcaaaaacatttaacgcagatcattcatatattgtaaccaatggtacttctactgcgaataaaattgttggtatgttctctgcaccatctggcagtactgtattagtagaccgtaactgtcataagtcattaactcaccttatgatgatgagtgatgttacacctatctacttccgcccgacgcgtaatgcatacggtattttaggtggtatcccacaaagtgaattcactcgtgaagttattgaagctaaagttgcagcaacaccgggtgctgaaatgccagattatgcagttatcactaactctacttatgatggcctgctttataacacgcaatttattaaagaaacactagatactaagtctattcactttgatagtgcttgggtaccatatactaactttaattctatttatgaaggtaagtgtggtatgagtggtgaagctatgccaggcaaggtgttctatgaaacacaatctacgcataaacttttagctgcattctctcaagcatcaatgatccacattaaaggtgaggttgataaagaaacctttaatgaagcatttatgatgcatacatcaacgtcaccacagtatggtatcgtggcatcagcagaaactgctgcagcaatgatgcgtggcaatactggcaaacgtttaattcaaggctctattgatcgtgctatccgtttccgcaaagaaattaaacgcttagaagcacaaagtgaaggttggttctttgacgtttggcaacctgaagatatcgaaacaacagaatgttggaagttagatccaaaagacgattggcatggctttaaagatattgatgataatcatatgtatcttgatccaattaaagtgacactattaacaccgggaatggggaaagatagcgaacttagtgagtctggtattcctgcagaacttgttgctaaattccttgatgaacgtggtattgttgtcgaaaaaacaggcccatacaacttattattcttgttctcaattggtattgataaagcaaaagcactggaattactacgtggactaacagaatttaaacgtggcttcgatcttaatctgaaagttaagagtttcttaccatcattatatgctgaagatccaagtttctatgaaggtatgaatattcaagatcttgctcaaggtattcataatatgattaagaagtttaagctacctgagctgatgtttaaagcgtttgatgtacttcctgaaatgaaggtcacaccgaacaaagcatgggaacaagaacttcgtggtaacacggaagaagttaaactagaggaaatggtaaatcgtgtaagtgctaatatgatcttgccgtaccctcctggtgtgccactaatccttcctggtgaaatggtaacagatacatcacgtccggtacttgaatttttagaaatgctatgtgagatcggtagtaagttccctggttttgaaacagatattcatggcgtataccttcaagatgatggtagctataccgttaaagtacttaaagaagattag

SEQ ID NO: 1986 - protein, 712 aa, Moritella japonica
MNIIAILNHMGVFFKEEPIRQLHKSLEACGYEVVYPLDDNDLVKMIEMNPRICGAIFDWDKYSLELCEKINNLNEKLPVFAFANEQSVLDISLTDLRLNVSFFEYMLGMGDDIALKINQAIDLYKDEIMPPFTKALFKYVEEGKYTFCTPGHMGGTAFQKSPAGSIFYDFYGPNAFKADVSISMPELGSLLDHSGPHKEAEEYIAKTFNADHSYIVTNGTSTANKIVGMFSAPSGSTVLVDRNCHKSLTHLMMMSDVTPIYFRPTRNAYGILGGIPQSEFTREVIEAKVAATPGAEMPDYAVITNSTYDGLLYNTQFIKETLDTKSIHFDSAWVPYTNFNSIYEGKCGMSGEAMPGKVFYETQSTHKLLAAFSQASMIHIKGEVDKETFNEAFMMHTSTSPQYGIVASAETAAAMMRGNTGKRLIQGSIDRAIRFRKEIKRLEAQSEGWFFDVWQPEDIETTECWKLDPKDDWHGFKDIDDNHMYLDPIKVTLLTPGMGKDSELSESGIPAELVAKFLDERGIVVEKTGPYNLLFLFSIGIDKAKALELLRGLTEFKRGFDLNLKVKSFLPSLYAEDPSFYEGMNIQDLAQGIHNMIKKFKLPELMFKAFDVLPEMKVTPNKAWEQELRGNTEEVKLEEMVNRVSANMILPYPPGVPLILPGEMVTDTSRPVLEFLEMLCEIGSKFPGFETDIHGVYLQDDGSYTVKVLKED

SEQ ID NO: 1987 - DNA, 1479 bp, Streptomyces coelicolor
  CDS (1)..(1479)
atgacagtcgatcaccgccgagcaccggtcctggaagccctcgtcgaataccgccgtgcgggacggctgtcgttcacgccgcccggacacaagcaggcgcgcggggcggaccccgcggtgcgcgaggtgctgggtgacgccgtgttccacggggacgtgctggcgacggccggactcgacgaccggctcacccggggacgggtgctgcagcgcgcccaggagctgatggcggacgccgtgcacgccgatcacaccttcttcacgacgtgcgggagttccctgtcggtgaaggcggcgatgctggcggtggcggggccgcacgagaagctgctgatcggccgggacgcccacaagtccgtggtctcggggctgatcctgtccggcatcgagccggtgtgggtcgaaccgcgctgggacgcggaacggcatctggcccatccgccgtccgccgagtcgttcgaggaggcgttcggggcgcatcccgacgccaagggtgccctgatcaccagcccgacgccgtacggggcgagcgccgatctgcgggccgtcgccgaggtgtgccacgggcgctcgctgccgctgatcgtcgacgaggcttggggggcgcatctgcctttccacccggatctgccgtcctgggcgatggacgcgggggccgacatctgcgtgaccagcatccacaagatgggcagcggtctcgaacagggctcggtgttccacctgcgcggcgacctggtgccgcccaagctgctcggtatgcgcgccgacctgctgagcaccaccagcccgtcggtgctgatcttcgccggtctcgacgggtggcgccgccagatggcgctcggcgggcaggagctgatgggcggcgcgctggagctggcggccggtgtccgggcggccgtcgaggagatcgacggcatgcacgtcaacgaccgcgaggacttctgcggtcccgggctggcccacggcttcgatccgctgccggtcgtcatcgacctcgaagggctcggtgtctcgggcttccgggcggcggactggctgcgggagcaccgcggtgtggtcgcccacctcaccgaccaccgccgtatcggcgcgcagatcacccacggcgacgaccgggggaccgccggcgaactgctcaccgccctcaaggacctcgccctcgccgcccccggcctgggatcggctccgggcgtcgaggtgccgtcgccggccgagctgcggatgcctcaggtgtgcctgccccgggacgcgttcttcggccccaccgaggacgtgcccctggaccgggccgccggccgggtcgcggcggagatgatcactccgtatccgcccggcattccggccgtgctgccgggcgagcggctggccgagccggtcctgcgctatctgcgcagtggcctggaggcggggatgtacctccccgacccgaccgatccggcgctggagacggtcagggtcgtcgcggagcacggtgcgtga

SEQ ID NO: 1988 - protein, 492 aa, Streptomyces coelicolor
MTVDHRRAPVLEALVEYRRAGRLSFTPPGHKQARGADPAVREVLGDAVFHGDVLATAGLDDRLTRGRVLQRAQELMADAVHADHTFFTTCGSSLSVKAAMLAVAGPHEKLLIGRDAHKSVVSGLILSGIEPVWVEPRWDAERHLAHPPSAESFEEAFGAHPDAKGALITSPTPYGASADLRAVAEVCHGRSLPLIVDEAWGAHLPFHPDLPSWAMDAGADICVTSIHKMGSGLEQGSVFHLRGDLVPPKLLGMRADLLSTTSPSVLIFAGLDGWRRQMALGGQELMGGALELAAGVRAAVEEIDGMHVNDREDFCGPGLAHGFDPLPVVIDLEGLGVSGFRAADWLREHRGVVAHLTDHRRIGAQITHGDDRGTAGELLTALKDLALAAPGLGSAPGVEVPSPAELRMPQVCLPRDAFFGPTEDVPLDRAAGRVAAEMITPYPPGIPAVLPGERLAEPVLRYLRSGLEAGMYLPDPTDPALETVRVVAEHGA

SEQ ID NO: 1989 - DNA, 2130 bp, Eikenella corrodens
  CDS (1)..(2130)
atgaagaacatcttattaggctgtggtcataaggaacttggtgactatctgaagagcttgattgaaactttggaaaagggtggtcacaccatccgaatagcccatgacccgcaagaaatcctgacgttcctgaaacatgacgccagaataggctcagtgctttgtacactggatattttcaaccgagaattagacgaacaaattattgcactcaacgatgagctacccgtattcattctgaagcccaccgactgcgacaaacccgtggacttcggcgctgtaggcgaccatgccaccttcatcgattgccatctgttcagcaacgaagacgttgttgataaaattgaaaaagcaatctgtcactatatcgacaatatcaccccgcccttcactaaagccctgtttgactacgttgataaaaacaaatacacattctgtactccgggtcacatgagcggtaccgctttcttgaaatctcccgtaggtagcctgttctacgacttctacggtgaaaacacattcaaatcagatatttcagtttctatgggcgaattgggctctctgctcgaccactccggcccgcacaaagaggccgaagaatacatcgccgaaaccttcaatgccgaccacagctacatcgtaaccaacggtacttccaccgccaacaaaatcgtgggtatgtactccgttccggccggcagcaccgtactgatcgaccgtaactgccacaaatcattaacccacctgttgatgatgagcgacattactccggtgtatctgaaaccgacccgtaacgcctacggtatcttgggtggtattccgcaaaaagaattcaccaaagaagttattaccgaaaaacttaccaaagttccgggcgccacttggccggtacatgccgtgattaccaactccacttatgacggcctgttctacaacaccgacaagatcaaagacaccctggatgtgaaatccatccacttcgactctgcttgggttccctacaccaacttcagcccgatctacaacggcaaaaccggtatgggcggtaagcaggttaaagacaaggtaatctttgaaacccactctacccacaaactgctggccgcattctcacaggcttccatgattcacgttaagggtaacctgaacaccgccaccttcggcgaagcctacatgatgcacacctccacttctccgttctaccccatggtagcctctactgaagtggcagcagccatgatgcgcggcaactccggtaaacgcctgatgcaggattcactggaacgcgccgttaaattccgtaaggaaatcaagaaacacaaagcccatgccgactcatggtatttcgatgtatggcaacctgaaaatgttgacaacatcgaatgctgggaattgcatcagaccgacaaatggcacggcttcaaagacatcgacgcccagcacatgtacctcgacccgattaaggtaactctgcttaccccgggcttggataaaaacggcgagctggaaaaaaccggtatccccgccaacctcgtttccaaattcttggaagaccgcggcatcatcgtggagaaaaccggcccctacaacatcctcgtgctcttcagcatcggcgtggacgacaccaaagccctcagcctgctgcacgcattgaacgagttcaaatccctgtacgatgccaacgccaccgtagaagaagtattgccgcgcgtattcaacgaatcgccctctttctaccaagaaatgcggattcaagaattggcacaaggcatccacagcctgatctgcaaacacaacctgcctgaactgatgttcagcgcattcgaagtgttgccgaccatggtgatgaacccgcacaaagccttccagcttgagctgaaaggtcagattgaagactgctacttggaagacatggtaggcaagatcaacgccaacatgattctgccctatcctcccggcgtaccgttggtaatgcctggtgaaatgatcaccgaagaaagcaagcccatcttggaattcctgatgatgctgtgcgaaatcggcgcccacttccccggcttcgaaaccgacatccacggtgcttaccgtcaagaagacggccgctataaagttaagattgttaaagcttaa

SEQ ID NO: 1990 - protein, 709 aa, Eikenella corrodens
MKNILLGCGHKELGDYLKSLIETLEKGGHTIRIAHDPQEILTFLKHDARIGSVLCTLDIFNRELDEQIIALNDELPVFILKPTDCDKPVDFGAVGDHATFIDCHLFSNEDVVDKIEKAICHYIDNITPPFTKALFDYVDKNKYTFCTPGHMSGTAFLKSPVGSLFYDFYGENTFKSDISVSMGELGSLLDHSGPHKEAEEYIAETFNADHSYIVTNGTSTANKIVGMYSVPAGSTVLIDRNCHKSLTHLLMMSDITPVYLKPTRNAYGILGGIPQKEFTKEVITEKLTKVPGATWPVHAVITNSTYDGLFYNTDKIKDTLDVKSIHFDSAWVPYTNFSPIYNGKTGMGGKQVKDKVIFETHSTHKLLAAFSQASMIHVKGNLNTATFGEAYMMHTSTSPFYPMVASTEVAAAMMRGNSGKRLMQDSLERAVKFRKEIKKHKAHADSWYFDVWQPENVDNIECWELHQTDKWHGFKDIDAQHMYLDPIKVTLLTPGLDKNGELEKTGIPANLVSKFLEDRGIIVEKTGPYNILVLFSIGVDDTKALSLLHALNEFKSLYDANATVEEVLPRVFNESPSFYQEMRIQELAQGIHSLICKHNLPELMFSAFEVLPTMVMNPHKAFQLELKGQIEDCYLEDMVGKINANMILPYPPGVPLVMPGEMITEESKPILEFLMMLCEIGAHFPGFETDIHGAYRQEDGRYKVKIVKA

SEQ ID NO: 1991 - DNA, 2271 bp, Escherichia coli; identical to SEQ ID NO: 1859
  CDS (4)..(2271)

SEQ ID NO: 1992 - protein, 755 aa, Escherichia coli
MKVLIVESEFLHQDTWVGNAVERLADALSQQNVTVIKSTSFDDGFAILSSNEAIDCLMFSYQMEHPDEHQNVRQLIGKLHERQQNVPVFLLGDREKALAAMDRDLLELVDEFAWILEDTADFIAGRAVAAMTRYRQQLLPPLFSALMKYSDIHEYSWAAPGHQGGVGFTKTPAGRFYHDYYGENLFRTDMGIERTSLGSLLDHTGAFGESEKYAARVFGADRSWSVVVGTSGSNRTIMQACMTDNDVVVVDRNCHKSIEQGLMLTGAKPVYMVPSRNRYGIIGPIYPQEMQPETLQKKISESPLTKDKAGQKPSYCVVTNCTYDGVCYNAKEAQDLLEKTSDRLHFDEAWYGYARFNPIYADHYAMRGEPGDHNGPTVFATHSTHKLLNALSQASYIHVREGRGAINFSRFNQAYMMHATTSPLYAICASNDVAVSMMDGNSGLSLTQEVIDEAVDFRQAMARLYKEFTADGSWFFKPWNKEVVTDPQTGKTYDFADAPTKLLTTVQDCWVMHPGESWHGFKDIPDNWSMLDPIKVSILAPGMGEDGELEETGVPAALVTAWLGRHGIVPTRTTDFQIMFLFSMGVTRGKWGTLVNTLCSFKRHYDANTPLAQVMPELVEQYPDTYANMGIHDLGDTMFAWLKENNPGARLNEAYSGLPVAEVTPREAYNAIVDNNVELVSIENLPGRIAANSVIPYPPGIPMLLSGENFGDKNSPQVSYLRSLQSWDHHFPGFEHETEGTEIIDGIYHVMCVKA

SEQ ID NO: 1993 - DNA, 2196 bp, Lactobacillus sp
  CDS (1)..(2196)
atgagttcttctcttaaaattgcttcgactcaagaagcgcgtcaatatttcgatactgaccgcgttgttgtcgatgctgtaggctctgattttactgatgtcggtgctgttatcgcaatggattacgaaacagatgtcatcgacgctgctgatgcaactaagtttggtattcctgtttttgccgtaactaaggatgcccaagctatcagtgctgatgagctgaagaagattttccacatcattgatttggaaaacaaatttgatgctactgttaacgctcgtgaaatcgaaactgctgttaacaactacgaagacagcattttaccaccattcttcaagtcattgaaagaatacgttagccgtggtttaatccaattcgactgcccaggtcaccaaggtggtcaatactacagaaagcacccagctggtcgtgaattctacgacttcttcggcgaaactgtcttccgtgcagacttatgtaacgctgacgttgccttgggtgacttgctgatccacgaaggtcctgctgttgctgctgaaaagcatgctgcacgtgtttacaacgctgacaagacttacttcgttttaggtggttcttccaacgctaacaacactgtaacatctgctttagtttctaacggcgacttggtattgttcgaccggaacaaccacaagtccgtttacaactcagctttagctatggctggtggccgtcctgtttacctccaaacaaaccgtaacccatacggcttcatcggtggtatctacgacagcgacttcgatgaaaagaagatccgtgaactggcagctaaggttgacccagaacgtgctaagtggaagcgtccattccgtctggctgttatccaattaggtacttacgatggtactatctacaacgcacacgaagttgtaaagcgtatcggtcacctttgtgattacatcgaattcgactctgcttgggtaggttacgaacaattcattcctatgatgcgtaactcttcaccattattgattgatgaccttggtccagaagatcctggtatcattgttgttcaatcagttcacaagcaacaagccggcttctcacaaacttcacaaatccacaagaaggatagccacatcaagggtcaattacgttactgtgaccacaagcactttaacaactccttcaacttgttcatgtctacttcaccattctacccaatgtatgcagcattagacgttaacgctgctatgcaagaaggcgaagcaggtcgcaagttatggcatgaccttctgattactaccattgaagctcgtaagaagttgatcaaggctggctcaatgttccgtccattcgttccacctgttgttaacggcaagaagtgggaagatggcgacactgaagatatggctaacaacattgactactggcgctttgaaaagggtgctaagtggcatgcttacgaaggctacggcgacaaccaatactacgttgatccaaacaagttcatgttaactacacctggtatcaacccagaaactggtgactacgaagacttcggtgttccagctactatcgttgctaactacttacgtgaccacggtatcatccctgaaaagtctgacttgaactctatcttgttcttgatgactccagctgaaactccagctaagatgaacaacctgatcactcaacttcttcaattacaacgcttgatcgaagaagatgctccattgaagcaagttcttccttcaatctacgctgctaacgaagaacgttacaatggctacactatccgtgaactttgccaagaattgcacgacttctacaagaacaacaacacgttcacataccagaagcgtctcttcttacgtgaattcttcccagaacaaggtatgcttccatacgaagctcgtcaagaattcatccgcaaccacaacaagcttgttccattgaacaagatcgaaggcgaaatcgccctcgaaggtgctcttccataccctccaggagtattctgtgtagcaccaggtgaaaagtggtcagaaactgctgttaagtacttcactatcttacaagatggtatcaacaacttccctggattcgctccagaaatccaaggtgtatacttcaagcaagaaggcgacaaggttgttgcttacggtgaagtttacgatgcagaagttgctaagaacgatgatcgttacaacaactaa

SEQ ID NO: 1994 - protein, 731 aa, Lactobacillus sp; identical to SEQ ID NO: 1814

SEQ ID NO: 1995 - DNA, 1482 bp, Bacillus anthracis
  CDS (1)..(1482)
atgtatagattgtcccaatacgaaacaccattgtttaccgctttagttgagcacagtaagcgaaatccaattcaattccatattccaggtcataaaaaagggcaaggcatggatcctgaatttcgcgaatttattgggcataatgcattagcaattgatttaattaacattgcgccgctcgatgatttacatcatccaaaaggtatgattaaagaagcacaagatttagcagccgctgcatttggtgcggatcatactttcttttctattcaaggtacaagtggcgcaataatgacaatggtgatgagcgtttgcggtcctggtgacaaaatactagtgccacgaaacgtgcataaatcagtaatgtcagctattattttctcaggtgcaaaacctattttcatgcatcctgaaatcgatccaaaacttggtatttcacatggaatcacaatccaatctgtcaaaaaagcacttgaagagcactcagatgcgaaaggcttacttgttattaatccaacatactttggctttgctgcggacttagaacagattgtacaattagcacattcttacgatatccctgtactcgttgatgaggctcatggtgttcatattcattttcacgatgaactgccgatgtcagcgatgcaagccggtgcagatatggcagcaacgagtgttcacaaattaggtggatctttaacgcaaagctctattcttaatgtaaaagaaggccttgtgaacgtaaaacatgttcaatctattattagcatgcttacgactacatcaacgtcttacatcttgttagcctccctagatgttgctagaaaacgtcttgctacagaaggaaaggcgctcatagaacaaacaatacaattagcggaacaagttcgtaatgctataaatgatattgaacatctttactgtccagggaaagaaatgctaggtacggatgctacttttaactatgatcctacaaagataattgtatctgtaaaagatttaggtattacaggccatcaggctgaagtatggcttagagagcaatataacattgaagtagaactctcagatttatacaacatactatgtcttgtcacttttggagatacagaaagtgagacgaatacacttattgcagcattacaagatttatcagcaatatttaaaaataaagctgataaaggtgttcgaatacaagtagaaattccagaaatacctgtgttagcactttctcctcgagatgctttttattcggaaacagaagtcatcccatttgaaaatgcagcaggtcgtattatagctgatttcgttatggtttatccgccagggattccaatctttactccgggggaaattattacacaagacaacttagagtatattcgtaaaaacttagaagcaggtttacctgtacaaggtcctgaagatatgacattacaaacattacgcgtgatcaaagagtacaagcctatcagttga

SEQ ID NO: 1996 - protein, 493 aa, Bacillus anthracis
MYRLSQYETPLFTALVEHSKRNPIQFHIPGHKKGQGMDPEFREFIGHNALAIDLINIAPLDDLHHPKGMIKEAQDLAAAAFGADHTFFSIQGTSGAIMTMVMSVCGPGDKILVPRNVHKSVMSAIIFSGAKPIFMHPEIDPKLGISHGITIQSVKKALEEHSDAKGLLVINPTYFGFAADLEQIVQLAHSYDIPVLVDEAHGVHIHFHDELPMSAMQAGADMAATSVHKLGGSLTQSSILNVKEGLVNVKHVQSIISMLTTTSTSYILLASLDVARKRLATEGKALIEQTIQLAEQVRNAINDIEHLYCPGKEMLGTDATFNYDPTKIIVSVKDLGITGHQAEVWLREQYNIEVELSDLYNILCLVTFGDTESETNTLIAALQDLSAIFKNKADKGVRIQVEIPEIPVLALSPRDAFYSETEVIPFENAAGRIIADFVMVYPPGIPIFTPGEIITQDNLEYIRKNLEAGLPVQGPEDMTLQTLRVIKEYKPIS

SEQ ID NO: 1997 - DNA, 1383 bp, Bacillus cereus
  CDS (1)..(1383)
atgtcccaatacgaaacaccattgtttaccgctttagttgagcacagtaagcgaaatccaattcaattccatattcctggtcataaaaaaggacagggcatggatcctacatttcgcgaatttattgggcataatgcattagcaattgatttaattaatattgcgccactcgatgatttacatcatccaaaaggtatgattaaagaagcacaagatttagcagcagccgcattcggtgcagatcatactttcttttctattcaaggtacaagtggcgctattatgacaatggtgatgagcgtttgcggtcctggtgacaaaatcctagtaccacgaaacgtgcataaatcagtaatgtcagctattattttctcaggtgcaaaaccgattttcatgcatcctgaaatcgatccgaagctcggtatttctcatggaatcacaattcaatctgtaaaaaaagcacttgaagagcactcagatgcaaagggcttacttgttattaacccaacgtactttgggtttgctgcagacttagaacagattgtacaattagcacattcttatgacatccctgtactagtcgacgaagctcatggtgttcatattcattttcacgatgaattacctatgtcagcgatgcaagctggtgcggatatggcagcaacaagtgttcacaaattaggaggctctttaactcaaagttctattcttaatgtgaaagaaggcttagtgaatgtaaagcatgtccaatctattattagcatgcttacaaccacatcaacttcttacatcttgttagcatcccttgatgttgcgagaaaacgtcttgctacagaaggaacagcactcatagaacaaacaatacaattagctgagcatgttcgtgatgctataaattctattgagcatctttactgtcctggaaaagaaatgttaggtacagatgctacctttaactatgatcctacaaagataattgtatctgtaaaagatttaggtattaccggccaccaagctgaagtatggcttagagagcaatataacattgaagtagaactctcagatctatacaacatactatgtcttatcactttgggagatacagaaagtgatacaaatacacttattgcagcattacaagatttagcagcaacatttagaaatagggcagataaaggtgttcaagtacaagtagagattccagaaattccagtgctagcactttctcctcgagatgctttttattcggaaacagaagtcattccatttgaaaatgcagcggggcgtattatagctgattttgttatggtttatccgccagggattccaatctttactccggggggaaattattacacaagaaaacttagagtatattcgtaa

SEQ ID NO: 1998 - protein, 460 aa, Bacillus cereus
MSQYETPLFTALVEHSKRNPIQFHIPGHKKGQGMDPTFREFIGHNALAIDLINIAPLDDLHHPKGMIKEAQDLAAAAFGADHTFFSIQGTSGAIMTMVMSVCGPGDKILVPRNVHKSVMSAIIFSGAKPIFMHPEIDPKLGISHGITIQSVKKALEEHSDAKGLLVINPTYFGFAADLEQIVQLAHSYDIPVLVDEAHGVHIHFHDELPMSAMQAGADMAATSVHKLGGSLTQSSILNVKEGLVNVKHVQSIISMLTTTSTSYILLASLDVARKRLATEGTALIEQTIQLAEHVRDAINSIEHLYCPGKEMLGTDATFNYDPTKIIVSVKDLGITGHQAEVWLREQYNIEVELSDLYNILCLITLGDTESDTNTLIAALQDLAATFRNRADKGVQVQVEIPEIPVLALSPRDAFYSETEVIPFENAAGRIIADFVMVYPPGIPIFTPGGNYYTRKLRVYS

SEQ ID NO: 1999 - DNA, 20 bp, artificial sequence
  primer
atggggcagggttttccacc

SEQ ID NO: 2000 - DNA, 25 bp, artificial sequence
  primer
ttacttcaacacataaccgtacaac

SEQ ID NO: 2001 - DNA, 723 bp, Escherichia coli K12
  CDS (1)..(723)
atggtagcaaggcagcgcgcttgcagcgaccagatatgcagagggatgggtgatttattcagttgccaaacccgctggagtattgagataattttcagtctgactctcgcaatatcttatgaggtttcagttcatgtcctgcggcgctctctgagcgaagcgggtttatcattaacgaatagtcttagtagtaccgaaaaaatggcagagaaacgcaatatctttctggttgggcctatgggtgccggaaaaagcactattgggcgccagttagctcaacaactcaatatggaattttacgattccgatcaagagattgagaaacgaaccggagctgatgtgggctgggttttcgatttagaaggcgaagaaggcttccgcgatcgcgaagaaaaggtcatcaatgagttgaccgagaaacagggtattgtgctggctactggcggcggctctgtgaaatcccgtgaaacgcgtaaccgtctttccgctcgtggcgttgtcgtttatcttgaaacgaccatcgaaaagcaacttgcacgcacgcagcgtgataaaaaacgcccgttgctgcacgttgaaacaccgccgcgtgaagttctggaagcgttggccaatgaacgcaatccgctgtatgaagagattgccgacgtgaccattcgtactgatgatcaaagcgctaaagtggttgcaaaccagattattcacatgctggaaagcaactaa

SEQ ID NO: 2002 - protein, 240 aa, Escherichia coli K12
MVARQRACSDQICRGMGDLFSCQTRWSIEIIFSLTLAISYEVSVHVLRRSLSEAGLSLTNSLSSTEKMAEKRNIFLVGPMGAGKSTIGRQLAQQLNMEFYDSDQEIEKRTGADVGWVFDLEGEEGFRDREEKVINELTEKQGIVLATGGGSVKSRETRNRLSARGVVVYLETTIEKQLARTQRDKKRPLLHVETPPREVLEALANERNPLYEEIADVTIRTDDQSAKVVANQIIHMLESN

SEQ ID NO: 2003 - DNA, 507 bp, Aquifex aeolicus
  CDS (1)..(507)
atgaggatttaccttataggctttatgtgctccgggaaaagcacagttggttccctcctctcccgctctttaaacattcccttctatgacgttgacgaagaggtgcagaaaagggaaggactttcaatcccccaaatctttgaaaagaaaggggaagcttacttcagaaagcttgagtttgaagtcttaaaggatttatccgaaaaagaaaacgtagtcatttccacgggaggaggactcggggcaaacgaagaagcattaaactttatgaagagtagaggcacaaccgttttcatagatatcccctttgaggttttccttgaaaggtgtaaggactcaaaggagagaccccttttaaagagacctctcgatgagataaaaaacttatttgaagagaggagaaagatttattcaaaggcggacataaaggtgaagggggaaaaaccccccgaagaggttgtaaaggaaattttattatcccttgaagggaacgcccttggtgggtga

SEQ ID NO: 2004 - protein, 168 aa, Aquifex aeolicus
MRIYLIGFMCSGKSTVGSLLSRSLNIPFYDVDEEVQKREGLSIPQIFEKKGEAYFRKLEFEVLKDLSEKENVVISTGGGLGANEEALNFMKSRGTTVFIDIPFEVFLERCKDSKERPLLKRPLDEIKNLFEERRKIYSKADIKVKGEKPPEEVVKEILLSLEGNALGG

SEQ ID NO: 2005 - DNA, 717 bp, Deinococcus radiodurans
  CDS (1)..(717)
atgaccttttctgagctttcggaaagcgtccagcacgcactggacgaggtgctggcggcgccgccccggcccccggagggtgaggcaggcaccccgcttcagggggatgagggtagactgcctgttatgtttccgtccggcctgattgaacgccctgccaactgggtggcgctggcgggctttatgggcactggcaaaagccggatcggctgggagctgtcccgcgccctggcgctgcatttcgtggacaccgacaagctcatcacccgggtggtcggcaaaagcatccccgaggtgttcgcgcaggagggcgaaggctatttccgcgcctgcgagcgcgaggtggtgcagcgcgtgacccggcttgaccacgctgtgatcagcctcggcggcggcaccttcatccacgaggaaaaccgccgcctgctgctgtcgcgcggcccggtggtcgtgctgtgggccacccccgaaaccgtctaccagcgcaccaagcacagcgaccggcccctcctcaaggtcgaagaccccctctcgcgcattcgcaccctgatgaacgagcgcgaaggcgtctaccgccagggcaccattcacgttcacagcgacgggcgcccctccgaggagatcgtggaagaggtcgtcgaacggctctgggcctggcgcgacgcccaggcggcgtgggccgccctgcccccggactacgaccgtgcgacgagttga

SEQ ID NO: 2006 - protein, 238 aa, Deinococcus radiodurans
MTFSELSESVQHALDEVLAAPPRPPEGEAGTPLQGDEGRLPVMFPSGLIERPANWVALAGFMGTGKSRIGWELSRALALHFVDTDKLITRVVGKSIPEVFAQEGEGYFRACEREVVQRVTRLDHAVISLGGGTFIHEENRRLLLSRGPVVVLWATPETVYQRTKHSDRPLLKVEDPLSRIRTLMNEREGVYRQGTIHVHSDGRPSEEIVEEVVERLWAWRDAQAAWAALPPDYDRATS

SEQ ID NO: 2007 - DNA, 498 bp, Campylobacter jejuni
  CDS (1)..(498)
atgatgaaagctaaaaatatcgtttttataggatttatgggttctggaaaaagcactttagcaagagctttagctaaggatttagatcttgtttttttagatagtgattttttaatagaacaaaaatttaatcaaaaagtcagtgaaatttttgaacaaaaaagggaaaatttttttagagaacaagagcaaaaaatggctgatttttttagttcttgtgagaaagcttgtattgctacaggtgggggttttgttaatgtttcaaatttagaaaaagcaggtttttgtatttatttaaaagcagattttgaatatttaaaaaagcgtttagacaaagatgaaatttctaaaagacctttattttatgatgaaattaaagcaaaaaaattatataatgagcgtttaagcaagtatgaacaaaaggcaaattttattttaaatatagaaaataaaaatatagatgagcttttaagcgagattaaaaaggtgataaaatga

SEQ ID NO: 2008 - protein, 165 aa, Campylobacter jejuni
MMKAKNIVFIGFMGSGKSTLARALAKDLDLVFLDSDFLIEQKFNQKVSEIFEQKRENFFREQEQKMADFFSSCEKACIATGGGFVNVSNLEKAGFCIYLKADFEYLKKRLDKDEISKRPLFYDEIKAKKLYNERLSKYEQKANFILNIENKNIDELLSEIKKVIK

SEQ ID NO: 2009 - DNA, 546 bp, Salmonella enterica subsp. enterica serovar Typhi
  CDS (1)..(546)
atgatgcaacctctttatcttgttggcccgcggggctgtgggaaaaccaccatcggtatggcgctggcgcaggcaaccggttttcggtttgcagataccgaccgctggctgcaatcgcacgtgcagatgagcgtcgctgatatcgttgaaaaagaaggctggggagggttccgcgcccgggaaaccgcggccctggaggcggtaagcgcgccttcgactgtcgtggcgacgggaggcggtattattctcacggagtataaccgacgttatatgcaccgtgttggcgtagtgatttatctgtgcgcgccggtatccacgctggttaaccggcttgaggctgaacctgaagcggatctgcgcccgaccctcaccggcaagccgttgagcgaagaggttcgggaagtgcttgagcagcgtgacgcgttgtatcgcgaaacggcgcattacattattgacgcgacgaaagcgccggcccaggtcgtttctgaaattattgcggcgctgccgccgtcgacgcaacggttacagggagatgtctatacttaa

SEQ ID NO: 2010 - protein, 181 aa, Salmonella enterica subsp. enterica serovar Typhi
MMQPLYLVGPRGCGKTTIGMALAQATGFRFADTDRWLQSHVQMSVADIVEKEGWGGFRARETAALEAVSAPSTVVATGGGIILTEYNRRYMHRVGVVIYLCAPVSTLVNRLEAEPEADLRPTLTGKPLSEEVREVLEQRDALYRETAHYIIDATKAPAQVVSEIIAALPPSTQRLQGDVYT

SEQ ID NO: 2011 - DNA, 522 bp, Salmonella enterica subsp. enterica serovar Typhi
  CDS (1)..(522)
atggcagagaaacgcaatatctttctggttgggcctatgggtgccggaaaaagcactattgggcgccagttagctcaacaactcaatatggaattttacgattctgatcaagagattgagaaacgaaccggagctgatgtgggctgggtcttcgatgttgaaggtgaagacggcttccgtaatcgtgaagaaaaagttatcaacgaattgacggaaaaacagggtattgtgctggcaaccggcggtggctctgtaaaatcgcgtgaaacgcgtaaccgtctctccgcgcgtggcgtcgtggtctaccttgaaacgaccatcgaaaaacaactggcgcgcacgcagcgtgataaaaaacgcccgctgttgcaggttgaagcaccgcctcgcgaagttctggaagcgctggctaacgaacgcaatccgctgtacgaagagattgccgacgtcaccattcgcaccgacgatcaaagcgctaaggttgtggcaaaccagattattcatatgctggaaagcaactaa

SEQ ID NO: 2012 - protein, 173 aa, Salmonella enterica subsp. enterica serovar Typhi
MAEKRNIFLVGPMGAGKSTIGRQLAQQLNMEFYDSDQEIEKRTGADVGWVFDVEGEDGFRNREEKVINELTEKQGIVLATGGGSVKSRETRNRLSARGVVVYLETTIEKQLARTQRDKKRPLLQVEAPPREVLEALANERNPLYEEIADVTIRTDDQSAKVVANQIIHMLESN

SEQ ID NO: 2013 - DNA, 474 bp, Listeria innocua
  CDS (1)..(474)
atgggagctggaaaaacaacagtcggcaatatactcgcgaaattagctgatttgccttatattgatattgacgaagtaattattcgcgaacaaggaatgagtgtatctgaaatttttgcaaagtatggtgaacaagaattccgccgactagaacacgaaaaattaaaagaactagctaataccaaagccgttattgcaacaggcggtggcattgttctaaatcctgaaaatagaaaagtcttaaaaaatacatatccagttatttatttagaaaccgatccggaagtatttatgaaccgcttaaaaggtgatacaacacgcccgctagttcaacaaaagacacctgaagaaatccgagcaattttcgaaccgagaattgcccattatcaagattccgcagacttcattgtcaatacggacaaccgtaatcaacacgaagtcgctaaagccattttaaccatgctagataagtaa

SEQ ID NO: 2014 - protein, 157 aa, Listeria innocua
MGAGKTTVGNILAKLADLPYIDIDEVIIREQGMSVSEIFAKYGEQEFRRLEHEKLKELANTKAVIATGGGIVLNPENRKVLKNTYPVIYLETDPEVFMNRLKGDTTRPLVQQKTPEEIRAIFEPRIAHYQDSADFIVNTDNRNQHEVAKAILTMLDK

SEQ ID NO: 2015 - DNA, 474 bp, Listeria monocytogenes
  CDS (1)..(474)
atgggagctggaaaaacaacggttggaaatatactcgcaaacttagctgacttaccgtacatcgatattgacgaagtaattacaagcgaacaaggaatgagtgtatcggacatttttgctaaatatggtgaaaaagaattccgccgtctagaacatgaaaaattaaaagaattagcaacaaccaaagccgttatagcaacaggtggtggcattgttcttaatcctgaaaatagagaagttttaaaaaatacatatccggttatttatttagaaacggatcccgaagtatttatgaatcgcttaaaaggcgacaccactcgaccgctcgtacagcaaaaaacagccgaagaaattcgtgcaattttcgaaccaagaattgctcattatcaagattccgcagattttattgttaatacggataatcgtaatcaacaagaagttgctcaaactattttaaccatgttagataagtaa

SEQ ID NO: 2016 - protein, 157 aa, Listeria monocytogenes
MGAGKTTVGNILANLADLPYIDIDEVITSEQGMSVSDIFAKYGEKEFRRLEHEKLKELATTKAVIATGGGIVLNPENREVLKNTYPVIYLETDPEVFMNRLKGDTTRPLVQQKTAEEIRAIFEPRIAHYQDSADFIVNTDNRNQQEVAQTILTMLDK

SEQ ID NO: 2017 - DNA, 525 bp, Yersinia pestis
  CDS (1)..(525)
atgacacaaactatcttcatggtaggcgcgcgcggtgcgggtaagaccactattgggaaggcattggcgcaggcattggggtatcggtttgttgatacagatctatttatgcaacaaacctcacaaatgaccgtggctgaagttgttgagagtgaaggttgggatggttttcgtctacgtgaaagcatggcactacaggcagtaacggcacctaaaacagtcgttgccactggtggtggtgcggtactgtccagtgaaaaccgcgcattcatgcgtgatcatgggcgagtcatttatctgcgggcgtctgcagccgtattggcaaagcggctagcggaagatcctgaagaggctcagcggccaagtttaaccggtaaacccatcgttgaagaaatactggatgtgttggctagtcgtgaagcgttgtatcaggacgtcgcccatcatgtacttgatggaacgcaaaccccgtcactggttgtcgaacaaattttacagatgttgactggtgagatggtcaaataa

SEQ ID NO: 2018 - protein, 174 aa, Yersinia pestis
MTQTIFMVGARGAGKTTIGKALAQALGYRFVDTDLFMQQTSQMTVAEVVESEGWDGFRLRESMALQAVTAPKTVVATGGGAVLSSENRAFMRDHGRVIYLRASAAVLAKRLAEDPEEAQRPSLTGKPIVEEILDVLASREALYQDVAHHVLDGTQTPSLVVEQILQMLTGEMVK

SEQ ID NO: 2019 - DNA, 546 bp, Nostoc sp. PCC 7120
  CDS (1)..(546)
atgagtagtttattgcagggagttaacctatacttaatcggcatgatgggcgctggtaagactacagtaggacatttactcgccaaagaattgggttatggctttttagatactgataatgtgattgcccaagctactaaaaaatctatcaatgagatatttgccgaagcaggggaagccggatttcgccagatagaaagcgatgtgttagcccaggtttgttcctatactaagttgactgtagcgacaggtggcggcattgtgttgcggcgagaaaattggagttacctacaccacggtttaattttgtggctagatgtgccagtagatatactctatgcacgtttagcggcagatacaacaagaccacttttacaggatgatgacccaaaaggcaaattgcgatcgctcctggaacaacgcacaccgctttattcgcaagcagatttacgcatctgtgtcaatgcagaagaaacaccagaacaaattgccaataaagttatgcaggcaattcccagcgtcttgaaacaaactgcctctaattag

SEQ ID NO: 2020 - protein, 181 aa, Nostoc sp. PCC 7120
MSSLLQGVNLYLIGMMGAGKTTVGHLLAKELGYGFLDTDNVIAQATKKSINEIFAEAGEAGFRQIESDVLAQVCSYTKLTVATGGGIVLRRENWSYLHHGLILWLDVPVDILYARLAADTTRPLLQDDDPKGKLRSLLEQRTPLYSQADLRICVNAEETPEQIANKVMQAIPSVLKQTASN

SEQ ID NO: 2021 - DNA, 1479 bp, Thermotoga maritima
  CDS (1)..(1479)
atgagaatcttcctcgttggaatgatgggttctggaaagagcactatcggtaaaaggatttccgaggtgctcgaccttcagttcatagatatggatgaagagatagaaagaagagagggaagaagcgttcgaaggattttcgaagaagacggtgaggagtacttccgcctgaaagaaaaagaacttcttaaagaacttgtggaaagagacaacgtggttgtggcaacgggtggaggtgttgtggtcgatccagagaacagagagcttttgaagaaggaaaagactctctttctctacgctccccctgaagtgttgatggaaagagtaacaacagagaacagacctcttctgagcgaaggaaaagagagaatacgggagatctgggaaaagagaaaacagttctacgcggagttcagaaggatcgacacctccaggttgaacgagtgggaaacaaccgcactcgttgtgctggaggctctggacgagaaagaaatctcaacgatagaaaaaccacacctggtgaagatcatcctcggtggcttcaagagggtgagaaacgaagagctggttttcaccacggagagggtggagaagatatacggaaggtacctcccggagaatcggcttctttttccggatggagaggaagtgaagacgctggagcatgtctccagagcgtactacgaactcatccgaatggactttcccaggggaaagaccatagcgggtgtcgggggaggtgctctcaccgacttcaccggctttgtagcgagcacgtttaaaagaggagtgggactttctttctatccaacaacacttctggctcaggtggacgcttccgttggtggaaagaatgccatcgatttcgctggagtgaaaaacgtcgttgggactttcagaatgccagactacgtgatcatagatcccaccgtcacgctttccatggatgagggcaggttcgaagagggagtcgtggaagccttcaagatgacgattctttcgggtcgcggggtagaactcttcgatgagccggagaagattgagaagagaaatctcagagttctcagcgagatggtaaaaatctccgttgaagagaaagcgaggatagtgatggaagatccctacgacatgggtttgaggcacgccctgaatctgggacacacactcggtcatgtgtacgagatgctggaaggggtacctcacggtatagcagtagcatggggcatcgaaaaagagacgatgtacctgtacagaaaaggaatagtgcctaaggaaaccatgagatggatcgtagaaaaggtcaaacagatcgtaccaattcctgttccatccgtcgatgttgagaaagccagaaatctcattctgaacgacaagaagatcctgaaaggttccagagtcaggcttccttacgtgaaagaaatcggaaagatcgaattcttggaggtcgatccgctcgagcttctggaggtggtagattga

SEQ ID NO: 2022 - protein, 492 aa, Thermotoga maritima
MRIFLVGMMGSGKSTIGKRISEVLDLQFIDMDEEIERREGRSVRRIFEEDGEEYFRLKEKELLKELVERDNVVVATGGGVVVDPENRELLKKEKTLFLYAPPEVLMERVTTENRPLLSEGKERIREIWEKRKQFYAEFRRIDTSRLNEWETTALVVLEALDEKEISTIEKPHLVKIILGGFKRVRNEELVFTTERVEKIYGRYLPENRLLFPDGEEVKTLEHVSRAYYELIRMDFPRGKTIAGVGGGALTDFTGFVASTFKRGVGLSFYPTTLLAQVDASVGGKNAIDFAGVKNVVGTFRMPDYVIIDPTVTLSMDEGRFEEGVVEAFKMTILSGRGVELFDEPEKIEKRNLRVLSEMVKISVEEKARIVMEDPYDMGLRHALNLGHTLGHVYEMLEGVPHGIAVAWGIEKETMYLYRKGIVPKETMRWIVEKVKQIVPIPVPSVDVEKARNLILNDKKILKGSRVRLPYVKEIGKIEFLEVDPLELLEVVD

SEQ ID NO: 2023 - DNA, 525 bp, Vibrio cholerae
  CDS (1)..(525)
atggctgagaaacgcaatattttccttgttggccctatgggcgctggcaaaagcacaattggtagacacctagctcaacaactgcacatggagtttatcgactctgatacggttatcgaagaacgtaccggagcggatatcgcatgggtgtttgatgttgaaggtgaagaaggcttccgcaagcgcgaagaagccgttattaatgatctaaccgagcaacagggtatcgtactggcgacgggtggtggctcagtaattagtaaagagaaccgcaaccgactgtctgctcgcggtatcgttgtatacctcgaaactactatcgaaaaacaattagcacgtaccaatcgcgataaaaagcgcccactgctgcaaacggattgcccgcgtgaagtgctagagcaattggctgaagatcgtaatcctctgtacgaagagattgcggacatcacggtacgcactgacgatcaaagtgcaaaagtggtagccaatcagatcgtaaaaatgctagaagaacacataatgtaa

SEQ ID NO: 2024 - protein, 174 aa, Vibrio cholerae
MAEKRNIFLVGPMGAGKSTIGRHLAQQLHMEFIDSDTVIEERTGADIAWVFDVEGEEGFRKREEAVINDLTEQQGIVLATGGGSVISKENRNRLSARGIVVYLETTIEKQLARTNRDKKRPLLQTDCPREVLEQLAEDRNPLYEEIADITVRTDDQSAKVVANQIVKMLEEHIM

SEQ ID NO: 2025 - DNA, 531 bp, Chlamydophila pneumoniae, Chlamydia pneumoniae
  CDS (1)..(531)
atgacaattattctatgtggtctacccacaagcggaaagtcttcgctcgggaaagctttggctaaatttctaaaccttcctttttatgatcttgatgatttaattgtaagcaactacagcagtgcactatactcctcatctgcagagatctataaagcttatggggatcagaaattcagtgaatgtgaagctcgtattcttgaaactttacctccagaagatgccttgatctcccttggtggagggaccttgatgtatgaagcctcttaccgagcgattcaaactaggggagctcttgtatttctctctgtagaactacctttaatttatgaaagactcgagaaacgagggttaccagaacggctgaaagaagccatgaaaacaaaacctctaagcgagattttaactgagcgcatcgacagaatgaaagaaattgctgattacatttttcccgtggatcacgtagatcattcctcgaagagctccttagatcaagcgtctcaagatctcattaccttgttaaagtcatga

SEQ ID NO: 2026 - protein, 176 aa, Chlamydophila pneumoniae, Chlamydia pneumoniae
MTIILCGLPTSGKSSLGKALAKFLNLPFYDLDDLIVSNYSSALYSSSAEIYKAYGDQKFSECEARILETLPPEDALISLGGGTLMYEASYRAIQTRGALVFLSVELPLIYERLEKRGLPERLKEAMKTKPLSEILTERIDRMKEIADYIFPVDHVDHSSKSSLDQASQDLITLLKS

SEQ ID NO: 2027 - DNA, 477 bp, Streptococcus pneumoniae
  CDS (1)..(477)
atggctaaggtgttattagggtttatgggggctggaaaatcgactattgcaagaggcttggaccctaattaccttgatatggatgctctgattgagaatcgcctaggtatgtccattgcgaattttttcgctgaaaagggagaaacagcctttcgtcaggtagaatcagaagtcctagctgatttactacaaacagaccaagtcgtgtcaactggaggaggagtggttatttctcagagaaatcgtgacttactcaagactaatacagataacatctacctgagagcagattttgaaaccctctaccaacgtatcgcagctgataaggacaatcagcgaccgctttttctaaataatagcaaggaagaactagtagctattttccaagaaagacaggcttggtatgaggaagtggctagtcgggttttggatgtgaccaagctaagcccagaggaaattatagaggaactaagatga

SEQ ID NO: 2028 - protein, 158 aa, Streptococcus pneumoniae
MAKVLLGFMGAGKSTIARGLDPNYLDMDALIENRLGMSIANFFAEKGETAFRQVESEVLADLLQTDQVVSTGGGVVISQRNRDLLKTNTDNIYLRADFETLYQRIAADKDNQRPLFLNNSKEELVAIFQERQAWYEEVASRVLDVTKLSPEEIIEELR

SEQ ID NO: 2029 - DNA, 477 bp, Streptococcus pneumoniae
  CDS (1)..(477)
atggctaaggtgttattagggtttatgggggctggaaaatcgactattgcaagaggcttggaccctaattaccttgatatggatgctctgattgagaagcgcctaggtatgtccattgcgaattttttcgctgaaaagggagaagcagcctttcgtcaggtagaatcagaagtcctagctgatttactacaaacagaccaagtcgtgtcaactggaggaggagtggttatttctcagagaaatcgtgacttactcaagactaatacagataacatctacctgaaagcagattttgaaaccctctacctacgtatcgtagctgataaggacaatcagcgaccgctttttctaaataatagcaaggaagaactagtagctattttccaagaaagacaggcttggtatgaggaagtggctagtcgggttttggatgtgaccaagctaagcccagaggaaattatagaggaactaagatga

SEQ ID NO: 2030 - protein, 158 aa, Streptococcus pneumoniae
MAKVLLGFMGAGKSTIARGLDPNYLDMDALIEKRLGMSIANFFAEKGEAAFRQVESEVLADLLQTDQVVSTGGGVVISQRNRDLLKTNTDNIYLKADFETLYLRIVADKDNQRPLFLNNSKEELVAIFQERQAWYEEVASRVLDVTKLSPEEIIEELR

SEQ ID NO: 2031 - DNA, 543 bp, Xylella fastidiosa
  CDS (1)..(543)
atgaatcccgctcccaatcttgtgatgatcggcccgatgggtgccggaaaaagctccatcggacgacgcattgccaaacacttcagcctacacttcgcagatacagatcacgccatcgttgaacgcgccggcacgaacatctccgctatcttcaaatattccggcgagccagaatttcggcgcctggagcgcgaagtactgcacgacttgctgaatcacgaaaaccaactcatcgccaccggtggcggtacgatcctggatccagagaaccgccgctgcatgcaagaacgcggcttcgtcgtgtttctaaagatcaacgtgaatacccaattggagcgactggcacatgaccgctaccggccattactgcaacaaatcgaccgcaaacaggtgctgagcgatctctacgccacacgccaaccgctctaccagcaaatcgcagatatgattgtgaccaccgaccacatgtcgcctaacacagccaccgcccagctcattctggacttaacagcccactggcagaaatcaagcaacgccgcatga

SEQ ID NO: 2032 - protein, 180 aa, Xylella fastidiosa
MNPAPNLVMIGPMGAGKSSIGRRIAKHFSLHFADTDHAIVERAGTNISAIFKYSGEPEFRRLEREVLHDLLNHENQLIATGGGTILDPENRRCMQERGFVVFLKINVNTQLERLAHDRYRPLLQQIDRKQVLSDLYATRQPLYQQIADMIVTTDHMSPNTATAQLILDLTAHWQKSSNAA

SEQ ID NO: 2033 - DNA, 552 bp, Bacillus halodurans
  CDS (1)..(552)
atgaagcgaattccatcgattagagagcggaacattgtgttgattggttttatgggggtagggaaaacatccgttggggaacagctggctaagcggttatttcgtgattttattgacgtcgatcaggaaattgaaaaaacatggaaaatgaagatttccgatatttttcgcttgaagggtgaagaagcgttccgtaaaattgaacgggaaatgacaattgattattgtacgaatacatcacttaaagtgatctcgttaggcggcggcgcctacatgcaagatgcgattcgcactgcgtgtctcgaccattgcatcgtcatttatttagatttgtcttggtccttatggaaggaacggttaaatgtattaatagacaatcgccccgttctacaagacaaaaaagtagaagaaatggaacagctctttacgaagcggcaaccgacctatcaaaagaatagctttcaagtagaaacagatggccgagaggtagcagagatagtatcctatctagaagaagtgatcaagttagggtgggaaatttacggatcataa

SEQ ID NO: 2034 - protein, 183 aa, Bacillus halodurans
MKRIPSIRERNIVLIGFMGVGKTSVGEQLAKRLFRDFIDVDQEIEKTWKMKISDIFRLKGEEAFRKIEREMTIDYCTNTSLKVISLGGGAYMQDAIRTACLDHCIVIYLDLSWSLWKERLNVLIDNRPVLQDKKVEEMEQLFTKRQPTYQKNSFQVETDGREVAEIVSYLEEVIKLGWEIYGS

SEQ ID NO: 2035 - DNA, 489 bp, Helicobacter pylori
  CDS (1)..(489)
atgcagcatttagtcttaatcggttttatggggagcggtaaaagctctttagcgcaagaattggggctagctttgaaattagaagtgttggatacggatatgatcattagcgagagggtgggcttgagcgtgagggagatttttgaagagcttggcgaagacaatttcaggatgtttgaaaaaaatttgattgatgaattaaaaacgctcaaaaccccccatgttatttctaccggtgggggcattgtgatgcatgaaaatcttaagggtttaggcacaactttttatctcaaaatggattttgagaccttgattaagcgtttgaatcaaaaagaaagggaaaaacgcccccttttaaataacctcactcaagccaaagagctttttgaaaaacgccaagccctctatgaaaaaaacgcctcctttatcattgacgccagaggtggtttaaataattctttaaaacaagtgctacaattcatcgcataa

SEQ ID NO: 2036 - protein, 162 aa, Helicobacter pylori
MQHLVLIGFMGSGKSSLAQELGLALKLEVLDTDMIISERVGLSVREIFEELGEDNFRMFEKNLIDELKTLKTPHVISTGGGIVMHENLKGLGTTFYLKMDFETLIKRLNQKEREKRPLLNNLTQAKELFEKRQALYEKNASFIIDARGGLNNSLKQVLQFIA

SEQ ID NO: 2037 - DNA, 600 bp, Mycobacterium leprae
  CDS (1)..(600)
atggcacccaaggcagtactcgtgggtctgccaggagccggcaagtccaccatcgggcggcgactgtccaaggcgctaggggtgagcttgctcgataccgacgctgctattgagaagcagaccggtcgcagcatcgctgacatctttgccatcgacggggaagaagagttccgccgcatcgaagagggcgtggtgcgggctgctttagtcgagcatgacggtgtggtgtcgcttggcggcggtgctgtcactagcccaggggtatgcgcggcgctcgctggccacattgtcatctatctggagatcaacgccgaagaagcaatgcggcgtgcctgtggcagtaccgtgcgaccgttgctggccgggcccgaccgtgctgaaaaattccaggatctgatggccagacgggttcctctttaccggcgagttgcgactatccgggttgataccaactgccacaatctgggggcggtagtccgctacatcatggcccggttgcaggctcaactagccactcctgtctctggtggtgatcgcaagagtagcgaagccgagcgtagtggggcgccacttcgcaaatctagtgaggtcgtcaaatga

SEQ ID NO: 2038 - protein, 199 aa, Mycobacterium leprae
MAPKAVLVGLPGAGKSTIGRRLSKALGVSLLDTDAAIEKQTGRSIADIFAIDGEEEFRRIEEGVVRAALVEHDGVVSLGGGAVTSPGVCAALAGHIVIYLEINAEEAMRRACGSTVRPLLAGPDRAEKFQDLMARRVPLYRRVATIRVDTNCHNLGAVVRYIMARLQAQLATPVSGGDRKSSEAERSGAPLRKSSEVVK

SEQ ID NO: 2039 - DNA, 543 bp, Haemophilus influenzae
  CDS (1)..(543)
atggcggaaaaacgtaatatttttttagtaggaccaatgggtgcaggtaaaagtactatcggtcgtcaattagcacaacagcttaatatggattttattgattccgatgcagtgattgaagaacgtacgggcgcggatattagctggatttttgatttggaaggcgaagacggcttccgaaaacgtgaagaacgcattattaacgaactcacacaaatgcaaggtattgtactttcaactggtgggggagcagtgctttctaaggaaaaccgtaattatttatcagcacgtggtattgtgatttatttagaaacaacggtggaaaaacaattccaacgcactcaacgtgataaaaaacgtccattgctccaagatgcagagaatcctcgtcaagtattggaagatttagcaaaaattcgcaatccgctttatgaagaaattgcggacatcactttgccaaccgatgaacaaaatgccaaaataatggtaaatcaaattgttgatttaattgataatatgaatgggttgaatggtgcactttaa

SEQ ID NO: 2040 - protein, 180 aa, Haemophilus influenzae
MAEKRNIFLVGPMGAGKSTIGRQLAQQLNMDFIDSDAVIEERTGADISWIFDLEGEDGFRKREERIINELTQMQGIVLSTGGGAVLSKENRNYLSARGIVIYLETTVEKQFQRTQRDKKRPLLQDAENPRQVLEDLAKIRNPLYEEIADITLPTDEQNAKIMVNQIVDLIDNMNGLNGAL

SEQ ID NO: 2041 - DNA, 513 bp, Neisseria meningitidis
  CDS (1)..(513)
atgaaaaactttaacggcaaactcatcctcatcggactgatgggcgcgggcaaaaccacgctgggccggcaaatggcgcagcggctggattaccgtttttacgacagcgatcacgaaatcgccgcagccgccggcgttcccatccccaccatatttgaaatggaaggcgaacagggattccgttcgcgcgaaaccgccatactcaaaaagctggttatcctgccccatatcgtcctgtccaccggcggcggcgcggtgttaaaagaagaaaaccgcgcccttatccgcaaaagcggcacggtcgtctatctgcacgccccgcccgaaaccctgctcgaacgcacgcgctgcgacaacagccgtcctttgctgcaagttgccgatcctttggcgaaattacgtgaactctacgccgcacgcgaccccgtttaccgccaaaccgccgactttaccgtagaatcggcaaactgccgggaaaccgtgcaaaccctgctcaaacgcttatcccgataa

SEQ ID NO: 2042 - protein, 170 aa, Neisseria meningitidis
MKNFNGKLILIGLMGAGKTTLGRQMAQRLDYRFYDSDHEIAAAAGVPIPTIFEMEGEQGFRSRETAILKKLVILPHIVLSTGGGAVLKEENRALIRKSGTVVYLHAPPETLLERTRCDNSRPLLQVADPLAKLRELYAARDPVYRQTADFTVESANCRETVQTLLKRLSR

SEQ ID NO: 2043 - DNA, 603 bp, Caulobacter crescentus
  CDS (1)..(603)
atgaccgagaccgatcaaacgcccgacaccgccccagaggccgccccagaggtcgcgcccatcgtctccgacgacctggcgccgctgcgcgccaagaccatcgtgctggtgggcctgatgggcgtgggcaagtccagcgtcgggcggcggctggccaatgtgctgggcctgccgttccgcgacgccgacaatgaggtcgaggccgccgccggacgctcgatctccgagatcttcgccgagctgggtgagccggccttccgcgacggcgagcgccgggtgatcgcccggctgctggacgagccgccgcacgtgctggccaccggcggcggcgcgttcgtcaacgccgagacccgcgccctgatcaacgagaaggccgtgtcggtctggctgaaggccgatgtcgagctcctggcccgccgcgtctcgcgcaaggacaaccgcccgctggtgcgcggcaaggacccggtgaaggtgctgaccgagctcgccgaagcccgctatccggcctatgccgaggcgcaagtccatgtcgagaccggcgacaccccccacatggtggcggtcgaggccattctgacggcgctgcgtcaggcccacgcttaa

SEQ ID NO: 2044 - protein, 200 aa, Caulobacter crescentus
MTETDQTPDTAPEAAPEVAPIVSDDLAPLRAKTIVLVGLMGVGKSSVGRRLANVLGLPFRDADNEVEAAAGRSISEIFAELGEPAFRDGERRVIARLLDEPPHVLATGGGAFVNAETRALINEKAVSVWLKADVELLARRVSRKDNRPLVRGKDPVKVLTELAEARYPAYAEAQVHVETGDTPHMVAVEAILTALRQAHA

SEQ ID NO: 2045 - DNA, 531 bp, Mycobacterium tuberculosis
  CDS (1)..(531)
atggcacccaaagcggttctcgtcggcctgccgggctccggcaagtccaccatcgggcgccggctggccaaggcgctcggggtcggcctgctcgacaccgacgtcgcgatcgagcagcggaccggacgcagcatcgccgacatcttcgccaccgacggggagcaggagttccgacgtatcgaggaggacgtggtgcgcgcggcactggccgaccacgacggtgtgctgtcgctcggcggcggcgcggtgaccagccccggtgtgcgcgcggcgctggccggccacaccgtcgtctacctggagatcagcgccgccgagggcgtgcgccgcaccggcggcaacaccgtgcgcccactgctggccggccccgaccgcgccgaaaaataccgcgcgctgatggccaagcgggcaccgctgtaccggcgcgtcgcgaccatgcgagtggacaccaatcgccgcaaccccggggcggtggtccgccatatcctgtcgcggctgcaggttcccagccccagcgaggcggccacatga

SEQ ID NO: 2046 - protein, 176 aa, Mycobacterium tuberculosis
MAPKAVLVGLPGSGKSTIGRRLAKALGVGLLDTDVAIEQRTGRSIADIFATDGEQEFRRIEEDVVRAALADHDGVLSLGGGAVTSPGVRAALAGHTVVYLEISAAEGVRRTGGNTVRPLLAGPDRAEKYRALMAKRAPLYRRVATMRVDTNRRNPGAVVRHILSRLQVPSPSEAAT

SEQ ID NO: 2047 - DNA, 489 bp, Lactococcus lactis subsp. lactis
  CDS (1)..(489)
atgagtatcattttaattggatttatgggtgcgggaaagtccacagtagcaaaacttttaacagaaaattttactgatttggatcaattaattgaagaagaaattgagatgacaattgctgaattttttgaattatttggggaagctgattttcgtaaaattgaaaatgaggtttttgaacttgcgctgcaaaagaatataattattgcaacgggtggtggaataattgaaaatccaaagaatttagaggctcttgatagagaagctggagttgtctttttgaccgctgattttgaaacgctttgggaacgaatttcgatggatttgcagaatgttcgtcctctagcgcaggataaaaaggccgctcaacttttatttgaaaaaagaaaaaatgactatgcaaaagtggccgatttaacgattgatgttactgataagagtcctgagcaaattgtagaagagattcgtgaaaaatgggggataaattaa

SEQ ID NO: 2048 - protein, 162 aa, Lactococcus lactis subsp. lactis
MSIILIGFMGAGKSTVAKLLTENFTDLDQLIEEEIEMTIAEFFELFGEADFRKIENEVFELALQKNIIIATGGGIIENPKNLEALDREAGVVFLTADFETLWERISMDLQNVRPLAQDKKAAQLLFEKRKNDYAKVADLTIDVTDKSPEQIVEEIREKWGIN

SEQ ID NO: 2049 - DNA, 498 bp, Clostridium acetobutylicum
  CDS (1)..(498)
atgaatttagtacttataggtatgcctggatgcggtaagagtacaataggtaaaattttatcaaaagagctaaatatgaaattttatgatgctgataaatatctagaagatagaaataatatgaagatttccgatatgtttaaaagaggagaagaattttttagaaatttagaaagtgcagccctaaaagaacttagttttgaggagaactccgttatagcaacaggaggaggcgcagtaacaagggaaaaaaatatactttgtttaaagaaaaaaggaaagatagtatttataaataggccgccagaaaagataatggaagatgttgatattgaaaatagacctcttttagaacatggaaagagcagaattcttaagctctatgaagaaagatacaaattatacattaactactgtgattatcaggttttaaatgatggatctatagatagagttgttttaagcataaaaaaataccttgaaggggagggaatttaa

SEQ ID NO: 2050 - protein, 165 aa, Clostridium acetobutylicum
MNLVLIGMPGCGKSTIGKILSKELNMKFYDADKYLEDRNNMKISDMFKRGEEFFRNLESAALKELSFEENSVIATGGGAVTREKNILCLKKKGKIVFINRPPEKIMEDVDIENRPLLEHGKSRILKLYEERYKLYINYCDYQVLNDGSIDRVVLSIKKYLEGEGI

SEQ ID NO: 2051 - DNA, 519 bp, Pseudomonas aeruginosa
  CDS (1)..(519)
atggtcaacctgatcctcgtcggcccgatgggtgctggaaagagcaccatcgggcgcctgctcgccaaggagctgcatctcgcgttcaaggactccgacaaggagatcgaacagcggtgcggcgcgaatatcccatggatcttcgatgtcgagggcgaggtcggtttccgcgagcgtgagcaggccatgctcaccgaactctgcgccgccgacggcatggtgatcgccaccggcggcggggcggtgatgcgcgacggtaaccgccaggtgctgcgcgccggtggccgggttgtgtacctgcatgcctcggtcgagcaccagatcgcgcgcacggcgcgggaccgcaaccgccccttgttgcagaagcccaacccaggacagatcctccgcgacctgatggcgctgcgcgacccgctctaccgcgaaatcgccgatgtggtggtggagaccgacgaaaggccgccgcgcctggtcgtccaggaaattctcgaacgcctgcgcaagttgccgccccgctga

SEQ ID NO: 2052 - protein, 172 aa, Pseudomonas aeruginosa
MVNLILVGPMGAGKSTIGRLLAKELHLAFKDSDKEIEQRCGANIPWIFDVEGEVGFREREQAMLTELCAADGMVIATGGGAVMRDGNRQVLRAGGRVVYLHASVEHQIARTARDRNRPLLQKPNPGQILRDLMALRDPLYREIADVVVETDERPPRLVVQEILERLRKLPPR

SEQ ID NO: 2053 - DNA, 522 bp, Buchnera sp
  CDS (1)..(522)
atggcagaaaaacgaaatatttttctagttgggcccatgggtgctgggaaaagcactattggtcgtcaattatctcaacaacttaatatggaattttttgactccgatcaagaaattgaaaaacgtactggtgctgatataagttgggtttttgatgtagagggtgaaagtggttttcgtttgagagaacaaagagttattgatgaattaactactaaacagggtattgttcttgctacaggaggaggttcagttaaatttagagaaactcgtaattttttgtcatctcgtggtattgtagtttatttagaaactactattgagaaacaattagcacgtactaagagagataaaaaaagacccttgttgcagaatgctgattcaaatcggatgatattagaaaatttagcttatgaaagaaatcctttctatgaagaaattgcagatataaaagttaaaactgatgatcaaagtgctaaatctgtagcttttaatataattcgtttattagaagaaatataa

SEQ ID NO: 2054 - protein, 173 aa, Buchnera sp
MAEKRNIFLVGPMGAGKSTIGRQLSQQLNMEFFDSDQEIEKRTGADISWVFDVEGESGFRLREQRVIDELTTKQGIVLATGGGSVKFRETRNFLSSRGIVVYLETTIEKQLARTKRDKKRPLLQNADSNRMILENLAYERNPFYEEIADIKVKTDDQSAKSVAFNIIRLLEEI

SEQ ID NO: 2055 - DNA, 501 bp, Agrobacterium tumefaciens
  CDS (1)..(501)
atggggctgatgggggctggaaagtcggcggtgggccgcatggtcgcccagcagctcaaggtgcctttcattgatacggatgtcgaaatcgagcgcgtatcgcgcatgacgatatcggagcttttcgccacctatggcgaggaggaattccgggcgctggaaacgcgggtcatcaagcggttgatgcgcggcggtcccaaggtcgtctccacgggcggcggcgcatttatcaacgacactacccgaggccatatcaggcgcggcggcatttcgctgtggctgaaggccgatctcgaggttctgtgggagagggtcaacaagcgcgaccaccgcccgcttctcaagactgaaaaccccaaggcaacgctcgctgccctgatggagaaacgttatccgatctatgcggaggcggacgtcaccatcgaatcccgtgatgtccgcaaggagatcatcgcgaccgaagtgctgacggctttagccggccttaaacagaaagactga

SEQ ID NO: 2056 - protein, 166 aa, Agrobacterium tumefaciens
MGLMGAGKSAVGRMVAQQLKVPFIDTDVEIERVSRMTISELFATYGEEEFRALETRVIKRLMRGGPKVVSTGGGAFINDTTRGHIRRGGISLWLKADLEVLWERVNKRDHRPLLKTENPKATLAALMEKRYPIYAEADVTIESRDVRKEIIATEVLTALAGLKQKD

SEQ ID NO: 2057 - DNA, 561 bp, Bacillus subtilis
  CDS (1)..(561)
atgaacgctaaacgagccatcccagtaagagaaagaaatatcgtcctgatcggattcatgggtgtaggaaaaacaacaatcggccaattggtcgctaaaaaattatatagagattttattgatattgaccagcagatcgaaaaggatttcaatatgtcaattcctgagatatttgagaaaaagggagaagacttttcccggaaaacggagaaggaatatattttagacatctgccatcataaacgattcaaaatcgtatctctgggcgggggatcttttaaacaagaagaaatcagaaattgctgtctggaaaactgtctcgtgcttcatctggacctgtcatgggagaactggaagcagcgcgcggatttattgatcgaaagccgccctgtactgcataaccgttcaatggatgaaatggaacagctgtttaacgaaagaaaagtcatttatgacaagcacaattcaaaagtggcaacagacaacctttccccggaagaggttgccgattacattgttgagacattaaaaattggctgggatctttatcagccgatgtaa

SEQ ID NO: 2058 - protein, 186 aa, Bacillus subtilis
MNAKRAIPVRERNIVLIGFMGVGKTTIGQLVAKKLYRDFIDIDQQIEKDFNMSIPEIFEKKGEDFSRKTEKEYILDICHHKRFKIVSLGGGSFKQEEIRNCCLENCLVLHLDLSWENWKQRADLLIESRPVLHNRSMDEMEQLFNERKVIYDKHNSKVATDNLSPEEVADYIVETLKIGWDLYQPM

SEQ ID NO: 2059 - DNA, 810 bp, Escherichia coli
  CDS (286)..(810)
gatccagaccggcggaccagatagcctttcacaacgtgaccgccaggcctttgccgcggagctggagaagtggtggctggaagtgcaacgtagtcgtggctaaatgtaatttattatttacacttcattcttgaatatttattggtatagtaaggggtgtattgagattttcactttaagtggaattttttctttacaatcgaaattgtactagtttgatggtatgatcgctattctcatgacaccggctttcgccgcattgcgacctattggggaaaacccacgatgacacaacctctttttctgatcgggcctcggggctgtggtaaaacaacggtcggaatggcccttgccgattcgcttaaccgtcggtttgtcgataccgatcagtggttgcaatcacagctcaatatgacggtcgcggagatcgtcgaaagggaagagtgggcgggatttcgcgccagagaaacggcggcgctggaagcggtaactgcgccatccaccgttatcgctacaggcggcggcattattctgacggaatttaatcgtcacttcatgcaaaataacgggatcgtggtttatttgtgtgcgccagtatcagtcctggttaaccgactgcaagctgcaccggaagaagatttacggccaaccttaacgggaaaaccgctgagcgaagaagttcaggaagtgctggaagaacgcgatgcgctatatcgcgaagttgcgcatattatcatcgacgcaacaaacgaacccagccaggtgatttctgaaattcgcagcgccctggcacagacgatcaattgttga

SEQ ID NO: 2060 - protein, 174 aa, Escherichia coli
MTQPLFLIGPRGCGKTTVGMALADSLNRRFVDTDQWLQSQLNMTVAEIVEREEWAGFRARETAALEAVTAPSTVIATGGGIILTEFNRHFMQNNGIVVYLCAPVSVLVNRLQAAPEEDLRPTLTGKPLSEEVQEVLEERDALYREVAHIIIDATNEPSQVISEIRSALAQTINC

SEQ ID NO: 2061 - DNA, 522 bp, Erwinia chrysanthemi
  CDS (1)..(522)
atgacagaacccatttttatggtcggcgccagagggtgcggaaaaaccaccgtcggccgtgagctggcgcgggcgcttggctatgagtttgtcgatacggatatttttatgcagcacaccagcggcatgacagtggcggacgtggtggcagcggaaggctggccggggtttcgccgccgtgaaagcgaggccttgcaggctgtcgcgacaccgaatcgtgtggtggcgaccggtggcggcatggtgttgttggagcaaaaccgccagtttatgcgtgcgcacggaacggtcgtctatttgttcgcgccagccgaggagctggcgttacgcttgcaggcaagcccacaggcacaccagcgaccgacactgaccgggcggcctattgctgaggaaatggaggcggtgctccgtgaacgcgaagcgttgtatcaggatgtagcgcactatgtggtcgatgcgacccaaccgcccgccgcgattgtctgcgaattgatgcagacgatgcgtctgcctgcggcctga

SEQ ID NO: 2062 - protein, 173 aa, Erwinia chrysanthemi
MTEPIFMVGARGCGKTTVGRELARALGYEFVDTDIFMQHTSGMTVADVVAAEGWPGFRRRESEALQAVATPNRVVATGGGMVLLEQNRQFMRAHGTVVYLFAPAEELALRLQASPQAHQRPTLTGRPIAEEMEAVLREREALYQDVAHYVVDATQPPAAIVCELMQTMRLPAA

SEQ ID NO: 2063 - DNA, 1293 bp, Lycopersicon esculentum (tomato)
  CDS (123)..(1025)
gttgttccaattttcattgctcttctgctcagggcagcagaagcttgttgacagtatagagtgcactcttcagctctttctaattttaaaaaaatttcttgtggtgttggtggatagagactatggaggctagagtttcgcagagccttcagttgtcctcatggataaattccgataaggtagtaaggaaaccgagtggtttgttgcgtttctctgagaagtggaatgaaaaaccaaggcatcgggtagttgtatcctgccatttacagcctagaaaagctgcacattctgatagacgagtacagttgaaagtttcatgttctcctcaaaatgttcaagcttcagttctggagtcaggatgtttctctgcatcaattgatgaaatcgagacattaaagaataaagcagaagaagttgaagaatatctagatggacgatgtgtataccttgttggaatgatgggctgcggaaaaacaactgtgggccggattttggcagaaacactgggatattccttttttgactgtgacaggctgatagagcaggctgttggtggaattactgtagctgaaatctttgagcttcgcggagagagcttcttcagggataatgagactgaggtattgcacaaactatctttgatgcatcggcttgttgtttcaacgggtggaggtgcagttgttcgtcccattaattggaggcatatgcacaagggtattagtgtttggttagatgttcctttagaagctttggccaagagaattaccacggaaggaactaaatctcgcccccttttacatgaagaatcaggagacgtttatgatacgactttgaagcggttaactactttaatggagacgaggggtgaaaattatgccaatgcaagtgccagggtttcactagaaaatattgcattgaaaagggaaaaagatgtctgtcatattacacctgctgaaattactttagaggttcttatacaaattgagaacttcttaaagacacaaaagagcgtagttgtgctataagctttttcactaccaatcgtgtggaggtggatggtttggtgctctactctcttgaccagggtacgattttaggtgttcgagacaattgaggttttggtaatgttttgtttctgttatgcactggatatgtaattgtacataatcaaaaccaattttggaactgtagtgtatcctaagcgcccaattgttgtatactaagaatgcaaactcagtagttatttcgtttgtttcaaagtttgtaacagaaataaatacccaaatttccaat

SEQ ID NO: 2064 - protein, 300 aa, Lycopersicon esculentum (tomato)
MEARVSQSLQLSSWINSDKVVRKPSGLLRFSEKWNEKPRHRVVVSCHLQPRKAAHSDRRVQLKVSCSPQNVQASVLESGCFSASIDEIETLKNKAEEVEEYLDGRCVYLVGMMGCGKTTVGRILAETLGYSFFDCDRLIEQAVGGITVAEIFELRGESFFRDNETEVLHKLSLMHRLVVSTGGGAVVRPINWRHMHKGISVWLDVPLEALAKRITTEGTKSRPLLHEESGDVYDTTLKRLTTLMETRGENYANASARVSLENIALKREKDVCHITPAEITLEVLIQIENFLKTQKSVVVL

SEQ ID NO: 2065 - DNA, 489 bp, Lactococcus lactis
  CDS (1)..(489)
atgagtatcattttaattggatttatgggtgccggaaaatcaacggtggcaaaacttttagcagaagaatttactgatttagataagttgattgaagaagagattgaaatgccaattgcgactttttttgaattatttggagaagctgattttcgtaaaattgaaaatgaggtttttgagcttgctgttcaaaaagatattattatcgcaactggtggaggaatcatagaaaatccaaagaatttaaatgttcttgatagagcatcacgagttgtatttttgactgctgattttgatactttatggaagcgaatttccatggattggcagaatgttcgacctttagctcaagacaaagaagctgctcaacttttatttgaaaaaagaatgaaagactattcattggttgcggatttaacaattgatgtgaccgataaaagtccagagcagattgcagagcagattagagaaaagtgggagatagagtag

SEQ ID NO: 2066 - protein, 162 aa, Lactococcus lactis
MSIILIGFMGAGKSTVAKLLAEEFTDLDKLIEEEIEMPIATFFELFGEADFRKIENEVFELAVQKDIIIATGGGIIENPKNLNVLDRASRVVFLTADFDTLWKRISMDWQNVRPLAQDKEAAQLLFEKRMKDYSLVADLTIDVTDKSPEQIAEQIREKWEIE

SEQ ID NO: 2067 - DNA, 570 bp, Synechocystis sp
  CDS (1)..(570)
atggcccaggatctaatcaaagaacaattacaaggcgttaacctgtttctgatcggcatgatgggcagtggtaaatccaccgtcgggccgttgttggcagaacagttggggtaccgttttttcgatgcggatgtgttgattgagcgggtggctggcaaggcgatcgccgacatttttgcggaggatggggaagatacttttcgggatttggagacggaagtgttgggacatctggcggcccaaaccagaagcgtcattgccaccgggggcggagtggtgctccgacgacaaaattggagttatctacaccatggcctggtcatttggcttgatggttccctggaattacttttggccaggctccagggagatgaagcaagacccctgctccaggtggaaaatctggaagaacggttaggaaatttattggcccaacggcaacccctctacgcccaggcggatctccggtttcccctgcaggcagaccaagatcctctggcgatcgccggagaattactggccactattccaggactgcttaaaccccaatgcagtgccgaacaaaattga

SEQ ID NO: 2068 - protein, 189 aa, Synechocystis sp
MAQDLIKEQLQGVNLFLIGMMGSGKSTVGPLLAEQLGYRFFDADVLIERVAGKAIADIFAEDGEDTFRDLETEVLGHLAAQTRSVIATGGGVVLRRQNWSYLHHGLVIWLDGSLELLLARLQGDEARPLLQVENLEERLGNLLAQRQPLYAQADLRFPLQADQDPLAIAGELLATIPGLLKPQCSAEQN

SEQ ID NO: 2069 - DNA, 693 bp, Corynebacterium glutamicum
  CDS (101)..(673)
ctgcagaaattcggcggtgactccctgagcgaaaccaagagcaacattgacacctacctcaaaaacattgaggaacgaatgaaattcgaaggtttagaggatggagcgtaatgaagtgaatgatcaaattcacttagatcatcaatcagatgacacctctgaatgctcctgcccgatcgtggttcttgtgggtttgccaggagctggaaaatccaccattggacgtcgattagcgcgcgccttaaacactgaactcgtcgactccgacgaactgattgagcgcgccaccggaaaagcctgtggcgccgtgttcagcgagctcggcgagccagccttccgcgagctcgaggccatccacgtggccgaagcactgaaatcctccggagtggtgagcttgggaggcggatctgtgctgacagaatccacccgtgaactgctcaaaggccaggacgtggtctggatcgacgtgccagtagaagaaggcatcaggcgcaccgcaaacgagcgttcccgccccgtgctgcaagccgccgaccccgccgagcactaccgcaacctggtgaaagtgcgcaccccgttgtacgaagaggtggcaacctaccgacttcgcaccaacaaccgcagcccccagcaagtggtggcagcagtgttgcatcatctagaaatcgattaattaaaccgggcacctgatta

SEQ ID NO: 2070 - protein, 190 aa, Corynebacterium glutamicum
MERNEVNDQIHLDHQSDDTSECSCPIVVLVGLPGAGKSTIGRRLARALNTELVDSDELIERATGKACGAVFSELGEPAFRELEAIHVAEALKSSGVVSLGGGSVLTESTRELLKGQDVVWIDVPVEEGIRRTANERSRPVLQAADPAEHYRNLVKVRTPLYEEVATYRLRTNNRSPQQVVAAVLHHLEID

SEQ ID NO: 2071 - DNA, 522 bp, Erwinia carotovora subsp
  CDS (1)..(522)
atggcagagaaacgcaatatctttctggttgggcctatgggtgccggcaaaagcactattggccgtcaattagctcagcaactcaatatggagtttttcgactccgatcaagaaattgagcgacgcactggggctgatgtgggctgggtattcgatgtggaaggcgaagaaggcttccgcgatcgtgaagagaaagtcattaatgaattgacggaaaagcaaggcatcgtactggcgacaggcggtggctcagtcaaatcacgtgagacgcgcaatcgtctttcagcgcgcggcgttgtcgtttatttggaaacgacaatcgagaaacaactggcccgcacgcagcgtgacaagaaacgtccgttacttcaggttgaaacccctccacgtgaagtattggaagcgttggcgaaagagcggaacccgctttatgaagaaatcgctgatgttaccattcggactgacgagcaaagtgccaaggtcgttgctaaccagattatcaatatgctggaaagtaactaa

SEQ ID NO: 2072 - protein, 173 aa, Erwinia carotovora subsp
MAEKRNIFLVGPMGAGKSTIGRQLAQQLNMEFFDSDQEIERRTGADVGWVFDVEGEEGFRDREEKVINELTEKQGIVLATGGGSVKSRETRNRLSARGVVVYLETTIEKQLARTQRDKKRPLLQVETPPREVLEALAKERNPLYEEIADVTIRTDEQSAKVVANQIINMLESN

SEQ ID NO: 2073 - DNA, 522 bp, Erwinia carotovora subsp
  CDS (1)..(522)
atgacacaccccatttttatggttggtgccagaggctgtgggaagaccaccgttgggcatcagctggcgcaggcgttgggatatgactttgtcgataccgacctttttatgcagcagacgaccaatatgacggtcgctgatgtggtcgcgcaggaaggatggcatggttttcgccagcgtgaaagtctggcgcttcagcaggtggcgtctaaccgctgcatcgtcgcgacaggcggcggaatggtgctagcggaagccaatcgacgttttatgcatgataaaggcatcgttatttatctccacgcggatgcagagctgctggctcagcggctggaagaaaatccgcaggataaccagcggcctacactgaccggacgccccatcgcagaggaaatggctgacgtactggccgcgcgtgaagcgctttatcgcggtgctgcacatcacgttattgatgcgtcgcagacaccggacgccattgtggtaagtgtgttaaaggcgctgcgtttgtcggcagcgtag

SEQ ID NO: 2074 - protein, 173 aa, Erwinia carotovora subsp
MTHPIFMVGARGCGKTTVGHQLAQALGYDFVDTDLFMQQTTNMTVADVVAQEGWHGFRQRESLALQQVASNRCIVATGGGMVLAEANRRFMHDKGIVIYLHADAELLAQRLEENPQDNQRPTLTGRPIAEEMADVLAAREALYRGAAHHVIDASQTPDAIVVSVLKALRLSAA

SEQ ID NO: 2075 - DNA, 543 bp, Acinetobacter sp
  CDS (1)..(543)
atgccaagcaaagagtttgacaccctgccaaatatttatttggtagggcccatgggagcaggaaagacaacagtcggtcgacatttagcagagttgttagggcgtgagtttctagacagtgatcatgaaattgagcgtagaacaggtgcaaccatcccatggatttttgaaaaagagggtgaaatcggatttagaagtcgggaaaccattgtgctggatgatttaacatctcgacgggatttagtgttagcaacaggtggtggggtggtaacacaaccagccaaccggagctatttaaaaacacgaggtgttgttgtttatttatacacgcctgttgagcttcagttacagcgtacctatcgtgataaaaatagacctttattacaggttgaaaaccctgaacagcgtcttcgtgatttattaaagttaagagatcctttatatcgcgatgttgcacatcatattatcgaaacaaatcaaggtgctgcccgagagctggctcagcaaattttacgtgtgattttaagttctggatcacattaa

SEQ ID NO: 2076 - protein, 180 aa, Acinetobacter sp
MPSKEFDTLPNIYLVGPMGAGKTTVGRHLAELLGREFLDSDHEIERRTGATIPWIFEKEGEIGFRSRETIVLDDLTSRRDLVLATGGGVVTQPANRSYLKTRGVVVYLYTPVELQLQRTYRDKNRPLLQVENPEQRLRDLLKLRDPLYRDVAHHIIETNQGAARELAQQILRVILSSGSH

SEQ ID NO: 2077 - DNA, 633 bp, Bartonella quintana
  CDS (1)..(633)
atgaaaactaatcatcccaaacatatcccgataacacaaataaaaaagcagcttttatcgtctcttgataaacgagcacttgtacttgttggtcttatgggtgcaggcaaatcagtaatcggaaaacgcattgctaccatgctcggtttgcccttctacgattctgaccaggaaattgaaaaagctgcacaaatgacaatcactgaattttttaaagtttatggtgaatcagaattccgtgctcttgaacagcatgttactctaagcctcatgaaaaaaagtcctcttgttttagcaacaggtggcggtgcctacataaatgaagatatccgacaagtcattaataaaaatggtatatctatatggctcaaagcagatcttgatattctcatgaaacgtgtttcgcgacacccaacgcgaccactccttcaaacagcaaaccctaaagaaaccatgaaaaaactcatggaacaacgctaccctatctatgcaaaagcaaacttaacaattaacagttataaggaaagccgccatactgtagcacaaaatgttatacggtctgtacagaactacatctatacagaaattaacgataggaataaccagcatgcaaaccaagaccgtcactgttaa

SEQ ID NO: 2078 - protein, 210 aa, Bartonella quintana
MKTNHPKHIPITQIKKQLLSSLDKRALVLVGLMGAGKSVIGKRIATMLGLPFYDSDQEIEKAAQMTITEFFKVYGESEFRALEQHVTLSLMKKSPLVLATGGGAYINEDIRQVINKNGISIWLKADLDILMKRVSRHPTRPLLQTANPKETMKKLMEQRYPIYAKANLTINSYKESRHTVAQNVIRSVQNYIYTEINDRNNQHANQDRHC

SEQ ID NO: 2079 - DNA, 633 bp, Bartonella henselae
  CDS (1)..(633)
atgaaaagtaatcgaccaaaacatattccgataacaaaaataaagaatcaacttttatcgtctcttgataaccgagcacttgtacttattggtcttatgggtgtaggcaaatcggtgatcggaaaacgtattgccaccatgctctgtttacctttctatgattctgatcaagaaattgaaaaagctgcacaaatgactatcactgaactctttaaaacttatggtgaatcagaattccgggctcttgaacaacgcgttattctaaatctcatgaaaaacagacctcttgttttagcaacaggtggtggtgcctacataaacgaagatatccgaaaagccgttcataaaaatggtatatccatatggcttaaagtcgatcttgataccctcatgcaacgtgtctcaaagcgtccaacacgcccacttcttcaaacagaaaatcctaaagaaactatgcaaaaactcatgaaacagcgctatcctatctatgcaaaagcaaacttaacaattaacagtcataaggaaaaccgtcaaaccgtagcacaaaatgtcatacggtctgtacaacactacctcgatacagaaaagaatgataggaataaccagcatgcaaaccaaaactgtcactgttaa

SEQ ID NO: 2080 - protein, 210 aa, Bartonella henselae
MKSNRPKHIPITKIKNQLLSSLDNRALVLIGLMGVGKSVIGKRIATMLCLPFYDSDQEIEKAAQMTITELFKTYGESEFRALEQRVILNLMKNRPLVLATGGGAYINEDIRKAVHKNGISIWLKVDLDTLMQRVSKRPTRPLLQTENPKETMQKLMKQRYPIYAKANLTINSHKENRQTVAQNVIRSVQHYLDTEKNDRNNQHANQNCHC

SEQ ID NO: 2081 - DNA, 525 bp, Staphylococcus aureus subsp
  CDS (1)..(525)
atgaatcatgataaatcaccaataattttaattggtttcatgggtaccggtaaatctacgattggtaaatacgttgcagatgagcaaaatttatcatttattgatatagattcatatatcgaagaaaagtataagttaacaataccagaaatatttagtaaacatggtgaacaatatttcaggaatttagagttcacatgtttgcaagaatgtattaacactgcagatataattgctactggtggtggtattattgaaagtgaagaggtatttaattttttgaaaaatcaaaaaaacattatttggttagattgtaatattgatattatatatagtcgaatcaatgatgacccacatcgacctaatgcaaataataagacaatcaagcagttaaatgacttgtattgctcgcggattttaagatataatgaaatcgcattcaagaaatttgatagtcatttgctatcaatttcagaaatatattatgaattgctaaatttaataaaagcgagtgatcagtattag

SEQ ID NO: 2082 - protein, 174 aa, Staphylococcus aureus subsp
MNHDKSPIILIGFMGTGKSTIGKYVADEQNLSFIDIDSYIEEKYKLTIPEIFSKHGEQYFRNLEFTCLQECINTADIIATGGGIIESEEVFNFLKNQKNIIWLDCNIDIIYSRINDDPHRPNANNKTIKQLNDLYCSRILRYNEIAFKKFDSHLLSISEIYYELLNLIKASDQY

SEQ ID NO: 2083 - DNA, 528 bp, Photobacterium profundum
  CDS (1)..(528)
atgctaacaatggctgaaaaacgaaatattttcctggtcggacctatgggtgccggcaaaagtactattggtagacaccttgcacaacagttgcacatggagttttttgattctgataccgttatcgaagatcgtaccggagctgatataagctgggtattcgatgttgaaggtgaagaaggcttccgtgttcgcgaagaaggtgttattgacgatctgactcaagagcaaggtattgttctcgcgacaggtggtggttctgttgtcagtaaagagaaccgtaaccgcttatctgctcgtggtgttgttgtttatcttgaaacgacaatcgagaaacagctagcacgtactcaacgagataaaaagcgcccgttgcttcaaacggatgctccacgtgaagtacttgaagctcttgctgcagaacgtaatccaatgtatgaagaagtgtccgactatgttgtacgcactgatgatcagagcgccaaagtagttgccaaccaaatcatcaatatgcttgaagagcgttaa

SEQ ID NO: 2084 - protein, 175 aa, Photobacterium profundum
MLTMAEKRNIFLVGPMGAGKSTIGRHLAQQLHMEFFDSDTVIEDRTGADISWVFDVEGEEGFRVREEGVIDDLTQEQGIVLATGGGSVVSKENRNRLSARGVVVYLETTIEKQLARTQRDKKRPLLQTDAPREVLEALAAERNPMYEEVSDYVVRTDDQSAKVVANQIINMLEER

SEQ ID NO: 2085 - DNA, 612 bp, Parachlamydia sp
  CDS (1)..(612)
atgcatcaaaaagagttttcccaactttattcaagatttaaaaaaacttggggctcggtttacatgatttctaaaagaagcgttgctttgattggtctacctttgtgtgggaaaacaacatgggggcaatggctggctaaaaaatttgagtatgcctttattgatacagactggctaattcaacaaaaacatcctacgttaacatgtcgagaaatttttcaattatttgggcagtcctatttccgttctttagaaagggatgtcattgatgacttaaagccaactaaacaggtgattattgcaaccggaggtggggtgatttataatgatcaaaatcgaaatgcgctaaaaaaatattgtcggttaatttatttgaaactttctttttcaaactggaaagagcgtattttcagtcaaactgagttaccagcctatatttctcaagaacaatcttcggatgtatctttgaaaaaactctatgcaagcagaacgttaatttatgaaaattgggcagaccaaactatcgatatgaacggatctatgaacaacgatttttctgttcatctactcatgagccttcaatttgttaaagaggaaaataatggcatctaa

SEQ ID NO: 2086 - protein, 203 aa, Parachlamydia sp
MHQKEFSQLYSRFKKTWGSVYMISKRSVALIGLPLCGKTTWGQWLAKKFEYAFIDTDWLIQQKHPTLTCREIFQLFGQSYFRSLERDVIDDLKPTKQVIIATGGGVIYNDQNRNALKKYCRLIYLKLSFSNWKERIFSQTELPAYISQEQSSDVSLKKLYASRTLIYENWADQTIDMNGSMNNDFSVHLLMSLQFVKEENNGI

SEQ ID NO: 2087 - DNA, 918 bp, Rhodopseudomonas palustris
  CDS (1)..(918)
atggccgagccagacgataccgacgcgagctttctgctcgacctcggccgccatgtccgcaccatgcgcgggcggcgcggcatgtcgcgcaaggtgctggccaaggtctccggcatctcggagcgctacatcgcccagctcgaaagcggcaaaggcaacgtatcgatcatgctgctgcgccggatctccgaagcgctggcgacgccgctcgaagacctgctgccgtccaatgaatcttcggccgactggccggtgatccgcgatctggtgcggcgcgccaccccggtgcagatcgcgcatgccaaggacgtcttgtccggcctcggccgctacggcggcagcctggagcgggaggcgaccttccatggcatcgggctgatcggcctgcgcggcgccggcaagtcgacgctcggcaagatgctggccgacagcatcggctggagcttcgtcgaactgaatcgcgaaatcgaacgccagaacggcctgtcggtgtccgagatcatcgcgctgtacggccaggaaggcttccgccgcatggagcagactgcgctgtcgcggctgctcgcccgcaaggagccgatcgtgctggcgaccggcggcggcatcgtctccgagccgatcaccttcgatcagatcctgacctcgttctacacgatctggctgaaggccgagccggaggagcacatgtcgcgggtccgcggccagggcgacctgcggccgatggccgacgaccgcgccgcgatgcaggagctgcgcaccatcctgcaaagccgcgagccactgtatgcccgcgccgccggcgtactcgacaccgccgggctgtcggtcgaagccgccgcgcagaagctggtcgcgatggtgtcgccggtgctgagccgcgatgcaggcgcgttcggcctgcgcgaggccacgccgtaa

SEQ ID NO: 2088 - protein, 305 aa, Rhodopseudomonas palustris
MAEPDDTDASFLLDLGRHVRTMRGRRGMSRKVLAKVSGISERYIAQLESGKGNVSIMLLRRISEALATPLEDLLPSNESSADWPVIRDLVRRATPVQIAHAKDVLSGLGRYGGSLEREATFHGIGLIGLRGAGKSTLGKMLADSIGWSFVELNREIERQNGLSVSEIIALYGQEGFRRMEQTALSRLLARKEPIVLATGGGIVSEPITFDQILTSFYTIWLKAEPEEHMSRVRGQGDLRPMADDRAAMQELRTILQSREPLYARAAGVLDTAGLSVEAAAQKLVAMVSPVLSRDAGAFGLREATP

SEQ ID NO: 2089 - DNA, 612 bp, Rhodopseudomonas palustris
  CDS (1)..(612)
atgccgagaatgtctgaaaccgtaccgacggctgctgccggcaggtcgccccaggaagccgagatcgtcgcggcgctgggcgatcgcccggtcgtgctcatcggcatgatgggcgccggcaaatccaccgtcggacgccggctggcgctgcgactcgggctgccgtttctcgacgccgacaccgagattgaatcggcggccgcgatgaccatcccggagatcttcgaaacccatggcgagccgcattttcgcgacggcgaggctcgggtgatttcgcggctgctcgacggcggcaccaaggtgctggcgaccggtggtggggccttcatgcgcgaggaaactcgtgaccggattcgcgagaaggcgatctcgatgtggctcgaggcggaggccgacgtgatcctgcgccgggtcaagcgccgcgcggaccggccgctgctgaagacgccagatccggccggcaccatcgcccggctgatcgcggaacgctatccgctataccgcgaagccgatatcaccatcgcgtcccgcgacgtgccgcacgagaagatcgtcgacgaatgcgtcgcggcgctccacgactatctgtgcgccgcgccgccccaaccttga

SEQ ID NO: 2090 - protein, 203 aa, Rhodopseudomonas palustris
MPRMSETVPTAAAGRSPQEAEIVAALGDRPVVLIGMMGAGKSTVGRRLALRLGLPFLDADTEIESAAAMTIPEIFETHGEPHFRDGEARVISRLLDGGTKVLATGGGAFMREETRDRIREKAISMWLEAEADVILRRVKRRADRPLLKTPDPAGTIARLIAERYPLYREADITIASRDVPHEKIVDECVAALHDYLCAAPPQP

SEQ ID NO: 2091 - DNA, 522 bp, Corynebacterium diphtheriae
  CDS (1)..(522)
atgagtggtcgggttcgcccaatcgttgttttagtaggtccaccggggtcaggtaaaacgactattggccgtcgtcttgcgaatgccctgaatacttcggtggtggatagcgatgtgttgattgaacaactccaaggcaaaccctgtggtgttgtatttgctgaactcggtgagccaaactttcgagatttagaagcagaagtaatagactttgccctcacaacagcaggggtagtgagcctcggtggcggtgccgtgacaacggaatcagtgcgacaaaagcttcgagcgcaaatagtggtatgggtagatgtatccgcagcggaaggcgtgcgtcgaactgcagttgaaaattcgaggccattactggatacaacgaatccacttgaacgctacagcgaattattagctcagcgtcgtgatttttataaagaagtagcagattatcgcgcgcacacagatggtcggagtccacagcaaattgttgctgatattttgggctttcttgaaaccttacgttga

SEQ ID NO: 2092 - protein, 173 aa, Corynebacterium diphtheriae
MSGRVRPIVVLVGPPGSGKTTIGRRLANALNTSVVDSDVLIEQLQGKPCGVVFAELGEPNFRDLEAEVIDFALTTAGVVSLGGGAVTTESVRQKLRAQIVVWVDVSAAEGVRRTAVENSRPLLDTTNPLERYSELLAQRRDFYKEVADYRAHTDGRSPQQIVADILGFLETLR

SEQ ID NO: 2093 - DNA, 543 bp, Desulfovibrio vulgaris
  CDS (1)..(543)
atgatgacacgacgtgaaggcgcacgactttttgaaggatgctgcgtaaccatcatcggcatggccggtgcaggcaagacgacagtgggaagggaacttgcacgccagatggactgggcacatgtggacacggacagcctcatcgaggcgacgtacgggacagtactccagaatgtggccgacagcatgagcaaggaagccttcctcgatgtggaagccggcatcatctgccgcatcggggcgaaacgggctgtcctttccacgggtggcagcgtcgtctaccgggcagaggccatgcgccatctcgcgtcactgggcccggtcgtctatcttgatgtctcgctgccgctcatcctcgaacgcatcgcccgcaaccccgacaggggcctcgccatcgcaccggggcagaccatcgaagacctctacaacgaacgcaaggccctgtacgaaacgtatcaggacttcaccttgaccgccgacaccctcacgcccgaggaatgcggtcgcgccatcctgtcatggctggagacggcagatgcctaa

SEQ ID NO: 2094 - protein, 180 aa, Desulfovibrio vulgaris
MMTRREGARLFEGCCVTIIGMAGAGKTTVGRELARQMDWAHVDTDSLIEATYGTVLQNVADSMSKEAFLDVEAGIICRIGAKRAVLSTGGSVVYRAEAMRHLASLGPVVYLDVSLPLILERIARNPDRGLAIAPGQTIEDLYNERKALYETYQDFTLTADTLTPEECGRAILSWLETADA

SEQ ID NO: 2095 - DNA, 528 bp, Desulfovibrio vulgaris
  CDS (1)..(528)
atggggtcggaagtgtgccgggtcttcctcatcgggggcagggccagcggcaagagtacggtgggcagggcgctcgccgcaaggcttggatgggatttcgcggataccgacgccatggtgacgcggcgtgccgggtgcgacatcgccacactggtggcggaacgcgggtgggatgccttccgtgacatggagagtgacgccctgcgtgatgccgcagcgcgtgaacgtgtcgtcgtcgccacaggcgggggcatggtgctgcgtgcggaaaatagggcgctgctgcgcgaggcgggggtcaccgtgttcctgtcgttgcctgtcgaggtcgtggcggcgcggcttgcccgcaacccggaacatgggcaacgcccctcactgaccggaaaggccgtggcggacgaggtggcggacgtgatgcgcgaacgggcacctctctatgccgaggcggcccgccatgtggtgcgcggcgatgcgcccgtggcgtgcatcgtcgaggacatcaccgcgctgcttgccttttcgtga

SEQ ID NO: 2096 - protein, 175 aa, Desulfovibrio vulgaris
MGSEVCRVFLIGGRASGKSTVGRALAARLGWDFADTDAMVTRRAGCDIATLVAERGWDAFRDMESDALRDAAARERVVVATGGGMVLRAENRALLREAGVTVFLSLPVEVVAARLARNPEHGQRPSLTGKAVADEVADVMRERAPLYAEAARHVVRGDAPVACIVEDITALLAFS

SEQ ID NO: 2097 - DNA, 555 bp, Thermus thermophilus
  CDS (1)..(555)
atggcccgcctcgaggttccccgtcccgccaccttcgtcaccctcaccgggttcatgggggtggggaaaagccgcatcgggcgggagctcgcccgggcgctcatgctccacttcattgacctggaccgctacattgagcggcgcaccgggatctccatccccgacatcttccgccacctcggggaggaggccttccgcaggatggagaaggaagcggtgcgggagctcgtgggaaaggactacctggtcctctccctgggcgggggaaccttcatggacccggaaagccaaaaggccctcctcggccgcgggcccgtggtagccctatgggcgagccccgagaccatcctggaaagggccatgcgcaagcccggggaaaggcccctcctccaggtggaaaaccccctggagaggatccggaccctcctcgaggcccgggcccccatctaccgcaaggcccacatccacgtctccaccgacgggcgtcgcgtggaggaagtggtggaggaaatcgtggagaagctctggcgccatgcagaggctagaggtgcgtga

SEQ ID NO: 2098 - protein, 184 aa, Thermus thermophilus
MARLEVPRPATFVTLTGFMGVGKSRIGRELARALMLHFIDLDRYIERRTGISIPDIFRHLGEEAFRRMEKEAVRELVGKDYLVLSLGGGTFMDPESQKALLGRGPVVALWASPETILERAMRKPGERPLLQVENPLERIRTLLEARAPIYRKAHIHVSTDGRRVEEVVEEIVEKLWRHAEARGA

SEQ ID NO: 2099 - DNA, 513 bp, Bacillus cereus
  CDS (1)..(513)
atgagaggaacgaaaatgaaatctatatacataaccggctatatgggagcagggaaaacaacaattggaaaagcgttaagtaaagaacttcacatggatgttatagatacagatcaaaaaattgaagagaagcaagagaaggagattcgtgatatttttgccgaagaaggtgaaatgacttttcgggaatatgaaagtgagatgttacgttcactacctgttgaaaatgtaatcattacaactggcggcggaatcattgagcgagaggaaaaccgaaagtggatgaaggaaaatggcactgtcgtgtatttatattgtgatccacacgtaattgcagagaggcttcgtgaagatacgacacgtccactatttcagaagaaagatatagatgcatttgtaatgaaattcgaatcgcgccgagcttattatgaagaggctcatattcatattgatacgacgaataagtctgtaaagcaaattatgaatgaattaaaagaaaagattaatggataa

SEQ ID NO: 2100 - protein, 170 aa, Bacillus cereus
MRGTKMKSIYITGYMGAGKTTIGKALSKELHMDVIDTDQKIEEKQEKEIRDIFAEEGEMTFREYESEMLRSLPVENVIITTGGGIIEREENRKWMKENGTVVYLYCDPHVIAERLREDTTRPLFQKKDIDAFVMKFESRRAYYEEAHIHIDTTNKSVKQIMNELKEKING

SEQ ID NO: 2101 - DNA, 531 bp, Mycobacterium paratuberculosis
  CDS (1)..(531)
atggcgcccaaagcggtgctgatcgggctgccgggctccggcaagtccaccatcgggcggcggctggccaaggcgctcggggtgggtttcctggacaccgatgcggccatcgagcagcgcaccggccggcccatcgccgagatcttcgccaccgacggtgagcgggagttccgccgcatcgaggaggaggtggtgcgcgcggcgctgaccgagcacgacggcgtgctgtcgctgggcggcggcgcggtcaccagccccggggtgcgcgaggcgctggccggccacaccgtcgtctacctggagatcagcgccaccgagggggtgcggcgcaccggcggcaacacggtgcgcccgctgctggccgggccggatcgcgccgagaagtaccgcgcgctgctggccgagcgcagcccgctgtaccggcgggccgccaccatccgggtcgacaccaaccggcgcaaccccggcgcggtggtgcgctacatcgtgtcgcggctgcccgccaccgatgcctgccgggccgccacatga

SEQ ID NO: 2102 - protein, 176 aa, Mycobacterium paratuberculosis
MAPKAVLIGLPGSGKSTIGRRLAKALGVGFLDTDAAIEQRTGRPIAEIFATDGEREFRRIEEEVVRAALTEHDGVLSLGGGAVTSPGVREALAGHTVVYLEISATEGVRRTGGNTVRPLLAGPDRAEKYRALLAERSPLYRRAATIRVDTNRRNPGAVVRYIVSRLPATDACRAAT

SEQ ID NO: 2103 - DNA, 528 bp, Geobacter sulfurreducens
  CDS (1)..(528)
atgtccgtgccttctgacgggcgcaacgtggtcctgaccggtttcatgggaaccggcaagagcacggtgggaaagctcctggcaaggcgcctcggctaccgcttcagtgacctggatgcgttgatcgtggagcgggccggcatctccatcaacgagatattcgagcggtatggggaacaacgattccgtgagctggaaacggaagcgattcgttcccttggtggcgtttccggccgggtggtggccaccggcggtggggcggtcattgcgccccggaacagagtgttgctccgcgaggcgggattggtggtgaacctcacggcttcgcttgaggtgatcctgtctcggctgaagggcgatcgggagcgcccgttgttgaagagtaacaacactccggaggctctggccgcgctcatgacagctcgtgagaacgcttacgccgatgcggacttgaggattgacactgccggcaaaagcgtggaagatgtggtcacagaaatcgccacctttgtccgggagcatcaatga

SEQ ID NO: 2104 - protein, 175 aa, Geobacter sulfurreducens
MSVPSDGRNVVLTGFMGTGKSTVGKLLARRLGYRFSDLDALIVERAGISINEIFERYGEQRFRELETEAIRSLGGVSGRVVATGGGAVIAPRNRVLLREAGLVVNLTASLEVILSRLKGDRERPLLKSNNTPEALAALMTARENAYADADLRIDTAGKSVEDVVTEIATFVREHQ

SEQ ID NO: 2105 - DNA, 540 bp, Leptospira interrogans
  CDS (1)..(540)
atgaaaaaaaacttcgctctgatcggccccagaggagtcggaaaatctaaaatttctcgtaaactttctaaaattacaggaatgcccgtagtatccactgatatgatcgcagtctatgagattggtggaatgtcaattcctgaattcattcaaaagaatgaaggagattggagaccatttaggaatttagaatttgaaattcttaccaaactcaaaacctctcaaggaatcatcttagattgtggaggtggaattttgtttgatttggataccaaaggaaaagaaatcctaagtgaccgtaagactacccttttaaaatccattgcagtggtttttggtctttccagacccacggaaattttagtggaaaagattcaaaacgatcctacccgtcctccattgagtacaattcagtcttatcgtactatattagaaagtcgattaccttactatcaaagtatttcggattattatttagaaatagacgatctgaaggtggaagagatttgttctagaattctacagaaaattgaatattga

SEQ ID NO: 2106 - protein, 179 aa, Leptospira interrogans
MKKNFALIGPRGVGKSKISRKLSKITGMPVVSTDMIAVYEIGGMSIPEFIQKNEGDWRPFRNLEFEILTKLKTSQGIILDCGGGILFDLDTKGKEILSDRKTTLLKSIAVVFGLSRPTEILVEKIQNDPTRPPLSTIQSYRTILESRLPYYQSISDYYLEIDDLKVEEICSRILQKIEY

SEQ ID NO: 2107 - DNA, 501 bp, Wolinella succinogenes
  CDS (1)..(501)
atgagctccgctaaaggctctaatctcattctcattggatttatgggaagtggaaaaagtagcgtggctcggattttagccaaggaaagcggtcacctttgggtcgataccgattcattgctggagttacgagaggggatgagcgttgctcagatttttgaacaacacaaagaggagggatttcgcgctctagagagagagcttgcctttcaaatgcgccactccctccaagaatctatcatctccacaggaggcgggatgcctctcttttgtgacctttcctctttgggcaaactcttctttcttgatcttcctttcgaggctattttagagcgcctctccaaagaagagcgtgccaaacgcccccttttaaacgacctatcaaaggctaaagcgctttttaatcagaggcgcagctcctatcttcatctagctaatcacaccctccaagccgaccaatccccactcaaagtagcccaagaaattctctctcttctctag

SEQ ID NO: 2108 - protein, 166 aa, Wolinella succinogenes
MSSAKGSNLILIGFMGSGKSSVARILAKESGHLWVDTDSLLELREGMSVAQIFEQHKEEGFRALERELAFQMRHSLQESIISTGGGMPLFCDLSSLGKLFFLDLPFEAILERLSKEERAKRPLLNDLSKAKALFNQRRSSYLHLANHTLQADQSPLKVAQEILSLL

SEQ ID NO: 2109 - DNA, 561 bp, Porphyromonas gingivalis
  CDS (1)..(561)
atgcacgctccgatttttatcgttggctatatgggttccggcaagagtacggtagggcgtaagatggccgatgtactcggttggcgttttatcgatacggatttctttatcgagaaccgattccgcaagcgcgtggcggatatattccgtgacgaaggcgaggcggtttttcgcaggcgcgagcgtgtcgtcatcgaagaactatccggaatggaggatgctattatcgccacagggggcggattgccctgtcattcggacaatatgacgctgatgaacgaagccggcttgacgctgtatttggaagtttcggatgaggttcttgccgttcgtttggagctgtgcaagcggacaaggccgaaggtgaaagacaagaccggcgaagagctgctctcccacatccgggaggaaatggctttccgaggcgatatatatcgccgtgcaaaggtgattgtaaatagcgacaagctggtggatgaagaggatgagagacagcttgtcactcgtatcgtcgccgatttgcgcgccaaaggatacctaccgcaagcaatacagccataa

SEQ ID NO: 2110 - protein, 186 aa, Porphyromonas gingivalis
MHAPIFIVGYMGSGKSTVGRKMADVLGWRFIDTDFFIENRFRKRVADIFRDEGEAVFRRRERVVIEELSGMEDAIIATGGGLPCHSDNMTLMNEAGLTLYLEVSDEVLAVRLELCKRTRPKVKDKTGEELLSHIREEMAFRGDIYRRAKVIVNSDKLVDEEDERQLVTRIVADLRAKGYLPQAIQP

SEQ ID NO: 2111 - DNA, 525 bp, Photorhabdus luminescens
  CDS (1)..(525)
atgaaccaaatattgtttattgtaggtgcacgtggggcaggaaaaacgacggttggaaaattattagccaatgaattatcgtacacatttattgacactgatcaccatatccaacaaaccagtaatatgaccattgcggatattgttaaccagcaaggatggcaacaatttcggcaattagaaagccaagctttacaacaagttactcaaattaatcgcgttatttctactggaggaggtatcattctttccgctgaaaatcgccaatatatgcgacaaaatggcacggtgatttatcttcaagcttcagcgagcattttggctgagcgattaatgcagcaaccagaaagtacccaacgtcctagtttgacgggaaaatctattgttgaagaaatggaagaagtgcttgccgccagagaaaatctctattgtgaatgtgcgaaccatattattaatgcgcacctttcaccggaaaaaattacaacttatgtgaaagagattatgttctctggaatagtttcctga

SEQ ID NO: 2112 - protein, 174 aa, Photorhabdus luminescens
MNQILFIVGARGAGKTTVGKLLANELSYTFIDTDHHIQQTSNMTIADIVNQQGWQQFRQLESQALQQVTQINRVISTGGGIILSAENRQYMRQNGTVIYLQASASILAERLMQQPESTQRPSLTGKSIVEEMEEVLAARENLYCECANHIINAHLSPEKITTYVKEIMFSGIVS

SEQ ID NO: 2113 - DNA, 534 bp, Gloeobacter violaceus
  CDS (1)..(534)
atgctgaagggtgtcagtctgtatctggtcggcatgatggggtccggcaaatcgacggtgggccggctgctcgctgaaaagctgggctacggctttgtcgatctcgacgcgctcatcgaacaggtaagcggcaagcgggtgggcgaaatttttgagcgcgagggcgaagcggtttttcgtgatctcgaaagccgggtgctcgccgaggtgagcgcctacacccgtctggtcgtcgccaccggcggcggcgtggtgctcgcccggcgcaactggggctatttgcaccacggagtggtcgtctggctcgacgccgatatcgagacgctgctcgggcgggtggagcacgaacctggcacccggcccctgcttgccggcggcgacaggcacctgcgcctggtcgaactgttgggcgagcgcgccaggctttacgcccaggcggacgtgcgcgtgagcgcggcgggactgccgccggcagtggccgaggagacgctgcgctgtctggcggcgcgtctggcggaggacagtgctccgtga

SEQ ID NO: 2114 - protein, 177 aa, Gloeobacter violaceus
MLKGVSLYLVGMMGSGKSTVGRLLAEKLGYGFVDLDALIEQVSGKRVGEIFEREGEAVFRDLESRVLAEVSAYTRLVVATGGGVVLARRNWGYLHHGVVVWLDADIETLLGRVEHEPGTRPLLAGGDRHLRLVELLGERARLYAQADVRVSAAGLPPAVAEETLRCLAARLAEDSAP

SEQ ID NO: 2115 - DNA, 555 bp, Chromobacterium violaceum
  CDS (1)..(555)
atgcctgccatggagaaactggcaggcaacttttttctggtcggtctgatgggcgcgggcaagaccacggtgggcagagcgctggcgcgccgcaccggcaaaacgttctacgactccgaccaggagatcgaggcgcgcaccggcgtgcgcgtggccaccatcttcgacatcgaaggcgaaatgcgcttccgcaaccgcgaggcctgcgtgatccgcgacctggcccagcagcgcgacatcgtgctcgccaccggcggcggcgctgtgctgcgcgaggaaaaccgcaaggtgctggccagccacggcacagtgatctacctgcgcgcctcgatagacgaccttctggcccgcacccagcacgacaagaaccgtccgctgctgcagatcgccgaccctcgcgccaaactggaaagcctgttcaacgagcgcgatccgttttaccgcgaaatcgccgacatcatcatcgacaccacccagcagaacgtcaatctgctggtcggccgtctggtcgaccagttgttggactccccgcaccatcccaaggaaaccgactag

SEQ ID NO: 2116 - protein, 184 aa, Chromobacterium violaceum
MPAMEKLAGNFFLVGLMGAGKTTVGRALARRTGKTFYDSDQEIEARTGVRVATIFDIEGEMRFRNREACVIRDLAQQRDIVLATGGGAVLREENRKVLASHGTVIYLRASIDDLLARTQHDKNRPLLQIADPRAKLESLFNERDPFYREIADIIIDTTQQNVNLLVGRLVDQLLDSPHHPKETD

SEQ ID NO: 2117 - DNA, 576 bp, Synechococcus sp
  CDS (1)..(576)
atgtcggacgcaactctctccttgaagcagcgcctgggcggccgcagcctgtacctggtgggaatgatgggcagcggtaaaaccagcaccggtcgccccctggcggaacaactgggttacggctttgtggatgccgatgccgtgatcgagcaggccgcaggctgcagcattcctgagatttttgagcgggacggtgaagcaggattccgggccctggaaagccaggtgctcaacgccatcggccaacgtcactccctagtggtggccaccggcggcggtgtggtgacgcaacaggagaactgggggctactgcacagcggcatcgtggtctggctggatgtggtgccagagcagctcatgcaacgcctcagagcggacagcacggtgcggccactgctccaaaccgaagatccagacgctgcgctcaacgcgctgctcaaccaacgcaggcccctttatgccgaggccgatctcacggtggtgattaatcaagaaacacccctcgccgtcgccgacgggatcctgcaacttctgccaagcctgctgaaggatccaacccagcgccgaaccgactga

SEQ ID NO: 2118 - protein, 191 aa, Synechococcus sp
MSDATLSLKQRLGGRSLYLVGMMGSGKTSTGRPLAEQLGYGFVDADAVIEQAAGCSIPEIFERDGEAGFRALESQVLNAIGQRHSLVVATGGGVVTQQENWGLLHSGIVVWLDVVPEQLMQRLRADSTVRPLLQTEDPDAALNALLNQRRPLYAEADLTVVINQETPLAVADGILQLLPSLLKDPTQRRTD

SEQ ID NO: 2119 - DNA, 564 bp, Rhodopirellula baltica
  CDS (1)..(564)
atgaacaacgacgaagtgaaacctcagcacctctatttgaccggctaccgtgggtgcggcaaaagtacgcttgcgaaacttttagcgcagaagctgtctctgccctcagtcgacttggacgatgtgatcgaaacgaccgcaggcaaatccatcgccgaaatcttcgcgaatgaaaccgaagtcggttttcgcgaccgggaagaagccgctttgatggaagtttccaggcgaccgcaacatgtgatcgcgcttggcggaggcaccatccttcgcgaagcaaaccggaacatcatcgcgaattcaggctggtgcgtttggctggacgccgaaccagatgtcctggtcgcccgcttggccggtgacgcgacgacggccgatcgacggccttcactgactgaccaatccgtttttgacgaagtccaatccgtgatgagccatcgcgaaccgctctatcgtgcatcggctgacttgcgaattgacacaagccaccggaacatggacgagatattgacagaggttttgaaggcggcgccgtccagcatcggacaagccgacctcagctag

SEQ ID NO: 2120 - protein, 187 aa, Rhodopirellula baltica
MNNDEVKPQHLYLTGYRGCGKSTLAKLLAQKLSLPSVDLDDVIETTAGKSIAEIFANETEVGFRDREEAALMEVSRRPQHVIALGGGTILREANRNIIANSGWCVWLDAEPDVLVARLAGDATTADRRPSLTDQSVFDEVQSVMSHREPLYRASADLRIDTSHRNMDEILTEVLKAAPSSIGQADLS

SEQ ID NO: 2121 - DNA, 558 bp, Prochlorococcus marinus subsp
  CDS (1)..(558)
atggaaaaatctattattgagaaaacaaacaaaataattcaaggaagaagtatatatttgataggtatgatggctagtggtaaatctaaaactggtccagtattagccgagttattgaggtataagtatattgatctggataaattaatagagaatatagcaaaaaaaacaattaatgagatgttccaggaagatggagaaaaagcattccgagaactagaaacaaattgcttaaaagaaacaattaaaatcccttctttaatcgtttctactggtggaggaattatttctaaaccagaaaactggggtgttttaaggcaaggaattattatttggattgacacaaagcaagagattgctcttgagaggttgaaaaaagatattgaaaatagacctctattacagggagaagatttaagtgatttatataaccaaatttttcaatctagaaaaaatttatattctcaggctgacttaagagttgaggttaataacgaagatgttgaagaagttgcaaaacaaatagtttatggaatttacaaaaaaattataaattaa

SEQ ID NO: 2122 - protein, 185 aa, Prochlorococcus marinus subsp
MEKSIIEKTNKIIQGRSIYLIGMMASGKSKTGPVLAELLRYKYIDLDKLIENIAKKTINEMFQEDGEKAFRELETNCLKETIKIPSLIVSTGGGIISKPENWGVLRQGIIIWIDTKQEIALERLKKDIENRPLLQGEDLSDLYNQIFQSRKNLYSQADLRVEVNNEDVEEVAKQIVYGIYKKIIN

SEQ ID NO: 2123 - DNA, 579 bp, Prochlorococcus marinus
  CDS (1)..(579)
atgaacgaaagcccagcccctcaccccctcaagcaaaggcttggtggtcgcaacctctatttggtgggaatgatggccagtggcaagagcagcacaggcaggcctctagccgaacaactcagctatgggtttgttgatacagatgccgtcatcgaacaacttgctggccaaccaatcccgaagatctttagcgaagaaggagaagcagggtttcgaacaatggagtctcaagtactcaatgccattggccaacgccattcacttgttgttgctactggcggagggatagtgagtaagccagaaaactggggggtcttgcatcagggcatcgtgatctggctaaaccctgggcgagaagagctactcagacgcttaaatgccgacagcggcaataggcctttactgcaaacagaagatccagaagcagccttcgactgtttatttgccgagcgcctaccgctttattgcgaagcagacttgcatgtggaagtgggagcagaggaaccagacgggattgcgctaaagattattgagttcctgccccagttattatcgccacctccacaaatgaatggttaa

SEQ ID NO: 2124 - protein, 192 aa, Prochlorococcus marinus
MNESPAPHPLKQRLGGRNLYLVGMMASGKSSTGRPLAEQLSYGFVDTDAVIEQLAGQPIPKIFSEEGEAGFRTMESQVLNAIGQRHSLVVATGGGIVSKPENWGVLHQGIVIWLNPGREELLRRLNADSGNRPLLQTEDPEAAFDCLFAERLPLYCEADLHVEVGAEEPDGIALKIIEFLPQLLSPPPQMNG

SEQ ID NO: 2125 - DNA, 573 bp, Prochlorococcus marinus
  CDS (1)..(573)
atgacttataaattgagacctaatcaagtgataaaaaaattaggaggccgcattatctatctagtaggaatgatgggttcaggaaagagcactacagggccgcatcttgctaaattactgaaatatagttttattgatcaggatgaattaattgagaaagtagctaaatcttccgtttcacagatttttagagaagaaggtgaaaatggttttcgtgatattgagactcaagttctcaagcaaattggtcaaagacattccttggttgttgcaactggaggaggtcttgtaactcgttctgagaactggggtgttttacatcaaggaattgttatttggctggatccaaatcgggaacttttgtttgcaaggttgaagtctgataaaacggttgttcgcccgttgttggacaataaagatcctaaagacgtcttggactctttaataaagcaacgctatttgtcatatgctgaagcagatttacatatctctatcgagagggaaacacctgaagaagttgccttagtaattttcaaaaaattgtctgaaataattagagttcaggaggattaa

SEQ ID NO: 2126 - protein, 190 aa, Prochlorococcus marinus
MTYKLRPNQVIKKLGGRIIYLVGMMGSGKSTTGPHLAKLLKYSFIDQDELIEKVAKSSVSQIFREEGENGFRDIETQVLKQIGQRHSLVVATGGGLVTRSENWGVLHQGIVIWLDPNRELLFARLKSDKTVVRPLLDNKDPKDVLDSLIKQRYLSYAEADLHISIERETPEEVALVIFKKLSEIIRVQED

SEQ ID NO: 2127 - DNA, 558 bp, Candidatus Blochmannia floridanus
  CDS (1)..(558)
atgttaacagataatagaaaaatttttttaattggtcctatgggtgctggtaaaagcactataggtcgtcagttggcgcaacggttgaatttagaattctttgattcagatcgagaaattgaaacgtgtaccggagtaaatattagttgggtatttgatgtagaaggtgaagttggatttcgtaatcgggaggaaaaaattattgatgagttgactcaaaaaaaaagcattgtactggctactggaggaggttctattaaatctcatattgctagagatcatcttgctaaacgaggattagtaatttatttaaaaacgactattgataaacaattagtgcgtactaaacgtgataaaagaagacctttattaaaatcatctacattatttaattatcagaatttaagagagttgttagaggatttagcaaaagaacggaatccattgtacgaggaaatttctgatattacagtatcaactgatgagtacagtgtaaaatgtgtagtaaataagattcttgtacttttaaaaaagaatggtgctatatataaagattaa

SEQ ID NO: 2128 - protein, 185 aa, Candidatus Blochmannia floridanus
MLTDNRKIFLIGPMGAGKSTIGRQLAQRLNLEFFDSDREIETCTGVNISWVFDVEGEVGFRNREEKIIDELTQKKSIVLATGGGSIKSHIARDHLAKRGLVIYLKTTIDKQLVRTKRDKRRPLLKSSTLFNYQNLRELLEDLAKERNPLYEEISDITVSTDEYSVKCVVNKILVLLKKNGAIYKD

SEQ ID NO: 2129 - DNA, 636 bp, Bordetella bronchiseptica
  CDS (1)..(636)
atgaatgcttccgctaatttatgcgcggcgtccgacaacgacccgcaaccgggcgaccaggaggccgcccaccctgtagcctgcgccggtgacgagccggcggcgttcctgccgcacgatctgccgatctttctggtggggatgatgggcgccggcaagaccaccatagggcgaggcctggcgcgtgcgctgaggcgcgaattcatcgatctcgaccatgagttggaggcgcgttgcggcgtgcgggttccggtcatcttcgaaatcgaaggcgaagccgggtttcgccggcgggaagctgccgcattgcaagagtgtacccaacgccggcagataattcttgccaccggcgggggcgcggtgctggccgcggagaaccggcaggccctgcgcgagcgcggcatcgtgatctacctgcgcgccagcgtggaagagctgttccggcgcaccagccgcgatcgcaaccgccccttgctggccaccgccgatccgcgcgctaccctgcgcgagctgatggtggcgcgcgaaccgctgtataacgaggtggccgatctggtcatcgataccggcagcatgcccatcgccacgctggtgaagtccctgctgcccaagctgcaagcctacgagaagaaataa

SEQ ID NO: 2130 - protein, 211 aa, Bordetella bronchiseptica
MNASANLCAASDNDPQPGDQEAAHPVACAGDEPAAFLPHDLPIFLVGMMGAGKTTIGRGLARALRREFIDLDHELEARCGVRVPVIFEIEGEAGFRRREAAALQECTQRRQIILATGGGAVLAAENRQALRERGIVIYLRASVEELFRRTSRDRNRPLLATADPRATLRELMVAREPLYNEVADLVIDTGSMPIATLVKSLLPKLQAYEKK

SEQ ID NO: 2131 - DNA, 864 bp, Oryza sativa
  CDS (1)..(864)
atggacgccggtgtgggtctccgggcgaagcccggcgcctgggccggactcggaaacccacgccgctcttccacggcgagggttccggtgaggttcgcggtggagaagttcgctcagccgttggttttgggctctgatcgccggagctgcggtgccaaactgaaggtttcgtgttccaggaaaccggcaggtattgacaaaacctattactctgctgatgaagctcttgttctaaagcaaaaagcagaggacgtggtcccttatttgaatgaccggtgtatttacttagttggaatgatgggttctggcaaaactacagttgggaagatattagctgaagtattaggctattctttctttgacagcgataagttggttgagaaggcagttggcatatcatctgttgctgaaatctttcagctccatagtgaagcattcttcagagataatgagagtgaggtactaagggatttgtcgtcaatgcatcgattagttgttgcaaccggaggtggtgcggtgatccgaccaatcaattggagttacatgaagaaagggtcaacaatctggttagatgttccattggatgcacttgcaagacgaattgctgcagtaggaactgcttctcggcccctcttgcatcaagaatctggtgatccttatgcaaaggcttatgcaaaactgactgcactttttgaacaaagaatggactcatatgctaatgctgatgccagggtttcactcgaacatattgcagtgaaacaaggacatagtaatgtgacgacacttacaccaagtgccattgctattgaggcattgctaaagatggagagctttcttactgagaaggcaatgatcagaaactaa

SEQ ID NO: 2132 - protein, 287 aa, Oryza sativa
MDAGVGLRAKPGAWAGLGNPRRSSTARVPVRFAVEKFAQPLVLGSDRRSCGAKLKVSCSRKPAGIDKTYYSADEALVLKQKAEDVVPYLNDRCIYLVGMMGSGKTTVGKILAEVLGYSFFDSDKLVEKAVGISSVAEIFQLHSEAFFRDNESEVLRDLSSMHRLVVATGGGAVIRPINWSYMKKGSTIWLDVPLDALARRIAAVGTASRPLLHQESGDPYAKAYAKLTALFEQRMDSYANADARVSLEHIAVKQGHSNVTTLTPSAIAIEALLKMESFLTEKAMIRN

SEQ ID NO: 2133 - DNA, 471 bp, Bacillus cereus
  CDS (1)..(471)
atgggagcagggaaaacaacaattggaaaagcattaagtcaagaacttcaaatggatgttgtagatactgatcaaaaaatcgaagagaagcaagagaaggcaattcgaaatatttttgccgaagaaggcgaaatggcttttcgggaatatgaaagcgaaatgttacgtgcgctaccagtccataatgtcattattacaactggtgggggaattattgaacgagcggaaaatcgcaagtggatgaaagagaacggaactgtcgtgtatttatattgtgatccgcatgtaattgcagaaaggcttcgtgaagatacgacacgtccactatttcaaaagaaagatatagatgcatttgtaacgaaatttgaatcacgccgagcttattatgaagaggctcacattcatatcgatacgacaaataagtctgtaaagcaaattatgaatgaattaaaggaaaagattaatgtataa

SEQ ID NO: 2134 - protein, 156 aa, Bacillus cereus
MGAGKTTIGKALSQELQMDVVDTDQKIEEKQEKAIRNIFAEEGEMAFREYESEMLRALPVHNVIITTGGGIIERAENRKWMKENGTVVYLYCDPHVIAERLREDTTRPLFQKKDIDAFVTKFESRRAYYEEAHIHIDTTNKSVKQIMNELKEKINV

SEQ ID NO: 2135 - DNA, 498 bp, Bacillus anthracis
  CDS (1)..(498)
atgaaatctatatacataaccggttatatgggagctgggaaaacaacaattggaaaagcattaagtaaagaacttcatatggatgttgtagatacagatcaaaaaattgaagagaagcagggaaaagtaattcgtgatatttttgccgaagaaggtgaaatggcttttcgggaatatgaaagtgaaatgttatgttcactacctgttgataatgtaatcattacaactggcggcggaatcgttgagcgagaggaaaaccgaaaatggatgaaggaaaatggaactgtcgtgtatttatattgtgatccacatgtaattgcagaaaggcttcgtgaagatacgacacgtccactatttcagaagaaagatatagatgcatttgtaacgaaattcgaatcgcgccgagcttattatgaagaggctcatattcatatcgatacgacgaataagtctgtaaagcaaattatgaatgaattaaaagaaaagattaatgaataa

SEQ ID NO: 2136 - protein, 165 aa, Bacillus anthracis
MKSIYITGYMGAGKTTIGKALSKELHMDVVDTDQKIEEKQGKVIRDIFAEEGEMAFREYESEMLCSLPVDNVIITTGGGIVEREENRKWMKENGTVVYLYCDPHVIAERLREDTTRPLFQKKDIDAFVTKFESRRAYYEEAHIHIDTTNKSVKQIMNELKEKINE

SEQ ID NO: 2137 - DNA, 522 bp, Chlamydophila caviae
  CDS (1)..(522)
atgaacctatttctatgtggactaccggcagtgggcaagaccttattgggtcgtgcccttgctaactatctatcaatttctttctttgatactgatgatttaattgtaagtaactacgacaacgggctatattcctcagcaggtgagatatttcaagctgttggagaagaggcgtttgcaactttagaggtagaggctttacgctccttaccccgagataatagcgttactgctttaggtgggggtaccattatgcatcaagaagcatatgatataattaagcacaggggaacattgatctatctttctcttcctgttactgaaatttatcaacggctcttgaaacgcggccttcccgaaagattaaaacacacgccaaatgtagaagagattttaaaacaacgtataaatcgtatgcagcgtgtagcaaattacaatttttctctgaatcatatagacctctttgatgaacgctctttattatcggcatgtgaatctcttaatattttactaaatccatga

SEQ ID NO: 2138 - protein, 173 aa, Chlamydophila caviae
MNLFLCGLPAVGKTLLGRALANYLSISFFDTDDLIVSNYDNGLYSSAGEIFQAVGEEAFATLEVEALRSLPRDNSVTALGGGTIMHQEAYDIIKHRGTLIYLSLPVTEIYQRLLKRGLPERLKHTPNVEEILKQRINRMQRVANYNFSLNHIDLFDERSLLSACESLNILLNP

SEQ ID NO: 2139 - DNA, 516 bp, Streptomyces avermitilis
  CDS (1)..(516)
atgaccgttccgcgcgtcgtcctcgtcggccccatgggcgtcggcaagtccacggtgggcgcgctcgtcgccgagcggctcggctgcgcctaccgggacacggacgacgacatcgtgaccgccgagggccgcaccatcgccgacatcttcgtcgacgagggcgagccggtcttccgtgccatcgagaagcgggcggtgcacacggcgctcgccgagcacgacggcgtactggcgctcggcggcggcgcgatcctcgacgcggacacccgcgcgctgctcgccgggcaccgtgtcgtctacctctcgatggaggtcgacgaggccgtcaagcgcaccggcctcaacgcggcccggccgctgctcgccgtcaacccgcgccggcagtggcgggagctgatggaggcgcgccgccacctgtacaccgaagtcgcccgcgcggtggtcgccaccgacggccgcggccccgaagaggtcgcccaagccgtcctcgacgcactggagttgaaggaagcatga

SEQ ID NO: 2140 - protein, 171 aa, Streptomyces avermitilis
MTVPRVVLVGPMGVGKSTVGALVAERLGCAYRDTDDDIVTAEGRTIADIFVDEGEPVFRAIEKRAVHTALAEHDGVLALGGGAILDADTRALLAGHRVVYLSMEVDEAVKRTGLNAARPLLAVNPRRQWRELMEARRHLYTEVARAVVATDGRGPEEVAQAVLDALELKEA

SEQ ID NO: 2141 - DNA, 636 bp, Nitrosomonas europaea
  CDS (1)..(636)
atgcatttccggtacaattaccgcatgcaacgcagcaaaacgccaaacacaaaaaattctgataccgggtcgataccaggcaacatcatcctgatcggtatgatgggctccggtaaaaccacggttggcaagttactagcaaatctcgtcggcaagactttcatcgacatcgatcatgaaatccagcgacgcacaggggtcggaatacccgtgatcttcgaaatagaaggagaagccggttttcgcaaacgtgaaagcgaagtactgcgggatatcgtcaggcagcagaacatcgtactcgctaccggagggggagcaatattacaccccgataatcgtgccttactgcggcagcatggtacggtggtttatctgtgtgcacccgtcacggaattgcgccgccgtacttatctggataaaaaccggcctctgctgcaaaccggaaacgtgcatgccaaactgattgagctatttacccaacgcgatccgctgtatcgcgaaaccgcacatatcatcatggacagcggtcggcaaagtgcccgtgctttcgtccagaaactgatacagaaattacgccagtccaatcaggaattcactgctgccggatctcctccttgcgttaaaccgtctgaataa

SEQ ID NO: 2142 - protein, 211 aa, Nitrosomonas europaea
MHFRYNYRMQRSKTPNTKNSDTGSIPGNIILIGMMGSGKTTVGKLLANLVGKTFIDIDHEIQRRTGVGIPVIFEIEGEAGFRKRESEVLRDIVRQQNIVLATGGGAILHPDNRALLRQHGTVVYLCAPVTELRRRTYLDKNRPLLQTGNVHAKLIELFTQRDPLYRETAHIIMDSGRQSARAFVQKLIQKLRQSNQEFTAAGSPPCVKPSE

SEQ ID NO: 2143 - DNA, 507 bp, Enterococcus faecalis
  CDS (1)..(507)
atggaaagcattgttttaattggtttcatgggtgcgggtaaaacaactatcggccaaagtttggccaataaactgaagatgcctcatcttgatttagatacagcgttaattgaaaaaataggacgctcaattcctgactatttcgaaaaatatggtgaagcagctttccgagaacaggaaacccaacttttaaaggagctgtcaaaaaatacagccgtcctttcaactgggggcgggattgttgtcggaccagaaaatcgtagcttattaaaatcttttcagcaagtgatttatttacatgcgacaccagaagagctgttaaaaagaatcacagaagatactgaaaaccaacggcccttagctatagaacgttcttcaaaagaaatcattactttgtttgagtctcgtaaaaatttttatgaagaatgtgcgaagatgacaattgatacgaccaatcgctcgccagaagaaattatcaatgaaattctgcaacaattaaaggagtag

SEQ ID NO: 2144 - protein, 168 aa, Enterococcus faecalis
MESIVLIGFMGAGKTTIGQSLANKLKMPHLDLDTALIEKIGRSIPDYFEKYGEAAFREQETQLLKELSKNTAVLSTGGGIVVGPENRSLLKSFQQVIYLHATPEELLKRITEDTENQRPLAIERSSKEIITLFESRKNFYEECAKMTIDTTNRSPEEIINEILQQLKE

SEQ ID NO: 2145 - DNA, 540 bp, Coxiella burnetii
  CDS (1)..(540)
atgaaaaaaaatctcaccaatatttatttaatcggcctcatgggcgcgggcaaaaccagcgtcggtagccaacttgctaagttgacgaaacgtatactctacgattccgacaaagagattgaaaaacgaaccggcgctgatatagcttggatttttgaaatggaaggagaggctggtttccgtcgacgtgaaagagaaatgattgaagcgctttgtaaacttgataatatcattttagccactggaggcggtgttgtgttagatgaaaaaaatcgacagcaaatatctgaaaccggtgtcgttatctatttaaccgcttccatcgacactcaattaaaacggattggtcaaaagggtgagatgcgacgccctctttttattaaaaataattccaaagaaaaattacaacagcttaacgaaatccgaaaacccctttatcaggcaatggcggacctcgtttatccgacggacgatctaaatcctcgtcagctagccactcaaattctagttgatattaaacaaacctattcagacctatga

SEQ ID NO: 2146 - protein, 179 aa, Coxiella burnetii
MKKNLTNIYLIGLMGAGKTSVGSQLAKLTKRILYDSDKEIEKRTGADIAWIFEMEGEAGFRRREREMIEALCKLDNIILATGGGVVLDEKNRQQISETGVVIYLTASIDTQLKRIGQKGEMRRPLFIKNNSKEKLQQLNEIRKPLYQAMADLVYPTDDLNPRQLATQILVDIKQTYSDL

SEQ ID NO: 2147 - DNA, 510 bp, Tropheryma whipplei
  CDS (1)..(510)
atggaatcaatggctatcgtactaattggtcctcctgccgtcgggaaaacccttttggggggtcttgttgcaaagcgccttcgggtaatctttaacgatacagattttctagtggaaaaattttttggacccgtgaaagaactgcttttaacctgcgaaagtcagtttagagatgctgagtccatctgcttgcgaaatgccctctctcgcgggggtgttgtcgcaactggtgcagggtgtgttcagcgaaaggaaaatcagaggtacatatccaggcatttagttatttttttgcgcacctcatgcgataacgtcgctccacgcctttgttttgacacacgtcccgtaacgggtgatattgaatcatggattgctgtgtacaacaaacgaaaagatatttattcaaaactggcagatattgaatttgatgtcaataagagcagtccgatatctttagcagatcaacttgtacggtttatttacaatcgctcttggcatcgagaattctga

SEQ ID NO: 2148 - protein, 169 aa, Tropheryma whipplei
MESMAIVLIGPPAVGKTLLGGLVAKRLRVIFNDTDFLVEKFFGPVKELLLTCESQFRDAESICLRNALSRGGVVATGAGCVQRKENQRYISRHLVIFLRTSCDNVAPRLCFDTRPVTGDIESWIAVYNKRKDIYSKLADIEFDVNKSSPISLADQLVRFIYNRSWHREF

SEQ ID NO: 2149 - DNA, 468 bp, Shigella flexneri
  CDS (1)..(468)
atggcccttgccgattcgcttaaccgtcggtttgtcgataccgatcagtggttgcaatcacagctcaatatgacggtcgcggagatcgtcgaaagggaagagtgggcgggatttcgcgccagagaaacggcggcgctggaagcggtaactgcggcatccaccgttatcgctacaggcggcggcattattctgacggaatttaatcgtcacttcatgcaaaataacgggatcgtggtttatttgtgtgcgccagtatcagtcctggttaaccgactgcaagctgcaccggaagaagatttacggccaaccttaacgggaaaaccgctgagcgaagaagttcaggaagtgctggaagaacgcgatgcgctatatcgcgaagttgcgcatattatcatcgacgcaacaaacgaacccagccaggtgatttctgaaattcgtagcgccctggcacagacgatcaattgttga

SEQ ID NO: 2150 - protein, 155 aa, Shigella flexneri
MALADSLNRRFVDTDQWLQSQLNMTVAEIVEREEWAGFRARETAALEAVTAASTVIATGGGIILTEFNRHFMQNNGIVVYLCAPVSVLVNRLQAAPEEDLRPTLTGKPLSEEVQEVLEERDALYREVAHIIIDATNEPSQVISEIRSALAQTINC

SEQ ID NO: 2151 - DNA, 903 bp, Azoarcus evansii
  CDS (1)..(903)
atgagcctcgaacccaccaccgaacagcagcaggaagagctccagacggccgaccaggccgccgaaggcaatatcctgccgacgctcggcaagcgcgtccgcgagatccgcgaccgccgtggcatgacgagaaagctcgtggcgcgtgaagccggcgtttcggaacgccacctcgcccacctcgaaggcggcgacggcaacgtgtccatcgtcctgctgcacaacatcgcccgcgcgctcaacgtttcgctgatcgagctgctcgcgccggaaaccgaagacaccgtcgagaagcgcctcatccgccgcttcctcgagcgcctgccgcagcaccgcctggaagaagtggtgttccgcctgatgcgcgacttcggccacgaggaagccgtgcgccgcaagcgcgtcgcgctgatcggcctgcgcggcgccggaaagtcgacgctcggcaagcgcctcgcgcaggaagaaaacatgcccttcatcgagctcgaccgcgagatcgagaaggaaaccggcatccccgggcgcgagatcttctcgctgtacggccagtccggttatcgccgcatcgagaagcgcaccctcgagcgcgtgctgcgcgacaacccgcgcgccgtgatctcggtcggcggcggcgtcgtgtcgcagccggaaagcttcgagatgctgctgtcgcagtgcatgaccgtgtgggtcaaggcccagccggaagaacacatgtcccgcgtgatggcccagggcgacctgcgcccgatggcgggcaacgacgaggcgatggaggacctcaagcgcatcctcgaggcgcgcttgcccctctacgccaaggccgacaccgtgctcgacacctcgggtgaaacggtggaccagagtttcatcaaattgcgccagctcgtgatgggctga

SEQ ID NO: 2152 - protein, 300 aa, Azoarcus evansii
MSLEPTTEQQQEELQTADQAAEGNILPTLGKRVREIRDRRGMTRKLVAREAGVSERHLAHLEGGDGNVSIVLLHNIARALNVSLIELLAPETEDTVEKRLIRRFLERLPQHRLEEVVFRLMRDFGHEEAVRRKRVALIGLRGAGKSTLGKRLAQEENMPFIELDREIEKETGIPGREIFSLYGQSGYRRIEKRTLERVLRDNPRAVISVGGGVVSQPESFEMLLSQCMTVWVKAQPEEHMSRVMAQGDLRPMAGNDEAMEDLKRILEARLPLYAKADTVLDTSGETVDQSFIKLRQLVMG

SEQ ID NO: 2153 - DNA, 522 bp, Lactobacillus plantarum
  CDS (1)..(522)
atgcgagcaattttaattggatttatgggtagtgggaaaacaacggtcggtcggcttttggcggccgggttagcaactaaacatgctgatttagatgatttgattgttcagcgggcgggacggtcgattacgactatttttgcggagcaaggagaggggtacttccggcaattggagcatcagactttgctccaagcactcgaaacacccgggattttatcgaccggtggtggtactccgaccattgcaatgaatgcaattagtctgaaacaaagcacggtgccagttatctggttgacggctagtgatcaaaccactattaaccgtgttaaaaatgatactagccgaccacttgtcaatgaattggatacaggggcactgattgcgttgaagcaacggcgccaagccttatatgccgctgcggccgatttgacgatcgcaaccgatcaactgacaccccagcagattgcccgccaaattcagcagtggttgaatcagcagccagttgcgctccaagcttga

SEQ ID NO: 2154 - protein, 173 aa, Lactobacillus plantarum
MRAILIGFMGSGKTTVGRLLAAGLATKHADLDDLIVQRAGRSITTIFAEQGEGYFRQLEHQTLLQALETPGILSTGGGTPTIAMNAISLKQSTVPVIWLTASDQTTINRVKNDTSRPLVNELDTGALIALKQRRQALYAAAADLTIATDQLTPQQIARQIQQWLNQQPVALQA

SEQ ID NO: 2155 - DNA, 504 bp, Clostridium tetani
  CDS (1)..(504)
atgccaggggcagggaagtctacctttggaaaagagcttagcaagataatacagtatgattttatagatacagattatgaaatagaaaaaatagaaagaagtgctattaaacatatttttaaagaaaagggagaaaactactttagaaaattggaaagagatttattaaatgatataataaaatttgataaaaaagtagttgctacaggtggaggattgcccatatttttcaacaatatggacatattaaataaaaatggtattactatttttttagatgtgccattggaagaacttttaaaacgaaatgaaaaaaatgacaataggcctttattggataaagaaaataaatatgataaattaaaagaaatatataattctagaatccatatatataataaatgtaaaattaaagtggaaaattataatatatctgcctatgaattaagctataaaatattagaagagatgagaaataaataccaccatattatttgcaaatga

SEQ ID NO: 2156 - protein, 167 aa, Clostridium tetani
MPGAGKSTFGKELSKIIQYDFIDTDYEIEKIERSAIKHIFKEKGENYFRKLERDLLNDIIKFDKKVVATGGGLPIFFNNMDILNKNGITIFLDVPLEELLKRNEKNDNRPLLDKENKYDKLKEIYNSRIHIYNKCKIKVENYNISAYELSYKILEEMRNKYHHIICK

SEQ ID NO: 2157 - DNA, 909 bp, Bradyrhizobium japonicum
  CDS (1)..(909)
atgaccgacagtcccgacgccgaatcccgcttcctcgaacagctcggccagcgtgtgcgcaccacgcgcgcactgcgcggcatgtcgcgcaaagtgctcgccaaggtatcaggaatctcggagcgctacatcgcgcagctcgaaagcggcaagggcaatgtctcgatcgtgctgctccgccgcgtctccgacgcgatgggcgcgcatctcgaagatctgctgcccagcgccgatccgacgccggactggcagatgtttcgcgatctcctgcgcaaggcgacgcccgcgcagatcgcgcaggccaaggacgtgctcgccggcggcagcgcatccgcgccgcggcgcgcgccgttctgcggcatcgcgctgatcggcctgcgcggcgccggcaagtccacgctcggcaagatcctggcgaagaaggtcggctggagcttcgtcgagctcaacaaggaggtcgagcagcagaacggcctctcggtcgccgagatcatcgcgctctacggccaggaaggctttcgccgcatggagcaggcggcgctgcaacagctgctcgcgcgcaacgagttgatggtgcttgcgaccggcggcggcatcgtctccgagcctttgaccttcgaccagatcctgtcgtcgttctacacgatctggctgaaggccgagcccgaggagcacatggcccgcgtccgtcgccagggcgacctgcgcccgatggcggacgaccgctccgcgatggccgagctgcgcaacatcctcttgagccgcgagccgctgtactcgcgtgcgacggcggtggtggacacggcgggcctctccgtcgatgccgccgccgcgcgcctgatcgacgcggtgcgcccggtgctccagaacgaagcgcgcagttttggtctgcgcagcgtggcgctgtag

SEQ ID NO: 2158 - protein, 302 aa, Bradyrhizobium japonicum
MTDSPDAESRFLEQLGQRVRTTRALRGMSRKVLAKVSGISERYIAQLESGKGNVSIVLLRRVSDAMGAHLEDLLPSADPTPDWQMFRDLLRKATPAQIAQAKDVLAGGSASAPRRAPFCGIALIGLRGAGKSTLGKILAKKVGWSFVELNKEVEQQNGLSVAEIIALYGQEGFRRMEQAALQQLLARNELMVLATGGGIVSEPLTFDQILSSFYTIWLKAEPEEHMARVRRQGDLRPMADDRSAMAELRNILLSREPLYSRATAVVDTAGLSVDAAAARLIDAVRPVLQNEARSFGLRSVAL

SEQ ID NO: 2159 - DNA, 735 bp, Bradyrhizobium japonicum
  CDS (1)..(735)
atggcaagagtcctctggcgaggccccctttggggtcgtataggtggccaaagcaggccgcttttggcggcagatcgagcgagacccagagcgagatccagagcgagacccatgtccgacgccgcgttgccgatacaagcatcgcctgaggccgacatcctgtcggcgctcggggcgcgctcgatcgtgctcgtcggcatgatgggggtgggtaaatccaccatcggccgccgcatggcggcccggctcaagctgcccttcgtcgacgcggacaccgagatcgaggcggcggccggcatgaccataccggagattttcgagcgccatggcgagggccatttccgcgacggcgaggcccgcgtgatcgcgcgcctgctcgacggcggcccggtggtgctggcgaccggcggcggcgccttcatgcgcgaggagacgcgtgcgcgcatcgcggccaaggcggtctcgatctggctcaaggccgaccacgacgtcatcatgcgccgcgtccgccgccgcgccgaccgcccgttgctccagaccgccgaccccgagggaaccgtgacgcgcctgctcaccgagcgcgagccggtctacagccatgccgacctcaccatcgcctcgcgcgacgtgccgcacgacaagatcgtcgaggagtgtatcgagacgctgcgcgcccatctctgcggcgaacaggccgcccaaccacctgccgacgttgcgagtgccgtacgatga

SEQ ID NO: 2160 - protein, 244 aa, Bradyrhizobium japonicum
MARVLWRGPLWGRIGGQSRPLLAADRARPRARSRARPMSDAALPIQASPEADILSALGARSIVLVGMMGVGKSTIGRRMAARLKLPFVDADTEIEAAAGMTIPEIFERHGEGHFRDGEARVIARLLDGGPVVLATGGGAFMREETRARIAAKAVSIWLKADHDVIMRRVRRRADRPLLQTADPEGTVTRLLTEREPVYSHADLTIASRDVPHDKIVEECIETLRAHLCGEQAAQPPADVASAVR

SEQ ID NO: 2161 - DNA, 528 bp, Bacteroides thetaiotaomicron
  CDS (1)..(528)
atggttcgtatcttccttaccggctatatgggtgccggaaaaactactttgggcaaggcttttgcccgcaaactgaatgtcccgttcattgatctggactggtatatcgaagaacgttttcataaaactgtcggagaactattcacggaacggggggaagccggatttcgagagttggaaagaaatatgcttcatgaggtagctgagtttgagaacgtcgttatctctacaggcgggggagcaccctgcttttatgacaatatggagtttatgaaccggacggggaaaaccgttttcttgaatgtacatcccgatgtgctgttcagacgcttgcgtattgccaagcagcaacgtcccattcttcagggaaaggaagatgatgaattaatggatttcatcattcaggcgcttgaaaagcgcgcacctttttatacgcaggcgcaatatatctttaatgcggacgaactggaagaccgctggcagattgaatcatctgtgcaacgtctgcaggaactgctggaattataa

SEQ ID NO: 2162 - protein, 175 aa, Bacteroides thetaiotaomicron
MVRIFLTGYMGAGKTTLGKAFARKLNVPFIDLDWYIEERFHKTVGELFTERGEAGFRELERNMLHEVAEFENVVISTGGGAPCFYDNMEFMNRTGKTVFLNVHPDVLFRRLRIAKQQRPILQGKEDDELMDFIIQALEKRAPFYTQAQYIFNADELEDRWQIESSVQRLQELLEL

SEQ ID NO: 2163 - DNA, 477 bp, Streptococcus mutans
  CDS (1)..(477)
atggctaaaattttaatcggttttatgggggcaggaaaatcaactgtttcccgtttattagacccggattttcaagatatggatgatattataactgagaaaattggaatgcctattgcagcattttttgaaaaagaaggtgaggatgcctttcgggaaattgagtctgaaaccttatccaatcttgctgattcagatagtactgtatcaactggaggcggtgttgttgagagtgctcgcaatcgtgatattttggcaaaaaatggtgaaacaatttatttaaaagcagattttgaaactctttgtaagcgaattgaagcagacagtaataacgttcggccactttttattaataatagccgtcaggaatttaaaaagattttcgatcgcagacaggctctctatgaggaagccgctaatattattattgatgttgctggtaaaacaccccaagaaattgttgaggaaataaaatga

SEQ ID NO: 2164 - protein, 158 aa, Streptococcus mutans
MAKILIGFMGAGKSTVSRLLDPDFQDMDDIITEKIGMPIAAFFEKEGEDAFREIESETLSNLADSDSTVSTGGGVVESARNRDILAKNGETIYLKADFETLCKRIEADSNNVRPLFINNSRQEFKKIFDRRQALYEEAANIIIDVAGKTPQEIVEEIK

SEQ ID NO: 2165 - DNA, 513 bp, Streptococcus agalactiae
  CDS (1)..(513)
atgcctaaggtattattgggattcatgggagttggcaagactagtgttgccaactgcttagaaaatgaagtaattgatatggatagtctgattgaaaaacatattggtatgtcaatttcccgattttttacagaagaaggagaagcctcctttcgtgctttagaatctcaatttttaaacgaacttttaaagaaaaaaaatgaaggacttgtgatagctagtggaggaggtattgtactccttgaagaaaatcgtcgtcttttaactttaaatcgtcataataatattcttttaacaggaagttttgaagtcttatatcatcgtataaaaaaagatgagaagaatagaagaccattatttttaaaccattcaaaagaagaattttatgatatttatcaaaaacgcatgttactctatagtggtttgtctgatatgattattgataccgattatcttacaccacaaaaaatagctactgtaattggagagtcactggttaatttatctaactaa

SEQ ID NO: 2166 - protein, 170 aa, Streptococcus agalactiae
MPKVLLGFMGVGKTSVANCLENEVIDMDSLIEKHIGMSISRFFTEEGEASFRALESQFLNELLKKKNEGLVIASGGGIVLLEENRRLLTLNRHNNILLTGSFEVLYHRIKKDEKNRRPLFLNHSKEEFYDIYQKRMLLYSGLSDMIIDTDYLTPQKIATVIGESLVNLSN

SEQ ID NO: 2167 - DNA, 603 bp, Brucella suis
  CDS (1)..(603)
atgagcggtacgaacaaacaaacaaatcttcacaggcagacggaaacgatccgccagctgctcggcagtaaagtggttgttctcgttggcctgatgggagccggaaaatccaccatcggccgcaaggtggcgaacatgctcaacctgccgttcaaggatgcggatacggaaattgaaactgtttcgcggatgacagttgccgaactgttcgaggcctatggggaagtggaatttcgcgatctcgaacgtcgcgtgatcctgcgccttctcgatgacggccccatggtgctggcgaccggcggcggcgcctatatgaacgccgaaacccgcgcggcgattgccgaagcggggatttccatctggattaatgccgatctcgacgtcttgatggagcgcgtttcgcgccgccagaaccgtccccttttgagaaacagcgatccgcgcggcgtcatgcagcggctgatggacgagcgctacccggtttatgcgctggccgagctgcatctgatgacgcgcgatgagaaaaaggaagtgattgccgcagaactgatcgaggttctggcggcgcatctggaaaaggaacaggccgcttccgccggatga

SEQ ID NO: 2168 - protein, 200 aa, Brucella suis
MSGTNKQTNLHRQTETIRQLLGSKVVVLVGLMGAGKSTIGRKVANMLNLPFKDADTEIETVSRMTVAELFEAYGEVEFRDLERRVILRLLDDGPMVLATGGGAYMNAETRAAIAEAGISIWINADLDVLMERVSRRQNRPLLRNSDPRGVMQRLMDERYPVYALAELHLMTRDEKKEVIAAELIEVLAAHLEKEQAASAG

SEQ ID NO: 2169 - DNA, 912 bp, Thauera aromatica
  CDS (1)..(912)
atgagcacccagatcgacgacagcctgaatgccacaccaaatgacggcgatgccgaggtcgacacccgcagcgatgccgaatttctcgacgcgctcggtaagcgcgtgcgcgagatccgcgatcgccgcggcatgacccgcaagctggtggcgcgcgaagcgagcgtatcagagcgccacctcgcccatctcgaagccggcgaaggcaacgtctccatcgtcctgctgcgccacatcagccgcgccctcgacgtgccactgatcgagctgctcgcggtggagaccgaagacaccgtcgaacgccgcctgatccgccgctttctcgaacgcctgccccggcaccggctggaagacgtggtgttccgcctgatgcgcgacttcggtcacgaggaagccgcgcgccgcaagcgcatcgccctgatcggcctgcgcggcgcaggcaagaccacgctcggcaagcgcctcgccaccacacaaggcgtccccttcatcgagctcgacggcgagatcgaaaaggaaaccggcatgccgtcgagcgagcttttcgcgctctacgggcagaccggttaccgccgcatcgagcagcgaacactcgagcgcgtgatccgcgaccacgaccgggcggtgatctcggccggcggcggcgtcgtgtcgcagcccgaaacctacgacatgctgctctccaactgcctgacggtgtggctcaaggcccagcccgaagagcacatgtcacgggtcatggcccagggcgacctgcgcccgatggccggcaacgacgaggcgatggaagatctcaagcgcatcctcaatgcccgcgagccgctgtacgcgcgcgccgataccgtgatcgacacttccggtctgaccatcgacgcctgcttccagaaactgcgggaaatcgtcaccagctga

SEQ ID NO: 2170 - protein, 303 aa, Thauera aromatica
MSTQIDDSLNATPNDGDAEVDTRSDAEFLDALGKRVREIRDRRGMTRKLVAREASVSERHLAHLEAGEGNVSIVLLRHISRALDVPLIELLAVETEDTVERRLIRRFLERLPRHRLEDVVFRLMRDFGHEEAARRKRIALIGLRGAGKTTLGKRLATTQGVPFIELDGEIEKETGMPSSELFALYGQTGYRRIEQRTLERVIRDHDRAVISAGGGVVSQPETYDMLLSNCLTVWLKAQPEEHMSRVMAQGDLRPMAGNDEAMEDLKRILNAREPLYARADTVIDTSGLTIDACFQKLREIVTS

SEQ ID NO: 2171 - DNA, 1300 bp, Arabidopsis thaliana
  CDS (113)..(1024)
aatttttcaaaaaaaaaaaaaaaaaaggtcgactcatcctccggcgggagtagaaaattcttcttggttctgcagggtttttgaatagtttgtgtattgaagattgtctgaaatggaagcagctattactcagaggattcagtacccatcatgggttgattgtagaaaagttgagtgtaagccgcagcgtggttcattgcggtattctcagcaggttaaggtagatagaaggtttagaggtctttctttggctcgcttgcaacctgaaagaagaaatgatcaacgaagagcagtttctccagcggtttcctgttctgataacaattcctcagcgttgttggagactggaagtgtttatccatttgatgaagatattctcaagagaaaagcagaagaggttaaaccgtatttgaatggacgatctatgtaccttgtcggaatgatgggttctgggaaaacaactgtgggaaagttaatgtccaaagtgctcggttatacgttctttgactgcgacactttgattgaacaggcgatgaatggaacttctgttgcagagatatttgttcatcacggagagaatttttttagaggaaaggagaccgatgcgcttaagaagctctcttcgaggtatcaagttgttgtttccacaggtggaggtgcagttataagacccattaactggaagtatatgcataaaggaatcagcatttggctagatgtgcctctagaagcattagcccatagaatcgctgctgttggaactgattcacgaccactgctacacgatgaatcaggaaatgcatactcagtggctttcaaacgtctctcggctatttgggacgagcgcggtgaagcatacacaaacgcaaatgccagagtctccttagaaaatattgcagcaaagcgtggctataaaaatgtctcagatctcacaccaactgaaattgctatcgaggccttcgagcaagttctgagctttctagagaaagaagaaactatggagatcccagacggcgacctctaatttcccagccttcttttctccgtctcttcatttatctgtttaatcaactaaacgaagcaatcactcatcaccaggccattgagcaagttcagagacaaagaagacctctagttactggttccgggtcattggagcttacacgagcctaattttgactggaactatggtttattgaaagaagattcaatacatgtatatataaaatatatacttttttttttttgtttcagtatcatccttcttctcttttccttacaataagaattaagaaaaagg

SEQ ID NO: 2172 - protein, 303 aa, Arabidopsis thaliana
MEAAITQRIQYPSWVDCRKVECKPQRGSLRYSQQVKVDRRFRGLSLARLQPERRNDQRRAVSPAVSCSDNNSSALLETGSVYPFDEDILKRKAEEVKPYLNGRSMYLVGMMGSGKTTVGKLMSKVLGYTFFDCDTLIEQAMNGTSVAEIFVHHGENFFRGKETDALKKLSSRYQVVVSTGGGAVIRPINWKYMHKGISIWLDVPLEALAHRIAAVGTDSRPLLHDESGNAYSVAFKRLSAIWDERGEAYTNANARVSLENIAAKRGYKNVSDLTPTEIAIEAFEQVLSFLEKEETMEIPDGDL

SEQ ID NO: 2173 - DNA, 903 bp, Arabidopsis thaliana
  CDS (1)..(903)
atggaagcagctactgttcagaggtttcagtactcatcatggaatgatttgagaaattttgaagggaagcctcgtggttctctgaggtataatacacagcgaattaaggaagataaaaggtttagagttgttgctttaactcttgacaaaagaagggatcatcgacttagatcagtttctgataagaactcctcagcattgttggaaactggaagtcttcttcattctccatttgatgaagaacaacagattttgaagaaaaaagctgaagaggttaaaccgtatttaaatggacgatcgatgtatcttgttggtatgatgggttccgggaaaacgactgtagggaagattatggcaagatcgcttggttatacattctttgattgtgacactttgatcgagcaggctatgaagggaacttctgtagctgagatatttgagcatttcggtgagagtgtcttcagagaaaaagagactgaagcgttaaagaaactctctttgatgtaccaccaagttgttgtttcaaccgggggaggggcagttataagacccatcaattggaagtacatgcataaaggtattagtatttggcttgatgtacctctagaagccttagcgcatagaatagctgctgtaggaactggttcaagaccattgctacatgatgatgagtcaggggacacatacacagcggctttaaaccgtctttcaacgatttgggatgcacgtggtgaagcatacactaaagccagcgcaagagtttccttggagaatattactttgaagctcggttatagaagtgtctcagatcttacaccagctgaaatcgccattgaggcctttgagcaagttcagagctatttagagaaagaagatggtatggctagaccagatggactctag

SEQ ID NO: 2174 - protein, 300 aa, Arabidopsis thaliana
MEAATVQRFQYSSWNDLRNFEGKPRGSLRYNTQRIKEDKRFRVVALTLDKRRDHRLRSVSDKNSSALLETGSLLHSPFDEEQQILKKKAEEVKPYLNGRSMYLVGMMGSGKTTVGKIMARSLGYTFFDCDTLIEQAMKGTSVAEIFEHFGESVFREKETEALKKLSLMYHQVVVSTGGGAVIRPINWKYMHKGISIWLDVPLEALAHRIAAVGTGSRPLLHDDESGDTYTAALNRLSTIWDARGEAYTKASARVSLENITLKLGYRSVSDLTPAEIAIEAFEQVQSYLEKEDGMARPDGL

SEQ ID NO: 2175 - DNA, 576 bp, Chlorobium tepidum
  CDS (1)..(576)
atgaaacaccactcactcatatttctgaccggcttcagcggttcaggcaaatcgaccatcggcccgctcctggccaactcgctcggcttcgagttcattgacctcgaccgcgaaatcgagcttaccgccgggaagagcatcaaccggattttcgccgaagatggcgaggccgccttccgctcgctcgaactccggacgctcgaaaagatcggccaacaggagcggatggtggtctcgcttggcggcggcgtgctcgaaaacgaccgatgcttcgagctgatccgctcgcacggcaccctgatctacctcaagtccagccctgaaattctcacgctccggctccagcacaagaccgaccgccccctgctcaaaggcccggacgggcggaagctgacgcgagaagagatccagcagcgcatcgcggagcttctgaaaaaacgggaaccccgctacctgaaagccgatctggtgctcttcaccgactcgaaaaagatcggcgcaagtgtcgaggagttgacacgcaaaatcgagcggcacatccgccgcgcgtcgaaaaacaacactaacgagaagtaa

SEQ ID NO: 2176 - protein, 191 aa, Chlorobium tepidum
MKHHSLIFLTGFSGSGKSTIGPLLANSLGFEFIDLDREIELTAGKSINRIFAEDGEAAFRSLELRTLEKIGQQERMVVSLGGGVLENDRCFELIRSHGTLIYLKSSPEILTLRLQHKTDRPLLKGPDGRKLTREEIQQRIAELLKKREPRYLKADLVLFTDSKKIGASVEELTRKIERHIRRASKNNTNEK

SEQ ID NO: 2177 - DNA, 492 bp, Streptococcus pyogenes
  CDS (1)..(492)
atgactaaagtgttattgggatttatgggagtggggaaaacaacggtttcgaaacacctaagtatgcactgtaaagatatggatgctattattgaagctaaaatcggtatgtctattgcagctttttttgaacagcatggagaaatagcatttcgaacaattgaaagtcaagtgttaaaagatctattgtttacaaatgataatagtgtcatcgtaacaggtggcggtgtagtggttttacaagaaaatcgacaattactgagaaaaaatcaccagcataatattttattggtagcttcttttgaaactttgtaccagcgtttaaaacatgataaaaagtctcaaagacctctatttcttaagtactctaaggaagcattttatgaattttatcaacaacgtatggtattttatgagggactttcagatttagtaatcagagttgaccatcgtacgcctgaagaagttgccaacatcattgagggttattag

SEQ ID NO: 2178 - protein, 163 aa, Streptococcus pyogenes
MTKVLLGFMGVGKTTVSKHLSMHCKDMDAIIEAKIGMSIAAFFEQHGEIAFRTIESQVLKDLLFTNDNSVIVTGGGVVVLQENRQLLRKNHQHNILLVASFETLYQRLKHDKKSQRPLFLKYSKEAFYEFYQQRMVFYEGLSDLVIRVDHRTPEEVANIIEGY

SEQ ID NO: 2179 - DNA, 543 bp, Xanthomonas campestris
  CDS (1)..(543)
atgaaccccgctcccaatctcgtgatgatcggcccgatgggcgccggtaaaagctgcatcggccgccgcctggccgagcgcttcgggctggatttcgtggatgtggaccaggccatcgtcgagcaggtcggcagcagcatccccgcgatcttcgaacagcacggcgaagcgcgctttcgccagcacgaagccgaggccctgcacggcctgctcgcgcagagcaacaaactggtctccaccggcggcggcgcgatcctggatgcgggcaatcgccagcgcatccgcgagcgcggcttcgtggtgtacctgcatgtgagcgtgccggcccagctcacccggctggcgcgcgaccgcaatcgcccgctgctgcagcgcccggaccgcgaacaggtgctgcacggcatggccgcgctgcgcaccccgctgtaccaggaagtggccgacctcaccctggaaaccgatcacctttcccccgccgaggccaccgcgcagctggtgctgcgcctggccgcgcaatggcgcatgtcgagtacccctgcatga

SEQ ID NO: 2180 - protein, 180 aa, Xanthomonas campestris
MNPAPNLVMIGPMGAGKSCIGRRLAERFGLDFVDVDQAIVEQVGSSIPAIFEQHGEARFRQHEAEALHGLLAQSNKLVSTGGGAILDAGNRQRIRERGFVVYLHVSVPAQLTRLARDRNRPLLQRPDREQVLHGMAALRTPLYQEVADLTLETDHLSPAEATAQLVLRLAAQWRMSSTPA

SEQ ID NO: 2181 - DNA, 543 bp, Xanthomonas axonopodis
  CDS (1)..(543)
atgaaccccgcacccaatctcgtgatggtcggcccgatgggcgccggaaaaagctgcatcggccgtcgcctggccgagcgcttcgggctggaattcgtcgatgtggaccaggccatcgtcgaacaggtgggcagcagcatcccggccatcttcgagcagcatggcgaagccaggtttcggcagcacgaggcggaaaccctgcaggcgctgctggaacaggacaacaaactgatttccaccggtggcggcgcagtgctggatccgcgcaaccgcgagcgcatctgcgcgcgtgggttcgtggtgtacctgcatgtcagtgtgccggcgcaattgacacgcctggcgcgcgaccgcaatcgcccgctgctgcaacgcgccgaccgcgagcaggtgctgcatgcgatggccgcgcaccgcacgccgctgtaccaccaggtcgcagatctcagcctggaaaccgatcatctttcccccgccgaagccacagcgcagctggtgctgcgcctggccgcgcaatggcgcatgtcgagtaaccccgcatga

SEQ ID NO: 2182 - protein, 180 aa, Xanthomonas axonopodis
MNPAPNLVMVGPMGAGKSCIGRRLAERFGLEFVDVDQAIVEQVGSSIPAIFEQHGEARFRQHEAETLQALLEQDNKLISTGGGAVLDPRNRERICARGFVVYLHVSVPAQLTRLARDRNRPLLQRADREQVLHAMAAHRTPLYHQVADLSLETDHLSPAEATAQLVLRLAAQWRMSSNPA

SEQ ID NO: 2183 - DNA, 531 bp, Methanosarcina mazei
  CDS (1)..(531)
atgggcaggaagcgtgtggtaatgaacataacattaatcggtatggcaggagcggggaaaagtaccataggaaaagcgcttgcaaaacgtctggattatacttttattgatgttgaccgtttgatcacagatagaactggaatgcccctccaggtactcattgataaacagggcgattctgctcttctcagatttgaggaagaagctattctgggtcttgggcaggtggataactgtattatttccccgggagggagcgtaatttattccgaaaaatccatggtctacttaaaaaacatctcaaaagttgtctttctggacgcttctttcaggagcatcgcaaggcgaataccgaatgcaagaagaagaggtatagtgggcctgagggatagaagccttaaagaactatttgaagaaaggctggttctgtataataaatacgctgatttctccgtaaaaatcaggggaaaggaaaatattcaggggattgtagatcgagtgatcaggctctgttttatggtggaatcctga

SEQ ID NO: 2184 - protein, 176 aa, Methanosarcina mazei
MGRKRVVMNITLIGMAGAGKSTIGKALAKRLDYTFIDVDRLITDRTGMPLQVLIDKQGDSALLRFEEEAILGLGQVDNCIISPGGSVIYSEKSMVYLKNISKVVFLDASFRSIARRIPNARRRGIVGLRDRSLKELFEERLVLYNKYADFSVKIRGKENIQGIVDRVIRLCFMVES

SEQ ID NO: 2185 - DNA, 516 bp, Thermoanaerobacter tengcongensis
  CDS (1)..(516)
atgaaaaacatagttttgacaggattcatggggacaggaaaaactactgtagggaaaaaagtggcaactactcttcattttaattttattgacactgacaagctggttgagaaaatggcaggcatgagtgtggcggaaatatttgaaaagcacggggaagaatattttagaaagttggaaaaagcggctgtcataaaagcctctcgcctaaaaaatcacgtaatagctacaggaggcggggttgtattaaacccttcaaatattgtacaattaagaaaaaacggagtaataatcctcttaaaagcaaggccggaagtaattttgaggaatatatccaaaacaaaagataggcctcttcttgcggtggaagaccctgaaaagaggataagagagcttttagaggaaagagagcctttttacagatttgcagattacactatagacgtctctgacaagacaatagaggaagtcgctgaagaagtcataagagcgtatataaagcttaaggggagatga

SEQ ID NO: 2186 - protein, 171 aa, Thermoanaerobacter tengcongensis
MKNIVLTGFMGTGKTTVGKKVATTLHFNFIDTDKLVEKMAGMSVAEIFEKHGEEYFRKLEKAAVIKASRLKNHVIATGGGVVLNPSNIVQLRKNGVIILLKARPEVILRNISKTKDRPLLAVEDPEKRIRELLEEREPFYRFADYTIDVSDKTIEEVAEEVIRAYIKLKGR

SEQ ID NO: 2187 - DNA, 519 bp, Fusobacterium nucleatum
  CDS (1)..(519)
atgaaagataatattgcattaattggttttatgggaagtgggaaaacaactgttggaaaacttcttgctaaaactatggacatgaaatttgttgatatagataaagtaatagaagcccatgaaaaaaaatcaatcaatgatatttttcatgaaaaagggcaaatttattttagagatttagaaagggaaattatcttacaagaatctttaaaaaatgattgtgttattgccactggtggaggttctattttagataatgaaaacattaaaagattaaaagaaacatcttttattgtttttcttaatgcaactattgaatgtttatatttaagacttaaagacaatactactcgtcctattttaaatgatgttgaggataaaagaaagcttatagaagaattattagaaaaaagaaaattcttatatcaaatatcagctgattatattattgatataaatgaacacacaaatatttatgaaacagttgataagattaaagaaatatatataatatcttaa

SEQ ID NO: 2188 - protein, 172 aa, Fusobacterium nucleatum
MKDNIALIGFMGSGKTTVGKLLAKTMDMKFVDIDKVIEAHEKKSINDIFHEKGQIYFRDLEREIILQESLKNDCVIATGGGSILDNENIKRLKETSFIVFLNATIECLYLRLKDNTTRPILNDVEDKRKLIEELLEKRKFLYQISADYIIDINEHTNIYETVDKIKEIYIIS

SEQ ID NO: 2189 - DNA, 528 bp, Methanosarcina acetivorans
  CDS (1)..(528)
atgaaggaagcgggtcctatgaatataactttaattggtatggcaggagcggggaagagtactataggcaaggcacttgcaaaacgcttgaattatacctttattgacgttgacgggattattacgaaaaggacaggtatgcccctccaggctctgattgataaacagggggattcggctttgatccggtatgaagaagaagctattctggaacttgagcagatggacaactgtattatctctcccggagggagcgtggtttattccgaaaaagccatggagcacctgaaaaaaatctcgaagatagtctttctggacgctcctttcagaagcatcgtaagaaggatccctaacgcaagaaagagaggtatagtagggctcagggacaggagccttaaagagctttttgaagagaggctggtcttgtataagaagtatgccgacttttcaataagacttaaaggaaaggaaaatgttcagagaattgcggggaagataattcagctctgttttgggtcagagccctga

SEQ ID NO: 2190 - protein, 175 aa, Methanosarcina acetivorans
MKEAGPMNITLIGMAGAGKSTIGKALAKRLNYTFIDVDGIITKRTGMPLQALIDKQGDSALIRYEEEAILELEQMDNCIISPGGSVVYSEKAMEHLKKISKIVFLDAPFRSIVRRIPNARKRGIVGLRDRSLKELFEERLVLYKKYADFSIRLKGKENVQRIAGKIIQLCFGSEP

SEQ ID NO: 2191 - DNA, 516 bp, Clostridium perfringens
  CDS (1)..(516)
atgaaaaaaagaggagtacttttaattggaatgcctggagcaggaaaaacaaccataggaagagagctttcaaaggtattaaaaatgaattttttagacatggatgaattcatagaaagaagtacaggaaaagaaataaaagaactttttgctcagggagaagaggtttttagagatttagaaagtaaaagttgtgaacttttatcaaccttaaaaaatgtggttatatcttctggtggcggaatagttacaagagaagaaaatatggggaattttaaggagtttataactgtttttataaacagacctttagatttaattatggaagatatagacacagaaggaagacctcttttatgggatggcaaagaaagacttactaatttatatagagatagaattgatttatataaaaagcatagtgatatagaaattataaatgatggtactactaaagaggctattagggaaatagtcgaagctatttctgagttgggtttacaagagaaagaatag

SEQ ID NO: 2192 - protein, 171 aa, Clostridium perfringens
MKKRGVLLIGMPGAGKTTIGRELSKVLKMNFLDMDEFIERSTGKEIKELFAQGEEVFRDLESKSCELLSTLKNVVISSGGGIVTREENMGNFKEFITVFINRPLDLIMEDIDTEGRPLLWDGKERLTNLYRDRIDLYKKHSDIEIINDGTTKEAIREIVEAISELGLQEKE

SEQ ID NO: 2193 - DNA, 573 bp, Ralstonia solanacearum
  CDS (1)..(573)
atgtctgtttccaacgtttttttcgtcggcctgatgggggccggcaagaccactgtcgggcgtgccgtcgcccggcggcttgacttgccgttcttcgactccgaccacgagatcgaagcgcgttgcggcgtgcgcgtgccggtcatcttcgagcatgaaggcgaaatgggctttcgcgaccgcgaaacccagatgatcgatgagctgaccgcgcgccacggcgtggtcgtggccaccggcggcggcgccgtgctgcgcccggaaaaccgcgctttcctgcgcgagcgcggcacggtgatctacctgcgcgccaatccccacgacctgtacctgcgcacgcgccacgacaagaaccgtccgctgctgcagaccgagaacccgcgcgccaggctcgaggaactgcacgcgattcgcgacccgctgtaccgcgaggtggcgcactttgtcatcgaaaccggcaagcccaccgtggcccagcttgttaatatggtgctgatgcaactcgaagtggccggcatcgtggtgccgcccgccgcctcttccccgacctcgcaagtctcccgccagtcatga

SEQ ID NO: 2194 - protein, 190 aa, Ralstonia solanacearum
MSVSNVFFVGLMGAGKTTVGRAVARRLDLPFFDSDHEIEARCGVRVPVIFEHEGEMGFRDRETQMIDELTARHGVVVATGGGAVLRPENRAFLRERGTVIYLRANPHDLYLRTRHDKNRPLLQTENPRARLEELHAIRDPLYREVAHFVIETGKPTVAQLVNMVLMQLEVAGIVVPPAASSPTSQVSRQS

SEQ ID NO: 2195 - DNA, 579 bp, Rhizobium meliloti
  CDS (1)..(579)
atgaacgatgtgaccgaaccggtttccgcgacgctggccgaaagggcgaagcgcactctcggtaagcgcaatctcgttttcatcggcctgatgggggcaggtaaatcggcaatcggtcggctgaccgcccaggcgctcggcgttcctttcgtcgattccgaccacgagatcgagcgggtctcgcgcatgacggtcagcgatctcttcgcgacctacggcgaggaagagttccgggcgctggaggcccgcgtgctgaagcgcctgctcaggtccggcccgcgggtggtgtcgaccggcggcggcgcctatatcaacgagcgctcgcggcggcatatcaagaagggcggcctgacgatctggctcaacgccgagcttgacgtgctatgggagcgggtaaacaagcgcgacacccggccgcttctgaagaccgagaatccgaagcagacgctcgagaacctgatgcgcgcgcgctacccaatctatgccgaggcggacctgaccgttctctcgcgcgatgtgaaaaaggaagcgatggtcgaggaggttctcgccgccgtcgccgatcatcagaaagcctga

SEQ ID NO: 2196 - protein, 192 aa, Rhizobium meliloti
MNDVTEPVSATLAERAKRTLGKRNLVFIGLMGAGKSAIGRLTAQALGVPFVDSDHEIERVSRMTVSDLFATYGEEEFRALEARVLKRLLRSGPRVVSTGGGAYINERSRRHIKKGGLTIWLNAELDVLWERVNKRDTRPLLKTENPKQTLENLMRARYPIYAEADLTVLSRDVKKEAMVEEVLAAVADHQKA

SEQ ID NO: 2197 - DNA, 7122 bp, Rhizobium loti
  CDS (1)..(7122)
atggagggcgccgtgtgcgccacgcattgtaatcggcgcgcatttctcgcctggagacggattatgacgggagttgaccggcgtttgaatgcgcctagcggatcaggcacgcaccgggctgaatcggatcatggcggtggtcaaaaaggctcgaccttcagttctgtcgttcagggcttgcgctctgaagatcgagagttaggggcatcctcagctgaaaggccaccttcggccagcgatgtccggcgccgcacgtccggcgatccctccgtcaataggtgtgacggccagcccgtttttcgcgacttgccgcatctgggagcgacaaatcggcaagaaagttcgtcgcgttccggtgcagaagtccgcaatgccgatcagtccaggagttcacaacaaagtggtccttcctcgcgcaggcagcccgtgtcgggcctggatcgcagaccaaaaaggcggcgcctggacgatgtcgccgcgcagagcgtgcaaagtgcaatctcagaagaacaatctaacaacgcactacacgccatttgttttgcccgtgacattgaggggttctcgcgtgcagtggtggagcatgacagacggctgcaaggggcgggcgacgaggtccatgcagccttcctgcaaaaggccgccgcccagttcaaagctcaatttgtcacatgcttcgaggacaatatccgccgcgggcaatcatggggctacgccaccgcatgcaatacggtgagtcgtgaggctggaggtcaggaaggtgtggaagcttgcaaggcgatggcagctcgggtgtcgcagcttcctagtgcgttaatgtgcgaagtagaccccaaagccttttcgctcttttcggcatcgtttggtcggcatccgcagtcgagaacatgccgaaatggaacgatcagaatcgccgaattttgccgcgatgagggcaggacacttggcgtactgcaaagtcaaagtctgtcgttgctggtgaacggtttcagcaagtggccgcagcggtcggaaactcgtgacggtacggaagccgtcgccagtgaggtccgtcgtcgcgaggaccgccgtttcgggctctctgattttagggagcagcacctggctaatctggtgaacggtttcagcaagtggccggaaaaggagtggtcccgccaagccaccggaacgattgccggtgaagtccttcgccgccgtaacctcgggctctcaacttttaatcaccaggacttggccaacctagtgaacggtttcggaaagtgtgcccaagaggaggtctgttgccaagccacagttgcaatcgcgggcgaggtcctgcgccgcgaccgccgtgcccggctctccgaattcacccaccaggaactggcgaacctggtgcaaggtttcagcaaatggccggaagagcaggcgtcccgcgaagccgccagtgcgatggccggtgaggtccttggtcgtaaccggcgtgccggcgtcgctgatcttaatccccagcacatggcgacccttgtgaacggtttcagtaagtggccgatagaggagcggtgtcgccaagtcaccggagcgattgccgatgaggtaggtcgccgcgccgcccgcggcaggttcgggctctctgattttaatcatcaggacttagcgaacctcgtgaacggttttaggaaatggccggaaggggcggtctaccgccaagccacagccaatatcgccacagaagtctctcgccgcgccggcgagcaagggctgtctcattttactccgcaggagctggctaacctagtgaacgggttcggcaaatgcccggacgatgccgactatcatcacgccacagtcgcgatcgccagtgaggtcatccgccgccgcgcccaactctctgctttcagtcatcagcacttggcaaacttggtgaacggtttcagtaagtggccacaacaggcggactgtcgcgatgcaacactggcgatcgccagcgaggtctttcaacgcgacgaccagttctctcatcttactcagcaggcacttgcgacattggcgaacggttttagcaagtggccggaagaggcggcgtctcgccaggcaacagtcgccatcgccggggaggtcacccgccgcgccgggcgcggcgagttcgggctctctgatttcaatgaccaggacctggcgaacctggtgaacggattcggcaagtggccggaagcggcgtcgactcagcaagccacaatcgctatagccagcgaggtccttcgccgaggcacccgactccgtgactttactcaccagcacctagctaatctggtgaacggtttcagcaagtggccggacggggcggactgtcgcgacgccgcgatcgccatcgccggtgaggtcattcgccgcggcgcccgactctgtgagtttagtcaccagcacctatctaatctggtgaacggtttcagcaagtggccggtcggggaggactgtcgcagagccgcgatcgcaatcgccggggaagcccgtcagcgccagctctccgatttcgctccgcagggagtggcgaccttgatgaacggcttcaccaagtggccggaagagtcggcgtgccagcagtccacgatggacatcgcgcgcagattgggtgctcgagagctacgattcggtgtgttcacgacagctcagctaagtattctcgccaatgctttgtcgcgaatgatcatgaaggcagaagacactggggatattacggacgcggctctgccgaaggatcgcttgcacaagctcgctcattacctgcactatgatgatgatcgcctggcgcaggctgacgttctagacatcacaaccgttttcaaggcacttggtaaggctcggctgtctgatgatctcggtttgctcgcaccgacaggcttgaaccgcctctcggaattgcgtcaagcccctgattttacgacccacaacgatctggaaaccatggctaatctgtgtgcatctctgctgccgctggctcgcagcccacagaggccgctgcgctcgcaccgcacgcaggccctcaatctgctcaacgacctccaatccgtgctcgagcagaagatcgaggcgcatctgaacgcaagcgatgccgagcggacccgtggaccgcttgccagccgccgccccgctttatcgatctatcagacgcttaaggcccgtgcggtcctggagagactattcaggtcaccgtatgtcgagggcaagaggtccgacttgcgggtgaggcagcaagcgctggagcgcaagacgaaggagatcctggacagcacgcgcggcctcattgaaagcgacctttccagcatgagctggaacctgatcgcgcagatcgaggcggagaatccagtggatgcgctggactttttcatagagcaggatgcggcgacgatccaggggcaacatccagcatcggtcttcgacgtgtatcaggtcctgcgaaccatggatcacgagccaagaccgccgcagggtgacgcaggactgatgcagttgccggtagttgacatgcagggacggccggtggccaccgagccggagagacggtattcgatatttcagcgcctgactgccggggctttgccagtcgttgcggtccagatgccaggaacgccgagcgccttcatgctggcgcgtacggtgaacgtcaacggtgtgccataccgcatggacctgttcggaggcagcaagttaaagccgccgcgattgaccgtgtctcagattgcggcccgtgctccaggcgagctagctaagctttccgggggaaagctgctggcgattccgtatgtcgataccgcaccgggcaccgccttcgagcagctgtctcggacttgggcccctttcaaggaggcctattattatacccagcgcaggggttttgcggcgccaccggcgatcaagggcctgggagttcacgactacgcgctggaaggcgccttcaaactgtcgctgctgccggaccgtcccgccaaccaggagcatcccttcaagctgagggggccggacggtcccattgcattgcgaccgcatgacggctgcggtttcatcagggcctcgctagccaaccttatgccagctgtatgtcgcgccggcgagcagggtcctgatcagatgtctgcctttggtgagggaaggaaatcatccctgccagtctcggcgctgcaacactatccgcgctgcgaccaagtggcggatgaggtccgtgaaaaggccacggcctggctcgagagccaacaagagccaacgttgaccaccgaagagctgtttagaacggtgacggccggacacatcgatggtcccggcgcggttgccgtaccctccaacgatgagtgtctccatgtgccgacgctgaagagcgaaacattgacggggacgagcggcgtgctggtcgggcgctcgccctacgataagccgaacctgcgcccgtttgccgccgagcgggtcaagttggccgtcgacggcgatccgaccgctgtatttctcgataactgcacggccattcaatacagcttcaatgtcgcccagaagtcggggagggaactggccgccgacgatccgactttctttgccaaaggcatcctgatcgttgtaccggataagatgtggccggccgcctacgccgaccgtgcgctaatcatgtctgccgaggacgtcaaatgccatgcgagctggaccacgagcaaggaccgcgtcaaggtggacacgacggtcgactgcctcggcatcctgcaggcgaccgaggtgtttgccccgggctcgttggttgccgtcccaactggtgaacagaagaaacttgacggcgacttcgacggagacagcctcgtcatcgtcggcgaccggccacagctttacgagcatgtcaggcaattcgatcaagaggagcaagctcgcggattgcgctcgctcaagccgccaaagtcgcacacgccggcgattgaggatggtcgctacaagttcgggcgcgccagccagatcctcgccgccacgcgcaatgttctggaaatctatacttgtctgcagcgagactttctcgctcaatcccatgaagcccgacagtggtttgccgagcgtgccatcttcggcacgtacgaaggcattcaccaagagctcaagcgagacatccgaggcgtgttggagcaggaacaggtcagtgctcagaacgtccaggagacgcttgaaaaggcgcggcacgacatccaactggcagaccatccggtcgcgcgcgagattgctgagttgctccacgctgagctcgagacgtgggccgcgaggctggatgagcaagctctgcccgaacaactcctgcccgaaacagtcgtcagcctgagcgaggcaccactcgcgatgagccaaccgctttgcgagctgttcccggagctggcggagatctattcggcaacggctcagccacgcgaccgcgtccagcttcttgtcgaccgttaccctacgcgcattgccccgcgaccggatggatacaatccacacgacctcgtgcggagtgcaaagaatctcctgagcctcggtatcaaagtcggaactgacgcatataaatcggacactggggcccacatctttatgttcaagagcaggcaacttcggcgcctgctgcaacaaacaccaggctcgaaatcggtgccctacaccaagagcattgcggctaccctcaaccagggtcggtttgatgtcgatgccacattgcaggatcttcaggacaatccgacgctggcggcttcagttatgcaagcttcgatcaaacttgctgccgagcgaggctttctgcctcaaccctcggctcgaggggcttctgccgatgattcagccacgacgatgaccttgactcccgagctggccgtacagcgagctcaaatggaggcttgccgcgcccgagccgaagagaaggacatcaccccgatggtaatctcggttgccgaagccctcaggagagccgatatcaacgtgaagatgccccatctcgctgagcgtttgagatcggaaagctcgatgacaggccagctcaccgggatacaggccccgtttgaagccggcgcccagctgatcaacaacgctgtacgccactgcttccaactccctgatagagattttacccgtgccttcaagaaagccattatagccttcgacgagagcgggtattctgaggtcagcacgaccaactggttcaggacgcgatcgccgaccttcgtcggcatcaagaccgtgctcgccacgccggggggctaccgcttcgaggtggagttccacactgcagacagctacaagaccaagatttacaatcacgacacctacaaggagctgcagaagctgcaggagctgcagcgagagagccaagatccactggatcagtctatagccgagcaactcttggagcgcgtgcgacaggcctgcaacaaggtcatcatccctcacgaggccatagagatcccccactgggaagcccacgccgatagcacagttggtgccagcctacgtcgtcggttgcaagtcgccccgccgagacgaacggagcgctccccgatcgcaacagagattcttggcgcgttgggcgcgcgatcgatcgtgctcgtcggcgtgaaaggcgcagggaaatccagtttgggccgtgcactcgccaaacgactaggaatgaggttcgtcgattccgatagaaaaatcgaggcgaagaccggcaagtccgtagctaagatcgtcgctgaggatggggaggcctatttcagagatcttgaggtgaatgagatcaggcagtcactcgaactggggtcggcggtgctcgcaaccggcggtgaagcgttcatgatcgaggagatccggcattatgtcggggagaaagccgtctcgatctggctcaataccagcgaggacgtgatcaggcggaacctgagagataacatcagaggcccaaaggtgcagaccgccgaccaagcccagaccatcacagacctgatgcatgtgcggaatccaatctatacacttgccgatctcacgattgccccgcagcatgagcgggatctcaagaacgcgaatgcttgcctgaccgcgctgcacgcctatgtttgcggtgggggcagggcggtacccaagctcgtgacctcatccggggtcgtaccatga

SEQ ID NO: 2198 - protein, 2373 aa, Rhizobium loti
MEGAVCATHCNRRAFLAWRRIMTGVDRRLNAPSGSGTHRAESDHGGGQKGSTFSSVVQGLRSEDRELGASSAERPPSASDVRRRTSGDPSVNRCDGQPVFRDLPHLGATNRQESSSRSGAEVRNADQSRSSQQSGPSSRRQPVSGLDRRPKRRRLDDVAAQSVQSAISEEQSNNALHAICFARDIEGFSRAVVEHDRRLQGAGDEVHAAFLQKAAAQFKAQFVTCFEDNIRRGQSWGYATACNTVSREAGGQEGVEACKAMAARVSQLPSALMCEVDPKAFSLFSASFGRHPQSRTCRNGTIRIAEFCRDEGRTLGVLQSQSLSLLVNGFSKWPQRSETRDGTEAVASEVRRREDRRFGLSDFREQHLANLVNGFSKWPEKEWSRQATGTIAGEVLRRRNLGLSTFNHQDLANLVNGFGKCAQEEVCCQATVAIAGEVLRRDRRARLSEFTHQELANLVQGFSKWPEEQASREAASAMAGEVLGRNRRAGVADLNPQHMATLVNGFSKWPIEERCRQVTGAIADEVGRRAARGRFGLSDFNHQDLANLVNGFRKWPEGAVYRQATANIATEVSRRAGEQGLSHFTPQELANLVNGFGKCPDDADYHHATVAIASEVIRRRAQLSAFSHQHLANLVNGFSKWPQQADCRDATLAIASEVFQRDDQFSHLTQQALATLANGFSKWPEEAASRQATVAIAGEVTRRAGRGEFGLSDFNDQDLANLVNGFGKWPEAASTQQATIAIASEVLRRGTRLRDFTHQHLANLVNGFSKWPDGADCRDAAIAIAGEVIRRGARLCEFSHQHLSNLVNGFSKWPVGEDCRRAAIAIAGEARQRQLSDFAPQGVATLMNGFTKWPEESACQQSTMDIARRLGARELRFGVFTTAQLSILANALSRMIMKAEDTGDITDAALPKDRLHKLAHYLHYDDDRLAQADVLDITTVFKALGKARLSDDLGLLAPTGLNRLSELRQAPDFTTHNDLETMANLCASLLPLARSPQRPLRSHRTQALNLLNDLQSVLEQKIEAHLNASDAERTRGPLASRRPALSIYQTLKARAVLERLFRSPYVEGKRSDLRVRQQALERKTKEILDSTRGLIESDLSSMSWNLIAQIEAENPVDALDFFIEQDAATIQGQHPASVFDVYQVLRTMDHEPRPPQGDAGLMQLPVVDMQGRPVATEPERRYSIFQRLTAGALPVVAVQMPGTPSAFMLARTVNVNGVPYRMDLFGGSKLKPPRLTVSQIAARAPGELAKLSGGKLLAIPYVDTAPGTAFEQLSRTWAPFKEAYYYTQRRGFAAPPAIKGLGVHDYALEGAFKLSLLPDRPANQEHPFKLRGPDGPIALRPHDGCGFIRASLANLMPAVCRAGEQGPDQMSAFGEGRKSSLPVSALQHYPRCDQVADEVREKATAWLESQQEPTLTTEELFRTVTAGHIDGPGAVAVPSNDECLHVPTLKSETLTGTSGVLVGRSPYDKPNLRPFAAERVKLAVDGDPTAVFLDNCTAIQYSFNVAQKSGRELAADDPTFFAKGILIVVPDKMWPAAYADRALIMSAEDVKCHASWTTSKDRVKVDTTVDCLGILQATEVFAPGSLVAVPTGEQKKLDGDFDGDSLVIVGDRPQLYEHVRQFDQEEQARGLRSLKPPKSHTPAIEDGRYKFGRASQILAATRNVLEIYTCLQRDFLAQSHEARQWFAERAIFGTYEGIHQELKRDIRGVLEQEQVSAQNVQETLEKARHDIQLADHPVAREIAELLHAELETWAARLDEQALPEQLLPETVVSLSEAPLAMSQPLCELFPELAEIYSATAQPRDRVQLLVDRYPTRIAPRPDGYNPHDLVRSAKNLLSLGIKVGTDAYKSDTGAHIFMFKSRQLRRLLQQTPGSKSVPYTKSIAATLNQGRFDVDATLQDLQDNPTLAASVMQASIKLAAERGFLPQPSARGASADDSATTMTLTPELAVQRAQMEACRARAEEKDITPMVISVAEALRRADINVKMPHLAERLRSESSMTGQLTGIQAPFEAGAQLINNAVRHCFQLPDRDFTRAFKKAIIAFDESGYSEVSTTNWFRTRSPTFVGIKTVLATPGGYRFEVEFHTADSYKTKIYNHDTYKELQKLQELQRESQDPLDQSIAEQLLERVRQACNKVIIPHEAIEIPHWEAHADSTVGASLRRRLQVAPPRRTERSPIATEILGALGARSIVLVGVKGAGKSSLGRALAKRLGMRFVDSDRKIEAKTGKSVAKIVAEDGEAYFRDLEVNEIRQSLELGSAVLATGGEAFMIEEIRHYVGEKAVSIWLNTSEDVIRRNLRDNIRGPKVQTADQAQTITDLMHVRNPIYTLADLTIAPQHERDLKNANACLTALHAYVCGGGRAVPKLVTSSGVVP

SEQ ID NO: 2199 - DNA, 612 bp, Rhizobium loti
  CDS (1)..(612)
atgaacgcgcaccaggcaaatcccccaggcgagagcctcgccgcgctgcttggccggctgggcagccggtccatcgtctttgtcggcctgatgggcgccggcaagacggcgatcgggcgcaaggtggcgacgatgctttcgctgcctttcatcgacagcgaccaggagatcgagagcgtctcgcgcatgaccgtgccggagctgttcgagcgctatggcgaggccgagttcagggccctggagcagcgcgtcatcctgcgcgtgctggaaaatggcccgcaggtgctgtcgaccggcggcggcgccttcatgaacgcgcagacgcgcgaggccatcgccggccatggcgtgtcggtgtggctgaaggccgagctcgaccttctgatggaccgggtctcgaagaagcagaaccggccgctgttgaagagtgccgatcctcgcgccgtgctggagcggctgatgagcgagcggtatccggtctacgcgacatcggatgtcaccgtgccgacccgcgacgaccgcaaggaagtcatcgctgccgaggtgctgaatgcgctgtgccggcatttcggcatcgatgaaattgcagcgacgggcgagatcgaatcgtga

SEQ ID NO: 2200 - protein, 203 aa, Rhizobium loti
MNAHQANPPGESLAALLGRLGSRSIVFVGLMGAGKTAIGRKVATMLSLPFIDSDQEIESVSRMTVPELFERYGEAEFRALEQRVILRVLENGPQVLSTGGGAFMNAQTREAIAGHGVSVWLKAELDLLMDRVSKKQNRPLLKSADPRAVLERLMSERYPVYATSDVTVPTRDDRKEVIAAEVLNALCRHFGIDEIAATGEIES

SEQ ID NO: 2201 - DNA, 516 bp, Streptomyces coelicolor
  CDS (1)..(516)
atgagcgcaccgctgatcgtcctggtcgggccgatgggggtcggcaagtccaccgtcgggcagctgctcgccgagcggctgggcacgggataccgggacacggacgaggacatcgtcaccgcccaggggcgggccatcgccgaaatcttcgtggacgagggcgaggccgccttccggaccctggagaaggaggccgtgcggaccgcgctcgccgagcacgagggcgtcctcgccctcggcggtggcgcgatcctggacgcggacacccgcgcgctgctcgccgggcagcgggtcgtctacctctcgatggacgtcgaggaggccgtcaagcgcaccggcctgaacgcggcgcgtccgctgctggcggtcaacccgcgcaaacagtggcgcgaactgatggaggcccgtcggcacctctacgaggacgtcgccacggccgtcgtggccacggacggtcgtacgccggaagaagtcacccaagccgccctggacgcagtggagttgaaagaagcatga

SEQ ID NO: 2202 - protein, 171 aa, Streptomyces coelicolor
MSAPLIVLVGPMGVGKSTVGQLLAERLGTGYRDTDEDIVTAQGRAIAEIFVDEGEAAFRTLEKEAVRTALAEHEGVLALGGGAILDADTRALLAGQRVVYLSMDVEEAVKRTGLNAARPLLAVNPRKQWRELMEARRHLYEDVATAVVATDGRTPEEVTQAALDAVELKEA

SEQ ID NO: 2203 - DNA, 843 bp, Arabidopsis thaliana
  CDS (1)..(843)
atggagatcttctctgcgtctgcttctctaactttaactggattcgttcctcgtcttcttcccttgctctctcctcaagctcgaactactctctgcaagccgttgctgtcttcttcttctactagactcatttcttgtcacagtcgtatagctccgtctcggtctctcgcagatcaatccgcctctactgggatcagtgttgttgattcggatcccattgatgttgtaaagaggaaagctatggacatagcccctgaactgaaaggagcttccatatttctggttggaattaataactctattaaaacgaacacggggaagcttttggctgaggcattacgatattactactttgatagtgataatttgatcacagaggcggctggtggaaatgtgtctgctcaagctttgaaggaagctgatgagaaggcttttcaagaatcagagactgaagtgctgaagcagctatcatctatgggtcggcttgtagtttgcgctggagatggtgcggtccaaagcttgagaaatcttgcacttcttagacacgggatctccatatggatcgatgttcctctggatatcactgctaaaggggatgatgattcattccactcagaaccttcccctgagttgtttgacacactaaaagcgagttacgagaaatcaagaaagggttacgaaacagcagatgtatccatttcccttgaaaaaatagctacaaagctagaatttgaagacttggaagcagtaacttctgaagacattgctttggagattctgaaagaaatagagaagttgacaagagtgaagaaaatgatggaagaagcttctcgacctttctag

SEQ ID NO: 2204 - protein, 280 aa, Arabidopsis thaliana
MEIFSASASLTLTGFVPRLLPLLSPQARTTLCKPLLSSSSTRLISCHSRIAPSRSLADQSASTGISVVDSDPIDVVKRKAMDIAPELKGASIFLVGINNSIKTNTGKLLAEALRYYYFDSDNLITEAAGGNVSAQALKEADEKAFQESETEVLKQLSSMGRLVVCAGDGAVQSLRNLALLRHGISIWIDVPLDITAKGDDDSFHSEPSPELFDTLKASYEKSRKGYETADVSISLEKIATKLEFEDLEAVTSEDIALEILKEIEKLTRVKKMMEEASRPF

SEQ ID NO: 2205 - DNA, 1623 bp, Bifidobacterium longum
  CDS (1)..(1623)
atgaccgcacgcccccgcgccgtcatcatcggcatgatgggagccggcaaaacacgtgtcggtaaggaagtggcgcatatgttgcgtctgccgttcgccgatgccgatgtggagatcgaacgtgaagtgggcatgaagattccctcctacttcgaggaatacggtgagccggcattccgcgaggtcgaggccgatctcatcgccgatatgcttgaggatttcgacggtatcttttcgctgggcggtggcgctcccatgacgccatccacccagcatgccctcgcctcctacatcgaccatggcggtcgtgtggtctaccttgatgccgatccggcggaagccatggaacgcgcgaaccgtgggggaggccggcccatgctcaatggcaacgccaactcccgttggaaaaaactgttcaagcagcgtgacccagtattccgcgaggtcgccaacgttcatgtccatacccgggggcttacgcctcagggcgcagcgaagaaagtgattgatatggtatctgagcgagcagtgcatgttaccggagcggcaattgagccgtatgatgtggtcattggcgaaggtgccatgaaccatctggtcgacgtgctgggacccaaacccgccaaaatcgcgcttatccacactcagccggtgcagcgacactccgatcgtgcccgcgccctgttgcgtcagggcggctatgaggtttccgacatcgtgattccggatgccgaacccggcaagaccattaccgtggccaacggcatttgggaacgccttggcaacgaaggtttcacccgatccgatgccgtggtggggcttggcggcggtgccgcaaccgatttggccggtttcgtggctgccacgtggatgcgcggcgtgcgctatgtaaactgcccgacctcgctgctggccatggtcgatgcctccaccggtggcaaaaccggcatcaacaccccgcagggcaagaacctcgtcggctcgttctacacgcctgccggtgtgctggccgacaccaagacgctggctacgctgcccaatgacatcttcatcgagggtctcggcgaagtcgccaaatccggtttcatccgcgaccccgaaatcctgcatatcctcgaagaccacgcagctgaactgcgcgctttcgacggctctacattcctcggctcgccgctcgaagacgtggttgccgagctcattgagcgcacggtaaaggtcaaggcctaccacgtctcctccgatttgaaggagaagggtctgcgtgaattcctcaactacgggcacacgatgggccatgccatcgaaaagctcgagcatttccgctggaggcatggcaatgcggtggccgtcggtatggtgtatgccgccgagctggcccatctgatcggttacatcgatcaggatctggttgactatcaccgctcgttgcttgcttcgatgggtctgccgacgtcgtggaatggcggctcgttcgacgacgtgctcgcattgatgcatcgcgacaagaaggcccgcggcaatgagctgcgcttcgtggtcctcgacgagattggtcacgtcgtacacctcgacaacccgcccgccgaagccgtggaagaagcattccgtcgtatccagcagtaa

SEQ ID NO: 2206 - protein, 540 aa, Bifidobacterium longum
MTARPRAVIIGMMGAGKTRVGKEVAHMLRLPFADADVEIEREVGMKIPSYFEEYGEPAFREVEADLIADMLEDFDGIFSLGGGAPMTPSTQHALASYIDHGGRVVYLDADPAEAMERANRGGGRPMLNGNANSRWKKLFKQRDPVFREVANVHVHTRGLTPQGAAKKVIDMVSERAVHVTGAAIEPYDVVIGEGAMNHLVDVLGPKPAKIALIHTQPVQRHSDRARALLRQGGYEVSDIVIPDAEPGKTITVANGIWERLGNEGFTRSDAVVGLGGGAATDLAGFVAATWMRGVRYVNCPTSLLAMVDASTGGKTGINTPQGKNLVGSFYTPAGVLADTKTLATLPNDIFIEGLGEVAKSGFIRDPEILHILEDHAAELRAFDGSTFLGSPLEDVVAELIERTVKVKAYHVSSDLKEKGLREFLNYGHTMGHAIEKLEHFRWRHGNAVAVGMVYAAELAHLIGYIDQDLVDYHRSLLASMGLPTSWNGGSFDDVLALMHRDKKARGNELRFVVLDEIGHVVHLDNPPAEAVEEAFRRIQQ

SEQ ID NO: 2207 - DNA, 525 bp, Buchnera aphidicola
  CDS (1)..(525)
atgacagaaaaacgaaatatttttttaattggacctatgggagctggaaaaagtactattggtcgtcatttagctcaacaactaagtatggaattttacgattcagatcaagaaatcgaaaaacgtactggtgtagatgttagttggatttttgatattgaaggagaattagggtttagaaaacgggaacaaaaaataattagtgaaataattgacaaaaggggtatagttttgtcaacaggaggaggatctattctttcaagagaaataagaaataaattatcatctcgtggcgtggttatttatttagaaacttctgtggaaaaacaattagttagaactaaaaaaaacaaacaacgtccattattacaagtagataatacatctattcaaactgttcttgaagaattggcttttcatagaaatcctctttatcaatcaatagctgatattacaatacgcatgaatgatagaagtattaaagctattgtattttacattattcgtttgttaaataatttttga

SEQ ID NO: 2208 - protein, 174 aa, Buchnera aphidicola
MTEKRNIFLIGPMGAGKSTIGRHLAQQLSMEFYDSDQEIEKRTGVDVSWIFDIEGELGFRKREQKIISEIIDKRGIVLSTGGGSILSREIRNKLSSRGVVIYLETSVEKQLVRTKKNKQRPLLQVDNTSIQTVLEELAFHRNPLYQSIADITIRMNDRSIKAIVFYIIRLLNNF

SEQ ID NO: 2209 - DNA, 510 bp, Corynebacterium efficiens
  CDS (1)..(510)
atggcacgtcccatcgtcgtcctggtcggtccacccggtgcaggcaaatccaccatcggtcggcgtctggcccgtgcccttaatgcggacctggtggacagtgatgaactgatcgagaaggccaccggcaaggcctgcggggaggtgttctccgaactcggtgagcccgccttccgcgagctggaggcacaccacgtcgccgaggcactcaaccatgacggtgtggtgagcctcggtggtggggccatcctcaccgaatccacccgtgagctgctcagggagcacgatgtggtgtggatcgatgtctccgtcgccgagggggtgcgccgcaccgccggggagcggacccgtccggtcctggcggctgacgacccggtcgagcactaccgcaacctcctggaaacccgccgtccgctctatgaggaggtgtccacgttccgcgtgcgcaccaactcccgcagtccacagcaggtggtggcagagatcctgcaccacctcgaggatgattag

SEQ ID NO: 2210 - protein, 169 aa, Corynebacterium efficiens
MARPIVVLVGPPGAGKSTIGRRLARALNADLVDSDELIEKATGKACGEVFSELGEPAFRELEAHHVAEALNHDGVVSLGGGAILTESTRELLREHDVVWIDVSVAEGVRRTAGERTRPVLAADDPVEHYRNLLETRRPLYEEVSTFRVRTNSRSPQQVVAEILHHLEDD

SEQ ID NO: 2211 - DNA, 525 bp, Haemophilus ducreyi
  CDS (1)..(525)
atggctgaaaaacgtaatattttcttagttggccctatgggggcaggcaaaagcactattggtcgtcagcttgctcagatgttaaacatggatttcattgactccgatgcagttattgaagaacgtgctggtgcaagcattgattggatctttgatattgaaggtgaagcgggtttccgtaaacgtgaagaacgtattattaatgaattaactaaaggtcaacaaggtattgtgctttctaccggtggtggatctattttatccaaagagaatcgcaatgctttgtcggcacgtgggattgttatctacttagaaacaacagtagataaacagtttgagcgtacacaacgagataaaaaacgtccgctcttacaaacagaagatccgcgtaaaatattagaagctatcgcgaaagaacgtaacccactttatgaagaaatcgcagatattaccctccaaactgacgaacaaagtgctaaagtcgtagctacgcatatcattgagttaattgataatttacaataa

SEQ ID NO: 2212 - protein, 174 aa, Haemophilus ducreyi
MAEKRNIFLVGPMGAGKSTIGRQLAQMLNMDFIDSDAVIEERAGASIDWIFDIEGEAGFRKREERIINELTKGQQGIVLSTGGGSILSKENRNALSARGIVIYLETTVDKQFERTQRDKKRPLLQTEDPRKILEAIAKERNPLYEEIADITLQTDEQSAKVVATHIIELIDNLQ

SEQ ID NO: 2213 - DNA, 504 bp, Helicobacter hepaticus
  CDS (1)..(504)
atggagaatatagttttaattggctttatgggaagcggtaaaacaaccatagggcgagaaattgcgttacttggaggacgttttttgcttgacactgaccaaattatagagcaaaatatgggaaaaagtataaacgaaatttttgaatcagtgggcgagagtggatttagacgtatagaatcccaacttattttatggctttccgctaatgttaaaaatgctgtgattgctacaggcggaggtatgcctatttataatgatgtagcatatttaggctatgtgttttggcttgatatgagttttgaaagcattttaaagcgattgactattacagaacaagaaaagcgtccactttttagtgatatttcaaaagcaaggcagctttataatgagcgtaagagtatttataaaaaacaatccaaatatattatcaatggagatgcttctgctttggaaattgcacgtaaaattatagaatgtatggataaagaggtgcaagaatag

SEQ ID NO: 2214 - protein, 167 aa, Helicobacter hepaticus
MENIVLIGFMGSGKTTIGREIALLGGRFLLDTDQIIEQNMGKSINEIFESVGESGFRRIESQLILWLSANVKNAVIATGGGMPIYNDVAYLGYVFWLDMSFESILKRLTITEQEKRPLFSDISKARQLYNERKSIYKKQSKYIINGDASALEIARKIIECMDKEVQE

SEQ ID NO: 2215 - DNA, 552 bp, Oceanobacillus iheyensis
  CDS (1)..(552)
atggggaagtttccattaagagaacaaagtatagttttaataggttttatgggcgttggaaaaacgacgattggtaagacggtagcaaaaaaattataccgtgattttatagatattgatgaagaaatcgaaaaaagattcaagatgccaactaaagatatttttcgattatatggagaaaaaacatttcgcaatgcggaaaaagatattatatctgaaatatgccaacaacgattaaaagttgtttctttaggtggaggagcatttttacaaaaggaaatacaagaaatttgtttaaactctagtattatattttatctcgatttgtcttgggatcgttggaaagaccgtatcgaacttttaatggaaagtcgaccagtacttcaaggcaagactatgaaggaaatgaaacaattatatgaagacagaaagccaatatatgagcaacatcattctagagtagatacagattatcatgagatagaagaagttgccgattatatcgccgaatcactaaaattagcatgggatatatatgaacctacttcatga

SEQ ID NO: 2216 - protein, 183 aa, Oceanobacillus iheyensis
MGKFPLREQSIVLIGFMGVGKTTIGKTVAKKLYRDFIDIDEEIEKRFKMPTKDIFRLYGEKTFRNAEKDIISEICQQRLKVVSLGGGAFLQKEIQEICLNSSIIFYLDLSWDRWKDRIELLMESRPVLQGKTMKEMKQLYEDRKPIYEQHHSRVDTDYHEIEEVADYIAESLKLAWDIYEPTS

SEQ ID NO: 2217 - DNA, 528 bp, Pasteurella multocida
  CDS (1)..(528)
atggcagaaaagcgtaatattttcttaattggaccaatgggcgcgggtaaaagtacgattggccgccaattagcacagctattaagtatggactttgtggattcggataatgaaattgaacaacgagcgggtgctgatattagttggatttttgatgttgaaggtgaagacggttttcgtaagcgtgaagaacgcattattaatgaattaacacaaagacaagggatcgtgttatctacaggtggtggcgcggtgttatcgaaagaaaatcgtaatcacttatcagcacggggtatcgtgatttatttagaaacgacggtagagaaacaatatcagcgtacacagcgtgataaaaaacgccctcttttgcaagaggttgaggatccccgtcaagtccttgaggatttagcaaaaattcgtaatcctttgtatgaagaaattgccgatatcaccttacctactgatgaacaaagcgctaaggtaatggcaacgcaaattgtcgatttaattgataatcttcacggttag

SEQ ID NO: 2218 - protein, 175 aa, Pasteurella multocida
MAEKRNIFLIGPMGAGKSTIGRQLAQLLSMDFVDSDNEIEQRAGADISWIFDVEGEDGFRKREERIINELTQRQGIVLSTGGGAVLSKENRNHLSARGIVIYLETTVEKQYQRTQRDKKRPLLQEVEDPRQVLEDLAKIRNPLYEEIADITLPTDEQSAKVMATQIVDLIDNLHG

SEQ ID NO: 2219 - DNA, 522 bp, Photorhabdus luminescens
  CDS (1)..(522)
atggcagagaaacgtaatatctttctggttgggcctatgggtgccggcaaaagcactattggtcgtcagttagctcagcaactcaatatggagttttacgactccgatcaagaaattgagcgacgtaccggagctgacgtgggctgggtattcgatgtggaaggcgaagaaggcttccgcgaacgcgaagaaaaagtgattaacgaactcacggaaaaacaaggcattgtactggcgactggcggaggttctgtgaaatccagagaaacccgcaatcgtctgtcagcccgtggggtcgtggtctacttggaaaccaccattgaaaaacagttagcacgcactcagcgcgataaaaaacgtcccttacttcaagttgatgcaccagcacgtgaagttttagaaaatttagcaaacgaacgtaatcctctgtatgaggaaattgctgatgtcactatccgtaccgatgaacagagcgctaaagttgtcgctaaccaaatcattgagttactggaaaaaaactga

SEQ ID NO: 2220 - protein, 173 aa, Photorhabdus luminescens
MAEKRNIFLVGPMGAGKSTIGRQLAQQLNMEFYDSDQEIERRTGADVGWVFDVEGEEGFREREEKVINELTEKQGIVLATGGGSVKSRETRNRLSARGVVVYLETTIEKQLARTQRDKKRPLLQVDAPAREVLENLANERNPLYEEIADVTIRTDEQSAKVVANQIIELLEKN

SEQ ID NO: 2221 - DNA, 519 bp, Pseudomonas putida
  CDS (1)..(519)
atgcgaaatttgatacttgtggggcccatgggcgctggtaaaagcaccatcggacgcctgttggccaaagagctgcgcctgctgttcaaggattccgacaaggaaatcgaactgcgatgcggcgcgaacatcccgtggatattcgacaaggaaggcgagccgggtttccgtgatcgcgagcaagcgatgattgccgagttgtgcgcgctcgacggtgtggtgctggccaccggcggtggcgcggtgatgcgcgaagccaaccggcaggcgctgcatcagggtggccgggtgatctacctgcatgcttcggtcgagcagcaagtcggccgcaccgcgcgcgaccgcaatcgcccgctgctgcgcacggccaatcccgaggcgaccttgcgcaccttgctggaaacccgcgacccgctctaccgcgagatcgccgacctggtggttgaaaccgacgagcggccaccacgcatggtggtgatcgatattctcgagcgcttgcagcagttgccgccccgttaa

SEQ ID NO: 2222 - protein, 172 aa, Pseudomonas putida
MRNLILVGPMGAGKSTIGRLLAKELRLLFKDSDKEIELRCGANIPWIFDKEGEPGFRDREQAMIAELCALDGVVLATGGGAVMREANRQALHQGGRVIYLHASVEQQVGRTARDRNRPLLRTANPEATLRTLLETRDPLYREIADLVVETDERPPRMVVIDILERLQQLPPR

SEQ ID NO: 2223 - DNA, 519 bp, Pseudomonas syringae
  CDS (1)..(519)
atgcgaaatttaatacttgtggggccgatgggtgctggcaaaagcaccatcggccgcttgcttgccaaagagttgcgactgccgttcaaggattccgacaaggaaatcgagctgcgcacgggcgccaacatcccctggatcttcgacaaggagggcgaaccgggtttccgggagcgcgagcaggccatgattgccgagttgtgcgaagccgatggcgtggttctggccactggcggcggcgcagtcatgcgcactgaaaaccgtcaggcgctgcgtgccggtgggcgtgtggtgtatctgcatgcctctatcgaacagcaggtcgggcgcaccgcgcgtgaccgaaatcgtcctttgttgcgtactgccgatccggcccgggtgctgagcgaattgctggccatccgcgacccgctgtatcgggaaatcgccgacgtggtgatcgaaaccgatgagcggccaccccgaatggtggttctcgagatactggcgcgccttgcagagcttcctccccgttaa

SEQ ID NO: 2224 - protein, 172 aa, Pseudomonas syringae
MRNLILVGPMGAGKSTIGRLLAKELRLPFKDSDKEIELRTGANIPWIFDKEGEPGFREREQAMIAELCEADGVVLATGGGAVMRTENRQALRAGGRVVYLHASIEQQVGRTARDRNRPLLRTADPARVLSELLAIRDPLYREIADVVIETDERPPRMVVLEILARLAELPPR

SEQ ID NO: 2225 - DNA, 516 bp, Shewanella oneidensis
  CDS (1)..(516)
atggctgaaaaacgtaatatttttctggtaggcccaatgggcgcaggtaaaagcacaattggtcgccatctggcccaaatgctgcatttagaattccacgattcagatcaagagattgagcaacgcactggcgctgatattgcttgggtgtttgatgttgaaggcgaagaaggtttccgccgtcgtgaggctcaggttattgctgatctgtctgaaaaacagggtattgtccttgccactggtggtggttcagttcagagcaaagatatccgtaatcatttatctgctcgcggtattgtggtttatctcgaaaccactatcgacaaacaggtagcgcgaactcaacgagacaagcgccgcccattactgcaagtagatgatccgcgagaagtattagagagcctcgcagaaatccgtaaccctctgtacgaagaaattgctgatgtggtcgttaaaactgacgatcaaagtgcaaaggtagttgcgaatcaaatcatagagaaattaggtttctag

SEQ ID NO: 2226 - protein, 171 aa, Shewanella oneidensis
MAEKRNIFLVGPMGAGKSTIGRHLAQMLHLEFHDSDQEIEQRTGADIAWVFDVEGEEGFRRREAQVIADLSEKQGIVLATGGGSVQSKDIRNHLSARGIVVYLETTIDKQVARTQRDKRRPLLQVDDPREVLESLAEIRNPLYEEIADVVVKTDDQSAKVVANQIIEKLGF

SEQ ID NO: 2227 - DNA, 519 bp, Staphylococcus epidermidis
  CDS (7)..(519)
attaatatgaagagtattcaagtgcctattattttagttggtttcatgggaactggtaaaactactgttggaaaatatctttcagatttatataatttaagttatgtggatttagataattttattgaagtaaatgaatgtaaatctatacctaatatatttaatgatatcggagaaaaaggatttagatcattggagactagatacctaaaatcttgtctcaatactttcgatattatttcaactggaggaggtattatagaagatacgaattcattaaagctcttaaaaaatcaaaagcatgtagtttggctagactgtgacattgaaatcattttcaaacgagttaaaaatgattcacatagacccaatgctaaaagtaaaaatcttaaccaacttgatgccttgtattcttcaagactttcaagatataatgaaatcgcattcatgaaagttgatagtgcacagagtgtttctgaaatttgcactttaattaaaacaaaattattaagcgattga

SEQ ID NO: 2228 - protein, 170 aa, Staphylococcus epidermidis
MKSIQVPIILVGFMGTGKTTVGKYLSDLYNLSYVDLDNFIEVNECKSIPNIFNDIGEKGFRSLETRYLKSCLNTFDIISTGGGIIEDTNSLKLLKNQKHVVWLDCDIEIIFKRVKNDSHRPNAKSKNLNQLDALYSSRLSRYNEIAFMKVDSAQSVSEICTLIKTKLLSD

SEQ ID NO: 2229 - DNA, 552 bp, Synechococcus elongatus
  CDS (1)..(552)
atgaaactgcaagaacgtcttgggggagccaatatctatcttgtgggcatgatgggtgctggtaaaaccaccacgggtcgcctcctggcccaacgcttgggctatagttttgtggataccgatgctgtgattacggcgtttcgccaacgaccgattcgcgaaatctttgcccaagagggggagcctgcctttcgggagttggagcaacaggtcctagcacaggtctctagttaccatcacttagtggtggccaccggtgggggcattgtcctcaacccgatgaactggagttatctgcatcacggtattgtggtctggcttcatgtcccccttgcggtgctctgtcaacgcctgcgccaagatcgggaacgtcccctgttgcaggagcagcctcttgaggaacgcttgggtgaactgctgcaggcgcgtcaacacctctatgctcaggcagatttagagctcaggattacgctggaagataccccggaaacggtgtgcgatcgcctgttggaaaccctaccctgtatcttgaaaccaatggaaccatgctag

SEQ ID NO: 2230 - protein, 183 aa, Synechococcus elongatus
MKLQERLGGANIYLVGMMGAGKTTTGRLLAQRLGYSFVDTDAVITAFRQRPIREIFAQEGEPAFRELEQQVLAQVSSYHHLVVATGGGIVLNPMNWSYLHHGIVVWLHVPLAVLCQRLRQDRERPLLQEQPLEERLGELLQARQHLYAQADLELRITLEDTPETVCDRLLETLPCILKPMEPC

SEQ ID NO: 2231 - DNA, 519 bp, Vibrio parahaemolyticus
  CDS (1)..(519)
atggctgagaaacgtaatattttccttgttggcccaatgggcgccggcaaaagtacaattggtagacatctagcacagcaactgcatatggagtttgttgactccgatacagtgattgaagaacgcactggtgcagacatctcttgggtttttgatgtagaaggtgaagaaggcttccgtaagcgtgaagaagcggtacttgaagatctgactcaagaacaaggcatcgtgctggcaactggcggcggctctgtgaaaagcaaagagaaccgtaaccgtctttctgctcgcggtgtagttgtttacctagaaacgacaattgaaaagcaacttgcacgtactaaccgtgacaagaagcgtcctctacttcaaacggacaaccctcgtgaagtattggagcaattagctgaagaacgtaacccgttatacgaagaagtagcggattacactgttcgcactgacgatcaaagtgcaaaagtggtagccaaccagatcgtaaaaatgctagaagagagataa

SEQ ID NO: 2232 - protein, 172 aa, Vibrio parahaemolyticus
MAEKRNIFLVGPMGAGKSTIGRHLAQQLHMEFVDSDTVIEERTGADISWVFDVEGEEGFRKREEAVLEDLTQEQGIVLATGGGSVKSKENRNRLSARGVVVYLETTIEKQLARTNRDKKRPLLQTDNPREVLEQLAEERNPLYEEVADYTVRTDDQSAKVVANQIVKMLEER

SEQ ID NO: 2233 - DNA, 519 bp, Vibrio vulnificus
  CDS (1)..(519)
atggctgagaaacgtaatattttccttgttggcccaatgggcgctggcaaaagcacaattggtcgatacctagctcaacaactccacatggagtttttggattctgatactgttattgaagagcgcacaggcgctgacatctcttgggtatttgatgttgaaggtgaagagggtttccgcaaacgtgaagaagcggttatcaacgatctgacactagagcagggtatcgtattggcaacgggcggtggctcggtgaaaagccgcgaaaaccgcaatcgtctttctgcacgtggtattgtggtatacctagaaacgactatcgagaaacagctagctcgtactaaccgtgacaaaaaacgtccgttactacaaacggataatccacgtgaagtactagaatcactggctggtgagcgtaaccctctttacgaagagatcgcggattacaccgttcgcactgacgatcaaagtgcaaaagtggtagccaaccagatcgtaaaaatgctagaagaaagctaa

SEQ ID NO: 2234 - protein, 172 aa, Vibrio vulnificus
MAEKRNIFLVGPMGAGKSTIGRYLAQQLHMEFLDSDTVIEERTGADISWVFDVEGEEGFRKREEAVINDLTLEQGIVLATGGGSVKSRENRNRLSARGIVVYLETTIEKQLARTNRDKKRPLLQTDNPREVLESLAGERNPLYEEIADYTVRTDDQSAKVVANQIVKMLEES

SEQ ID NO: 2235 - DNA, 522 bp, Wigglesworthia glossinidia brevipalpis
  CDS (1)..(522)
atggtagaaaaaagaaatatttttttaattggtcctatgggagctggaaaaagcaccattggaagacaaatatctcagcaactaagcatggaattttttgattctgaccaagaaatagaaaaaagaacaggagcagatatatcttgggtattagacttagaaggagaaaataaatttagaattagagaagaaaaaataataaatgagattacagaaaaacaaggaattgttcttgcaactggaggaggatcaattcaatctagaaaaactagaaatcgtttatctgctagaggtcttgtagtttatttagaaacaactatagataaacaattagatagaactaaaagagataaaaaaaaaccaattttacaaaataaaaattctgttaaatcttttttagaaaaattagcgacagaaagaaatcctctatatgaggacatagcagatttaattataaaaacagattttaaaagcgcaaaaataatagcacatcaaataattaatactttgtttaaaacttaa

SEQ ID NO: 2236 - protein, 173 aa, Wigglesworthia glossinidia brevipalpis
MVEKRNIFLIGPMGAGKSTIGRQISQQLSMEFFDSDQEIEKRTGADISWVLDLEGENKFRIREEKIINEITEKQGIVLATGGGSIQSRKTRNRLSARGLVVYLETTIDKQLDRTKRDKKKPILQNKNSVKSFLEKLATERNPLYEDIADLIIKTDFKSAKIIAHQIINTLFKT

SEQ ID NO: 2237 - DNA, 543 bp, Xylella fastidiosa
  CDS (1)..(543)
atgaatcccgcccctaatcttgtgatgatcggcccgatgggcgccggaaaaagctccatcggacgacgcattgccaaacacttcaacctacacttcgcagatacagatcacgccattgttgaacgcgccggtacgagcatctccactattttcaaatattccggcgaaccagaatttcgacgcctggagcgtgaagtactgtacgacttgctgaatcacgaaaaccgactcatcgccaccggcggcggtacgatcctggatccagagaaccgccaccgcatgcaaaaacgcggcttcgtcgtatttctaaagatcaacgtgaacacccaattggagcgactggcacatgaccgctaccgaccattactgcaacaaatcgaccgcaaacaggtactgagcgatctctacgccacacgccaaccgctctaccagaaaatcgcagatatgattgtgaccaccgaccacatgtcccctaacacagccaccgcccagctcattctggacttaacagcccactggcagaaatcaagcaacaccgcatga

SEQ ID NO: 2238 - protein, 180 aa, Xylella fastidiosa
MNPAPNLVMIGPMGAGKSSIGRRIAKHFNLHFADTDHAIVERAGTSISTIFKYSGEPEFRRLEREVLYDLLNHENRLIATGGGTILDPENRHRMQKRGFVVFLKINVNTQLERLAHDRYRPLLQQIDRKQVLSDLYATRQPLYQKIADMIVTTDHMSPNTATAQLILDLTAHWQKSSNTA

SEQ ID NO: 2239 - DNA, 22 bp, artificial sequence
  primer
atggtagcaaggcagcgcgctt

SEQ ID NO: 2240 - DNA, 25 bp, artificial sequence
  primer
ttagttgctttccagcatgtgaata

SEQ ID NO: 2241 - DNA, 1113 bp, Saccharomyces cerevisiae; identical to SEQ ID NO: 1363
  CDS (1)..(1113)

SEQ ID NO: 2242 - protein, 370 aa, Saccharomyces cerevisiae; identical to SEQ ID NO: 1364

SEQ ID NO: 2243 - DNA, 1086 bp, Deinococcus radiodurans; identical to SEQ ID NO: 1327
  CDS (1)..(1086)

SEQ ID NO: 2244 - protein, 361 aa, Deinococcus radiodurans; identical to SEQ ID NO: 1328

SEQ ID NO: 2245 - DNA, 1071 bp, Salmonella enterica subsp. enterica serovar Typhi
  CDS (1)..(1071)
atgcaaaaagacgcgctgaataacgtacgtatcaccgatgaacaggtattaatgacgccggagcagcttaaagcggcctttcccttgagcctggcgcaggaagcgcagatagcgcagtcccggggaatcatttctgacattattgccgggcgcgatccgcgtctgttggtggtatgcggtccttgttctattcacgatcctgaaaccgctctggaatatgcccgtcgatttaaagcccttgccgcagaggtcagcgatagcctctatctggtaatgcgcgtctattttgaaaagccgcgaactaccgtcggctggaaagggctgattaacgatcctcacatggatggctcatttgatgtggaagccgggttgaaaatagcgcgtcagctactggtggaactggtgaatatggggttgccattggcgaccgaagcgttggatccgaacagcccgcaatacctgggcgatctgtttagctggtcggcgataggggcgcgcacaaccgaatcgcaaacccaccgcgaaatggcgtctggtctttctatgccggtcggctttaaaaacggcacggatggcagcctggcgacagcgattaacgccatgcgcgccgctgcgcaacctcatcgttttgttggcattaaccaggccggtcaggttgcgttattgcaaacccagggaaatccgcatggccatgtgattctgcgtggcggcaaagcgccaaactatagcccggcagatgtcgctcagtgtgaaaaagagatggaacaggcgggactacgtccttcgctgatggtagattgcagtcatggtaactccaataaagattatcgccgccagccagccgttgccgaatctgtggttgcgcagattaaagatggcaatcgttcaatcattggcttaatgattgaaagtaatattcatgagggtaaccagtcttccgaacagccgcgcagcgaaatgaagtatggcgtttccgtcaccgatgcttgtattagctgggagatgaccgatgccctgttacgtgaaattcataaagatttgagcggccagctggcggtgcgcgtcgcataa

SEQ ID NO: 2246 - protein, 356 aa, Salmonella enterica subsp. enterica serovar Typhi
MQKDALNNVRITDEQVLMTPEQLKAAFPLSLAQEAQIAQSRGIISDIIAGRDPRLLVVCGPCSIHDPETALEYARRFKALAAEVSDSLYLVMRVYFEKPRTTVGWKGLINDPHMDGSFDVEAGLKIARQLLVELVNMGLPLATEALDPNSPQYLGDLFSWSAIGARTTESQTHREMASGLSMPVGFKNGTDGSLATAINAMRAAAQPHRFVGINQAGQVALLQTQGNPHGHVILRGGKAPNYSPADVAQCEKEMEQAGLRPSLMVDCSHGNSNKDYRRQPAVAESVVAQIKDGNRSIIGLMIESNIHEGNQSSEQPRSEMKYGVSVTDACISWEMTDALLREIHKDLSGQLAVRVA

SEQ ID NO: 2247 - DNA, 1071 bp, Yersinia pestis
  CDS (1)..(1071)
atgcaaaaagactcgctcaataacgtccatatcagtgccgaacaaatcctgataaccccggaagaactgaaaaatcagtttccactgagcgaaaatgatcagtattcgatagagcgcgcacgtaaaaccattgctgacattattcaggggcgagatccgcgtctgttggtcgtttgtgggccctgttcaattcatgatgtggatgcggcactggattacgcgcgtcgtttgaaaaaactctctgtggaattggatgacagcttatatatcgttatgcgtgtctattttgagaagccaagaactaccgtgggttggaaaggcctgatcaatgaccctgcaatggatggttcatttgatgtagaggcaggtttacacattgcccgtcgtttattgctggatttagtgggcatggggttgccgttagcgactgaagctctggatcctaatagcccacaatatttaggtgacctgttcagttggtcggccattggtgcccgtacaacggagtcacagacccaccgtgaaatggcatcaggcttgtctatgccggttggatttaaaaatggcactgacggtagcctaggcacggcaatcaatgcaatgcgcgccgctgccatgccacatcgctttatggggatcaatcagtcgggccaggtctgcctgttacaaactcagggtaacccacacggccatgtcattctacggggaggtaaaacaccaaactacagtgcacaagatgtcgctcagtgtgaaaaacagatgcaggatgcgggactcatcccatccttaatgatagattgcagtcacggtaattcaaataaagactaccgccgtcaggttgcggtggctgaatctgtggttgaacagatcaaggcgggcaatcgttcaattacaggtgtgatgctggaaagccacatccacgaaggaaatcagtcatctgaacagccacgtgctgatatgcgctacggtgtttctgtgactgacgcctgtattaactgggaaagcactgaaaccctgttacgtggtatgcgccaagaattgcttgcagcactgacggcacggactgcatga

SEQ ID NO: 2248 - protein, 356 aa, Yersinia pestis
MQKDSLNNVHISAEQILITPEELKNQFPLSENDQYSIERARKTIADIIQGRDPRLLVVCGPCSIHDVDAALDYARRLKKLSVELDDSLYIVMRVYFEKPRTTVGWKGLINDPAMDGSFDVEAGLHIARRLLLDLVGMGLPLATEALDPNSPQYLGDLFSWSAIGARTTESQTHREMASGLSMPVGFKNGTDGSLGTAINAMRAAAMPHRFMGINQSGQVCLLQTQGNPHGHVILRGGKTPNYSAQDVAQCEKQMQDAGLIPSLMIDCSHGNSNKDYRRQVAVAESVVEQIKAGNRSITGVMLESHIHEGNQSSEQPRADMRYGVSVTDACINWESTETLLRGMRQELLAALTARTA

SEQ ID NO: 2249 - DNA, 1047 bp, Yersinia pestis; identical to SEQ ID NO: 1331
  CDS (1)..(1047)

SEQ ID NO: 2250 - protein, 348 aa, Yersinia pestis; identical to SEQ ID NO: 1332

SEQ ID NO: 2251 - DNA, 1053 bp, Escherichia coli
  CDS (1)..(1053)
atgaattatcagaacgacgatttacgcatcaaagaaatcaaagagttacttcctcctgtcgcattgctggaaaaattccccgctactgaaaatgccgcgaatacggttgcccatgcccgaaaagcgatccataagatcctgaaaggtaatgatgatcgcctgttggttgtgattggcccatgctcaattcatgatcctgtcgcggcaaaagagtatgccactcgcttgctggcgctgcgtgaagagctgaaagatgagctggaaatcgtaatgcgcgtctattttgaaaagccgcgtaccacggtgggctggaaagggctgattaacgatccgcatatggataatagcttccagatcaacgacggtctgcgtatagcccgtaaattgctgcttgatattaacgacagcggtctgccagcggcaggtgagtttctcgatatgatcaccccacaatatctcgctgacctgatgagctggggcgcaattggcgcacgtaccaccgaatcgcaggtgcaccgcgaactggcatcagggctttcttgtccggtcggcttcaaaaatggcaccgacggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcacaggtgatgatcgatttcagccatgctaactcgtccaaacaattcaaaaagcagatggatgtttgtgctgacgtttgccagcagattgccggtggcgaaaaggccattattggcgtgatggtggaaagccatctggtggaaggcaatcagagcctcgagagcggggagccgctggcctacggtaagagcatcaccgatgcctgcatcggctgggaagataccgatgctctgttacgtcaactggcgaatgcagtaaaagcgcgtcgcgggtaa

SEQ ID NO: 2252 - protein, 350 aa, Escherichia coli; identical to SEQ ID NO: 1580

SEQ ID NO: 2253 - DNA, 1071 bp, Escherichia coli; identical to SEQ ID NO: 1333
  CDS (1)..(1071)

SEQ ID NO: 2254 - protein, 356 aa, Escherichia coli; identical to SEQ ID NO: 1334

SEQ ID NO: 2255 - DNA, 1131 bp, Nostoc sp. PCC 7120; identical to SEQ ID NO: 1335
  CDS (1)..(1131)

SEQ ID NO: 2256 - protein, 376 aa, Nostoc sp. PCC 7120; identical to SEQ ID NO: 1336

SEQ ID NO: 2257 - DNA, 1053 bp, Salmonella enterica subsp. enterica serovar Typhi; identical to SEQ ID NO: 1337
  CDS (1)..(1053)

SEQ ID NO: 2258 - protein, 350 aa, Salmonella enterica subsp. enterica serovar Typhi; identical to SEQ ID NO: 1338

SEQ ID NO: 2259 - DNA, 1077 bp, Pseudomonas aeruginosa; identical to SEQ ID NO: 1339
  CDS (1)..(1077)

SEQ ID NO: 2260 - protein, 358 aa, Pseudomonas aeruginosa; identical to SEQ ID NO: 1340

SEQ ID NO: 2261 - DNA, 1074 bp, Vibrio cholerae; identical to SEQ ID NO: 1343
  CDS (1)..(1074)

SEQ ID NO: 2262 - protein, 357 aa, Vibrio cholerae; identical to SEQ ID NO: 1344

SEQ ID NO: 2263 - DNA, 1038 bp, Lactococcus lactis subsp. lactis; identical to SEQ ID NO: 1345
  CDS (1)..(1038)

SEQ ID NO: 2264 - protein, 345 aa, Lactococcus lactis subsp. lactis; identical to SEQ ID NO: 1346

SEQ ID NO: 2265 - DNA, 1023 bp, Lactococcus lactis subsp. lactis; identical to SEQ ID NO: 1347
  CDS (1)..(1023)

SEQ ID NO: 2266 - protein, 340 aa, Lactococcus lactis subsp. lactis; identical to SEQ ID NO: 1348

SEQ ID NO: 2267 - DNA, 1032 bp, Streptococcus pneumoniae; identical to SEQ ID NO: 1349
  CDS (1)..(1032)

SEQ ID NO: 2268 - protein, 343 aa, Streptococcus pneumoniae; identical to SEQ ID NO: 1350

SEQ ID NO: 2269 - DNA, 1056 bp, Neisseria meningitidis
  CDS (1)..(1056)
atgacacaccattaccccacagacgatattaagattaaagaagttaaagagttgttgccgccgatagcccatctttacgagctgccgatttccaaagaggcttcgggcttggttcaccgcacccgtcaggaaatttccgatttggttcacggcagggacaagcggctgttggttattatcgggccgtgttcgattcacgatccgaaagcggcgttggaatatgcggagcgtttgttgaaactccgcaagcagtatgaaaacgagcttttgattgtgatgcgcgtttatttcgagaagccgaggacgacggtgggttggaaaggtttgattaacgacccgcatttggacggtacgtttgacatcaatttcggtttgcgtcaggcgcgcagcctgttgttgtcgctgaacaatatgggtatgcctgcctctaccgagtttttggatatgattacgccgcaatattatgcggacttgatttcttggggggcaatcggtgcgcggacgaccgaaagccaagttcaccgcgaattggcaagcgggctgtcctgccccgtcggctttaaaaacggtacggacggcaatttgaagattgccatcgacgcaatcggtgcggcgagccattcgcatcatttcctgtctgtaaccaaggccgggcattccgccattgtccataccggcggcaatcccgactgtcatgtcattttgcgcggcggcaaagagccgaattatgatgcggaacacgtcagcgaggcggcggaacaactgcgtgcggcaggggtaaccgacaagctgatgatagattgcagccacgccaacagccgcaaggattacactcggcagatggaagtggcacaagacattgccgcccaattggaacaggacggcggcaatatcatgggcgtgatggtggaaagccatttggtcgaaggcagacaggacaagccggaagtgtacggcaagagcattaccgatgcgtgtatcggttggggcgcgactgaagaactgttggcattgttggcaggtgcaaacaaaaaacgtatggcgcgcgccagttga

SEQ ID NO: 2270 - protein, 351 aa, Neisseria meningitidis
MTHHYPTDDIKIKEVKELLPPIAHLYELPISKEASGLVHRTRQEISDLVHGRDKRLLVIIGPCSIHDPKAALEYAERLLKLRKQYENELLIVMRVYFEKPRTTVGWKGLINDPHLDGTFDINFGLRQARSLLLSLNNMGMPASTEFLDMITPQYYADLISWGAIGARTTESQVHRELASGLSCPVGFKNGTDGNLKIAIDAIGAASHSHHFLSVTKAGHSAIVHTGGNPDCHVILRGGKEPNYDAEHVSEAAEQLRAAGVTDKLMIDCSHANSRKDYTRQMEVAQDIAAQLEQDGGNIMGVMVESHLVEGRQDKPEVYGKSITDACIGWGATEELLALLAGANKKRMARAS

SEQ ID NO: 2271 - DNA, 1095 bp, Pseudomonas aeruginosa; identical to SEQ ID NO: 1351
  CDS (1)..(1095)

SEQ ID NO: 2272 - protein, 364 aa, Pseudomonas aeruginosa; identical to SEQ ID NO: 1352

SEQ ID NO: 2273 - DNA, 1032 bp, Streptococcus pneumoniae; identical to SEQ ID NO: 1355
  CDS (1)..(1032)

SEQ ID NO: 2274 - protein, 343 aa, Streptococcus pneumoniae; identical to SEQ ID NO: 1356

SEQ ID NO: 2275 - DNA, 1143 bp, Xylella fastidiosa; identical to SEQ ID NO: 1603
  CDS (1)..(1143)

SEQ ID NO: 2276 - protein, 380 aa, Xylella fastidiosa; identical to SEQ ID NO: 1604

SEQ ID NO: 2277 - DNA, 1047 bp, Buchnera aphidicola; identical to SEQ ID NO: 1357
  CDS (1)..(1047)

SEQ ID NO: 2278 - protein, 348 aa, Buchnera aphidicola; identical to SEQ ID NO: 1358

SEQ ID NO: 2279 - DNA, 1104 bp, Corynebacterium glutamicum
  CDS (1)..(1104)
atgagttctccagtctcactcgaaaacgcggcgtcaaccagcaacaagcgcgtagtggctttccacgagctgccaagccctacagatctcatcgccgcaaacccactgacaccaaagcaggcttccaaggtggagcaggatcgccaggacatcgctgatatcttcgctggcgacgatgaccgcctcgttgtcgttgtgggaccttgctcagttcacgatcctgaagcagccatcgattacgcaaaccgcctggctccgctggcaaagcgccttgaccaggacctcaagattgtcatgcgcgtgtacttcgagaagcctcgcaccaccgtcggttggaagggattgatcaacgatcctcaccttaacgaaacctacgacatcccagagggcttgcgcattgcgcgtaaagtgcttatcgacgttgtgaaccttgatctcccagtcggctgcgaattcctcgaaccaaacagccctcagtactacgccgacactgtcgcatggggagcaatcggcgctcgtaccaccgaatctcaggtgcaccgccgccagctggcttctgggatgtctatgccaattggtttcaagaacggaactgacggaaacatccaggttgcagtcgacgcggtacaggctgcccagaacccacacttcttcttcggaacctccgacgacggcgcgctgagcgtcgtggagaccgcaggcaacagcaactcccacatcattttgcgcggcggtacctccggcccgaatcatgatgcagcttcggtggaggccgtcgtcgagaagcttggtgaaaatgctcgtctcatgatcgatgcgtcccacgccaactccggcaaggatcacatccgacaggttgaggttgttcgtgaaatcgcagagcagatttctggcggttctgaggctgtggcaggaatcatgatcgaatccttcctcgttggtggcgcacagaaccttgatcctgcgaaattgcgcatcaacggcggtgaaggcctggtgtacggacagtctgtgaccgataagtgcatcgatattgacaccaccatcgatttgctcgctgagctggccacagcagtaagggaacgccgagcagcagccaagtaa

SEQ ID NO: 2280 - protein, 367 aa, Corynebacterium glutamicum
MSSPVSLENAASTSNKRVVAFHELPSPTDLIAANPLTPKQASKVEQDRQDIADIFAGDDDRLVVVVGPCSVHDPEAAIDYANRLAPLAKRLDQDLKIVMRVYFEKPRTTVGWKGLINDPHLNETYDIPEGLRIARKVLIDVVNLDLPVGCEFLEPNSPQYYADTVAWGAIGARTTESQVHRRQLASGMSMPIGFKNGTDGNIQVAVDAVQAAQNPHFFFGTSDDGALSVVETAGNSNSHIILRGGTSGPNHDAASVEAVVEKLGENARLMIDASHANSGKDHIRQVEVVREIAEQISGGSEAVAGIMIESFLVGGAQNLDPAKLRINGGEGLVYGQSVTDKCIDIDTTIDLLAELATAVRERRAAAK

SEQ ID NO: 2281 - DNA, 1089 bp, Haemophilus influenzae; identical to SEQ ID NO: 1359
  CDS (1)..(1089)

SEQ ID NO: 2282 - protein, 362 aa, Haemophilus influenzae; identical to SEQ ID NO: 1360

SEQ ID NO: 2283 - DNA, 1502 bp, Candida albicans; identical to SEQ ID NO: 1361
  CDS (336)..(1442)

SEQ ID NO: 2284 - protein, 368 aa, Candida albicans; identical to SEQ ID NO: 1362

SEQ ID NO: 2285 - DNA, 2048 bp, Saccharomyces cerevisiae; identical to SEQ ID NO: 1365
  CDS (619)..(1731)

SEQ ID NO: 2286 - protein, 370 aa, Saccharomyces cerevisiae; identical to SEQ ID NO: 1366

SEQ ID NO: 2287 - DNA, 1107 bp, Schizosaccharomyces pombe; identical to SEQ ID NO: 1367
  CDS (1)..(1107)

SEQ ID NO: 2288 - protein, 368 aa, Schizosaccharomyces pombe; identical to SEQ ID NO: 1368

SEQ ID NO: 2289 - DNA, 1089 bp, Amycolatopsis orientalis; identical to SEQ ID NO: 1369
  CDS (1)..(1089)

SEQ ID NO: 2290 - protein, 362 aa, Amycolatopsis orientalis; identical to SEQ ID NO: 1370

SEQ ID NO: 2291 - DNA, 1119 bp, Schizosaccharomyces pombe; identical to SEQ ID NO: 1371
  CDS (1)..(1119)

SEQ ID NO: 2292 - protein, 372 aa, Schizosaccharomyces pombe; identical to SEQ ID NO: 1372

SEQ ID NO: 2293 - DNA, 1083 bp, Methylophilus methylotrophus; identical to SEQ ID NO: 1375
  CDS (1)..(1083)

SEQ ID NO: 2294 - protein, 360 aa, Methylophilus methylotrophus; identical to SEQ ID NO: 1376

SEQ ID NO: 2295 - DNA, 1770 bp, Debaryomyces hansenii
  CDS (1)..(1770)
atggagtcctcgatcgatatgaatgaagaattaaaaaagctaaaatcacataaggatgcgacttttcaattggatgcaaaagaagcagtcagctctgcttgtgaaccagaaaacaaatcaacctgtgaaaccactgtggaaacgaatgatattgaaagcgatattgaaggagaaccaaaatatggtacagtggacaattcgcaacaattgatggatcaattgaataagctcaaaataatgctggaacaggactcggctaaagtttcttcgtcgaatacgagctcgggaggatcgtcgtcggtgagtttggcacccaaatggatttatggtacaacattgcctcctttgaacgcttcaagaaataattattcgtcggcttcgggcttgtgtctaagcgagcgaggtcaagtggctgtagcgcagcccgagcttattcagaacttcttatttccaaccacaactttgttgcaacaaaaggttgtgaaatacagggaaagtattggaaatatattatcggcggatataattagtaaaaaaagtgcttttaagaatcccttgcttgttattacaggaccaagtttcattaccgatgctaatcaagctaaggcatgtgcacaatgggtgggaagcatgaatggaaaaaaatttcatgatttgcctaatgggatattgcccgatagtatattaggtttgtaccacaggtccaatagactagaacttaagaatatattgttgtctttgagaacaaatttaacaaagtacaaccatggttacaatgatccatcgtttttgagaggcttcaactcaatcatgacatacgagattgaacaaggaattccaatatgtagggcgttactttgcgagttagcagaaatttgtcccatagttggtgagacttcagacacaattacacctcagtacttctctgatctattttgtttaggtattgtcagtagtaaattgagagaatcacaattacaccgagaattagtatcaggtgtctcttacgctgtcggtttccacaccctggatgatacactgtgctttgataaagaatcttatacccataatatcacctcggctttggaagcaatgtatgcttcttctaatccccatcaatttttatccgtcactaaaatcggaacagttgcagttgtcgggactattggtaacgacgagacatctattatactactgataaatcttgaattagactactatgaaatcgaacatattattgaccaggtgtatgattattctaagtcaaatataaaaagaccaaaaattatgttagatgttggaaaaatatccaatgaagaatatgaatcaaaattagacctattaagacaacttctcgttctgaataccgatttaaaatacaaaattatcggcgtgatcatagatagtggtaacaactatatttcgcatcgttatacaattgatttaaataagccatttggtgtaaatgaagactttgaaaaccaagattatatcactgacgatgatatcgaaaggaataaaaacgataacgataagtctgaaaacagtatgaaccatcaaatgttaattggcttgaataattattttgtcaaaaataggatatacggtaaaatgtctccttcacgccaatcccaacaaagaccaagttctgagcttgactttgactcttcgttgatacacttggataagtattatgaatattttgttaatgcagataagttcatccaggaactagatgacatgagtagccttcgaatcaactctcaatga

SEQ ID NO: 2296 - protein, 589 aa, Debaryomyces hansenii
MESSIDMNEELKKLKSHKDATFQLDAKEAVSSACEPENKSTCETTVETNDIESDIEGEPKYGTVDNSQQLMDQLNKLKIMLEQDSAKVSSSNTSSGGSSSVSLAPKWIYGTTLPPLNASRNNYSSASGLCLSERGQVAVAQPELIQNFLFPTTTLLQQKVVKYRESIGNILSADIISKKSAFKNPLLVITGPSFITDANQAKACAQWVGSMNGKKFHDLPNGILPDSILGLYHRSNRLELKNILLSLRTNLTKYNHGYNDPSFLRGFNSIMTYEIEQGIPICRALLCELAEICPIVGETSDTITPQYFSDLFCLGIVSSKLRESQLHRELVSGVSYAVGFHTLDDTLCFDKESYTHNITSALEAMYASSNPHQFLSVTKIGTVAVVGTIGNDETSIILLINLELDYYEIEHIIDQVYDYSKSNIKRPKIMLDVGKISNEEYESKLDLLRQLLVLNTDLKYKIIGVIIDSGNNYISHRYTIDLNKPFGVNEDFENQDYITDDDIERNKNDNDKSENSMNHQMLIGLNNYFVKNRIYGKMSPSRQSQQRPSSELDFDSSLIHLDKYYEYFVNADKFIQELDDMSSLRINSQ

SEQ ID NO: 2297 - DNA, 1107 bp, Debaryomyces hansenii; identical to SEQ ID NO: 1377
  CDS (1)..(1107)

SEQ ID NO: 2298 - protein, 368 aa, Debaryomyces hansenii; identical to SEQ ID NO: 1378

SEQ ID NO: 2299 - DNA, 1074 bp, Yarrowia lipolytica; identical to SEQ ID NO: 1379
  CDS (1)..(1074)

SEQ ID NO: 2300 - protein, 357 aa, Yarrowia lipolytica; identical to SEQ ID NO: 1380

SEQ ID NO: 2301 - DNA, 1089 bp, Yarrowia lipolytica; identical to SEQ ID NO: 1381
  CDS (1)..(1089)

SEQ ID NO: 2302 - protein, 362 aa, Yarrowia lipolytica; identical to SEQ ID NO: 1382

SEQ ID NO: 2303 - DNA, 1119 bp, Kluyveromyces lactis; identical to SEQ ID NO: 1383
  CDS (1)..(1119)

SEQ ID NO: 2304 - protein, 372 aa, Kluyveromyces lactis; identical to SEQ ID NO: 1384

SEQ ID NO: 2305 - DNA, 1095 bp, Kluyveromyces lactis; identical to SEQ ID NO: 1385
  CDS (1)..(1095)

SEQ ID NO: 2306 - protein, 364 aa, Kluyveromyces lactis; identical to SEQ ID NO: 1386

SEQ ID NO: 2307 - DNA, 1074 bp, Erwinia carotovora subsp; identical to SEQ ID NO: 1387
  CDS (1)..(1074)

SEQ ID NO: 2308 - protein, 357 aa, Erwinia carotovora subsp; identical to SEQ ID NO: 1388

SEQ ID NO: 2309 - DNA, 1047 bp, Erwinia carotovora subsp; identical to SEQ ID NO: 1389
  CDS (1)..(1047)

SEQ ID NO: 2310 - protein, 348 aa, Erwinia carotovora subsp; identical to SEQ ID NO: 1390

SEQ ID NO: 2311 - DNA, 1056 bp, Erwinia carotovora subsp; identical to SEQ ID NO: 1391
  CDS (1)..(1056)

SEQ ID NO: 2312 - protein, 351 aa, Erwinia carotovora subsp; identical to SEQ ID NO: 1392

SEQ ID NO: 2313 - DNA, 1113 bp, Acinetobacter sp; identical to SEQ ID NO: 1393
  CDS (1)..(1113)

SEQ ID NO: 2314 - protein, 370 aa, Acinetobacter sp; identical to SEQ ID NO: 1394

SEQ ID NO: 2315 - DNA, 1056 bp, Acinetobacter sp; identical to SEQ ID NO: 1395
  CDS (1)..(1056)

SEQ ID NO: 2316 - protein, 351 aa, Acinetobacter sp; identical to SEQ ID NO: 1396

SEQ ID NO: 2317 - DNA, 1119 bp, Candida glabrata; identical to SEQ ID NO: 1397
  CDS (1)..(1119)

SEQ ID NO: 2318 - protein, 372 aa, Candida glabrata; identical to SEQ ID NO: 1398

SEQ ID NO: 2319 - DNA, 1071 bp, Candida glabrata; identical to SEQ ID NO: 1399
  CDS (1)..(1071)

SEQ ID NO: 2320 - protein, 356 aa, Candida glabrata; identical to SEQ ID NO: 1400

SEQ ID NO: 2321 - DNA, 1083 bp, Photobacterium profundum; identical to SEQ ID NO: 1401
  CDS (1)..(1083)

SEQ ID NO: 2322 - protein, 360 aa, Photobacterium profundum; identical to SEQ ID NO: 1402

SEQ ID NO: 2323 - DNA, 1053 bp, Photobacterium profundum; identical to SEQ ID NO: 1403
  CDS (1)..(1053)

SEQ ID NO: 2324 - protein, 350 aa, Photobacterium profundum; identical to SEQ ID NO: 1404

SEQ ID NO: 2325 - DNA, 1113 bp, Photobacterium profundum; identical to SEQ ID NO: 1405
  CDS (1)..(1113)

SEQ ID NO: 2326 - protein, 370 aa, Photobacterium profundum; identical to SEQ ID NO: 1406

SEQ ID NO: 2327 - DNA, 1056 bp, Photobacterium profundum; identical to SEQ ID NO: 1407
  CDS (1)..(1056)

SEQ ID NO: 2328 - protein, 351 aa, Photobacterium profundum; identical to SEQ ID NO: 1408

SEQ ID NO: 2329 - DNA, 1092 bp, Parachlamydia sp; identical to SEQ ID NO: 1409
  CDS (1)..(1092)

SEQ ID NO: 2330 - protein, 363 aa, Parachlamydia sp; identical to SEQ ID NO: 1410

SEQ ID NO: 2331 - DNA, 1095 bp, Rhodopseudomonas palustris; identical to SEQ ID NO: 1411
  CDS (1)..(1095)

SEQ ID NO: 2332 - protein, 364 aa, Rhodopseudomonas palustris; identical to SEQ ID NO: 1412

SEQ ID NO: 2333 - DNA, 1100 bp, Amycolatopsis methanolica; identical to SEQ ID NO: 1413
  CDS (1)..(1086)

SEQ ID NO: 2334 - protein, 361 aa, Amycolatopsis methanolica; identical to SEQ ID NO: 1414

SEQ ID NO: 2335 - DNA, 1071 bp, Treponema denticola; identical to SEQ ID NO: 1415
  CDS (1)..(1071)

SEQ ID NO: 2336 - protein, 356 aa, Treponema denticola; identical to SEQ ID NO: 1416

SEQ ID NO: 2337 - DNA, 1068 bp, Geobacter sulfurreducens; identical to SEQ ID NO: 1417
  CDS (1)..(1068)

SEQ ID NO: 2338 - protein, 355 aa, Geobacter sulfurreducens; identical to SEQ ID NO: 1418

SEQ ID NO: 2339 - DNA, 1095 bp, Ashbya gossypii; identical to SEQ ID NO: 1419
  CDS (1)..(1095)

SEQ ID NO: 2340 - protein, 364 aa, Ashbya gossypii; identical to SEQ ID NO: 1420

SEQ ID NO: 2341 - DNA, 1122 bp, Ashbya gossypii; identical to SEQ ID NO: 1421
  CDS (1)..(1122)

SEQ ID NO: 2342 - protein, 373 aa, Ashbya gossypii; identical to SEQ ID NO: 1422

SEQ ID NO: 2343 - DNA, 1098 bp, Amycolatopsis balhimycina; identical to SEQ ID NO: 1423
  CDS (1)..(1098)

SEQ ID NO: 2344 - protein, 365 aa, Amycolatopsis balhimycina; identical to SEQ ID NO: 1424

SEQ ID NO: 2345 - DNA, 1053 bp, Vibrio vulnificus
  CDS (1)..(1053)
atgccactaaaaacagatgaattgagaacccaacctttgggtccaatgccaactcccgctgagttgagccaagcccatccgattaccgacgatgtggccgagcgaattgcgaaatctcgcagacaaattgaagatattttaacgggtaaggacaaccgtcttttggtgattgtcggtccttgctctgtgcacgatactgaagccgcgattgattacgcgacgcgtttaagctcgattcaagagcagtatcgcgatgagctgttcatcgttatgcgtacctactttgaaaaaccacgcactgtggtgggctggaaaggcctcattaccgacccaaatctggatggctcgtatgcgctagaagctggcctgcataaagcacgtaagctattgctcgatatcaacaaacttggccttgccaccgcaaccgagtttcttgacatgatcaccggtcaatatattgctgatttgatcacttggggcgcgattggagctcgaaccactgaatcgcaaattcaccgtgaaatggcgtctgcactctcctgcccggttggctttaaaaacggcaccaacggcaacgtgaaaattgcgattgacgcaattcgcgcatcaaaagcttcgcattacttctactctccagataaaaatggccgcatgaccgtttaccgcaccagtggtaacccatatggacatattattctgcgtggtggtgatacaggccctaactttgacgcaaaatcggttgagtctgcctgtcaatcactggctgagttcgatttgccacaacgtttgatcgttgatttcagtcacgctaactgtgaaaagcaacatcgtaaacagctcgatgtcgcgcaagacatttgtaaccaactaaaagcgggcagcacttatatcgcaggcatcatggcagaaagcttcattaccgaaggcaatcagccgatgactgaccttgataacttgacctacggccaatcgatcactgacccttgcctaagctgggaacacacagcgcaaatgctggacatgcttgcgactgctgtaaaagaaagccgttaa

SEQ ID NO: 2346 - protein, 350 aa, Vibrio vulnificus
MPLKTDELRTQPLGPMPTPAELSQAHPITDDVAERIAKSRRQIEDILTGKDNRLLVIVGPCSVHDTEAAIDYATRLSSIQEQYRDELFIVMRTYFEKPRTVVGWKGLITDPNLDGSYALEAGLHKARKLLLDINKLGLATATEFLDMITGQYIADLITWGAIGARTTESQIHREMASALSCPVGFKNGTNGNVKIAIDAIRASKASHYFYSPDKNGRMTVYRTSGNPYGHIILRGGDTGPNFDAKSVESACQSLAEFDLPQRLIVDFSHANCEKQHRKQLDVAQDICNQLKAGSTYIAGIMAESFITEGNQPMTDLDNLTYGQSITDPCLSWEHTAQMLDMLATAVKESR

SEQ ID NO: 2347 - DNA, 1047 bp, Photorhabdus luminescens; identical to SEQ ID NO: 1427
  CDS (1)..(1047)

SEQ ID NO: 2348 - protein, 348 aa, Photorhabdus luminescens; identical to SEQ ID NO: 1428

SEQ ID NO: 2349 - DNA, 1053 bp, Photorhabdus luminescens; identical to SEQ ID NO: 1429
  CDS (1)..(1053)

SEQ ID NO: 2350 - protein, 350 aa, Photorhabdus luminescens; identical to SEQ ID NO: 1430

SEQ ID NO: 2351 - DNA, 1095 bp, Photorhabdus luminescens; identical to SEQ ID NO: 1431
  CDS (1)..(1095)

SEQ ID NO: 2352 - protein, 364 aa, Photorhabdus luminescens; identical to SEQ ID NO: 1432

SEQ ID NO: 2353 - DNA, 1119 bp, Gloeobacter violaceus; identical to SEQ ID NO: 1433
  CDS (1)..(1119)

SEQ ID NO: 2354 - protein, 372 aa, Gloeobacter violaceus; identical to SEQ ID NO: 1434

SEQ ID NO: 2355 - DNA, 1107 bp, Chromobacterium violaceum; identical to SEQ ID NO: 1435
  CDS (1)..(1107)

SEQ ID NO: 2356 - protein, 368 aa, Chromobacterium violaceum; identical to SEQ ID NO: 1436

SEQ ID NO: 2357 - DNA, 1059 bp, Chromobacterium violaceum; identical to SEQ ID NO: 1437
  CDS (1)..(1059)

SEQ ID NO: 2358 - protein, 352 aa, Chromobacterium violaceum; identical to SEQ ID NO: 1438

SEQ ID NO: 2359 - DNA, 1140 bp, Neurospora crassa; identical to SEQ ID NO: 1439
  CDS (1)..(1140)

SEQ ID NO: 2360 - protein, 379 aa, Neurospora crassa; identical to SEQ ID NO: 1440

SEQ ID NO: 2361 - DNA, 1092 bp, Neurospora crassa; identical to SEQ ID NO: 1441
  CDS (1)..(1092)

SEQ ID NO: 2362 - protein, 363 aa, Neurospora crassa; identical to SEQ ID NO: 1442

SEQ ID NO: 2363 - DNA, 1068 bp, Synechococcus sp; identical to SEQ ID NO: 1443
  CDS (1)..(1068)

SEQ ID NO: 2364 - protein, 355 aa, Synechococcus sp; identical to SEQ ID NO: 1444

SEQ ID NO: 2365 - DNA, 1053 bp, Rhodopirellula baltica; identical to SEQ ID NO: 1445
  CDS (1)..(1053)

SEQ ID NO: 2366 - protein, 350 aa, Rhodopirellula baltica; identical to SEQ ID NO: 1446

SEQ ID NO: 2367 - DNA, 1068 bp, Prochlorococcus marinus subsp; identical to SEQ ID NO: 1447
  CDS (1)..(1068)

SEQ ID NO: 2368 - protein, 355 aa, Prochlorococcus marinus subsp; identical to SEQ ID NO: 1448

SEQ ID NO: 2369 - DNA, 1083 bp, Prochlorococcus marinus; identical to SEQ ID NO: 1449
  CDS (1)..(1083)

SEQ ID NO: 2370 - protein, 360 aa, Prochlorococcus marinus; identical to SEQ ID NO: 1450

SEQ ID NO: 2371 - DNA, 1074 bp, Prochlorococcus marinus; identical to SEQ ID NO: 1451
  CDS (1)..(1074)

SEQ ID NO: 2372 - protein, 357 aa, Prochlorococcus marinus; identical to SEQ ID NO: 1452

SEQ ID NO: 2373 - DNA, 1113 bp, Haemophilus ducreyi; identical to SEQ ID NO: 1453
  CDS (1)..(1113)

SEQ ID NO: 2374 - protein, 370 aa, Haemophilus ducreyi; identical to SEQ ID NO: 1454

SEQ ID NO: 2375 - DNA, 1080 bp, Haemophilus ducreyi; identical to SEQ ID NO: 1455
  CDS (1)..(1080)

SEQ ID NO: 2376 - protein, 359 aa, Haemophilus ducreyi; identical to SEQ ID NO: 1456

SEQ ID NO: 2377 - DNA, 1086 bp, Candidatus Blochmannia floridanus; identical to SEQ ID NO: 1457
  CDS (1)..(1086)

SEQ ID NO: 2378 - protein, 361 aa, Candidatus Blochmannia floridanus; identical to SEQ ID NO: 1458

SEQ ID NO: 2379 - DNA, 1074 bp, Bordetella pertussis
  CDS (1)..(1074)
atgtcgcacaataccgatgaccttcgtatccgtgaaatcaaagagctgaatcctcccgcgcatgtcatgcgcgagtttccgtgctcgaaggatgtttctgaaatcgtctacgccgcccgccagggcatgcatcgcatcctgcatggcatggatgaccgcctgatcgtcgtgatcggcccttgctcgatccacgataccaaggcggcgctcgaatacgcggatcgtctcaagccggtgcgcgaccgcctggccgccgacctcgaggtggtgatgcgcgtctacttcgaaaagccgcgcaccaccgtgggctggaagggcctgatcaacgaccccgacctagatggcagcttcgatatcaacaagggcgtgcgcgtggcgcgcgaactgctgctggacatcaacagccgcggcctgccggcgggttgcgagttcctcgacatgattaccccgcagtacatcgccgacctggtgtcgtggggggcgatcggggcgcggacgaccgaaagccaggttcaccgcgagctggcttccggcctgtcgtgtcctgtcggtttcaagaacggcaccgacggcaatgtgaagatcgccgtcgatgccatcaaggccgcctcgcaaccgcaccatttcctctcggtgaccaagggcgggcattcggccatcgtctcgaccgcgggcaacgaggactgccacgtcatcctgcgcggcggcaaggcgcccaactacgatgccgccagcatcgaagcggcctgccaggacatggccaaggccggcctggcccagcgcatcatgatcgacgccagccacgccaacagcagcaagaaacccgagaatcagccgctggtggtcgatgatgtggccaaccagatcgagcagggcgatgcccgcatcgtgggcctgatgatagaaagccatctgctgggcggccgccaggacctggtgcccgggcaggccttgacgtacgggcagagcatcaccgacggttgcatcgactgggatgcttcggtgcaggtgctggagcgcctggcccatgcggtgcgcgagcgccggcgcgcgtcgctgagcgccggcaagtag

SEQ ID NO: 2380 - protein, 357 aa, Bordetella pertussis; identical to SEQ ID NO: 1460

SEQ ID NO: 2381 - DNA, 1119 bp, Bordetella bronchiseptica; identical to SEQ ID NO: 1461
  CDS (1)..(1119)

SEQ ID NO: 2382 - protein, 372 aa, Bordetella bronchiseptica; identical to SEQ ID NO: 1462

SEQ ID NO: 2383 - DNA, 1179 bp, Nitrosomonas europaea; identical to SEQ ID NO: 1463
  CDS (1)..(1179)

SEQ ID NO: 2384 - protein, 392 aa, Nitrosomonas europaea; identical to SEQ ID NO: 1464

SEQ ID NO: 2385 - DNA, 1083 bp, Coxiella burnetii; identical to SEQ ID NO: 1465
  CDS (1)..(1083)

SEQ ID NO: 2386 - protein, 360 aa, Coxiella burnetii; identical to SEQ ID NO: 1466

SEQ ID NO: 2387 - DNA, 1053 bp, Vibrio parahaemolyticus; identical to SEQ ID NO: 1471
  CDS (1)..(1053)

SEQ ID NO: 2388 - protein, 350 aa, Vibrio parahaemolyticus; identical to SEQ ID NO: 1472

SEQ ID NO: 2389 - DNA, 1053 bp, Vibrio parahaemolyticus; identical to SEQ ID NO: 1473
  CDS (1)..(1053)

SEQ ID NO: 2390 - protein, 350 aa, Vibrio parahaemolyticus; identical to SEQ ID NO: 1474

SEQ ID NO: 2391 - DNA, 1074 bp, Vibrio parahaemolyticus; identical to SEQ ID NO: 1475
  CDS (1)..(1074)

SEQ ID NO: 2392 - protein, 357 aa, Vibrio parahaemolyticus; identical to SEQ ID NO: 1476

SEQ ID NO: 2393 - DNA, 1083 bp, Pseudomonas syringae; identical to SEQ ID NO: 1477
  CDS (1)..(1083)

SEQ ID NO: 2394 - protein, 360 aa, Pseudomonas syringae; identical to SEQ ID NO: 1478

SEQ ID NO: 2395 - DNA, 1077 bp, Pseudomonas syringae; identical to SEQ ID NO: 1479
  CDS (1)..(1077)

SEQ ID NO: 2396 - protein, 358 aa, Pseudomonas syringae; identical to SEQ ID NO: 1480

SEQ ID NO: 2397 - DNA, 1062 bp, Pseudomonas putida; identical to SEQ ID NO: 1481
  CDS (1)..(1062)

SEQ ID NO: 2398 - protein, 353 aa, Pseudomonas putida; identical to SEQ ID NO: 1482

SEQ ID NO: 2399 - DNA, 1113 bp, Pseudomonas putida; identical to SEQ ID NO: 1483
  CDS (1)..(1113)

SEQ ID NO: 2400 - protein, 370 aa, Pseudomonas putida; identical to SEQ ID NO: 1484

SEQ ID NO: 2401 - DNA, 1086 bp, Bradyrhizobium japonicum; identical to SEQ ID NO: 1485
  CDS (1)..(1086)

SEQ ID NO: 2402 - protein, 361 aa, Bradyrhizobium japonicum; identical to SEQ ID NO: 1486

SEQ ID NO: 2403 - DNA, 1053 bp, Yersinia pestis; identical to SEQ ID NO: 1487
  CDS (1)..(1053)

SEQ ID NO: 2404 - protein, 350 aa, Yersinia pestis; identical to SEQ ID NO: 1488

SEQ ID NO: 2405 - DNA, 1038 bp, Wigglesworthia glossinidia brevipalpis; identical to SEQ ID NO: 1491
  CDS (1)..(1038)

SEQ ID NO: 2406 - protein, 345 aa, Wigglesworthia glossinidia brevipalpis; identical to SEQ ID NO: 1492

SEQ ID NO: 2407 - DNA, 1071 bp, Vibrio vulnificus; identical to SEQ ID NO: 1739
  CDS (1)..(1071)

SEQ ID NO: 2408 - protein, 356 aa, Vibrio vulnificus; identical to SEQ ID NO: 1740

SEQ ID NO: 2409 - DNA, 1053 bp, Vibrio vulnificus; identical to SEQ ID NO: 1493
  CDS (1)..(1053)

SEQ ID NO: 2410 - protein, 350 aa, Vibrio vulnificus; identical to SEQ ID NO: 1494

SEQ ID NO: 2411 - DNA, 1071 bp, Vibrio vulnificus; identical to SEQ ID NO: 1497
  CDS (1)..(1071)

SEQ ID NO: 2412 - protein, 356 aa, Vibrio vulnificus; identical to SEQ ID NO: 1498

SEQ ID NO: 2413 - DNA, 1062 bp, Synechococcus elongatus; identical to SEQ ID NO: 1499
  CDS (1)..(1062)

SEQ ID NO: 2414 - protein, 353 aa, Synechococcus elongatus; identical to SEQ ID NO: 1500

SEQ ID NO: 2415 - DNA, 1032 bp, Streptococcus mutans; identical to SEQ ID NO: 1501
  CDS (1)..(1032)

SEQ ID NO: 2416 - protein, 343 aa, Streptococcus mutans; identical to SEQ ID NO: 1502

SEQ ID NO: 2417 - DNA, 1035 bp, Streptococcus mutans; identical to SEQ ID NO: 1503
  CDS (1)..(1035)

SEQ ID NO: 2418 - protein, 344 aa, Streptococcus mutans; identical to SEQ ID NO: 1504

SEQ ID NO: 2419 - DNA, 1008 bp, Streptococcus agalactiae; identical to SEQ ID NO: 1505
  CDS (1)..(1008)

SEQ ID NO: 2420 - protein, 335 aa, Streptococcus agalactiae; identical to SEQ ID NO: 1506

SEQ ID NO: 2421 - DNA, 1065 bp, Shewanella oneidensis; identical to SEQ ID NO: 1507
  CDS (1)..(1065)

SEQ ID NO: 2422 - protein, 354 aa, Shewanella oneidensis; identical to SEQ ID NO: 1508

SEQ ID NO: 2423 - DNA, 1092 bp, Shewanella oneidensis; identical to SEQ ID NO: 1509
  CDS (1)..(1092)

SEQ ID NO: 2424 - protein, 363 aa, Shewanella oneidensis; identical to SEQ ID NO: 1510

SEQ ID NO: 2425 - DNA, 1059 bp, Shewanella oneidensis; identical to SEQ ID NO: 1511
  CDS (1)..(1059)

SEQ ID NO: 2426 - protein, 352 aa, Shewanella oneidensis; identical to SEQ ID NO: 1512

SEQ ID NO: 2427 - DNA, 1170 bp, Corynebacterium efficiens; identical to SEQ ID NO: 1515
  CDS (1)..(1170)

SEQ ID NO: 2428 - protein, 389 aa, Corynebacterium efficiens; identical to SEQ ID NO: 1516

SEQ ID NO: 2429 - DNA, 1134 bp, Bifidobacterium longum; identical to SEQ ID NO: 1517
  CDS (1)..(1134)

SEQ ID NO: 2430 - protein, 377 aa, Bifidobacterium longum; identical to SEQ ID NO: 1518

SEQ ID NO: 2431 - DNA, 1233 bp, Bifidobacterium longum; identical to SEQ ID NO: 1519
  CDS (1)..(1233)

SEQ ID NO: 2432 - protein, 410 aa, Bifidobacterium longum; identical to SEQ ID NO: 1520

SEQ ID NO: 2433 - DNA, 1221 bp, Phytophthora infestans; identical to SEQ ID NO: 1521
  CDS (20)..(1153)

SEQ ID NO: 2434 - protein, 377 aa, Phytophthora infestans; identical to SEQ ID NO: 1522

SEQ ID NO: 2435 - DNA, 1062 bp, Chlorobium tepidum; identical to SEQ ID NO: 1523
  CDS (1)..(1062)

SEQ ID NO: 2436 - protein, 353 aa, Chlorobium tepidum; identical to SEQ ID NO: 1524

SEQ ID NO: 2437 - DNA, 1074 bp, Xanthomonas campestris; identical to SEQ ID NO: 1525
  CDS (1)..(1074)

SEQ ID NO: 2438 - protein, 357 aa, Xanthomonas campestris; identical to SEQ ID NO: 1526

SEQ ID NO: 2439 - DNA, 1074 bp, Xanthomonas axonopodis; identical to SEQ ID NO: 1527
  CDS (1)..(1074)

SEQ ID NO: 2440 - protein, 357 aa, Xanthomonas axonopodis; identical to SEQ ID NO: 1528

SEQ ID NO: 2441 - DNA, 1080 bp, Ralstonia solanacearum; identical to SEQ ID NO: 1529
  CDS (1)..(1080)

SEQ ID NO: 2442 - protein, 359 aa, Ralstonia solanacearum; identical to SEQ ID NO: 1530

SEQ ID NO: 2443 - DNA, 1179 bp, Ralstonia solanacearum; identical to SEQ ID NO: 1531
  CDS (1)..(1179)

SEQ ID NO: 2444 - protein, 392 aa, Ralstonia solanacearum; identical to SEQ ID NO: 1532

SEQ ID NO: 2445 - DNA, 1065 bp, Synechococcus sp; identical to SEQ ID NO: 1533
  CDS (1)..(1065)

SEQ ID NO: 2446 - protein, 354 aa, Synechococcus sp; identical to SEQ ID NO: 1534

SEQ ID NO: 2447 - DNA, 1035 bp, Escherichia coli; identical to SEQ ID NO: 1535
  CDS (1)..(1035)

SEQ ID NO: 2448 - protein, 344 aa, Escherichia coli; identical to SEQ ID NO: 1536

SEQ ID NO: 2449 - DNA, 1200 bp, Stigmatella aurantiaca; identical to SEQ ID NO: 1537
  CDS (62)..(1147)

SEQ ID NO: 2450 - protein, 361 aa, Stigmatella aurantiaca; identical to SEQ ID NO: 1538

SEQ ID NO: 2451 - DNA, 1083 bp, Amycolatopsis mediterranei; identical to SEQ ID NO: 1541
  CDS (1)..(1083)

SEQ ID NO: 2452 - protein, 360 aa, Amycolatopsis mediterranei; identical to SEQ ID NO: 1542

SEQ ID NO: 2453 - DNA, 1053 bp, Pasteurella multocida; identical to SEQ ID NO: 1543
  CDS (1)..(1053)

SEQ ID NO: 2454 - protein, 350 aa, Pasteurella multocida; identical to SEQ ID NO: 1544

SEQ ID NO: 2455 - DNA, 1086 bp, Pasteurella multocida; identical to SEQ ID NO: 1545
  CDS (1)..(1086)

SEQ ID NO: 2456 - protein, 361 aa, Pasteurella multocida; identical to SEQ ID NO: 1546

SEQ ID NO: 2457 - DNA, 1125 bp, Emericella nidulans; identical to SEQ ID NO: 1547
  CDS (1)..(1125)

SEQ ID NO: 2458 - protein, 374 aa, Emericella nidulans; identical to SEQ ID NO: 1548

SEQ ID NO: 2459 - DNA, 1089 bp, Emericella nidulans; identical to SEQ ID NO: 1549
  CDS (1)..(1089)

SEQ ID NO: 2460 - protein, 362 aa, Emericella nidulans; identical to SEQ ID NO: 1550

SEQ ID NO: 2461 - DNA, 1239 bp, Vibrio cholerae; identical to SEQ ID NO: 1551
  CDS (114)..(1175)

SEQ ID NO: 2462 - protein, 353 aa, Vibrio cholerae; identical to SEQ ID NO: 1552

SEQ ID NO: 2463 - DNA, 2184 bp, Candida albicans; identical to SEQ ID NO: 1553
  CDS (461)..(1573)

SEQ ID NO: 2464 - protein, 370 aa, Candida albicans; identical to SEQ ID NO: 1554

SEQ ID NO: 2465 - DNA, 1047 bp, Buchnera aphidicola; identical to SEQ ID NO: 1555
  CDS (1)..(1047)

SEQ ID NO: 2466 - protein, 348 aa, Buchnera aphidicola; identical to SEQ ID NO: 1556

SEQ ID NO: 2467 - DNA, 1047 bp, Buchnera aphidicola; identical to SEQ ID NO: 1557
  CDS (1)..(1047)

SEQ ID NO: 2468 - protein, 348 aa, Buchnera aphidicola; identical to SEQ ID NO: 1558

SEQ ID NO: 2469 - DNA, 1047 bp, Erwinia herbicola; identical to SEQ ID NO: 1559
  CDS (1)..(1047)

SEQ ID NO: 2470 - protein, 348 aa, Erwinia herbicola; identical to SEQ ID NO: 1560

SEQ ID NO: 2471 - DNA, 1047 bp, Salmonella typhimurium; identical to SEQ ID NO: 1561
  CDS (1)..(1047)

SEQ ID NO: 2472 - protein, 348 aa, Salmonella typhimurium; identical to SEQ ID NO: 1562

SEQ ID NO: 2473 - DNA, 1047 bp, Shigella flexneri
  CDS (1)..(1047)
atgaacagaactgacgaactccgtactgcgcgtattgagagcctggtaacgcccgccgaactcgcgctacggtatcccgtaacgcctggcgtcgccacccatgtcaccgactcccgccgcagaattgaaaaaatactgaatggtgaagataagcgactgttggtcattattggcccctgctcgatccacgatctcaccgctgcaatggagtacgccacccgtctgcagtcgctgcgcaaccagtaccagtcacggctggaaatcgtaatgcgcacctattttgaaaaaccacgaactgttgtcggctggaaagggctaatctccgatccggatttaaacggcagctatcgggtaaatcacggtctggagctggcgcgcaaattacttttacaggtaaatgagctgggtgtccctaccgcgactgagttcctcgatatggtaaccggtcagtttattgctgatttaatcagttggggcgcgattggcgctcgtactaccgaaagtcagatccaccgcgaaatggcttcagcactctcctgtccggtaggttttaaaaatggtaccgatggcaacacgcggattgccgtggatgctatccgcgcagcccgcgccagccatatgttcctctcgccagacaaaaatggtcagatgaccatctatcagaccagcggcaacccgtatggccacattattatgcgtggcggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggagattgctggaattatggcggaaagtttcctgcgcgaaggaacgcaaaaaatcgtcggcggtcagccgctcacttacggtcaatccattaccgacccgtgtctgggctgggaagataccgaacgcctggtcgaaaaactcgcctttgcggtagatacccgcttctga

SEQ ID NO: 2474 - protein, 348 aa, Shigella flexneri
MNRTDELRTARIESLVTPAELALRYPVTPGVATHVTDSRRRIEKILNGEDKRLLVIIGPCSIHDLTAAMEYATRLQSLRNQYQSRLEIVMRTYFEKPRTVVGWKGLISDPDLNGSYRVNHGLELARKLLLQVNELGVPTATEFLDMVTGQFIADLISWGAIGARTTESQIHREMASALSCPVGFKNGTDGNTRIAVDAIRAARASHMFLSPDKNGQMTIYQTSGNPYGHIIMRGGKKPNYHADDIAAACDTLHEFDLPEHLVVDFSHGNCQKQHRRQLEVCEDICQQIRNGSTEIAGIMAESFLREGTQKIVGGQPLTYGQSITDPCLGWEDTERLVEKLAFAVDTRF

SEQ ID NO: 2475 - DNA, 25 bp, artificial sequence
  primer
atgttcattaaaaacgatcacgccg

SEQ ID NO: 2476 - DNA, 25 bp, artificial sequence
  primer
ctattttttcaaggcctttcttctg

SEQ ID NO: 2477 - DNA, 2772 bp, Saccharomyces cerevisiae
  CDS (1)..(2772)
atgtcaagcggcagtactattgtttcgtctgacaagtcggggcgaacatttaagcatgaggaagaactacccaagttaccattacctaaactctgtgacactttgcagcgtctgaaggagagtttagagccattgtattatgctgatggttactatcaacatcctttagatccagaacaaattgagaagctgtcatccataataagagattttgaagagaatcccgtaagtgagaagctgcaatctaaactacagagctaccatgacactagggattgctaccttgatgaattacacttagacatcaataaccagacctccactagggagattcaggacgatgtcctacccaggaatcccttcttggttctcgcagatgacgctttgccaaacatcactcaagctgataggtcagccgtcctagtgcactctgcggccaggtttatttctgctttgaaacaagatttgttgccaccagatatcaatgccaccaatggcaaaccactgtcaatggctccatttctgaacttgttcggtactactcgtagtcctgtttttcagcgcggtgaggttgaaaattttgatttgaacaaaccttacacagcatctgatttagaagaccctgattattcaagcgatgaggacgataacgacgaacccacccaaaaagactttgatgaccgtaaaagaaaacacgaagaagacatattcactggcaatggtataactataaaaagacatccggatagcaaacacatcttgatcatctccaggggccaatactatacactggaagtacttgattcgacgaataaaattatatacactgctgcagaattaaccacaattttcaaccatataataaaagattcttctggcattgaaaaatcaactgcgttaggtagtttgacctctcactcttttagaaactggaaatatgcaaggaagagactacagaaaaggtatcctaatgaattacatcgcatagactctgctctgttcgtgttagtgctggacgaatcacaagaagaaactaccaatgatggcgatgataccgctgatatcagtcaaatgtttaacaggactatcactgagcgagacaagaaatgtacttccgccaattgtaagagagtgttttacggtacttctataataaatagcaaaggccatcaagtgggttcatgtgtttctcgttggtatgataaattacagttagttgtcactgcagatgcaaaagccacagtgatttgggattccttcacatgtgacgggtcagtcgtgcttcggtttacttctgaaatttatacagaatcagtcttgagattagctagagacgttaacgccggtgacccacagttttcactctggcctaacgtgacacaaatggatcctgaaactaaaaaactgatgacggcgaccataagtgccgacggcggaggcccttctgaaattgaccctaagttggttgtaaataaaatcgattggtctttcagtaacatcctgaacacacatgtccatttgtcagaaaccaaactagctgatctgatttccaagtatgatattgttcgcgcttctattccattgggcagaaggtcagctcaaagattaggagtcaagcccgattcgatggttcaagtagctttacaaatagctcactatgctttgtatggaagaatggtgtttggattagaaccagtatccacacgtggtttcaaaaactcgagatcatcttttattaacattcaaagtcaagcgctgttggaactatgtcaattgtttatttctagctccattgatgggacagataaattagacaaatttatccaaacctgcgaaacacataataacatggttaaacatgcaaagtctggggtaggttatgaaaaacacttcaatgcattgaaatatctcttcaaatttcatgaccattttggtatccacttaagtggtgatgaatcatctgctgcgaaagatcttttcgaaaatccacttgttttacctttctcacagcctgagttgattgttgccaactgtggtaatgctgctaccacgacatttggtataactcctgctgtacctcatggctttggaatagggtacatcattaaagatgatcaagtagatttgaccgtgacatcgcaatttcgacagggtgacaggttaatgtttatgttaagttgggtgttaggcgaaattcgttcctactggaggatgtcacgcggcacttctcataataaaactggcgtgaagatcagtccagtggtcgataaattgtatgaaatggacaatgcagtcaataatcctccgaaacgtaacggccatacagtcaatggctcccgcaaaacatcttcttcatcacaggtaaatttgaacaggtatggcgggtttttcgatttggaaggccacattgacagtaggaatatatctaaaacaccatcgatgaagaatttgcagaaaaccttcaatggcttgaccatgagcgcagacaatgatcattcaagttccgcagtttccgttcccacagaaaaggaaaaattaaatacaggccatgaaattttacagatccaaccgcgggaagtggcaagtaatgggttggaagcagatgatgagacagatattgaaatagttgctggcaatgctgatggcacatcctcttcggcatcttcagctacatctctaaattccaagaaacgtaacgtcatcaactcaagattcgatattgattttgaccgcagtcgtgtgggtagaaaggtggcgaccttagatcaataa

SEQ ID NO: 2478 - protein, 923 aa, Saccharomyces cerevisiae
MSSGSTIVSSDKSGRTFKHEEELPKLPLPKLCDTLQRLKESLEPLYYADGYYQHPLDPEQIEKLSSIIRDFEENPVSEKLQSKLQSYHDTRDCYLDELHLDINNQTSTREIQDDVLPRNPFLVLADDALPNITQADRSAVLVHSAARFISALKQDLLPPDINATNGKPLSMAPFLNLFGTTRSPVFQRGEVENFDLNKPYTASDLEDPDYSSDEDDNDEPTQKDFDDRKRKHEEDIFTGNGITIKRHPDSKHILIISRGQYYTLEVLDSTNKIIYTAAELTTIFNHIIKDSSGIEKSTALGSLTSHSFRNWKYARKRLQKRYPNELHRIDSALFVLVLDESQEETTNDGDDTADISQMFNRTITERDKKCTSANCKRVFYGTSIINSKGHQVGSCVSRWYDKLQLVVTADAKATVIWDSFTCDGSVVLRFTSEIYTESVLRLARDVNAGDPQFSLWPNVTQMDPETKKLMTATISADGGGPSEIDPKLVVNKIDWSFSNILNTHVHLSETKLADLISKYDIVRASIPLGRRSAQRLGVKPDSMVQVALQIAHYALYGRMVFGLEPVSTRGFKNSRSSFINIQSQALLELCQLFISSSIDGTDKLDKFIQTCETHNNMVKHAKSGVGYEKHFNALKYLFKFHDHFGIHLSGDESSAAKDLFENPLVLPFSQPELIVANCGNAATTTFGITPAVPHGFGIGYIIKDDQVDLTVTSQFRQGDRLMFMLSWVLGEIRSYWRMSRGTSHNKTGVKISPVVDKLYEMDNAVNNPPKRNGHTVNGSRKTSSSSQVNLNRYGGFFDLEGHIDSRNISKTPSMKNLQKTFNGLTMSADNDHSSSAVSVPTEKEKLNTGHEILQIQPREVASNGLEADDETDIEIVAGNADGTSSSASSATSLNSKKRNVINSRFDIDFDRSRVGRKVATLDQ

SEQ ID NO: 2479 - DNA, 2296 bp, Rattus norvegicus (Norway rat)
  CDS (63)..(2039)
cctgcttgctcaggaactccctcagccgccgcgttctctagccgccgttgctgcccgggacgatgatgccgcgcctgctgtttcgtgcctggccccgctgcccctcgcttgtcctgggagcccctagtaggcccttaagtgctgtctcggggccggacgattatctgcagcacagcatcgtgcccaccatgcactaccaggacagcctgcccaggctgcctatccctaaacttgaagacaccatgaagagatacctcaatgcacagaagcctctcttggatgacagccagttcaggagaacagaagcgttgtgtaagaattttgagactggcgttgggaaggagctgcatgcccacctgcttgctcaggataagcagaataagcacaccagctacatctcaggcccctggttcgatatgtatttaactgctcgagactctatcgttttaaactttaatccatttatggcattcaatccggacccaaagtctgagtataatgaccagcttaccagggcaaccaacttgactgtttctgcagtccggtttctgaagacacttcaggctggccttttagaaccagaagtgttccacttgaacccttccaaaagtgacacagacgccttcaaaagactcattcgctttgttcctccctctctgtcctggtatggagcctacctggtcaacgcatatcccctggatatgtcccagtatttccggcttttcaattcaactcgtatacccagacccaatcgtgatgaactctttactgacaccaaggctagacacctcctggtcctaagaaaaggacatttctatgtctttgatgtcctcgatcaagatgggaacattgtgaatcccttagagattcaggcacatctaaagtacattctctcagacagcagccctgtgcccgagtttcctgtggcatatctgaccagtgagaaccgagatgtctgggcagagctcagacagaagttgatttttgatggcaatgaggaaaccctgaagaaagtggactctgctgtcttctgcctctgcctagatgacttcccgatgaaggatcttattcacttgtcacacaccatgctgcacggcgatggcacaaaccgctggtttgataagtcctttaacctcattgtagccgaggacggcactgctgcagtccacttcgagcactcgtggggggatggggtggcagtgcttaggtttttcaatgaagtgttcagagacagcactcagacccctgccatcactccccagagccagcctgccgccaccaactcctctgcgtctgtggagacgctcagcttcaacctcagcggtgctctcaaggctggcatcactgctgccaaggagaagttcgacaccacggtgaaaaccctcagcattgactccattcagttccagagaggtggcaaggagttcctgaagaagaagcagctgagccccgatgcggtggcccagctggccttccagatggccttcctgagacagtatggccagacggtggctacctatgagtcctgcagcactgcagccttcaagcacggccgcacagagactatccgcccagcctccatctttactaagagatgctccgaggcgtttgtcagggacccctccaagcacagtgtgggcgagcttcagcacatgatggctgagtgttccaaataccatggccagctgaccaaagaagcagcgatgggccagggctttgaccgacacttgtatgctctgcgctatctggcaacggccagaggactcaacctacctgagctctatctggatcctgcataccagcagatgaaccacaacatcctgtccaccagcactctgaacagcccagcagtgagccttgggggctttgcccctgtggtccctgatggctttggcattgcatatgctgttcacgatgactggataggctgcaatgtctcctcctactcaggacgcaatgcccgagagtttctccactgtgtccagaagtgcttggaagacattttcgatgctctagaaggcaaagccatcaaaacttagcttcctagtcgctgaaaagcctccattcttcctcatgaacatggatgttcatgtagctggaaggtgccatcttgtgcccaacaaaactaatcccaaggtgcttccacagccagtgctgcaggctgagctggaagagcccaactgaaggtagtgagaggtcgcagctgtaaagccctctttgttcaggagatagggtttggaaaactaactcagctgtatttattgtttaaatagaaataaaacctggtgttgcttag

SEQ ID NO: 2480 - protein, 658 aa, Rattus norvegicus (Norway rat)
MMPRLLFRAWPRCPSLVLGAPSRPLSAVSGPDDYLQHSIVPTMHYQDSLPRLPIPKLEDTMKRYLNAQKPLLDDSQFRRTEALCKNFETGVGKELHAHLLAQDKQNKHTSYISGPWFDMYLTARDSIVLNFNPFMAFNPDPKSEYNDQLTRATNLTVSAVRFLKTLQAGLLEPEVFHLNPSKSDTDAFKRLIRFVPPSLSWYGAYLVNAYPLDMSQYFRLFNSTRIPRPNRDELFTDTKARHLLVLRKGHFYVFDVLDQDGNIVNPLEIQAHLKYILSDSSPVPEFPVAYLTSENRDVWAELRQKLIFDGNEETLKKVDSAVFCLCLDDFPMKDLIHLSHTMLHGDGTNRWFDKSFNLIVAEDGTAAVHFEHSWGDGVAVLRFFNEVFRDSTQTPAITPQSQPAATNSSASVETLSFNLSGALKAGITAAKEKFDTTVKTLSIDSIQFQRGGKEFLKKKQLSPDAVAQLAFQMAFLRQYGQTVATYESCSTAAFKHGRTETIRPASIFTKRCSEAFVRDPSKHSVGELQHMMAECSKYHGQLTKEAAMGQGFDRHLYALRYLATARGLNLPELYLDPAYQQMNHNILSTSTLNSPAVSLGGFAPVVPDGFGIAYAVHDDWIGCNVSSYSGRNAREFLHCVQKCLEDIFDALEGKAIKT

SEQ ID NO: 2481 - DNA, 2255 bp, Homo sapiens (man)
  CDS (102)..(2078)
cctgacgcagtgtcttgggcgctaacggcggcggcggccttgtgtttagactccagaactccccacttgccgcgttctcgccgccgcaggctcccgggacgatggtgccccgcctgctgctgcgcgcctggccccggggccccgcggttggtccgggagcccccagtcggcccctcagcgccggctccgggcccggccagtacctgcagcgcagcatcgtgcccaccatgcactaccaggacagcctgcccaggctgcctattcccaaacttgaagacaccattaggagatacctcagtgcacagaagcctctcttgaatgatggccagttcaggaaaacagaacaattttgcaagagttttgaaaatgggattggaaaagaactgcatgagcagctggttgctctggacaaacagaataaacatacaagctacatttcgggaccctggtttgatatgtacctatctgctcgagactccgttgttctgaactttaatccatttatggctttcaatcctgacccaaaatctgagtataatgaccagctcacccgggcaaccaacatgactgtttctgccatccggtttctgaagacactccgggctggccttctggagccagaagtgttccacttgaaccctgcaaaaagtgacactatcaccttcaagagactcatacgctttgtgccttcctctctgtcctggtatggggcctacctggtcaatgcgtatcccctggatatgtcccagtattttcggcttttcaactcaactcgtttacccaaacccagtcgggatgaactcttcactgatgacaaggccagacacctcctggtcctaaggaaaggaaatttttatatctttgatgtcctggatcaagatgggaacattgtgagcccctcggaaatccaggcacatctgaagtacattctctcagacagcagccccgcccccgagtttcccctggcatacctgaccagtgagaaccgagacatctgggcagagctcaggcagaagctgatgagtagtggcaatgaggagagcctgaggaaagtggactcggcagtgttctgtctctgcctagatgacttccccattaaggaccttgtccacttgtcccacaatatgctgcatggggatggcacaaaccgctggtttgataaatcctttaacctcattatcgccaaggatggctctactgccgtccactttgagcactcttggggtgatggtgtggcagtgctcagattttttaatgaagtatttaaagacagcactcagacccctgccgtcactccacagagccagccagctaccactgactctactgtcacggtgcagaaactcaacttcgagctgactgatgccttaaagactggcatcacagctgctaaggaaaagtttgatgccaccatgaaaaccctcactattgactgcgtccagtttcagagaggaggcaaagaattcctgaagaagcaaaagctgagccctgacgcagttgcccagctggcattccagatggccttcctgcggcagtacgggcagacagtggccacctacgagtcctgtagcactgccgcattcaagcacggccgcactgagaccatccgcccggcctccgtctatacaaagaggtgctctgaggcctttgtcagggagccctccaggcacagtgctggtgagcttcagcagatgatggttgagtgctccaagtaccatggccagctgaccaaagaagcagcaatgggccagggctttgaccgacacttgtttgctctgcggcatctggcagcagccaaagggatcatcttgcctgagctctacctggaccctgcatacgggcagataaaccacaatgtcctgtccacgagcacactgagcagcccagcagtgaaccttgggggctttgcccctgtggtctctgatggctttggtgttgggtatgctgttcatgacaactggataggctgcaatgtctcttcctacccaggccgcaatgcccgggagtttctccaatgtgtggagaaggccttagaagacatgtttgatgccttagaaggcaaatccatcaaaagttaacttctgggcagatgaaaagctaccatcacttcctcatcatgaaaactgggaggccgggcatggtgctcatgcctgtaatcccagcattttgagaggctgaggcgggtggatcacttgaggtcaggagtttgagaccaacctggccaacatggtgaaaccttgtctctactaaaaatg

SEQ ID NO: 2482 - protein, 658 aa, Homo sapiens (man)
MVPRLLLRAWPRGPAVGPGAPSRPLSAGSGPGQYLQRSIVPTMHYQDSLPRLPIPKLEDTIRRYLSAQKPLLNDGQFRKTEQFCKSFENGIGKELHEQLVALDKQNKHTSYISGPWFDMYLSARDSVVLNFNPFMAFNPDPKSEYNDQLTRATNMTVSAIRFLKTLRAGLLEPEVFHLNPAKSDTITFKRLIRFVPSSLSWYGAYLVNAYPLDMSQYFRLFNSTRLPKPSRDELFTDDKARHLLVLRKGNFYIFDVLDQDGNIVSPSEIQAHLKYILSDSSPAPEFPLAYLTSENRDIWAELRQKLMSSGNEESLRKVDSAVFCLCLDDFPIKDLVHLSHNMLHGDGTNRWFDKSFNLIIAKDGSTAVHFEHSWGDGVAVLRFFNEVFKDSTQTPAVTPQSQPATTDSTVTVQKLNFELTDALKTGITAAKEKFDATMKTLTIDCVQFQRGGKEFLKKQKLSPDAVAQLAFQMAFLRQYGQTVATYESCSTAAFKHGRTETIRPASVYTKRCSEAFVREPSRHSAGELQQMMVECSKYHGQLTKEAAMGQGFDRHLFALRHLAAAKGIILPELYLDPAYGQINHNVLSTSTLSSPAVNLGGFAPVVSDGFGVGYAVHDNWIGCNVSSYPGRNAREFLQCVEKALEDMFDALEGKSIKS

SEQ ID NO: 2483 - DNA, 4377 bp, Rattus norvegicus (Norway rat)
  CDS (103)..(2424)
agtcggtcgactccgagctcagtgaggacctaaagcagaggactgtggtgcggaggacagtgcttgctccggggagtgcagagcaataggtccccactcaagatggcagaggctcaccaagctgtggccttccagttcaccgtcacccccgatggcattgacctccgcctgagccacgaagccctcaaacagatctgcctgtcggggctgcactcctggaagaagaagttcatccggttcaagaatggcatcatcactggtgtgttccccgcgaatccgtccagctggcttatcgtggtggtgggtgtgatttcatccatgcatgccaaagtggacccctccctgggcatgatcgcaaagatcagtcggaccctagacaccactggccgcatgtcaagccagacgaagaacattgtgagcggcgtcctctttggtacagggctctgggtggcagtcatcatgaccatgcgctactcgctgaaggtgctgctctcctaccacggctggatgtttgcagaacacggcaaaatgagccgcagcaccaagatctggatggctatggtcaaggtcctctcaggtcggaagcccatgttgtacagcttccagacgtctctgccacgcctgcctgtcccagctgtcaaagatactgtgagcaggtacctggaatctgtaaggccactgatgaaggaagaagacttccagcgcatgacagcactggcccaggattttgctgtcaacctcggacccaaattgcagtggtatttgaagctaaaatcctggtgggccacaaattacgtgagtgactggtgggaagaatatatctacctgcggggccgagggccgctcatggtcaacagcaactactacgccatggagatgctgtacatcaccccaacccatatccaggcagcgagagctggcaacaccatccacgccatactgctgtatcgtcgcacattagaccgtgaggaactcaaacccattcgtcttctgggatccaccattccactctgctcagcccagtgggagcgactcttcaatacttcccggatccctggggaggagacagacaccatccaacatatcaaggacagcaggcacattgttgtgtaccacagagggcggtacttcaaggtctggctctaccacgatgggaggctgctgaggccccgagagctggagcagcagatgcagcagatcctggatgatccctcagagccacagcctggggaggccaagctggccgccctcactgctgcagacagagtgccctgggcaaagtgtcggcagacctattttgcacgagggaaaaataagcagtccctggatgcggtggaaaaggcagcgttcttcgtgacgttggacgaatcggagcagggatacagagaggaggatcctgaggcatccatcgacagctacgccaaatccctgctgcatggaagatgctttgacaggtggtttgacaagtccatcacctttgttgtcttcaaaaacagcaagataggcataaatgcagagcactcctgggcggacgcgcccatcgtgggccatttgtgggagtatgtcatggccaccgacgtcttccagctgggttactcagaggatggacactgtaaaggagacaccaaccccaacatccctaagcccacaaggctacaatgggacattccaggagagtgccaggaggtcatagatgcatccctgagcagcgccagtcttttggcaaatgatgtggacctgcattccttcccatttgactctttcggcaaaggcttgatcaagaagtgccggacgagtcccgatgccttcatccagctggcgctgcagctcgcacattacaaggacatgggcaagttctgcctcacatatgaggcctccatgacccggctcttccgagaagggaggacagagactgtacgctcctgcactatggagtcctgcaactttgtgcaggccatgatggaccccaagtcaacggcagagcagaggctcaagctgttcaagatagcttgtgagaagcaccagcacctgtaccgcctcgccatgacgggcgccggcatcgaccgccatctcttctgcctctatgtggtgtccaagtatcttgcagtcgactcacctttcctgaaggaggtattgtctgagccatggaggttgtctacgagccagactcctcagcagcaggtggagctctttgactttgagaaaaaccctgactatgtgtcctgtggagggggctttgggccggttgccgatgacggctatggtgtctcctacattatagtgggagagaatttcatccacttccatatttcttccaagttctctagccctgagacagactcacaccgctttgggaagcacttgagacaagccatgatggacattatcaccttgtttggcctcaccatcaattctaaaaagtaaacccctgagccacacggaaggaaaacggaccctcgtgatacaaaccaaatgaatagatgttgctcctgaccataggacaggcagaaaattgctcttataaaactcagttttccttccagaaggtttaccgtcagtctccctagaacaacagtaggcttcacgtgtgaattgtgaccctactacatccagagatgccttggctccaggaatattgggcacagtcccctgatgtcttttgaatcggctcctactggataaagggatttaaatgctggtgaattcctggattctgggggttgtttcttcacatgtgttggaggtgacagacttcctcagtggtgaccctgtgaatacttgggcgtctgactccacccaggcagtgtgagcatcaccttgtggaaagagaaagtgtcttcagagccagcagaggcaacagctgtagctaacacatctgtaacacactaatggaatggttaggcctggggattaaggttctgctatgagtgacagccactgtccctttggaagttcacatttccaggaagcagagtaccacctccccagtgccaccttcctcacacatcttcaaaacccagtgccttaaagaaggggcccattggcaagcgggaccatagagaagacttagcatctgtgaagcctttgggtggatatgtgaggatgctgcttccccttactggttcctgcataaagatgtccctaagtaagcacttcccccacccctagaaaatgaggtccttggtgaaggcagggatgctggagtctcattgcctgccagttccattaagccacaaaatagcagacatgtgtccacagagggaggggcttggtagtcaaaggctgcatagctggacaacagcgggagagtgtggcttgctgtatttgacagctgttggcaagaggagtgagaccctggtcaccaagtcagacatactgacacaggcagccaaagctcacggagccaggagatatagatagatactggcttgtattctggcagatacacccctgggcttatcttctaatcccacccagtcagattccaaccagagtcaaattccatagaaggctaggtcattttggcgacagactcagggatctcaagtaatgggtgcttttacccacatgccatccctcagtgggagtgcctttcttgaaagcatccaatgggctaaagcagctctaccaagtctgtttggtatttaatgtaaacattagcattaatggagtggtctctcctacctgtcaccatcctgtcctgacaagcttagctctccgaggtttacatcatgtatttattttccagtgcccctttggccttgtttgattcctgcccctgtgccagaagtggcccagaagtgaggggtggggtgaccagcagtgcagagaggtgctggctgaacagttcatgtgtgtcttatgggtatacatgtataaattttgtaatgtaaaaaaaaaaatcatacctaaaagggccaaagttttttttttttttactaaaaccaagaaaacaaaagacaacataaagacataagcagaaacaaactgttgtaagtcagagcggcctgactctcgctgctgtgaccactcaccaacctgtgttactcagagtagcccggctagtgcccgagtgggacattcctctctcaggtttccagtgtccttgctgctcctgagcagttaccaatgcaatttcgcattccttacaaggcagaagagtgggctctcactgtatgtgttcaaaggaggaggtaagactattgtgtatttaatttaatgtggaacaaaatatagtcttaccgcagccaaggttcaaatttggtgttctaatctgtccattgcatgtaaataccatatctgtttggatataaatcttagaagtgcatgtgtgagcgaatgtagctggccattaataaaacattaatactgtctact

SEQ ID NO: 2484 - protein, 773 aa, Rattus norvegicus (Norway rat)
MAEAHQAVAFQFTVTPDGIDLRLSHEALKQICLSGLHSWKKKFIRFKNGIITGVFPANPSSWLIVVVGVISSMHAKVDPSLGMIAKISRTLDTTGRMSSQTKNIVSGVLFGTGLWVAVIMTMRYSLKVLLSYHGWMFAEHGKMSRSTKIWMAMVKVLSGRKPMLYSFQTSLPRLPVPAVKDTVSRYLESVRPLMKEEDFQRMTALAQDFAVNLGPKLQWYLKLKSWWATNYVSDWWEEYIYLRGRGPLMVNSNYYAMEMLYITPTHIQAARAGNTIHAILLYRRTLDREELKPIRLLGSTIPLCSAQWERLFNTSRIPGEETDTIQHIKDSRHIVVYHRGRYFKVWLYHDGRLLRPRELEQQMQQILDDPSEPQPGEAKLAALTAADRVPWAKCRQTYFARGKNKQSLDAVEKAAFFVTLDESEQGYREEDPEASIDSYAKSLLHGRCFDRWFDKSITFVVFKNSKIGINAEHSWADAPIVGHLWEYVMATDVFQLGYSEDGHCKGDTNPNIPKPTRLQWDIPGECQEVIDASLSSASLLANDVDLHSFPFDSFGKGLIKKCRTSPDAFIQLALQLAHYKDMGKFCLTYEASMTRLFREGRTETVRSCTMESCNFVQAMMDPKSTAEQRLKLFKIACEKHQHLYRLAMTGAGIDRHLFCLYVVSKYLAVDSPFLKEVLSEPWRLSTSQTPQQQVELFDFEKNPDYVSCGGGFGPVADDGYGVSYIIVGENFIHFHISSKFSSPETDSHRFGKHLRQAMMDIITLFGLTINSKK

SEQ ID NO: 2485 - DNA, 2300 bp, Mus musculus (house mouse)
  CDS (69)..(2045)
cagcggcctgcttgctcgggaactccctcagccaccgcgtcctcaagccgccattgccgcccgggacgatgatgccgcgcctgctgttgcgtgactggccccggtgcccctcgcttgtcctgggagcccctagtcggcccttaagtgctgtctcggggcccgccgagtatctgcagcacagcatcgtacccaccatgcactaccaggacagcctgcccaggctgcctatccctaaacttgaagacaccatgaagagatacctcagtgcacagaagcctctcttgaatgacagccagttcaggaagacagaagtgttgtgtaaggattttgagaacggcattgggaaggagctgcatgcgcacctgctcgctcaggataaacagaataagcacaccagctacatctcaggcccctggtttgatatgtatttaactgctcgagactctgtcgttttaaactttaatccattcatggcattcaatccggacccgaagtctgagtataatgaccagctcaccagggccaccaacttgactgtttctgcagtgcggtttctgaagacacttcgggctggccttctagagccagaagtgttccacttgaaccctgccagaagtgacacagatgccttcaaaagactcatccgctttgttccttcctctctctcctggtatggagcctacctggtcaatgcatatcccctggatatgtcccaatattttcggcttttcaattcaactcgtatacccaaacccagtcgtgatgaactctttactgataccaaggctagacacctcctggtcctaagaaaaggacatttctatgtctttgatgtcctcgatcaagatgggaacattgtgaatccctcagaaatccaggcacatctaaagtacattctctcagacagcagccctgtgcccgagtttcccctggcttatttgaccagtgagaaccgagatgtctgggcagagctcagacagaagttgattcatggtggcaatgaggaaaccctgaggaaagtggactctgctgtcttctgcctctgcttagatgacttcccgatgaaggatcttgttcacttgtcacacaccatgctgcacggtgacggcacgaaccgctggtttgataagtcctttaacctcattgtagccaaagatggcactgctgcagtccacttcgagcatgcgtggggggatggtgtagcagtccttaggtttttcaatgaagtgttcagagacagcactcagacccctgccattgctccccagagccagccggccgccaccgactcctccgtgtctgtgcagaagctcagttttaagctcagcagtgctctaaaggctggcgtcaccgctgctaaggagaagtttgatgccaccatgaaaaccctcaccattgacgccattcagtttcagagaggtggcaaggaattcttgaagaagaagaagctgagccctgatgcagtggcccagctggccttccagatggctttcctgcgacagtatggccagacagtggctacctatgaatcctgcagcactgcagccttcaaacacggccgcacagagactatctgcccagcttccatctttactaagagatgctccgaggcatttgtcagggagccctccaagcacagtgtgggcgagcttcagcatatgatggctgagtgctccaaataccatggccagctgaccaaagaagcagcgatgggccagggctttgaccgacacttgtttgctctacggtatctggcagcagccagaggggtcaccctgcctgagctctatcaggaccctgcataccagcggataaaccacaacatcctgtccaccagcactctgagcagcccagcagtgagcctcggtggctttgcccctgtggtccctgatggctttggcattgcgtatgctgttcacgatgactggataggctgcaatgtctcctcctactcaggacgcaatgcccgagagtttctccactgtgtccagaagtgcttggaagacatgttcgatgccctcgaaggcaaagccatcaaaacttagcttcttggtcgatgaaaagcctccattcttcctcatgaacattggtgttcatgtagctggaaggtaccatcttgtcaacaaaactagttcctggtgcttgagcagccagtgctgcaggtgtgagcggaagatcccaactgaaggtaatgagagactgcagctctaaagcccttcttaaggagatcgggttggaaagctaactcagctgtatttattgtttaaatagaaataaacccagtgttgcttgcaaaaaaa

SEQ ID NO: 2486 - protein, 658 aa, Mus musculus (house mouse)
MMPRLLLRDWPRCPSLVLGAPSRPLSAVSGPAEYLQHSIVPTMHYQDSLPRLPIPKLEDTMKRYLSAQKPLLNDSQFRKTEVLCKDFENGIGKELHAHLLAQDKQNKHTSYISGPWFDMYLTARDSVVLNFNPFMAFNPDPKSEYNDQLTRATNLTVSAVRFLKTLRAGLLEPEVFHLNPARSDTDAFKRLIRFVPSSLSWYGAYLVNAYPLDMSQYFRLFNSTRIPKPSRDELFTDTKARHLLVLRKGHFYVFDVLDQDGNIVNPSEIQAHLKYILSDSSPVPEFPLAYLTSENRDVWAELRQKLIHGGNEETLRKVDSAVFCLCLDDFPMKDLVHLSHTMLHGDGTNRWFDKSFNLIVAKDGTAAVHFEHAWGDGVAVLRFFNEVFRDSTQTPAIAPQSQPAATDSSVSVQKLSFKLSSALKAGVTAAKEKFDATMKTLTIDAIQFQRGGKEFLKKKKLSPDAVAQLAFQMAFLRQYGQTVATYESCSTAAFKHGRTETICPASIFTKRCSEAFVREPSKHSVGELQHMMAECSKYHGQLTKEAAMGQGFDRHLFALRYLAAARGVTLPELYQDPAYQRINHNILSTSTLSSPAVSLGGFAPVVPDGFGIAYAVHDDWIGCNVSSYSGRNAREFLHCVQKCLEDMFDALEGKAIKT

SEQ ID NO: 2487 - DNA, 2013 bp, Saccharomyces cerevisiae
  CDS (1)..(2013)
atgaggatctgtcattcgagaactctctcaaacttaaaggatcttccgataacgtcaaggagagcaatgcattcggccattgtcaattactccacccaaaaggcccaatttcccgtagagacaaataatggggaacactattgggcggaaaagccgaacaaattctaccagaacaaaaggcccaattttcaaggcattacctttgctaaacaacaagacttaccatcattacccgtgcccgaattgaagtctacacttgacaagtatttgcaaaccatccgcccattttgcaatgatgtagaaacttttgaaagacagcagctgttatgtaaggacttctcggagcacatggggcctatcttacaagaccgattgaaagagtatgccaacgataaaagaaactggatggccaagttttgggatgaacaatcctatttacaatacaacgatcctattgttccatacgtctcttatttttattctcatatgccattaccgaatcatttatcgaagatcgataatgatcctttgattaaggctactgcgattatctcaaccgtggttaaattcatcgaagctattaaagatgaatctttacccgtagaaattatcaaaggtatgccattttgtatgaatagtttttcattgatgtttaacacttcgagattgcctggtaagccagaggataaccaagatacaaatattttttattcagtttatgagaacaactttgtaactatcgcttataaagggaagttttacaaactgatgacccatgacgggaatgacaaaccgctttccgaaaacgaaatctggaggcaactgtactctgtggtattccaaggatcgcagtccgatcccaaactaggtggcattggttctctcacctctttacctcgtgatcaatggcgtgaagtacatctggagcttatgaaggatcctatttctcaggattcactagaaacaatccataagtcttcctttatgctatgtttggatcttgaccaatcccctgtcactttggaagaaaagtcaagaaattgctggcacggtgatggtattaacagattctacgataagtctttacagttcctggtcaccggtaatggttcatcaggtttcttagctgaacactcgaagatggatggtacgccaacattgtttttaaataactacgtttgtcagcagttgaataaactagatgtggatgacttcatgagaaaagtaattacgccatcatctacggtggcaatgaaacctatggaactgcccttcattatcacaccgaagattcataaagcaatcgaatctgcccaactacaatttaaggaaacaattggtgagcatgacctacgtgtttggcactacaacaaatacggaaaaacgtttataaaacgccatggcatgtcacctgatgcatttattcaacaagttatccaactggcggttttcaaatatctgaaacgacaactaccaacttacgaggctgcttccacgagaaaatacttcaaaggccgtactgaaactggtagatctgtgtccaccgcctccttagaatttgtttctaaatggcaaaatggcgatgttcctattgcagaaaagattcaggctttgaaacattctgcaaaagagcattctacgtacctgaaaaatgctgcaaatggtaatggtgtcgatcgtcatttcttcggtctaaagaatatgctaaaatctaatgatgaccaaattccgccccttttcaaagatcccttatttaattattcttcaacttggttgatctccacatctcaactatcttcggaatattttgacggttatggttggtctcaagtaaatgacaacgggtttggactggcatacatgttgaataacgagtggctgcatatcaatattgtcaacaaaccagccaagagtggagccagtgttaacagattacactattatttatctcaagctgctgatgaaatttttgacgccttggaaaatgagaataaacgaaaagcaaagttatga

SEQ ID NO: 2488 - protein, 670 aa, Saccharomyces cerevisiae
MRICHSRTLSNLKDLPITSRRAMHSAIVNYSTQKAQFPVETNNGEHYWAEKPNKFYQNKRPNFQGITFAKQQDLPSLPVPELKSTLDKYLQTIRPFCNDVETFERQQLLCKDFSEHMGPILQDRLKEYANDKRNWMAKFWDEQSYLQYNDPIVPYVSYFYSHMPLPNHLSKIDNDPLIKATAIISTVVKFIEAIKDESLPVEIIKGMPFCMNSFSLMFNTSRLPGKPEDNQDTNIFYSVYENNFVTIAYKGKFYKLMTHDGNDKPLSENEIWRQLYSVVFQGSQSDPKLGGIGSLTSLPRDQWREVHLELMKDPISQDSLETIHKSSFMLCLDLDQSPVTLEEKSRNCWHGDGINRFYDKSLQFLVTGNGSSGFLAEHSKMDGTPTLFLNNYVCQQLNKLDVDDFMRKVITPSSTVAMKPMELPFIITPKIHKAIESAQLQFKETIGEHDLRVWHYNKYGKTFIKRHGMSPDAFIQQVIQLAVFKYLKRQLPTYEAASTRKYFKGRTETGRSVSTASLEFVSKWQNGDVPIAEKIQALKHSAKEHSTYLKNAANGNGVDRHFFGLKNMLKSNDDQIPPLFKDPLFNYSSTWLISTSQLSSEYFDGYGWSQVNDNGFGLAYMLNNEWLHINIVNKPAKSGASVNRLHYYLSQAADEIFDALENENKRKAKL

SEQ ID NO: 2489 - DNA, 2064 bp, Saccharomyces cerevisiae
  CDS (1)..(2064)
atgccaaacttaaagagactacccatcccgccactgcaggacacgctcaaccgctacctggcacgcgtggaacccctgcaggacgagcgccaaaaccgccgtacgcgccgcactgtgctctccgcagaaaacctggacgcattgaacacgctgcacgagcggctgctagaatacgacgcacggctcgcggaaagcaacccagagtcctcatacatcgagcagttctggtatgacgcgtacttgctatatgatgcaactgtcgttctcaacgtcaacccgtacttccaactgcaggacgacccaaccatcaaagacacaccagagacggcggcacagggcccctatggcgcacacacggtgcaggttcgtcgtgccgcacgactcaccacctctattctcaagttcatccgccagattcgccacggcacactccgcacagacactgtgcgcggcaaaacgccgctgtcgatggaccagtatgagcggctattcggctccagtagaatccctccgggtcccggcgagccctcttgccacttgcaaacagacgccacgtcgcatcacgtggtggcgatgtatcgtggccagttctactggttcgacgtgctggacacacgcaacgagcccatcttcgccaccccagaacaactggagtggaacctctactcgatcatcatggacgcggaatccgccggaagcggatccgcgccctttggcgtgttcaccacagagtcgcgccgggtgtggtccaacatcagggactatctgttccatgcggacgactgcaccaactggcgcaatctcaagctgatcgactccgcgctgttcgtggtctgtctcgacgacgtggcgtttgccgccgatcagcaggacgagctcacgcgttcgatgctgtgcgggacttctaccatcaatctcgacccgcaccaacaccagccgccattgaacgtgcagacaggcacctgtctcaaccgctggtacgacaagttacaactgatcgtgaccaagaacggtaaggcgggcatcaacttcgaacacaccggtgtggacggccacactgtgctgcggctcgccacagacatctacacagactcgatcctgagcttcgcacgcggtgtcaccaagaacgtcgtcgacatctttagcgacgacgatggaaaaccatcgtcgtcgtcgttggcctcggcggctcactccgccaacttgatcaccatccctcgtaaactggaatggcgcactgacaatttcctgcaatcgtcgctgcactttgccgagacgcgcatctcggacttgatctcgcaatacgagtttgttaatcttgacttctccaactacggcgcgtcccatatcaagacagtgttcaagtgctcgccagacgccttcgtgcagcaggtgttccaggtcgcatacttcgcgttgtacggtcgcttcgagaccgtgtacgagcctgccatgaccaaggcgttccaaaacggccgcacagaggccatccgctccgtcacgggccaatcgaagctctttgtcaagtcactactggaccaggatgcctcggacgccaccaaaattcagctcttgcacgacgcctgtacggcgcactcgcaaatcacaagggaatgctcccaggggctcggccaggaccgtcacttgtatgcgctctactgcctctggaaccaatggtacaaggacaagttggagctcccacccatcttccgcgacaagtcctggactaccatgcagaacaacgtcttgagcacctccaactgcggtaacccctgcctcaagagcttcgggttcgggcctgtcaccgccaacggcttcggcatcggctacatcatcagagaccactccgtctctgtggtggtgtcctcaaggcatcgccagactgctcggtttgcgtcgctcatggaaaagtcgctgctggagatcgaccgcatcttcaaacggcagcaagctcgcgcagcaaaacccgctgccaggaccactgctagcgccaacaccaaatcagaagacatgaaatacctgttgtccggctacgattacttcgacgtgagcgtgtccggttga

SEQ ID NO: 2490 - protein, 687 aa, Saccharomyces cerevisiae
MPNLKRLPIPPLQDTLNRYLARVEPLQDERQNRRTRRTVLSAENLDALNTLHERLLEYDARLAESNPESSYIEQFWYDAYLLYDATVVLNVNPYFQLQDDPTIKDTPETAAQGPYGAHTVQVRRAARLTTSILKFIRQIRHGTLRTDTVRGKTPLSMDQYERLFGSSRIPPGPGEPSCHLQTDATSHHVVAMYRGQFYWFDVLDTRNEPIFATPEQLEWNLYSIIMDAESAGSGSAPFGVFTTESRRVWSNIRDYLFHADDCTNWRNLKLIDSALFVVCLDDVAFAADQQDELTRSMLCGTSTINLDPHQHQPPLNVQTGTCLNRWYDKLQLIVTKNGKAGINFEHTGVDGHTVLRLATDIYTDSILSFARGVTKNVVDIFSDDDGKPSSSSLASAAHSANLITIPRKLEWRTDNFLQSSLHFAETRISDLISQYEFVNLDFSNYGASHIKTVFKCSPDAFVQQVFQVAYFALYGRFETVYEPAMTKAFQNGRTEAIRSVTGQSKLFVKSLLDQDASDATKIQLLHDACTAHSQITRECSQGLGQDRHLYALYCLWNQWYKDKLELPPIFRDKSWTTMQNNVLSTSNCGNPCLKSFGFGPVTANGFGIGYIIRDHSVSVVVSSRHRQTARFASLMEKSLLEIDRIFKRQQARAAKPAARTTASANTKSEDMKYLLSGYDYFDVSVSG

SEQ ID NO: 2491 - DNA, 1941 bp, Caenorhabditis elegans
  CDS (1)..(1941)
atgcttcgttcctcaaacttgtgtcgatcaattacagcttctcgtggaaagcatgctttgaccggagacgactatcaatatctggaaaaatcagaaattccatcgtatcacttccagaagtcgctgagaagactgcctatcccaaagcttccagatacggtaaatcgctaccttgcttcttctaaagcagtgctctctccggatgtttttgcaaaaactgaagccaccattcgcagttttgaagccaatgaaggtccaaaacttcaagaagcgcttctagaatacgacaaggctcatagggacaccagttacatttctgagccatggtttgatatgtatctaagagccagagttccagttgctgtgaattacaacccatttatgatgtatgctccagatccaaatccgaaattcaatgatcagctaactcgcgccacgaatctcgccatttcctatgctagaatcaagcgatccctcgatgagaacctcttggggccagaggttttccatatgaacccgaaaaagagcgatacaaaattattcagaaccatttgcaaaactcttccaccaagtctctcatggttcggtgcagttgcattcaaagctttcccacttgacatgtcacagtataaatctttattctgcggatcgcgaattccaaagaaagaaaaggatatgctgtatttggatgcctctcaaaagcatttcgttgcgttctacaaaggtcatccatacgcagttcgtatctttgacgatgatggtaaactccttgatgctgaagacgttcatgcatctctcgcttggattttgagtaatggaaaggaagcggcaccagagagcagtattggatccctaacgtcgttggatcgtgactcgtgggctgaagctcgagtggaactcgaaaacgcaggaaatggagaatatttgaagaaaattgatggtggacttttcgcaatttgtcttgatgacctcaaaactgaagaacataaaagactcgtccaatctcttctcatcggagatgatgctcgtaatcgttggtttgacaagtgcttccagactatcatcgatgccaacggtcaagccacaatcaactttgaacactcgtggggagatggagttgccgtgcttcgtttaatggaagaatcattcaaggataccaacaaaaatcattttgtatctccagacgacactccaaaatctcataatccagcacatgtgcaggcactcgaattcaagctcacggattctctcaaatctaaaatcagtgatgctcagaagaaacacgtctctgcaaattctgatcttgattttgcgacaatggaattcgaaggactcaacagagatttgatcaagaaaactaaattgtcaccggattctgtgatgcagcttgctattcaaatggcattctattctttgtacaaagagtttgttccaacgtatgagtcatgttccactgctgctttcttgaagggaagaactgaatgcatgagatcggcaacatcagctacgcgtgccgccaccttggctattcttgaagaaaatcgtaaagatgttcgacaactattgactgattgctccacacaacatttccaacttgtaaaagaagcatcaatgggacaaggatatgatcgacatttgctcggcctcaaaatcacagctcaacgattgagccaaccaactccagatttcttccaagatccaggatacacgagaatgggtcattttgtactttcaacgagcactttgtcaacggatacgattgtcttcggaggattcggaccagttgtgcaagatggattcggtattggatacaacgttgttcccaacaaactcggagccgttatttcgagcaataagtcgaaacgtgacgctgccgccttctcgaatgctctttacaagagtttggacattcttcgtggtcaccttctcgatccgaaataa

SEQ ID NO: 2492 - protein, 646 aa, Caenorhabditis elegans
MLRSSNLCRSITASRGKHALTGDDYQYLEKSEIPSYHFQKSLRRLPIPKLPDTVNRYLASSKAVLSPDVFAKTEATIRSFEANEGPKLQEALLEYDKAHRDTSYISEPWFDMYLRARVPVAVNYNPFMMYAPDPNPKFNDQLTRATNLAISYARIKRSLDENLLGPEVFHMNPKKSDTKLFRTICKTLPPSLSWFGAVAFKAFPLDMSQYKSLFCGSRIPKKEKDMLYLDASQKHFVAFYKGHPYAVRIFDDDGKLLDAEDVHASLAWILSNGKEAAPESSIGSLTSLDRDSWAEARVELENAGNGEYLKKIDGGLFAICLDDLKTEEHKRLVQSLLIGDDARNRWFDKCFQTIIDANGQATINFEHSWGDGVAVLRLMEESFKDTNKNHFVSPDDTPKSHNPAHVQALEFKLTDSLKSKISDAQKKHVSANSDLDFATMEFEGLNRDLIKKTKLSPDSVMQLAIQMAFYSLYKEFVPTYESCSTAAFLKGRTECMRSATSATRAATLAILEENRKDVRQLLTDCSTQHFQLVKEASMGQGYDRHLLGLKITAQRLSQPTPDFFQDPGYTRMGHFVLSTSTLSTDTIVFGGFGPVVQDGFGIGYNVVPNKLGAVISSNKSKRDAAAFSNALYKSLDILRGHLLDPK

SEQ ID NO: 2493 - DNA, 2415 bp, Emericella nidulans
  CDS (1)..(2415)
atggaagctccccgctcacatccggctcctgagccgaagataaggcctaccacagtggatggaggcttgcccgatcaggttaagaccaagagtggtgggatcacattcgcacaccaagactctctgccgaagttacctatcccggatcttgagagcacatgcaagaaatatctcgacgctctgtcgccgctgcagactcctaaagagcaagaagagaccaaggctgctgtacgggagttcctcaaaggcgagggtcccggccttcaagagcggctgcagaaatatgccacatcgcaaacgagttatattgaacaattctggtacgactcctatctgaattacgacagtcctgtcgttctcaacctcaaccccttcttcttgctggaggacgatccaacacctgcgagaaacaaccagctgactagagcggcatcgctggttgtttcggccttatcatttgtgcgcgctgtcagacgggaggagttgcctcccgataccgttcgaggtacgccattgtgcatgtatcaatattcccggctatttggtactgcacgtgttcctactgagaatggctgcgttatcagccaagatcccaagtcaaagcatatcgttgttatgtgccgtggtcagttctactggtttgacgtcctcgacgagaatcatgaccaaatcatgacagaaaaggatatcgcaatgaaccttgaggttattctcgctgatgcagaacaaaccccaattcaagaggcggcgaagggcgcccttggagtcctcagtactgaaaaccgcaaggtgtggtcgggattgagggatatcctaaccaaagatgagcattcaattaacgctgagggcttaaacattgtggatactgccctatttgtcctctgcctggatgacaccgagcctcataacatgtccgagctttgcgcgaacatgctctgtggtacgaacgtggtggaaaagggcgttcaagtgggtacttgcacgaaccggtggtacgacaagctgcagatcatcgtgtgtaagaatgggagtgctggaatcaattttgagcacactggtgttgacggacatactgttcttcgcttcgcgagtgacgtctacacggacacgattcttcgctttgcacgaaccatcaacggccaggctcccagcttgtgggcaaccactagccctgacccgtccaaacgacaccctcgaagcttcggtgacgttagcccgacccccagaaaattagaatgggacatgttgcctgagcttagcattgctatccggtttgccgaatcgcatctcgcagatcttcttcagcagcatgaattccaagtgcttgatttcaagggattcggaaagaactttattacctcaatgggattctcaccggacgcattcgtccagatggcgttccaggcggcttactacgggctttacggacaagtggtaaatacctatgaaccagcaatgaccaaggctttcctgcatggacggaccgaagccattcgatctgtcaccaatgaagccctcgacttcgtgaagacattttgggctgaaaaccctgctgaggataaggtgaatgcccttcgaaaggctactgagaagcactcggcaatcacgaaggaatgctccaagggacaaggacaggaccgtcacctctatgctctttacaccctgtggcagcgacaattcgacgaagcccctagctcccggaacaacagcgtcgatgaagcgtcgaacgggtacacgagtcctgctgagatcgactccatcgctgggtctcctctatccccgtcctctgtatctgaggtggatgggttgtcatccactggcagctatggccgggctatgcgtaatttgcctcccactcccgccatcttcagcgaccccggctgggacaagatcaacaacacaattctttccacttcaaactgtggcaacccctgcttgcggcatttcggcttcggcccaacatctgcagacggattcggcattggctacattatcaaggacgactcaatctcaatttgcgcctcatctaagcaccgccaaaccgcgcgtctcatgcagacacttgagttgtacctgcttgagatccgcaagttgctgcgcgcgactgtccacaagccgtccagcccgcggaccagccgcgctcgtgaaatggagatgattgccgagcgggtccagcgtgatcaacgccggggtcgtattgtccgcacagacgcgggccatctgcgggccggtaccgagacgcccacgacggacagcggggacatggacgatgatggcatgggcggatatggtttctttgatgcagggatgctcctgcatgcgctcaaggggctcaacgtggatcgcgagcggggtggcgacaagacccctcgacgacggttcgttggcaagaagctacggttgaatgaatattga

SEQ ID NO: 2494 - protein, 804 aa, Emericella nidulans
MEAPRSHPAPEPKIRPTTVDGGLPDQVKTKSGGITFAHQDSLPKLPIPDLESTCKKYLDALSPLQTPKEQEETKAAVREFLKGEGPGLQERLQKYATSQTSYIEQFWYDSYLNYDSPVVLNLNPFFLLEDDPTPARNNQLTRAASLVVSALSFVRAVRREELPPDTVRGTPLCMYQYSRLFGTARVPTENGCVISQDPKSKHIVVMCRGQFYWFDVLDENHDQIMTEKDIAMNLEVILADAEQTPIQEAAKGALGVLSTENRKVWSGLRDILTKDEHSINAEGLNIVDTALFVLCLDDTEPHNMSELCANMLCGTNVVEKGVQVGTCTNRWYDKLQIIVCKNGSAGINFEHTGVDGHTVLRFASDVYTDTILRFARTINGQAPSLWATTSPDPSKRHPRSFGDVSPTPRKLEWDMLPELSIAIRFAESHLADLLQQHEFQVLDFKGFGKNFITSMGFSPDAFVQMAFQAAYYGLYGQVVNTYEPAMTKAFLHGRTEAIRSVTNEALDFVKTFWAENPAEDKVNALRKATEKHSAITKECSKGQGQDRHLYALYTLWQRQFDEAPSSRNNSVDEASNGYTSPAEIDSIAGSPLSPSSVSEVDGLSSTGSYGRAMRNLPPTPAIFSDPGWDKINNTILSTSNCGNPCLRHFGFGPTSADGFGIGYIIKDDSISICASSKHRQTARLMQTLELYLLEIRKLLRATVHKPSSPRTSRAREMEMIAERVQRDQRRGRIVRTDAGHLRAGTETPTTDSGDMDDDGMGGYGFFDAGMLLHALKGLNVDRERGGDKTPRRRFVGKKLRLNEY

SEQ ID NO: 2495 - DNA, 2601 bp, Debaryomyces hansenii
  CDS (1)..(2601)
atgacatacacatatgaatatgaagagggtcttcctcgattaccagttcctctgttaacgaacacgtcaacccaattattgaatacattgaaaccattattgagcgtagatgaatataacgaattactccaggaatcgagtgagtttctcagtcatgaagttattaatttgattcaacgtcatttggtggcagcttctttaaatcctaataacacatgctacttaaattgtgtgaataatggaaccagcccggggatttatggcgaaataagaggagatattcttcctcgaaacccgtacttaattttagaagaagatccgtatgcgaagactgttaatccacctaaccaaagtcaaagagcagccaatttggttaattcgtctttgaaatttgtaacaagtcttcgtaatgatacattacaaccagataggacacctaaaaatggtaatcccttatcgatgaactgttataatatattatttggcacaacaagagtgcccctcacagaagacgaaaattcgtaccaaagtgcaactatacaaaagtttaatgatatcaatgattcgagacacattgttatcatttgtaacaaccagtattattgcttggaagtgttgacagagtatagcgaagaggaatacaaggaatctaagaccaagcataaaatttggttcagtgattatgaattatcaataatttttcaagggataatcaacaattctaatactattgatagagttgagtctataaacaattctattggatctttgactacgcaatcattttcaatttggaaaataagcagaagtgaattgaataagtctaacaaaaaaaacttagaattgattgataatgccttattcatagttgtattggatcctaatttgccagattccgatcaagaaaagacatcggtgatagcacatggaacctctgagttgttgaaaggaactaatatgcaagtcggttcatgtacgtctaggtggtatgataagttacagttagtcgttactaagaattcagttgcaggtgtagtctgggaatcatcatcaacagatggcacagcgattttaagattcattagtgacatctatgctgattctattttgaaattagccaaaaacatcaatggagctgagtatacattgtttgatgataatgttgggtttgtatcagcagatggatcgatcaagaagccagagtctgaaagattgataattaccagaaccccagaacttttgaatttgataaggctatcagaaacaagattagccgacttaatacaccaacatgaatacaagaccttgactcttaaattgaacacctatttggtcaataaattcgaactcagtatagactcagttttgcaagttgcatttcagattgcaaattatactttatatgggagtatggcaaatacgttagaacccattaccactagaaagttcagagactcgaggactgaattaattccagttcaaaacgatcatatttctaggttggttaaattatttattacaaactcaaattcttcattgaaatgggacttgttcagagaatgttgtagcgttcatactaagcaatatcgtaatgctatgaatggtaaaggttttgagagacattttaatgcaatcatctctgttttagggagacctcatgcagtcgagactttgaacaaattgaatgctgatgtgcctgatttggaaccgattccagatataaagaaaataaaaaacctacatattccattactctcaaatcccacgattgaaaagctttcctctcctgaattattgatttctaattgtggtaatccagcattacacatgtttggtattccacctgcagcggaccaaggttttgggattggttacgttatccatggtgataaaatcatcattactgttagttcaaagttcagacaaacagagaggtttttgcgtacttttaaaggagtcatgaaggaattcttatcgattattaagcaaaaatcgaatttcttgattaatataaatgattcagaatctagaaaactggagttacaaagacttagaattgagcatgagcttaagaatattaacaaatccctccctctgacaaaacatcctatcgaattgactgttgaaaaaacacgcattccaatagaaaatgttagcattgaaggaaatggggatagtgtgcaatcccgctctagtagatctaactctttatcggacgattataaagaagattacgatattttagggggatatgggtacttcaattttggtgacttagatatgagatcggatgaattatcaagagaagagtcgttcttaaacagtactccacctagcttatcgagcttgaattcgaaacaacattcttcgacaaatcttcataaagcagcaatgactaataacaatagtcctagtgatatcaagcaaaagtttaatttgtctgctgagatcagagacagattgctgttacaagatgattattcgtcgacatcctctgttgcaggaagcatggaggatgcatcatcagaaggttcaaatgaaaattctagtaagccaaagaaattaataggcagagagttggatatttcagatgttcattag

SEQ ID NO: 2496 - protein, 866 aa, Debaryomyces hansenii
MTYTYEYEEGLPRLPVPLLTNTSTQLLNTLKPLLSVDEYNELLQESSEFLSHEVINLIQRHLVAASLNPNNTCYLNCVNNGTSPGIYGEIRGDILPRNPYLILEEDPYAKTVNPPNQSQRAANLVNSSLKFVTSLRNDTLQPDRTPKNGNPLSMNCYNILFGTTRVPLTEDENSYQSATIQKFNDINDSRHIVIICNNQYYCLEVLTEYSEEEYKESKTKHKIWFSDYELSIIFQGIINNSNTIDRVESINNSIGSLTTQSFSIWKISRSELNKSNKKNLELIDNALFIVVLDPNLPDSDQEKTSVIAHGTSELLKGTNMQVGSCTSRWYDKLQLVVTKNSVAGVVWESSSTDGTAILRFISDIYADSILKLAKNINGAEYTLFDDNVGFVSADGSIKKPESERLIITRTPELLNLIRLSETRLADLIHQHEYKTLTLKLNTYLVNKFELSIDSVLQVAFQIANYTLYGSMANTLEPITTRKFRDSRTELIPVQNDHISRLVKLFITNSNSSLKWDLFRECCSVHTKQYRNAMNGKGFERHFNAIISVLGRPHAVETLNKLNADVPDLEPIPDIKKIKNLHIPLLSNPTIEKLSSPELLISNCGNPALHMFGIPPAADQGFGIGYVIHGDKIIITVSSKFRQTERFLRTFKGVMKEFLSIIKQKSNFLININDSESRKLELQRLRIEHELKNINKSLPLTKHPIELTVEKTRIPIENVSIEGNGDSVQSRSSRSNSLSDDYKEDYDILGGYGYFNFGDLDMRSDELSREESFLNSTPPSLSSLNSKQHSSTNLHKAAMTNNNSPSDIKQKFNLSAEIRDRLLLQDDYSSTSSVAGSMEDASSEGSNENSSKPKKLIGRELDISDVH

SEQ ID NO: 2497 - DNA, 1899 bp, Debaryomyces hansenii
  CDS (1)..(1899)
atgaatattgattcgaaaacaatgcttaagactatcagaatgaacaaaatgccagtgtcaatgaaacaattttccacgtcttccttgaaaggggacttattcaaataccaaaaggatttaccaaaattgccggttcctgggttgcaggatactgctaataaatatgtgagatccgtggagccatttttgaccaaggaacagttgcagagaactaatgccaaaattagcgactttacaaaaccaggtgggagtggtgaagtgttgcaacagcgtttggttgaatttgcgcaaggaaaggataactggcttgcggaatggtgggatgattatgcctacatgtcttatagagatccagttgtgccatatgtgtcgtactttttctcgcacaaggacatcaacaacgctattggaaaggaccaattgttaaaggcatcgttgattgcttactacacgcttgagttcatggagctggttcaaagcgagactttggagcctgaaattatcaagggcaatccattctgtatgaatgccttcaaatacatgtttaacaactcgagggttccagcagagaattccgatattaccaagatgtacgagggatctgaacacagatattttactgttattatcaagaatcacttttacaaggtctaccaccatactaaggatggtcaacaattaagcaaagccgacatttacaagcaattgcaatatattttccaggatgtcacaaacaagccaagcggttcaccaattggtgcattgacttcactcaatagagatgaatggttaaactcttacaacagcttgaccaagtcaccaatcaacaatgcgtcattggaatcgatttatgcttcatcatttgtcatttgcttggacgacaacaacccaattactattgaagaaaaatctagaaactgctggcacggtgatggtcaaaatagattttttgacaagccattagaatttttcattagtagcaatggtaactctggatttttaggtgaacactctaagatggatgccaccccaactgtgcaattaaataactttgtttactctcaattggcgaaagaaaatccggctaccgtattatctgaaattgccaatgataccaagcaattgactgatttacaagtcgaagctattcctcaagtcttacaatttgacattaacccagtcgttagaaatgaaattaaccaggctgtcgtcaaatttaatgaaaccatttcctctcttgatcaagaaacattccaatacttcggttacggtaagaacttaattaagcaatttaaggtttctccagatgcttatgttcagatgttaatgcaattggcttactttaagatgacaggtaagatcaggccaacttacgaatcagctgctactagaaaatatttgaagggaagaacagaaactggtagaccagtttctgtcgaatctgccgctttcgttaagacttggactgataataatgctactaccgaagacaaagttgctgctttccaagctgcttgtaagcaacacgtcaagtacttaggtgatgctgctgatggtaagggtgttgaccgtcacttgtttggtttaaagcaaatgttgaagccaaatgaacccgttccagaaatctttactgacgatgtctacggctactcttcatcttggtacctttccacttctcaaattccttctgaatacttccaaagttggggtttctctcaagttacagatgatggttttggattagcatacttaattaactcagattggttaaacgttcatatttcttgcagaaagggtaacggattgagatccgatgtcttaaagtggtacttagttgaatctgctaacgaaatgaaacagatcttgacttcaaatttagctcctaaagcaaaattatga

SEQ ID NO: 2498 - protein, 632 aa, Debaryomyces hansenii
MNIDSKTMLKTIRMNKMPVSMKQFSTSSLKGDLFKYQKDLPKLPVPGLQDTANKYVRSVEPFLTKEQLQRTNAKISDFTKPGGSGEVLQQRLVEFAQGKDNWLAEWWDDYAYMSYRDPVVPYVSYFFSHKDINNAIGKDQLLKASLIAYYTLEFMELVQSETLEPEIIKGNPFCMNAFKYMFNNSRVPAENSDITKMYEGSEHRYFTVIIKNHFYKVYHHTKDGQQLSKADIYKQLQYIFQDVTNKPSGSPIGALTSLNRDEWLNSYNSLTKSPINNASLESIYASSFVICLDDNNPITIEEKSRNCWHGDGQNRFFDKPLEFFISSNGNSGFLGEHSKMDATPTVQLNNFVYSQLAKENPATVLSEIANDTKQLTDLQVEAIPQVLQFDINPVVRNEINQAVVKFNETISSLDQETFQYFGYGKNLIKQFKVSPDAYVQMLMQLAYFKMTGKIRPTYESAATRKYLKGRTETGRPVSVESAAFVKTWTDNNATTEDKVAAFQAACKQHVKYLGDAADGKGVDRHLFGLKQMLKPNEPVPEIFTDDVYGYSSSWYLSTSQIPSEYFQSWGFSQVTDDGFGLAYLINSDWLNVHISCRKGNGLRSDVLKWYLVESANEMKQILTSNLAPKAKL

SEQ ID NO: 2499 - DNA, 2259 bp, Debaryomyces hansenii
  CDS (1)..(2259)
atgacgtaccagtaccaagatcaacttcaaaagttaccaataccagatttacaagaaacatgcaagaactacttgaatgttttagaaccattacaaacggaaagggagcatgagagaaccaaggaggcggtgagactgtttttgttaggaggaaacggagaatacttggataaagagcttcggaaatacagtgagggacgcagttcttatattgagcagttctggtacgattcatacttgaactatgattcgccagtggtgttgaatttaaatccattctttcttttggaagatgacccgttccataacgagtctatgagtgtcaacccacaggtcaagagagctgcatcgttgacattatcgtcgttgaagttcatccgggccttaaaaaacgaaactttgctggtggacaagacaagaaccggccaacctctttgcatgtaccagtattctaagttatttggggcgtcgagaattcccaccgacgacggttgtgtcatgcaaacagacgtcaattcgaaccatatagttgtcatgagcaagtcccaattctattggtttgacgtgttggacaagaacaacaatttgatcttgtcggagccggaattgattgtcaatttcacgtccataattcaggactcattaaatacatcgatcagcgagattgctaaatcttcatttggggtattgactaccgaaaatagaagagtttgggcaaaaataagaaacagtggtactatcaccgataacgctaataataacgaaattttgagcattattgattctgcattatttattttatgtcttgatgacttaagattagaaaacttgtcagatttggctaagaacatgttgtgtggattgtcaatattagacaagggtgtccaggttggtacctgtaccaacagatggtacgacaaattgcaaataatcgtcacccaaaacggtaaggcgggtattaacttcgagcatacaggtgttgatggtcacacagttttacggtttgtaagtgacatctatacagactccattttatcgtttgcacagtccatcaatggccatgccccttcattgtggagtgatgattcgtcgtcaaagcctgactatgaccaagagttggttacaatccccagaaaattggaatgggaattaactccagatttatcgttggcattaagattcggggaaactaggttatcggatttgattaatcaaaatgaattcaaacatttggaattcaagaattacggttcctcaactattaaaaaaatgaaatacagtcctgatgcttttgttcaaatggcatttcaagttacttattatgctttatatggtaaggttgaatgcacttatgagccagccatgacaaagaattttttccacggtagaactgaagcagttcgaactgtatctcaagaatcaaacttgtttgttcgtaagttttttgatctgactgtatcaaataaagacaaacttgcatacttaacgagtgcatgcacaaagcactctcaacagaccaaacaaagttctatgggtaaaggaattgacagacacttatatgcgcttttctgcatctggaaaagatacgtcgattctagtgactacaaagcgatagacttagagcatgacaatgctgttactcttgataatcaaagatcttccattctgacgcttgtggacgatgacaatgaaacacattcttcggacactacaattggtaataattataataactgtaagaacgatttaaccgaattgccatctatatttgctgattcgggttgggataagttgaataatacagtcttatctacttcgaactgtggtaacccagcattgaggttatttggtttcggcccagtatcggctaacggattcggtttggcatatattattaaagacgattctatttcgatatgtgctgcatcaaaacatagacaaactgaaagatttttggtcacattagagctgtacttgaacgagatttacagcatttttcaagagtctagtaaggaacaaattgaatcaccaatcgataccaagattaaaacgaccacacaattactggcccctagaccatctttggttcaaaagaagtcaacagtatctaatttattaggtggatatggttacttcgatatgggtgataatgacatgaaatcgagaggtcctagtcctgaacctcctttccttaacagaaataacagtggtttctcggttagagaaattggcaagaaattgagattatctgaatactag

SEQ ID NO: 2500 - protein, 752 aa, Debaryomyces hansenii
MTYQYQDQLQKLPIPDLQETCKNYLNVLEPLQTEREHERTKEAVRLFLLGGNGEYLDKELRKYSEGRSSYIEQFWYDSYLNYDSPVVLNLNPFFLLEDDPFHNESMSVNPQVKRAASLTLSSLKFIRALKNETLLVDKTRTGQPLCMYQYSKLFGASRIPTDDGCVMQTDVNSNHIVVMSKSQFYWFDVLDKNNNLILSEPELIVNFTSIIQDSLNTSISEIAKSSFGVLTTENRRVWAKIRNSGTITDNANNNEILSIIDSALFILCLDDLRLENLSDLAKNMLCGLSILDKGVQVGTCTNRWYDKLQIIVTQNGKAGINFEHTGVDGHTVLRFVSDIYTDSILSFAQSINGHAPSLWSDDSSSKPDYDQELVTIPRKLEWELTPDLSLALRFGETRLSDLINQNEFKHLEFKNYGSSTIKKMKYSPDAFVQMAFQVTYYALYGKVECTYEPAMTKNFFHGRTEAVRTVSQESNLFVRKFFDLTVSNKDKLAYLTSACTKHSQQTKQSSMGKGIDRHLYALFCIWKRYVDSSDYKAIDLEHDNAVTLDNQRSSILTLVDDDNETHSSDTTIGNNYNNCKNDLTELPSIFADSGWDKLNNTVLSTSNCGNPALRLFGFGPVSANGFGLAYIIKDDSISICAASKHRQTERFLVTLELYLNEIYSIFQESSKEQIESPIDTKIKTTTQLLAPRPSLVQKKSTVSNLLGGYGYFDMGDNDMKSRGPSPEPPFLNRNNSGFSVREIGKKLRLSEY

SEQ ID NO: 2501 - DNA, 2244 bp, Yarrowia lipolytica
  CDS (1)..(2244)
atgagcgacagcacctttgctcaccaggagtcgctgcccaagctgcccattcccgacctcaaagacacatgtgacaattatctggaggcactgcgaccgctgcaaacggcccacgagcatgaacgaacagaaagagctgtccacgagtttctcaacaccagcggacccattctccaggaggagctcaagcagtacggaaagccccgatcgtcatacattgagcagttttggtacgattcgtatctcaactatgactcccccctcgttctcaacctcaaccccttcttcctcattgaagatgaccccaccccggttcaacagagccaggtcgatcgagcagctacattaaccacatcttctctgcggttcatccgagccctccgacgagaggagctgcccccagataacgtccgaggcacaaagctctgcatgtaccagtactcgcgactgtttgccagtgcccgaatcccctctgcaaatggctgtgtcatgcagtctgactccacctccaagcatattgttgtgctctgccgatcgcagttctactggtttgacgtgttggacgacaacaacgacctcatcatggtggaaaaggatatcgcgctcaactttgagactatcatccaggacgcagagggtactcctatcactgagattgcaaagggagccgtcggagtgctcaccacagaaaaccgacgtgtctgggcttctatcagagaccagatgaaccgtgccaccgactcttccaactacgagtgtctcaaactcattgactctgctctgtttgtcgtctgtttggatcacgcagcccccgagtctctttcagatctcacccgaaacgccctttgtggtctttcagagctccagaagggtgtccaggtcggaacatgcacgaacagatggtacgataagctgcaaattatcgtcactcagaatgcaaaggccggggtgactttcgagcatactggtgtcgatggtcacaccgtgctgcggtttgtgtccgacatttacaccgactccattctgcggtttgctaacaccatttctggagctgctccttctctttggaagacagtttctcctgacccagcgaagcgagatccagcttcgttcggtaacgtgtctaccactcctcgaaagctcgagtggtccattggccccgagctccaaactgctctacgttttgccgagacccggaactccgatctcatccaccagaacgagtttgagtgtctttctttcaaccactacggaaagaaagccatctgtgagatgggctgttctcctgacgcctttgttcagatggtcttccaggctgcctactacgttctttacggacgtgtggaatgcacttacgagcccgctatgaccaaaacctttttgcatggccgaaccgagtccattcggtcagtaacaaaggagtcgtctgagttctgccgaaagttctgcgaggaccttcctgctgaaaccaagctggagtacctacgaaaggcttgccagcagcacaccaagaatactaagaagtcctctcaaggtcttggacaggatcgtcatctttacgctcttctgtgcatctggagacgatatcttgaggagtctgatgacaacgactcaaccacctctcagacctccattggttctcagactgcagttgatattggagacgagatgactcccatcactggtctaggagacgtgcatcttcccaaggctggtggatccattcccagcatcttctctgatcccggatgggacaagctgaacaacaccattctgtcgacttccaactgtggtaaccctgctctcaagctgttcggattcggtcccacttctcccgatggatacggtcttggttacatcatcaaggatgactccatcaccatctgtgcatcttctaagcatcgacagactgctcgtttcctcgagactctgtccactgtcatgatggagatccgtctcctgtttcgagaggtcgccaaggccaaggcccagcgacctgctggtgcttctcgagctcggtcttgtgaacgagttcctcaggtacataccaccaagcaagttcactttggccgaactcttccccggtccaggaagccctccgagacagagatctacgacgaggagatgtcttatcttcttggaggttacggatactttgacatggcggactttgagaacgcggctgataccgagcggctgggacgcaaggagattggtagaaagctcagactggctgagtattaa

SEQ ID NO: 2502 - protein, 747 aa, Yarrowia lipolytica
MSDSTFAHQESLPKLPIPDLKDTCDNYLEALRPLQTAHEHERTERAVHEFLNTSGPILQEELKQYGKPRSSYIEQFWYDSYLNYDSPLVLNLNPFFLIEDDPTPVQQSQVDRAATLTTSSLRFIRALRREELPPDNVRGTKLCMYQYSRLFASARIPSANGCVMQSDSTSKHIVVLCRSQFYWFDVLDDNNDLIMVEKDIALNFETIIQDAEGTPITEIAKGAVGVLTTENRRVWASIRDQMNRATDSSNYECLKLIDSALFVVCLDHAAPESLSDLTRNALCGLSELQKGVQVGTCTNRWYDKLQIIVTQNAKAGVTFEHTGVDGHTVLRFVSDIYTDSILRFANTISGAAPSLWKTVSPDPAKRDPASFGNVSTTPRKLEWSIGPELQTALRFAETRNSDLIHQNEFECLSFNHYGKKAICEMGCSPDAFVQMVFQAAYYVLYGRVECTYEPAMTKTFLHGRTESIRSVTKESSEFCRKFCEDLPAETKLEYLRKACQQHTKNTKKSSQGLGQDRHLYALLCIWRRYLEESDDNDSTTSQTSIGSQTAVDIGDEMTPITGLGDVHLPKAGGSIPSIFSDPGWDKLNNTILSTSNCGNPALKLFGFGPTSPDGYGLGYIIKDDSITICASSKHRQTARFLETLSTVMMEIRLLFREVAKAKAQRPAGASRARSCERVPQVHTTKQVHFGRTLPRSRKPSETEIYDEEMSYLLGGYGYFDMADFENAADTERLGRKEIGRKLRLAEY

SEQ ID NO: 2503 - DNA, 2598 bp, Kluyveromyces lactis
  CDS (1)..(2598)
atgactatgtcgacgtttatcaatgagaaaaacttgccaaagttgcctctcccagacttgcaaaagaccttagaggagatggaggattccttgaaaccactgtattatgcagatgggtattataaacatcctttacatccagaagaatccagtgaattgcatgaaaatatcgagaaattcttgcattccaatgctgctgtaaaattacaggaaaaattgaagatgtttgatagatttaacggttgttatttggacaagttgcatctagacatcaataaccatacttccacgaaagagatccaggatgatgtgctaccaagaaatccgtttttaatcttagcagaagatgctacctctgatatctcacaagcagtccgtagtggtgtgctctgttcctctgctttgagatttgtcagtgccttgagacagaaccatttgcctcctgattgtggcagcgatgggaagccgatgagtatgcttccatataccaatcttttcggtacgacaagatgtcccgtgtttgaacatggtgaagtggaatccttcgatttgaacagaccttacgatgaatctgatttggaagccgaattgaataatctttctgcgcagagaaggccttctactgcgtcatcagaggcttctaatcagccatctgccaattctgacgatgatttggaatttttcaacgttcatggcattacaaagaaacagtaccctgattctaaacatattatgatcatttcaaagggtcaatattacactctggaagtgttggatgaaaacgataatgcattgtttacagattcacagttgtcacgtgttttccaacatattatcgatgattcgactacttcttatagtttgaaaagggctaccgcattgggttctctcacatcatattcctttaagaactggaagtatgcaagaaaaagattacagaagcgttatccacaggaattgaacgttatcgattctgctttattcatcgtcgttcttgacgaatcgactagtactagtgatatcaacgaagattgcaagaggttatactatggtactagtattgttgatgatgttacagggttccaagtcgggtcttgcacttcaagatggtatgacaagctacagttagtcgtaactgctgactcaaaggcagcagtgatttgggattcctttacttgtgatggtagcgttgttctaagatttactagtgatatttatgccgaatctattttgagattggctagagaagtccatgctggtgatcctcatttttccttatggccacaggtccctaaagcaagctcaaaagatgcatggactgagaaattttccaagatcacttggtcctttagtcatattttgaatacccatgttcatttatccgaaaccaagttgactgatttgatctcaaagcatgacatagttcacacaactattccatttggtcgtagaacagcccagaaattaggggttcgtgctgactctttgattcaaattgccctccaaatagctcattatgctctttatggtaagatggtattcagtttcgaaccagtgtctactaggttcttccaaaattctagatctacttttatcccaatacaaactcaagagctattagagttgtgccaactattcatatccaattccctaaatgaaacgggaaagttggagaagtttattactgcttgcaatgatcacagcgaaagaatccaaaaggctcaaagaggtacagggtttgaaaaacatttcaatgcaatcaagtaccttttcaagttccacgaccatttcgatattggcctatctcctgaagaattcgaaatctcttcaaaagtcttcaacgatgccatgctggaaccattctcagctcctgagttaattgcatctaattgtggtaattcagcaatgactgcgttcggtgttacaccagcagtaccacaaggatttggtattggttatattatcaaaaatgagcaatgtgacattacgttaacctcacaatacagacaagggagaagacttgctttcatgttgaaatgggtcctaactgaaatcaacaactactgggaattaagttccgttaaatctgtgaaaattagccccaaagttgatcagttatatgaaattgataatgcgattaaccaattgaaattcaactcattatccacaaaaccagaaatagcaaagagccctgttcaattcgctgaaagacctaaccttggatcgtaccaacaatcttcatcctccagtatcttcaatggtggtcatggtttcttagaactcaagggtcatcttgaaagtagagcttcatccaggcctatttctagatctggatccaatttgaagttatctgccatgaatacaacaaattcattacagcccaccttgtcaaatggcttagaagatgcactaacatctacaattagcatcacaagtgaggttttgaagcagaatgccggccatgaaatcttgaagattgatgcttcgaatatcggggaaacacaacctcaggtgcagaaaaagaacgttgtttcatccaagtttgaaattaactttgaccgttcaagtgttggtagaaaagttaatactcgtggttaa

SEQ ID NO: 2504 - protein, 865 aa, Kluyveromyces lactis
MTMSTFINEKNLPKLPLPDLQKTLEEMEDSLKPLYYADGYYKHPLHPEESSELHENIEKFLHSNAAVKLQEKLKMFDRFNGCYLDKLHLDINNHTSTKEIQDDVLPRNPFLILAEDATSDISQAVRSGVLCSSALRFVSALRQNHLPPDCGSDGKPMSMLPYTNLFGTTRCPVFEHGEVESFDLNRPYDESDLEAELNNLSAQRRPSTASSEASNQPSANSDDDLEFFNVHGITKKQYPDSKHIMIISKGQYYTLEVLDENDNALFTDSQLSRVFQHIIDDSTTSYSLKRATALGSLTSYSFKNWKYARKRLQKRYPQELNVIDSALFIVVLDESTSTSDINEDCKRLYYGTSIVDDVTGFQVGSCTSRWYDKLQLVVTADSKAAVIWDSFTCDGSVVLRFTSDIYAESILRLAREVHAGDPHFSLWPQVPKASSKDAWTEKFSKITWSFSHILNTHVHLSETKLTDLISKHDIVHTTIPFGRRTAQKLGVRADSLIQIALQIAHYALYGKMVFSFEPVSTRFFQNSRSTFIPIQTQELLELCQLFISNSLNETGKLEKFITACNDHSERIQKAQRGTGFEKHFNAIKYLFKFHDHFDIGLSPEEFEISSKVFNDAMLEPFSAPELIASNCGNSAMTAFGVTPAVPQGFGIGYIIKNEQCDITLTSQYRQGRRLAFMLKWVLTEINNYWELSSVKSVKISPKVDQLYEIDNAINQLKFNSLSTKPEIAKSPVQFAERPNLGSYQQSSSSSIFNGGHGFLELKGHLESRASSRPISRSGSNLKLSAMNTTNSLQPTLSNGLEDALTSTISITSEVLKQNAGHEILKIDASNIGETQPQVQKKNVVSSKFEINFDRSSVGRKVNTRG

SEQ ID NO: 2505 - DNA, 2079 bp, Kluyveromyces lactis
  CDS (1)..(2079)
atgccatctattaaagatacgaaccaggaagttttgcccaggttgccaatccctcctttggaagatacgttaaagcggtacttggctagattagagcctttgcaagattctagaagctatgaaaagacgaagcgagctgtggcagagtcagagcaaagcttgaggattatagatcatgaattgagaaagtatgacgaacatcttgctcaacgtgaacctatgtcttcgtatatcgaacagttctggtttgattcgtaccttgaatacgacgaatcagttgttttgaatttgaacccttatttccagttagctgatgatccaaccatgaacaatgtgccaaaagtcagttccagattctctcacttcaacaggcaagtcaagagaacatccaaattagtggtatcgatgttgaaattcgttaaagcgatcagaactggtaccttgcctactgacaacgtaaggggcaaatcaatgaccatggatcaatatggtaagttgttcggaagttctagattgccaccttctttgaacgattctactttatcgtcgtgtcatttacagactgatcccacctcacaccatgttgtcatcatgtacaagtcccaattctactggtttgacgtcttggatatcaataacgaacctatctttcaacaaccggaggaattggaatggaatttgtattcaatcataatggattctgagcagaacagtttggatcaaaatcttcaaaatagctgccccatgggtgttttcacaaccgaaaacagacgtgtgtggtcaaacgttagagattacatcagcaagtcagaagatcagactaactggcgtaacttgaagattatcgatagtgctttattcattatatgccttgatgattctgatttggaaggtgaacgtgactggatcaaatccatgatttgtggtacttctaaaattgatttgaatgataaagatgaagataagacgaaaccctctctcggtttacaaacagggacttgtaccaaccgctggtacgataaattgcagttgattgttgacagaggcggaagagcaggtatcaacttcgaacacactggtgttgatggtcatacagtattgcgaatgaccatggacatctataccgattctatcgtcaattttgctcagggtattaccagaaacgttccaaaagttttcgaagatgacgacgacgaccgcagagctaataggtcaactaaacaagctaatctaatcactattcctaggaaattagagtggtccgttgattcgttcatcctttcatctatgcactttgctgaaactcgtgccagtgatttgatatctcagattgagttcgaatatttggacttcaaacagttcggcgccgcccatatcaaaaaccagttcaaatgctcaccagatgcgttcttgcaaatgtgttttcaaacagcttactatgctctatacggtaaatttgagacaacgtacgaaccagctatgaccaagttcttccaaaatggacgtactgaagccatcagaaccgtttctgatcaatcaaaatcgtttgtcaaatcattcttcaacacagcggtatcaaatcctgacaagataaagttactacaagaagcatgcaaacagcattcaaatgtgacaagagaatgttccatggggctgggtcaagaccgtcatttgtatgctctatactgcatttggaaaaaagtatttgcaaaagatcctaaggtcccattaccacaattattccaagacgctggctggtccaccttgaataccaacgtgattagtacttcaaactgtggtaacccttgtttgaaaaactttgggttcggtcccgtttgtagcaacggtttcggtatcggttacattattagaaatgataccctatctgtggttgtctcttcaagacacaggcaaacggctcgtttcgttgaattgatgcaaagattcttgctcgaaatcaacagaattgtccgcaacgaagaacaatcttccaaaacttcaatgggttccttgcaatcggataacatgaaatatttattaagtggatatgattactttgacgttagtgtaactggatag

SEQ ID NO: 2506 - protein, 692 aa, Kluyveromyces lactis
MPSIKDTNQEVLPRLPIPPLEDTLKRYLARLEPLQDSRSYEKTKRAVAESEQSLRIIDHELRKYDEHLAQREPMSSYIEQFWFDSYLEYDESVVLNLNPYFQLADDPTMNNVPKVSSRFSHFNRQVKRTSKLVVSMLKFVKAIRTGTLPTDNVRGKSMTMDQYGKLFGSSRLPPSLNDSTLSSCHLQTDPTSHHVVIMYKSQFYWFDVLDINNEPIFQQPEELEWNLYSIIMDSEQNSLDQNLQNSCPMGVFTTENRRVWSNVRDYISKSEDQTNWRNLKIIDSALFIICLDDSDLEGERDWIKSMICGTSKIDLNDKDEDKTKPSLGLQTGTCTNRWYDKLQLIVDRGGRAGINFEHTGVDGHTVLRMTMDIYTDSIVNFAQGITRNVPKVFEDDDDDRRANRSTKQANLITIPRKLEWSVDSFILSSMHFAETRASDLISQIEFEYLDFKQFGAAHIKNQFKCSPDAFLQMCFQTAYYALYGKFETTYEPAMTKFFQNGRTEAIRTVSDQSKSFVKSFFNTAVSNPDKIKLLQEACKQHSNVTRECSMGLGQDRHLYALYCIWKKVFAKDPKVPLPQLFQDAGWSTLNTNVISTSNCGNPCLKNFGFGPVCSNGFGIGYIIRNDTLSVVVSSRHRQTARFVELMQRFLLEINRIVRNEEQSSKTSMGSLQSDNMKYLLSGYDYFDVSVTG

SEQ ID NO: 2507 - DNA, 2034 bp, Kluyveromyces lactis
  CDS (1)..(2034)
atgagaagtatggcatttagaagcagtgctggtattagtatggggatgagacgcatgggtcaaggtaacaagaaaagttctatattgagacagatgtctggtaagatgcagtattcggggtatcagaagttcccttttgagaccgggactaacgatgagtatattgcagaaagacctaattcgtattatcaggagaagagacctgggttcaaaggagccacttactcaaaacaacaggatatgccatccttaccgattccggagttgaaatcgactttggacaaatatttgaagtctattaaaccgttttgtcagacggatgctgaatatgagaaacagatccagttatgttactcatttctttcagaccaaggccctgctttgcaggagcggttgttgagttattctcaggagcggagaaactggatgcaagaactatgggatagtcagatttatcttggcgataggtcacctgtggttccttttgtgtcatatttttatggtcataagcctttaccaactagtcaccgtgccatcgatggcgacatgcttgttaaggccacggcgattatttctagtgtggtgaagttcgtggaatccttgaaagatgaagccttgccagcagaagtggtgaagggcaaacctttctgtatgaacggattccaatatatgttcaataattcaagggttcctcaattcaatatcgatacgaaccatttttactcgatctatgaacatggctacttgacggttgcctacaaggataattttttcaaagtttatacacacgataaagctggggcagtcttgtccaacgcagtaatctaccaacagttgaatcaaattgtcaaccatttgggttcacagggttctttgatcaatgcaaacgctggaatcggtgcattgacaactcttcctcgtgatgaatgggctggcgcttatcaacaattgcaattagaaccagtatcttcctcctctttagaaaccatccacaaatcctcattcgtcttatgtttggatcaggacactgctccaataactttggaagataagtctagagtgtgctggcacggagacggaaccaatagattctttgacaagcctttgcaattttttgttactggtaacggtttctccggtttcttggcagaacattcgaaaatggatggtactccaactttgtttttaaaccattacgtcgtggatcaattaacaaaattgaatccttcagcgttcgtcgagtccttacattccaacgtatcagcttacccttctgtgaacagtgaacatctaccatttataattacaccaaccttgagaaatactatcgagagtgcaaaattgcaatttataacaacagtggaacgtgaagatttacgcgtttggcactataataggtatggtaagagaattgtgaaaacatttaaagtgtcaccagatgcttacattcaacaggtgattcaacttgctgttttcaagtatttgaagaaacaactaccaacgtacgaagctgcttctaccagagcgtttttccaaggtagaactgaaactggtagaccggtcactgaatcctcttccaagttcgttaaaacatgggaatcacctacttctactactgaagagaaaattgctgctttctacgatgctgccaaggatcatgttgaatatttgaagatggcctctaacggtgaagccgttgatcgccatttctttgggttgaaaaacatggttcatgaatctgatgagccagtacctttgttccaagacgcattgttcaaatacagttctacttggttgatttcaacttcacaattatcctctgaaaactttgaatgttacggttggtctcaagtatacgataatggatttggcttagcctatatgatcaataacgaatttttgcacattaatatcaccaacaaaccagaagcttctggatttagtgttgacgaactacactattatttaactaaggcggcagatgaaatgtatgaaactttgtctctacacaactctgccaaggccaaactatga

SEQ ID NO: 2508 - protein, 677 aa, Kluyveromyces lactis
MRSMAFRSSAGISMGMRRMGQGNKKSSILRQMSGKMQYSGYQKFPFETGTNDEYIAERPNSYYQEKRPGFKGATYSKQQDMPSLPIPELKSTLDKYLKSIKPFCQTDAEYEKQIQLCYSFLSDQGPALQERLLSYSQERRNWMQELWDSQIYLGDRSPVVPFVSYFYGHKPLPTSHRAIDGDMLVKATAIISSVVKFVESLKDEALPAEVVKGKPFCMNGFQYMFNNSRVPQFNIDTNHFYSIYEHGYLTVAYKDNFFKVYTHDKAGAVLSNAVIYQQLNQIVNHLGSQGSLINANAGIGALTTLPRDEWAGAYQQLQLEPVSSSSLETIHKSSFVLCLDQDTAPITLEDKSRVCWHGDGTNRFFDKPLQFFVTGNGFSGFLAEHSKMDGTPTLFLNHYVVDQLTKLNPSAFVESLHSNVSAYPSVNSEHLPFIITPTLRNTIESAKLQFITTVEREDLRVWHYNRYGKRIVKTFKVSPDAYIQQVIQLAVFKYLKKQLPTYEAASTRAFFQGRTETGRPVTESSSKFVKTWESPTSTTEEKIAAFYDAAKDHVEYLKMASNGEAVDRHFFGLKNMVHESDEPVPLFQDALFKYSSTWLISTSQLSSENFECYGWSQVYDNGFGLAYMINNEFLHINITNKPEASGFSVDELHYYLTKAADEMYETLSLHNSAKAKL

SEQ ID NO: 2509 - DNA, 1989 bp, Candida glabrata
  CDS (1)..(1989)
atgactgtaggcaccgaggaagagtacaagaacttccagacattggaaaggcttcctatacctcctctagaggccaccctcaagagatacattgacagaactgaaccactgctgggtagtgaagaagcacagaagactaaaaaagtagtctactcagagagtaacctcgaggtattgagctatttgcaggataaattgttagagtacgaaaactggctcgctacttttgaaccccagtcctcatacattgaacaattctggtacaatgcctatttgatgtatgactctccagtggttcttaacgttaacccattctttgagcttgaagatgaccctacacttgattattcgatgcgcacaggtgtattccaggaatacacattgcaaattaaaagggcatcccgagtggtaacatctgcattgcgttttgcgagtcagatcaggaataatacattaaagccagatattttgcggaatgatgtaccgctgtctatggaccagtaccaaaagttgtttggctcgagccggatcccgccaaaacctaagcagcagtcgtgccatttacagaccgactctacgtctcaccacatagttatcatgtacaaaggtagtttctactggtttgatgtcctggattgtcagaatgagctcatatttcaaagcgccgaagagatagagtggaatttgtactccataattatggatagagagaggctaaacaaggaaaaccacaaaggattcttggaaatgggtattctgactacagagagcagaagaacttgggccaacatccgtgaacacatacacaagcaggactctcggcaaaattggcagaatttgaagattatagacagcgctctatttgtcctatgtcttgatgactacgagtcacacctggatgatccaaactctttgttaaaattgtttctaacaggcacatctgagatagatttcaatagtcctttcgagattgatgagtacgtgcatgcaccaaaaaaccttcagcgaggaacatgcatcaacagatggtttgacaagttacagatcatagtcaccaaatgcggtaaagcaggtgtgaactttgagcacactggtgtagatggccatacagtgctgcgactagcgaatgagatatacactgatgcaattacaagctttgcacagacagtcacttcaagaacgccgaggaccttgccacaagcagacagtaacctgataacagtgcctagaaagctggagtggctgaaagacgagtatctgtgcagggcggtgcactttgcagaagtgaaatgtacagacttgatctcccagtatgagatagagagtctcgagtttggaggctatggttcagcgcggatcaagagcgttttcaagtgctcaccagatgcatttgtacagcagatgttccaagtagcgttctatgcactttacggtacatttgaaaccatatatgagcccgcaatgacgaagacctttcttaatgggcggactgaggctatacgaccagtgactcatgactcgatcaaatttgtcaaatccgtgttcaaccacaggagcacggacactgagcgtatagatcttctgcacagagcatgccaggagcacacgcgcatcacgagggagtgctccatggggatgggccaggacagacacctctatgcgttgcaatgcatatggcagaaactacaagctgagacgccagacgaccccatcacacactcgacaccaccgatcttcgaagacaacgcatggcacaaaattaacaagaacatcctgagcacttcaaactgcggcagtcctgcactgaaatggtttgggttcggacctgtggacaaggacgggttcggcattggatacattatcaaggacagcaagatcagtgtcacagtgtcctcgagacacagacagacagcacggttcatcaccatgctggacagagcacttaacgagctggacaccatattcaacagggcaccaaagactatatag

SEQ ID NO: 2510 - protein, 662 aa, Candida glabrata
MTVGTEEEYKNFQTLERLPIPPLEATLKRYIDRTEPLLGSEEAQKTKKVVYSESNLEVLSYLQDKLLEYENWLATFEPQSSYIEQFWYNAYLMYDSPVVLNVNPFFELEDDPTLDYSMRTGVFQEYTLQIKRASRVVTSALRFASQIRNNTLKPDILRNDVPLSMDQYQKLFGSSRIPPKPKQQSCHLQTDSTSHHIVIMYKGSFYWFDVLDCQNELIFQSAEEIEWNLYSIIMDRERLNKENHKGFLEMGILTTESRRTWANIREHIHKQDSRQNWQNLKIIDSALFVLCLDDYESHLDDPNSLLKLFLTGTSEIDFNSPFEIDEYVHAPKNLQRGTCINRWFDKLQIIVTKCGKAGVNFEHTGVDGHTVLRLANEIYTDAITSFAQTVTSRTPRTLPQADSNLITVPRKLEWLKDEYLCRAVHFAEVKCTDLISQYEIESLEFGGYGSARIKSVFKCSPDAFVQQMFQVAFYALYGTFETIYEPAMTKTFLNGRTEAIRPVTHDSIKFVKSVFNHRSTDTERIDLLHRACQEHTRITRECSMGMGQDRHLYALQCIWQKLQAETPDDPITHSTPPIFEDNAWHKINKNILSTSNCGSPALKWFGFGPVDKDGFGIGYIIKDSKISVTVSSRHRQTARFITMLDRALNELDTIFNRAPKTI

SEQ ID NO: 2511 - DNA, 2856 bp, Candida glabrata
  CDS (1)..(2856)
atgtctgaagaaggtacgttcgcacatgaggaaagtctacccaggcttcccttgccggatctagagtcctcctttgagcagttgaaagccagtttggaaccactttactatgctgacgggtactaccagcacccactggaccccgagcagatcgagtctctgtcctcgagtctgaccagattcgccacgtcggatgctgccaggaagttgcaagccaagttgaaagagtttgaagagaagaacagttgctacctagacaaattacatctcgatattaataaccagacgagtgcgaaagagatcgcagatgatgtgctgccaaggaacccattcttgattctcgctgatgacgcagtgccggacatatcacaagctgagagatccgctgtgctagtacactccgcactgcggtttatttccgctctaaagaacaacaagctgcctcctgatgtcaacacgaagaacggaaagtacttgtctatggaaccttacttgaatctgttcggtactacaagatgccccatctttgaagaaggtgaagtggaaaatttcgatctggacaaaccttacactgcgtctgacctcgatggctctgacgaaagctcagatgagttcgacgatgactatgaattcgaagctggtgaaggaacaaatgattttggtgataacaatagaagaagaaactctttcattggtgccggggatgatgatgacgggctagagcctaagaaattgatcgaggaagctaacaaagaagttgaagaagaagaacaaaaagccgaacatcaacgccgccccacaactgcatccactacaacaactattaacagtacacaatctgccggtgacaaagaagaagaagacgaaagactgggccaagaagtgttcaaacgccatggtatcacagttaaacgccaccatgattcaaaacatattctggtaatatctaagggccagtattatactgtcgatgtcctcgacgaagaaaataaaattctatacaatgcaactgcattgacatccatttttcaccacatactagatgatgctgagaaatcatactcatttaggaaatctacggcattgggtagtttgacttcgcactctttcaaaaattggaaatacgccagaaagagactacagaagagatatccaaacgaattacatttgattgattcagcattatttgttctggtattggatgaatcagctggtaacactgcagatgttgccgcagatgaagcagagctgaaaccaggctccatccaagccacttccaacacttgtaaaaggttgttctacggaactagtattattgataatggtggtcatcaaatcggttcctgtgtctctagatggtatgacaaattgcaattagtggtcaccgctgatgtcaaagctgcagtcatttgggactctttcacatgtgatggttctgtggtgcttaggtttacttctgaagcatacactgaatctattttaagattagctagagctgttaacgctggtgatcctaggttctcattgtggccatctgtagtagattctgtatgcgacaaagaaattgcaaagacagctggtgatattaagtctggtgaaataagtcctgacttgcttgttaacaaaattgattggtccttcagtaatattctaaacacacatgtgcatttgtctgagacgaagctagctgatttgatttcaaaacacaatattgtaagatcttctgttcccttaggaaggagatctgctcaaaaattgggtattaaccctgactccatgatccaagtggctttacaagtggccttctattcactatacggtaaaatggtatatggattcgagcctatttccacaagatgtttcaagaactctaggtcctcgttcattaatatccagaacaaagaactacttgagctttgccaattgttcatatctacttcaatggacggtctaggtaaattggataaattcatacaaagttgtcagaaacatacagaaactgtcagattgaccaaacaaggcaaagggtttgagaaacattttaatgcattgaagtacttgtacaaattccatgatctttatggcatcgagttaagtgaagaagataaacagatggctgcatctgtttttgaaagcgaagccatagcaccattctctgctccagaattaatcattgctaactgtggtaactctgctacgacaaccttcggtatcactcctgcggtaccacacgggtttggtatcggttacattatcaaggatgatcagtgcgatttgacagtaacttcccaatttagacaaggtagcagattactgttcatgctaaactgggttctgaatgagataagaagtttctggagaatggctcgtgccacttctcaaacaaagagtggtgttaaaattagtcctatggtggataggctgtatgagatggacaatgctttgaattcaaagaatcgtacgtcttccaacctgaacatgaacactgcatacggcttatttgacttggatgctcatgttgacagcagaagcgtttcaaaatctccatcgctaaagaacttacctgcgaagtttgctgagatgacacctttcaacccattggtgacagcgcattccagtctagcgctttcagttcctactgagaaggaaaagcacgatacaggtcaccagattttgcagtttcaaccaaagatcattggtgatgaaggcgacgatgacgacatagctcttccaagtgtggaagacatgaacttatcagcagcagatgctgccaagagacgtaatgttatcgactccaaatttgaaattgattttgacaggtcccgtgttggacgtaagattgttacatttgactag

SEQ ID NO: 2512 - protein, 951 aa, Candida glabrata
MSEEGTFAHEESLPRLPLPDLESSFEQLKASLEPLYYADGYYQHPLDPEQIESLSSSLTRFATSDAARKLQAKLKEFEEKNSCYLDKLHLDINNQTSAKEIADDVLPRNPFLILADDAVPDISQAERSAVLVHSALRFISALKNNKLPPDVNTKNGKYLSMEPYLNLFGTTRCPIFEEGEVENFDLDKPYTASDLDGSDESSDEFDDDYEFEAGEGTNDFGDNNRRRNSFIGAGDDDDGLEPKKLIEEANKEVEEEEQKAEHQRRPTTASTTTTINSTQSAGDKEEEDERLGQEVFKRHGITVKRHHDSKHILVISKGQYYTVDVLDEENKILYNATALTSIFHHILDDAEKSYSFRKSTALGSLTSHSFKNWKYARKRLQKRYPNELHLIDSALFVLVLDESAGNTADVAADEAELKPGSIQATSNTCKRLFYGTSIIDNGGHQIGSCVSRWYDKLQLVVTADVKAAVIWDSFTCDGSVVLRFTSEAYTESILRLARAVNAGDPRFSLWPSVVDSVCDKEIAKTAGDIKSGEISPDLLVNKIDWSFSNILNTHVHLSETKLADLISKHNIVRSSVPLGRRSAQKLGINPDSMIQVALQVAFYSLYGKMVYGFEPISTRCFKNSRSSFINIQNKELLELCQLFISTSMDGLGKLDKFIQSCQKHTETVRLTKQGKGFEKHFNALKYLYKFHDLYGIELSEEDKQMAASVFESEAIAPFSAPELIIANCGNSATTTFGITPAVPHGFGIGYIIKDDQCDLTVTSQFRQGSRLLFMLNWVLNEIRSFWRMARATSQTKSGVKISPMVDRLYEMDNALNSKNRTSSNLNMNTAYGLFDLDAHVDSRSVSKSPSLKNLPAKFAEMTPFNPLVTAHSSLALSVPTEKEKHDTGHQILQFQPKIIGDEGDDDDIALPSVEDMNLSAADAAKRRNVIDSKFEIDFDRSRVGRKIVTFD

SEQ ID NO: 2513 - DNA, 2052 bp, Ashbya gossypii
  CDS (1)..(2052)
atggcgcaaaacaacacgggcctcgatgacagccagctggaccggttgcccatcccaccgctggcggacacgctgcagcggtacctggatcggctggagccgctacaggaggagcacaagttccagaggacacttgctgcggtgcgggcgtcggaagaacagctgacgtgcctggacagacggctgcgacaatacgacagcgagctggcgttggtcgagccggcgacgacatatatcgagcagttctggtacgactcgtacctgcagaccgacgaatcggtggtggtgaacatcaacccgtacttccagctggcggacgatccgacgatgcagaacatctcgcggggcggcttaggggagcactccgtgcagataaaacgtgcgtcgaagctggtggtgtctattttgaagtttgtgagggcgatcaggcgcggctcgctgagcccagacacggtgcgcggcgtgcgcctgtcgatggaccagtacgcgaagctgttcgggtcttcgcggataccgccggggcccggagaggactcttgccatctgcagacagatcccacgtcgcaccacgtagtggtgatgtatcagtcgcaattttactggtttgatgttttggatgtcaacaatgagcctattttccagacgcctgaggagctcgagtggaacctgtactccataataatggacaaggagcgcgaacagggtgcgccttacccgtggggcgtgttcagcacagaggtgacgggggtgtggtctgcgattcgccagcacatagcaaatgcggaagatcacactaactggaacaacctgaagatcatagacagcgcgctcttcatcatatgcctcgacgatgtcgagatcgcagaaggagttgaaatggcgcagtccatgctgtgtggtacctctgacatccaggtcccaacgccatccgagttgaagcagaacatcaataacggtatcccatccggagtgcagcgtggcacgtgcctgaatcgctggtactgcaagctgcagctcatcgtcaccaaaaatggcaaggctgggatcaactttgagcacacatgtgtcgatggccacacggttttgcgtttggcgcgggatatctacacggacagcattctgaacttcgctcaggggattacaaaatcagtaccgactgtgttctcatctgagccatcgtcgtgcccgtataggaacggatcttcaggcgccaacttgatcaccatcccgaggcgactggagtggaaacccgactcttatctcttgtcctcgctgcacttcgctgagacacggttaagcgatatgctgtcacagtttgacttcgcggtggtggacttccgtcgctatggctccaatcacatcaagacacacttcaagacctcacccgacgcgttcatgcagatggcattccagacagcatattacgcattgtatggtaaattcgagatgacatatgagcccgctatgacgaaatcgttccgcaatggccgcacagaggcaatccgcaccgtctcgcatgcgtccaagacatttgtgaagtcgatgttcgacaacgttagcaccgataaagagaggatgcagctgctgcaaagcgcgtgcgctcaccactcaaaaatcacccgcgaatgtggcgcaggccagggccaggaccgccatctctacgctctttactgtctgtggaaaaataatctctgtgacgaaatactctccatccctctgttcgaagatccaggttgggagttgctcacgacgaacgtaatcagcacctctaattgcagcaactcctgcctcaagagcttcggctttggtcctgtgtgcgccaatggcttcggcatcggatatatcattcgcggtgacagcctttccattgtgatcacgtcacggcacagacaaaccaggagactggcttcgctgattgagcggtttctcaccgaactagagcgtaccgcccagcgggccagctccgaagccggcttacgcgccgaaaagtccaacgacctcaagtacttgctatccggttacgactatttcgatgtcagcatccttggctag

SEQ ID NO: 2514 - protein, 683 aa, Ashbya gossypii
MAQNNTGLDDSQLDRLPIPPLADTLQRYLDRLEPLQEEHKFQRTLAAVRASEEQLTCLDRRLRQYDSELALVEPATTYIEQFWYDSYLQTDESVVVNINPYFQLADDPTMQNISRGGLGEHSVQIKRASKLVVSILKFVRAIRRGSLSPDTVRGVRLSMDQYAKLFGSSRIPPGPGEDSCHLQTDPTSHHVVVMYQSQFYWFDVLDVNNEPIFQTPEELEWNLYSIIMDKEREQGAPYPWGVFSTEVTGVWSAIRQHIANAEDHTNWNNLKIIDSALFIICLDDVEIAEGVEMAQSMLCGTSDIQVPTPSELKQNINNGIPSGVQRGTCLNRWYCKLQLIVTKNGKAGINFEHTCVDGHTVLRLARDIYTDSILNFAQGITKSVPTVFSSEPSSCPYRNGSSGANLITIPRRLEWKPDSYLLSSLHFAETRLSDMLSQFDFAVVDFRRYGSNHIKTHFKTSPDAFMQMAFQTAYYALYGKFEMTYEPAMTKSFRNGRTEAIRTVSHASKTFVKSMFDNVSTDKERMQLLQSACAHHSKITRECGAGQGQDRHLYALYCLWKNNLCDEILSIPLFEDPGWELLTTNVISTSNCSNSCLKSFGFGPVCANGFGIGYIIRGDSLSIVITSRHRQTRRLASLIERFLTELERTAQRASSEAGLRAEKSNDLKYLLSGYDYFDVSILG

SEQ ID NO: 2515 - DNA, 2535 bp, Ashbya gossypii
  CDS (1)..(2535)
atggtagaggacgatagtgcacccgctatggagttgacgtttgcacatgagacaaggttgcgcaagctgccgctccctgggctgaggtctacagcttcattgttgactgcagcgctggagccatttcatagtggtggcacacatgatggtggtggcgcggacgtcgagttggcaagctacctgggttctctagcagactcgagcggagcgctgaagctgcaagcgaagttggaggaattcgacaagcacagcgcgtgctatctggaccggctgcatctcaatatccacaaccatgttgccggcaaggaaatatcgcaggatatcctgccacgaaatccgttcctagtactggcggaagatgcagagatcgatatcagccaggaggatcgtgccggcgttctttgctactccgccctgcgctttgtgtcggcagtgcggcggcagcagctacctcctgaccacagccgtggccaggccttgtctatgaagccgtatctgaacctctttggcacaacgaggtgtcccattttcgaaccaggtgaggtggagtcattcgatttgaataagccttactccgagagtgatgtagaggcagagacccgaagcgatctgatggagcctgcgactaaagttacatctccagatgacagaccacggtcagagggcagcgacgagccgttcaaccaccatggtatcagcatgaaacagtaccccgcgtcaaagcacattttgatactttccaaggggcagtattatacgctggatgttctggatgacgatcataggattctctatacggacaaggatatggcaaaagtgtttgcatcggtcttggaagactcccggaagtcgtatagtgtggacagatccactgcactaggcagtcttacctcttattcttttaggaactggaagtatgcccgtaagcgccttcagaagcggtttcctgttgaattagaaatgatagattccgcgttgtttgtcatagtaatggatgaatctgatcgctcggacgaagaccaatcttacgccaagcggctattttacggtacgagcgtaattgatgaggtgactggtctccaagttggttcttgtacaacccggtggtacgataagttgcagcttgttgttactgctgatgcaaaggcttgtattatttgggattcttttacctgcgaggggtctgctgtgttgcgttttacctctgaggtatatgctgaatccgtgatgcgcttggctagagatgtcaatgagaattcgtctgcattttctttatggccatcgattgagacacggcgtatattggatgtgggagacaatgcggacaagtttttaaggaaaattgagtggtctttcctcaatgagatgaatacccacattcatctctcggaaaccaaactatcggatattatctcgaagcatgatattataaattacacgctcccgtttggccgtcacattgcgcgccggctcaatattcgtcctgattcgatgatacaggttggcctacaaattgcacattacgcactttatgggaaaattatatttgccctggaacctgtttctgttcgatctttccaaaattctatgtcagccttcataccgatccagagtacgaagcttgcagagctctgtcgacagttcatttcgaattctttggatacatcgctaaaatacatgcagttcatcgaagcttgccgtgcccacagtgagctcattgaacaggctaaacagggacacgccgccgagaaacactttaatgcattgcggcaccttttcaagttccggcgtcattttggtatcgatttagacgtagatgaaattgaacagttgtctggtcttttcgatagcccacaactggtgcctttctttactcccgagatgattgcttcaaattgcggaaacgcagccatgacaatgttcggagttacacctgcaatgagacaaggattcggaattgggtacatcctgaaaaatgaacaatgcgacctgacggtaatttggcagtaccggcagggcaaacgtttaatgttcatgcttgaatgggttctcacagagatatgcgagtattggaagtcaacgcggaagcatagtgaggacattaaaattagtccgacggtagatttgctttacggaattgataacgccctaaaatcagagaaagtggagcggtcagaaagaagaccttctgctttttataatggagggtacggtctttttgatttgaaggggcatgttgaatcaaggagcagcgtgtgctccacccctgtctcacgctctggttctcacctgaaactgaccgaactgatcacgtctctgtcttttaacaatgtcaacgctttgaccacggaggaagacaaacaagttactggctatgaaattgcaaaaatagatcagccaaagtccagttccccagatacagacgaactagcgaccgatgataagccaagtagaaagagcaacgttatcaattctaaatttgtcattaattttgacagatccagcgtaggccgcaaggtgaacacatctgattga

SEQ ID NO: 2516 - protein, 844 aa, Ashbya gossypii
MVEDDSAPAMELTFAHETRLRKLPLPGLRSTASLLTAALEPFHSGGTHDGGGADVELASYLGSLADSSGALKLQAKLEEFDKHSACYLDRLHLNIHNHVAGKEISQDILPRNPFLVLAEDAEIDISQEDRAGVLCYSALRFVSAVRRQQLPPDHSRGQALSMKPYLNLFGTTRCPIFEPGEVESFDLNKPYSESDVEAETRSDLMEPATKVTSPDDRPRSEGSDEPFNHHGISMKQYPASKHILILSKGQYYTLDVLDDDHRILYTDKDMAKVFASVLEDSRKSYSVDRSTALGSLTSYSFRNWKYARKRLQKRFPVELEMIDSALFVIVMDESDRSDEDQSYAKRLFYGTSVIDEVTGLQVGSCTTRWYDKLQLVVTADAKACIIWDSFTCEGSAVLRFTSEVYAESVMRLARDVNENSSAFSLWPSIETRRILDVGDNADKFLRKIEWSFLNEMNTHIHLSETKLSDIISKHDIINYTLPFGRHIARRLNIRPDSMIQVGLQIAHYALYGKIIFALEPVSVRSFQNSMSAFIPIQSTKLAELCRQFISNSLDTSLKYMQFIEACRAHSELIEQAKQGHAAEKHFNALRHLFKFRRHFGIDLDVDEIEQLSGLFDSPQLVPFFTPEMIASNCGNAAMTMFGVTPAMRQGFGIGYILKNEQCDLTVIWQYRQGKRLMFMLEWVLTEICEYWKSTRKHSEDIKISPTVDLLYGIDNALKSEKVERSERRPSAFYNGGYGLFDLKGHVESRSSVCSTPVSRSGSHLKLTELITSLSFNNVNALTTEEDKQVTGYEIAKIDQPKSSSPDTDELATDDKPSRKSNVINSKFVINFDRSSVGRKVNTSD

SEQ ID NO: 2517 - DNA, 1830 bp, Neurospora crassa
  CDS (1)..(1830)
atggcgcaaacaaggaagaacagctccctccccgccggctatgtcgaggacaagtccaaaggccccatgctccgcttccaggagtctctcccccgtcttcccgtccctaccctcgaggagacggctgcccgctactaccagtctttgaagccccttctcagtccccaggagctcgagaacagtaagaaggccattgacgccttcattgcccccaatggccctggtcgcaagctccaggagaagctggtcgcccgtcgcgaagaccccaagcacaagaactggctctacgagtggtggaacgatgcggcctacctctcctaccgcgaccccgttgtcccctacgtcagctacttctactctcaccgcgatgaccgccgccgccgcgaccctgccaagcgcgctgctgccatcaccaccgccgctctcgagtttaagaagatggtcgaccagggcactctcgagcccgagtacatgaagaagctccccatctgcatggactcttacaagtggatgttcaacgccagccgcgttgctgccaagcccgccgattaccccgtcaagttcagcgccgacgagcacaagtacatcctcgccatccgcaagaaccagttctacaagatctaccatgaggttggcggcaagcagctcaacaccgctgagctcgagcaggccttcaagcgcgtctatgagctcgctgcctcgcgcgctcccgctgtcggtgctctcacctccgaaaaccgcgacgtctggaccgacgcccgcgctactctcctctccgccgaccccaagaatgctaaggctctcgaggccattgaggcttcttccttcgtcgtctgccttgacgatgccgcccccgtcaccctcgaggagcgcgctcaccagtactggcacggtgacggccagaaccgctggtacgacaagcctctccagttcatcgtcaacgacaacggcacctcgggtttcatgggcgagcacagcatgatggacggcacgcccactcaccgcctcaacgactttgtcaacgacgtcattttcaacaacaagctcgacttctccgacccctcggtgcgctccaacctgcccgagcccgaagccgtcaagttcaccgtcaccaaggaggtccaggccgagatcgaccgggccattactgacttcagcaacgtcatcggccagcaccagctcgcggtgcaggccttccagggctacggcaagggtctgatcaagaagttcaagtgctcccccgacgcctacgtgcagatgatcatccagctggcctactacaagatgtacggcaagaaccgtccgacctacgagtcggccgccacccgccgcttccagcagggtcgcaccgagacgtgccgctccgtcagcgaggccagcgtggccttttgcaaggccgccaacgacgcgagcgtcgacgacaagaccaaggtcgagctcttccgcaaggccattgactcccacctcgagtacatctcggccgcctcggacggcaagggcgtcgaccgccacttgtttggcctcaagcgcctgctcgagcccaaccaggaggtccccgctctgtaccaggatcccgcctacggatactcgagttcgtggtacctgtctacttcccagctgagctccgagttcttcaacggatacggatggagccaggttattgaccagggattcggtattgcttatatgatcaacgagaacagcctcaactttaacattgtctccaagggcctcggctccgacaggatgagctactacctcaacgaggccgccaacgacctccgcgatctccttacccccactctggaggctcccaagtccaagctctaa

SEQ ID NO: 2518 - protein, 609 aa, Neurospora crassa
MAQTRKNSSLPAGYVEDKSKGPMLRFQESLPRLPVPTLEETAARYYQSLKPLLSPQELENSKKAIDAFIAPNGPGRKLQEKLVARREDPKHKNWLYEWWNDAAYLSYRDPVVPYVSYFYSHRDDRRRRDPAKRAAAITTAALEFKKMVDQGTLEPEYMKKLPICMDSYKWMFNASRVAAKPADYPVKFSADEHKYILAIRKNQFYKIYHEVGGKQLNTAELEQAFKRVYELAASRAPAVGALTSENRDVWTDARATLLSADPKNAKALEAIEASSFVVCLDDAAPVTLEERAHQYWHGDGQNRWYDKPLQFIVNDNGTSGFMGEHSMMDGTPTHRLNDFVNDVIFNNKLDFSDPSVRSNLPEPEAVKFTVTKEVQAEIDRAITDFSNVIGQHQLAVQAFQGYGKGLIKKFKCSPDAYVQMIIQLAYYKMYGKNRPTYESAATRRFQQGRTETCRSVSEASVAFCKAANDASVDDKTKVELFRKAIDSHLEYISAASDGKGVDRHLFGLKRLLEPNQEVPALYQDPAYGYSSSWYLSTSQLSSEFFNGYGWSQVIDQGFGIAYMINENSLNFNIVSKGLGSDRMSYYLNEAANDLRDLLTPTLEAPKSKL

SEQ ID NO: 2519 - DNA, 2388 bp, Candida albicans
  CDS (1)..(2388)
atgtcaacttatagatttcaagaaacattggaaaaacttcctattcctgatttagttcaaacttgtaatgcatatctcgaggcattaaaacctttgcaaactgaacaagaacatgaaaataccaaaattgccgtggacaaatttctcaatggtagcaattccaaaaccactaataatggagtggttacaggaagtggtattggtcattatttagatcgagaattgcgtcaatatgctaaaactagacctagttatatcgaacaattttggtatgattcatatttgaattatgattcccccgttgtattaaatttaaatccattttttcttttagaagatgatccatttactaatgaatcaagtagtattaatcctcaagttaaacgtgccaccaatttaactttatcatcattaaaattcattcaagcattgaaaaatgaaactttaagcgttgatacattgaaaaatgggaaaccgttatgtatgtatcaatatactaaattatttggtgcttcaagaattccatctcaagaaggatgtatgatgcaatctgatccattatcgaatcatattgttgttatgtcaaagtcgcaattttattggtttgatgtattggattctcataataatttgatattaaatgaagcagaattgaatattaattttaattcaatcattcgtgattctttaaatactccttcagatgaaattgctaaatcgtcgtttggggtattgactacggaaaatagacgtgtttgggctaatgtcagaaacaatttgattggtaataataccattaatcgtgaggtgttatcgattattgattcagcattatttattttatgttttgatgatattgccattgatgatttatcagaattgtcgaaaaatatgctttgtggattatctatattagataatggtatccaagttggtacttgtactaatcgttggtatgataaattacaaattattgttaccaagaatgctaaagcagggattaattttgaacatactggtgttgatggtcatactgttttacgatttgtaagtgatatttatactgattcaattttatcctttgctaattccattaacaacaatgctccttcattatggaaatccactaccaaaaatgatgttcccgattatgaattggaagaagaattaattactattccacgtaaattggaatgggatttaacacctgatttatcattggttttaagatttggtgaaactagattgtcggatttaatcaatcaaaatgaattccgtcatttagaatttaaaaattatggttcttctcaaattaaaaaaatgaaattttcaccagatgcttttgttcaaatggcgttccaagcaacttattatgctctttatggtaaagttgaatgtacttatgagccagccatgaccaaacaatattatcatggtcgtactgaagccattcgtacagtttcccaagaatcaaatttatttgttcgaaaattttttgattcaacagtatcaatgaaggaaaaattacaatatttatctgatgcttgtaagaaacattctgaaaagacaagaatgagttctatgggtcaaggtgttgatcgttacttatatgcaatgttttgtatttggaaaagatatttacaagattatgaagaagagcaacaacaacaacaacacccagttgaagaaggaagtggtggtgaacaacagatggaagcagtagggttatctagagatgataccatagttgttcaaatggatggtgaacatgacgatgatgattcaacaactgttgttggaaccaatggtggtaaaaaccttcatgcatctggatctcatggtaataacgatatctatgataattttgatttattaaaaacagtaccagaattatttgctgattcaggttgggataaattaaacagcacaattatttctacatccaattgtggtaatccatcgttaagattgtttggatttggtccagtttctgctaatgggtttggtattggttatattcttaaagatgattcaatttcaatttgtgctagttccaaacatcgtcaaactcaaagatttttggtgacattgaattcgtatttattggaaattcaaagtatttggaaacaagtggaaaccatgaataaattgcaggatgaattggcattgaagattgatattagtaaaaaacaaaaagaaacagaagaggaacaagctagaccaaaacacaatattaatgcattattgggaggttatggatattttgatatgggcgaagaagatattaaaagtagaggacaatctcctgaaccaccatttttaaaccgagcaaattcaagttttagtgttcgtgaaattggtaaaaaattacgattaagtgaatattaa

SEQ ID NO: 2520 - protein, 795 aa, Candida albicans
MSTYRFQETLEKLPIPDLVQTCNAYLEALKPLQTEQEHENTKIAVDKFLNGSNSKTTNNGVVTGSGIGHYLDRELRQYAKTRPSYIEQFWYDSYLNYDSPVVLNLNPFFLLEDDPFTNESSSINPQVKRATNLTLSSLKFIQALKNETLSVDTLKNGKPLCMYQYTKLFGASRIPSQEGCMMQSDPLSNHIVVMSKSQFYWFDVLDSHNNLILNEAELNINFNSIIRDSLNTPSDEIAKSSFGVLTTENRRVWANVRNNLIGNNTINREVLSIIDSALFILCFDDIAIDDLSELSKNMLCGLSILDNGIQVGTCTNRWYDKLQIIVTKNAKAGINFEHTGVDGHTVLRFVSDIYTDSILSFANSINNNAPSLWKSTTKNDVPDYELEEELITIPRKLEWDLTPDLSLVLRFGETRLSDLINQNEFRHLEFKNYGSSQIKKMKFSPDAFVQMAFQATYYALYGKVECTYEPAMTKQYYHGRTEAIRTVSQESNLFVRKFFDSTVSMKEKLQYLSDACKKHSEKTRMSSMGQGVDRYLYAMFCIWKRYLQDYEEEQQQQQHPVEEGSGGEQQMEAVGLSRDDTIVVQMDGEHDDDDSTTVVGTNGGKNLHASGSHGNNDIYDNFDLLKTVPELFADSGWDKLNSTIISTSNCGNPSLRLFGFGPVSANGFGIGYILKDDSISICASSKHRQTQRFLVTLNSYLLEIQSIWKQVETMNKLQDELALKIDISKKQKETEEEQARPKHNINALLGGYGYFDMGEEDIKSRGQSPEPPFLNRANSSFSVREIGKKLRLSEY

SEQ ID NO: 2521 - DNA, 2418 bp, Aspergillus fumigatus
  CDS (1)..(2418)
atggaagccccccggtctcaaccaagcgtcgatgctagggttaatgcctccaacccaacatcagtgaacggcggatcagccccggctcagtcccgtgagaaaaagggcttgacatttgccaaccaggactcactgccaaagttgcctattcctgaccttgagagcacatgcaagaaatacttagaagcactatcagctttgcaaaccccacgagagcaggaagaaacaaaggctgctgttcaggagttcctcaaaacagacggccctattcttcaggagaagttgaagaattatgcctcgtccaaaacgagttacattgaacagttctggtacgactcttacttgaactatgacaatcctgttgtcttgaatcttaatccgttctttttgctggaagacgaccccacgcctgccaggaacaatcaggtgactcgggccgcgtctcttgtcgtatctgctctctcctttgtccgggctgtcagaagggaggaactaccacctgacacggtccgaggcacaccactatgcatgtaccagtactctcgactattcggaactgcgcgtctacccacggacaatgggtgtatcatcagccaggacccgcacgcaaagcacatcgtggttttgtgccggggtcagttctactggtttgatgttcttgacgataacaacgacttgatcatgagcgagaaggatatcgccgtcaatctgcaggtgataattggcgatgccgaacagaccccagtacaggaggccgcaaagggtgcccttggtgttctcagcaccgagaatcggaaagtatggtcgggtctgagagatatactaaccaaggacgaggggtctaacaactcggagtgcctaaacattgtcgacacagcattgtttgtcctctgtctggacgacacagaaccggaaaatacgtcgcagctttgcgccaacatgctctgtggtacgagcgaggtcgtcagaggtgtccaggttggtacctgtaccaaccggtggtacgacaaactgcagattattgtgtgcaagaacggaagtgctgggatcaactttgaacacactggtgtcgacggccacacggttctgcgcttcgctagcgacgtttacacagatacgatccttcgtttcgctaaaaccatcaacggtcaagccccgtcgctctgggcaactgccagccctgatccttcaaagcgggaccccaagagctttggcaatgtcagcacgacaccgcgaaagctcgagtgggacatggttcctgagttgagcattgccttgcggtttgccgagtctcatcttgccgatctccttcaacagcatgaattcgctgttcttgactttgaaggatatggcaaaaatttcatcacttcgatgggcttctctccggatgcctttgtgcagatggcatttcaagccgcttattatgggttgtatggtcgcgtcgaaaacacctacgagccggcaatgaccaaattcttcttgcatgggcggacagaagccatccgaacggtcaccaatgagtgtgttgactttgtgaagaccttttggggcgacaaccctgcggagcagaaggtcaacgctcttcgtaaggcgactgaaaagcacaccgccatcaccaaggaatgctccaagggccggggtcaggatcgccacttgtacgccctgtattgtctttggcaaagatcatttgacgaggacagtccgtcagcgggcaatagcgttgaaaatggatccaacggatactcgagccccgttgagaacggatcggcgatcggttctcccaaaacgtcgtcctccatgtctgaggatggcctctcctcgaacggctatagctaccgcggtatccgcacactgcagcccactccggccatcttcagtgaccccggctgggacaaaatcaacaacacgatcttgtcaacatccaactgcggcaacccgagtctgaggcatttcggtttcggaccgacatccgcagatggatttggtatcggttacatcatcaaagacgattctatctcgatctgtgcctcgtccaagcaccggcagaccgcccggttgatgcaaacactggagtcgtatttgtacgagattcggaagctgctccgagccaccaacagtaaggcggtcagccctcgcacaagcagggcacgcgagatggagatggttgccgaacggttccaaaatgatcatcgtcggggccggctagtgcgtggcgactctggtttggtgcgacggggcacggatacgccaactacggacagtggcgatatcgaggatgatggcatgggtggatatggcttctttgactcgggcatgctgcttcatgctctaaaaggattgagtgtcgaccgagagcgggccgataagcctgcaaaacgtcggttcatcggaaagaagctgcggttaaacgaaatctga

SEQ ID NO: 2522 - protein, 805 aa, Aspergillus fumigatus
MEAPRSQPSVDARVNASNPTSVNGGSAPAQSREKKGLTFANQDSLPKLPIPDLESTCKKYLEALSALQTPREQEETKAAVQEFLKTDGPILQEKLKNYASSKTSYIEQFWYDSYLNYDNPVVLNLNPFFLLEDDPTPARNNQVTRAASLVVSALSFVRAVRREELPPDTVRGTPLCMYQYSRLFGTARLPTDNGCIISQDPHAKHIVVLCRGQFYWFDVLDDNNDLIMSEKDIAVNLQVIIGDAEQTPVQEAAKGALGVLSTENRKVWSGLRDILTKDEGSNNSECLNIVDTALFVLCLDDTEPENTSQLCANMLCGTSEVVRGVQVGTCTNRWYDKLQIIVCKNGSAGINFEHTGVDGHTVLRFASDVYTDTILRFAKTINGQAPSLWATASPDPSKRDPKSFGNVSTTPRKLEWDMVPELSIALRFAESHLADLLQQHEFAVLDFEGYGKNFITSMGFSPDAFVQMAFQAAYYGLYGRVENTYEPAMTKFFLHGRTEAIRTVTNECVDFVKTFWGDNPAEQKVNALRKATEKHTAITKECSKGRGQDRHLYALYCLWQRSFDEDSPSAGNSVENGSNGYSSPVENGSAIGSPKTSSSMSEDGLSSNGYSYRGIRTLQPTPAIFSDPGWDKINNTILSTSNCGNPSLRHFGFGPTSADGFGIGYIIKDDSISICASSKHRQTARLMQTLESYLYEIRKLLRATNSKAVSPRTSRAREMEMVAERFQNDHRRGRLVRGDSGLVRRGTDTPTTDSGDIEDDGMGGYGFFDSGMLLHALKGLSVDRERADKPAKRRFIGKKLRLNEI

SEQ ID NO: 2523 - DNA, 2757 bp, Neurospora crassa
  CDS (1)..(2757)
atgactcttactgaagttcgcactttcactcctccgagagctttcggtgacgctatcagccaaccagttgtcacaccagttatcacaacttcgacaacaccgcgctccatccccgaactccagatcacactcaagcccgccatcagcccatcaccaaaagcacgtcagaacagcatggcctctactcccgaagaaaagtccaaaggcggcgtaacatttgcccaccaggacaagctccccaagcttcctatcccagaactcgaaagcacctgccagagatatctcgcctccctaaaaccgcttcagacccacagggaacatgccgagacaaggcgcgccgttcaggagtttcttcaaacagatggccccgagctgcatgaaaagttgaagaaatacgctgaggaccaaacaagctatatcgagcagttctggtatgattcgtacctcaactacgacaaccccgtcgttctcaacttgaatccctttttcttgctcgaagatgatccgacaccggctcgcaacaaccaagtcactcgggccgcctccttgattgcgtcggctttggagtttgtaagggcagtccgcagggaggagcttccaccagacacggtccggggaacccccctagacatgtaccagtactcacgcctctttggtaccgctcgtgttcccaccgattccggatgccagattcagcaagatgacaagacgaagcacattgtcgtcatgtgccatggccagttctactggttcgatgttttggacgataactctgatgccatcatgaccgagaaggatatcgccatcaacctccagaccattgttgacgacgcccgacaaacccctatccaagaggctgccaagagtgccctcggtgtgctgagcacagagaaccggaaggtctggtcgggacttcgtgacgttctgacgagtgatcccggttccaacaacgccgactgcctgagcatagtcgacagtgctctcttcgttgtctgcctggattatacggaaccaaccaccgctgctgctctttctcagaacatgctctgtggcactagcgagattgagaagggagttcagattggcacctgcaccaaccgctggtacgacaagcttcagatcatcgtgtgcaagaacggcagcgccggtatcaactttgagcacaccggtgtcgatggtcacaccgtgctgcggtttgccagcgacatctacaccgacaccattctccgctttgcccggtctatcaatggcaaggctccctcgatgtgggcttcaacgagtcccgacccgtcgaagcgtgaccctgagagcttcggagacgtgagcaccaccccccacaagctcgagtgggacatgggtcccgagctcagcgtggctgtccgcttcgctgagacccgcctggccgatctcatagagcagaacgagttccaatgtctcgacttccacggctacggcaagaacttcatcacctccatgggcttctccccggacgcctttgtgcagatggccttccaagcagcctactacggcctctacggccgcgtcgagtgcacctatgagcctgccatgaccaaaatgttcctgcacggccgcaccgaggccatccgcaccgtctcggacgactcagtcaactttgtccagactttctgggctgacgcccccggcgacgccaaaatcgacgccctccgcaaggcctgccaggcccacgtcaacaagacccgcgactgcgcgaaagcccagggctgcgataggcacttgtacgccatgctctgcctctggcagcggatgcaggatgacgacgctgccagcaccaccaccgacaacagcatgaatggctattcttttgaagacggctccatcatcggctcgccatccaaggactccgtcttctcccaatccatggagtctcagtctgtcaacggcggtggtcgcgaacgtggcgactccatcaactcccacatctccgccaccccctcccaacgcggtggtgtacctcaaccactacccgccatcttcgccgacgccggctgggacaaactcaacaccaccatcctgtccacttccaactgcggcaacccgtccctccggcactttggctttggccccgtctccggcgaagggttcggtatcggctacattatcaaagatgagtgcatctccatctgcgtgtcgtctcgccatcgtcagacccgccgcttcgttgacactctggaatcctacctgcttgagatccgccgtattttgcgcatcgctgcaaggaacgccgcctccgccggtggtgttggtgccaccggtactaccggaaacaagggtatgagcagggctcgggagattgacgcggctgctatcaaccagaatggacaggaaaagctggctcgccccaagatcgggaacaggattaagtcgagggggaggttgatcacgggtcaaagcagcgggcttatgggtcacggaggaccaacgagcatgtacaccaatggaggcggcagcagtgtggggaacattaagggggcgggagggggcagtgttagtagcgcgatggaggagagcgtggtgatgagtgaggatgatgagattggtggttatggcttcttcgacgccggtatgctgcagcaagcgctcaaggcgcgccaacaggctcactaccaccatcattcccacaaccatgatagcagcagtgatgaccggagtaatcagagcagacaaaggaggagcaggagggatgtgggcaagaagttgcctttgatcgattactag

SEQ ID NO: 2524 - protein, 918 aa, Neurospora crassa
MTLTEVRTFTPPRAFGDAISQPVVTPVITTSTTPRSIPELQITLKPAISPSPKARQNSMASTPEEKSKGGVTFAHQDKLPKLPIPELESTCQRYLASLKPLQTHREHAETRRAVQEFLQTDGPELHEKLKKYAEDQTSYIEQFWYDSYLNYDNPVVLNLNPFFLLEDDPTPARNNQVTRAASLIASALEFVRAVRREELPPDTVRGTPLDMYQYSRLFGTARVPTDSGCQIQQDDKTKHIVVMCHGQFYWFDVLDDNSDAIMTEKDIAINLQTIVDDARQTPIQEAAKSALGVLSTENRKVWSGLRDVLTSDPGSNNADCLSIVDSALFVVCLDYTEPTTAAALSQNMLCGTSEIEKGVQIGTCTNRWYDKLQIIVCKNGSAGINFEHTGVDGHTVLRFASDIYTDTILRFARSINGKAPSMWASTSPDPSKRDPESFGDVSTTPHKLEWDMGPELSVAVRFAETRLADLIEQNEFQCLDFHGYGKNFITSMGFSPDAFVQMAFQAAYYGLYGRVECTYEPAMTKMFLHGRTEAIRTVSDDSVNFVQTFWADAPGDAKIDALRKACQAHVNKTRDCAKAQGCDRHLYAMLCLWQRMQDDDAASTTTDNSMNGYSFEDGSIIGSPSKDSVFSQSMESQSVNGGGRERGDSINSHISATPSQRGGVPQPLPAIFADAGWDKLNTTILSTSNCGNPSLRHFGFGPVSGEGFGIGYIIKDECISICVSSRHRQTRRFVDTLESYLLEIRRILRIAARNAASAGGVGATGTTGNKGMSRAREIDAAAINQNGQEKLARPKIGNRIKSRGRLITGQSSGLMGHGGPTSMYTNGGGSSVGNIKGAGGGSVSSAMEESVVMSEDDEIGGYGFFDAGMLQQALKARQQAHYHHHSHNHDSSSDDRSNQSRQRRSRRDVGKKLPLIDY

SEQ ID NO: 2525 - DNA, 2239 bp, Drosophila melanogaster
  CDS (76)..(2079)
tggactttgaaacgtcgcctctcgagtttaaacaacaaaagttactcaatttggaaagccatcgagtggatagccatgtttcggacccgggtgcaccgcaatctgtcgtggatatcgacgaactcgtcgaggacaacgaccactcatggccagcactaccaatacctgcaatgttccaagctgccaacgctgtactttcagcgctccttgccgcgattgcccattcctctgttggagaacagctgtcggcgtttcctggaggccaccaagccactactctcgccggcggagcaggcgcagacccagcaaacggtggaacagtttcgccaggggatcggcatggaactacacgcgaaactcaagagccatgatgcagagaacaagcataccagctacatctcgcagccctggttcgacatgtatctagccgatcgagcgcccctgccactcaactataatccgctgctggtgatgaaaagcgacgcgcgaccggagtaccagcaacaggtggttagggctaccaacctgatcatcagctcgttacggttctggcgatctctgcaggcggatctcctggagccggaggtgtaccacatgaacgccaagaagagcgacacttccagctaccgcaggtggatgaaggtggctcccaaagcctttgccacctacgcgtcttatgccttcaaggcctttccgctggacatgagccagtacaaccggttgtttggcacctctaggattcctaggatcggcaaggacgagctggtccagtcaccggacgccaagcacattctggttatgcgccgcggtcacatgtacgccgtaaatgtgctggactccagtggatacatcgagagtcccagtgtgattctgggcagactaagggctgtgcttaagcttgatgcagatcgcgaggcagccagcgtgccacttggtgttctgacctccggacagcgtgatgagtgggccaagacaagacagcattttgttagcaacaccaaaaatgccgatcttctggagagagaggtggatgcggctctgttctgcgtttgtctggatggcgaagaagatggagtctttaacgaaaaccagcaggagccgctgctcaagcatttgctggcgggaaaagcgcagaatcgttggttcgacaaatccatttccctgcttataagtgcagatggaacaacggctattaacttcgagcactcgtggggcgatggagtggctgtgcttcgctactttaacgagctctacaaggatactttgaagcagccgtttgtatccacggagacagtgcacactcccgccgaaggcgattttagcaacgtgcggcccatcaacttcgaaatcgacgatgccaccaagtcggccgtttcggaggcttataataaaaacgccagcattgtagataatctggacatgaatgtgctgaagtacccacacatcaacaagcccacatgcaagcagtatggcctaagtccggactccatcattcagctgtccttccagctggcttatcgccaagcctacagcggctatgtgggcagctacgaatcctgcagcacatccgccttccgacacggacgtaccgaaacgatgcgaccgtgcacaaatgccacacgggacttctgtgaagctatcctccagccggagaggagcaagcccagcgccggagaactacgagcaatgatcgacaattgcagcaaggtgcatggccagttaaccaaggaggcggctatgggccagggcttcgatcggcatctctttgcccttcggcacacggcccaaaaggagggaataccaattcccgatctctatgagactgaggcttacaagcgcattaataacaacatcattagtacctcaacactgggttcagatgccctgctagcgggttcctttggtccggtggtcaagaatggcttcggaatcggctattcgattcagaacgattttgccggcgccattgtcaccacgtacaaaaaccaggccgatgggaaggtgttcatagacagtctggaatcggcatttgataaaatttgcgctgtcatccagcagagcagcagtagcaagaagtaggagaaaatcgtgaggagtccgaccccgaatccaatgaatatggctttaacgtaacagggagatttattttgatgcttttacattgtatcccatgtgtctgaattgcaatatctttatctacaatttatagattatacactgaaaacattctaccccatct

SEQ ID NO: 2526 - protein, 667 aa, Drosophila melanogaster
MFRTRVHRNLSWISTNSSRTTTTHGQHYQYLQCSKLPTLYFQRSLPRLPIPLLENSCRRFLEATKPLLSPAEQAQTQQTVEQFRQGIGMELHAKLKSHDAENKHTSYISQPWFDMYLADRAPLPLNYNPLLVMKSDARPEYQQQVVRATNLIISSLRFWRSLQADLLEPEVYHMNAKKSDTSSYRRWMKVAPKAFATYASYAFKAFPLDMSQYNRLFGTSRIPRIGKDELVQSPDAKHILVMRRGHMYAVNVLDSSGYIESPSVILGRLRAVLKLDADREAASVPLGVLTSGQRDEWAKTRQHFVSNTKNADLLEREVDAALFCVCLDGEEDGVFNENQQEPLLKHLLAGKAQNRWFDKSISLLISADGTTAINFEHSWGDGVAVLRYFNELYKDTLKQPFVSTETVHTPAEGDFSNVRPINFEIDDATKSAVSEAYNKNASIVDNLDMNVLKYPHINKPTCKQYGLSPDSIIQLSFQLAYRQAYSGYVGSYESCSTSAFRHGRTETMRPCTNATRDFCEAILQPERSKPSAGELRAMIDNCSKVHGQLTKEAAMGQGFDRHLFALRHTAQKEGIPIPDLYETEAYKRINNNIISTSTLGSDALLAGSFGPVVKNGFGIGYSIQNDFAGAIVTTYKNQADGKVFIDSLESAFDKICAVIQQSSSSKK

SEQ ID NO: 2527 - DNA, 3100 bp, Saccharomyces cerevisiae
  CDS (821)..(2887)
aaattaatcagaattgaatctgagcgtatttatttgataacggtttacgtaactgttggaataaaaatcaactatcatctactaactagtgtttacgttactagtatattatcatatacggtgttagaagatgacgcaaatgatgagaaatagtcatcgttttcaacggaagctgaaatacaaggattgataatgtaataggatcaatgaatatcaacatataaaacgatgataataatatttatagaattgtgtagaattgcagattcccttttatggattcctaaatcctcgagaagaacttctagtatatctacgtacctaatattattgccttattaaaaatggaatcccaacaattatctcaaaattcccccaattctcatcagtaacaccccaccccgtattacttttaccgtgatgaagattggcatcgttactttctaaacgtaggacgtgcggaatgacaaaaccatcagcagtgtcacgatctctccagtcacaatggcaatcatgagtgcatagtccaaagtaaaggggcaaggaaaagcatgattgaaaggactccccatctggactctatatgtcatcagcggctaaaaaaaagcatatagcacaacatcagcatcagcatcagcactagagtcatcggcccggcggtccgcggtcatccccgcggactttccgtccgcccggcgggctgtatcagcgtcaactggaacgcgcatatatatacaagacacacataacatagaagcacacccacgacaataaccacacgacaataaccacacccgcccacccctcctttccgtatacaatgccaaacttaaagagactacccatcccgccactgcaggacacgctcaaccgctacctggcacgcgtggaaaccctgcaggacgagcgccaaaaccgccgtacgcgccgcactgtgctctccgcagaaaacctggacgcattgaacacgctgcacgagcggctgctagaatacgacgcacggctcgcggaaagcaacccagagtcctcatacatcgagcagttctggtatgacgcgtacttgctatatgatgcaactgtcgttctcaacgtcaacccgtacttccaactgcaggacgacccaaccatcaaagacacaccagagacggcggcacagggcccctatggcgcacacacggtgcaggttcgtcgtgccgcacgactcaccacctctattctcaagttcatccgccagattcgccacggcacactccgcacagacactgtgcgcggcaaaacgccgctgtcgatggaccagtatgagcggctattcggctccagtagaatccctccgggtcccggcgagccctcttgccacttgcaaacagacgccacgtcgcatcacgtggtggcgatgtatcgtggccagttctactggttcgacgtgctggacacacgcaacgagcccatcttcgccaccccagaacaactggagtggaacctctactcgatcatcatggacgcggaatccgccggaagcggatccgcgccctttggcgtgttcaccacagagtcgcgccgggtgtggtccaacatcagggactatctgttccatgcggacgactgcaccaactggcgcaatctcaagctgatcgactccgcgctgttcgtggtctgtctcgacgacgtggcgtttgccgccgatcagcaggacgagctcacgcgttcgatgctgtgcgggacttctaccatcaatctcgacccgcaccaacaccagccgccattgaacgtgcagacaggcacctgtctcaaccgctggtacgacaagttacaactgatcgtgaccaagaacggtaaggcgggcatcaacttcgaacacaccggtgtggacggccacactgtgctgcggctcgccacagacatctacacagactcgatcctgagcttcgcacgcggtgtcaccaagaacgtcgtcgacatctttagcgacgacgatggaaaaccatcgtcgtcgtcgtcgttggcctcggcggctcactccgccaacttgatcaccatccctcgtaaactggaatggcgcactgacaatttcctgcaatcgtcgctgcactttgccgagacgcgcatctcggacttgatctcgcaatacgagtttgttaatcttgacttctccaactacggcgcgtcccatatcaagacagtgttcaagtgctcgccagacgccttcgtgcagcaggtgttccaggtcgcatacttcgcgttgtacggccgcttcgagaccgtgtacgagcctgccatgaccaaggcgttccaaaacggccgcacagaggccatccgctccgtcacgggccaatccaagctctttgtcaagtcactactggaccaggatgcctcggacgccaccaagattcagctcttgcacgacgcctgtacggcgcactcgcaaatcacaagggaatgctcccagggtctcggccaggaccgtcacttgtatgcgctctactgcctctggaaccaatggtacaaggacaagttggagctcccacccatcttccgcgacaagtcctggactaccatgcagaacaacgtcttgagcacctccaactgcggtaacccctgcctcaaggcttcggggttcgggcctgtcaccgccaacggcttcggcatcggctacatcatcagagaccactccgtctctgtggtggtgtcctcaaggcatcgccagactgctcggtttgcgtcgctcatggaaaagtcgctgctggagatcgaccgcatcttcaaacggcaacaagctcgcacagcaaaacccgctgccagagccactgctagcgccaacaccaaatcggaagacatgaaatacctgttgtccggctacgattacttcgacgtgagcgtgtccggttgagtttatgctgagtttttgcgcatcaatattatttttactactactactactactactactactactacatactattaaatatactaaataagagaaaaacgctttggaagtgactggcgccgccgctggctactataatagcagcgactgtaatttaatctcatcccgtcgtttggattacctcttttactcgccgagcgaacgtgcaccaaa

SEQ ID NO: 2528 - protein, 688 aa, Saccharomyces cerevisiae
MPNLKRLPIPPLQDTLNRYLARVETLQDERQNRRTRRTVLSAENLDALNTLHERLLEYDARLAESNPESSYIEQFWYDAYLLYDATVVLNVNPYFQLQDDPTIKDTPETAAQGPYGAHTVQVRRAARLTTSILKFIRQIRHGTLRTDTVRGKTPLSMDQYERLFGSSRIPPGPGEPSCHLQTDATSHHVVAMYRGQFYWFDVLDTRNEPIFATPEQLEWNLYSIIMDAESAGSGSAPFGVFTTESRRVWSNIRDYLFHADDCTNWRNLKLIDSALFVVCLDDVAFAADQQDELTRSMLCGTSTINLDPHQHQPPLNVQTGTCLNRWYDKLQLIVTKNGKAGINFEHTGVDGHTVLRLATDIYTDSILSFARGVTKNVVDIFSDDDGKPSSSSSLASAAHSANLITIPRKLEWRTDNFLQSSLHFAETRISDLISQYEFVNLDFSNYGASHIKTVFKCSPDAFVQQVFQVAYFALYGRFETVYEPAMTKAFQNGRTEAIRSVTGQSKLFVKSLLDQDASDATKIQLLHDACTAHSQITRECSQGLGQDRHLYALYCLWNQWYKDKLELPPIFRDKSWTTMQNNVLSTSNCGNPCLKASGFGPVTANGFGIGYIIRDHSVSVVVSSRHRQTARFASLMEKSLLEIDRIFKRQQARTAKPAARATASANTKSEDMKYLLSGYDYFDVSVSG

SEQ ID NO: 2529 - DNA, 2266 bp, Xenopus tropicalis
  CDS (36)..(2012)
caaaggtctcacggctacttttatttgaagtcctcatggctcgcttgctaacctcttcatctgccttgagatggggggcagtgagttcctcgcagtcagttggaagagcgtacagctccgggagccccgatactgagtatgtgcagaggagcattgttccaactatgcacttccagaagagcctgccaaggctgcccattcctaaacttgaagacactataaagagatacttgaatgcacaaagacctcttctggatgatgttcagtttaagaaaactgagcagctggccttgaactttcagaatggtgttgggaagcagctgcatgaagagctagtgcagcaggacaagcagaacaaacatacaagctatatctctggtccttggtttgatatgtatctgtgtgcccgtgaatccattgtgcttaattttaatccctttatatcttttacacctgacccaaggccggattataacaggcagctgatcagagccacaaacatgacagtatctgccatgcgttttctaaagaccatgagagctgggtatttggaacctgaaatcttccacttaaatccagccaaaagtgacacactgacatttcggaaattaatccggtttgtgccctcctctctttcctggtacggtgcatatatggtgaatgcatatcctttagacatgtcacagtatttccgtctttttaacggtactcgcattccaaaacctaacagagatgaactgtggacagatgaaaagggtagacacttattggttctacgaaaagggaacttctatgtgtttgatgtcatagacaaagatggaaatatagtaaaggcatctgaaatccaggcacatctacaacacatcttgtctgataccactccagccccagaattcccactagggtatttaaccagtgaagagaggaacacatgggcagttctaaggcagaaattgttaaacaatggcaaccaagaggctctggcaaaagtggattctgctgtgttttgcttgtgtttggatgatttccccgttgaagatcgtgttagtttatcacacaatatgctgcatggttctggtctaaatcgctggtttgacaagtcatttagcattatcatgactgaagatggtacagccgctgttaattttgagcactcatggggagatggagttgctgttttaaggttccaaaatgaggtttttaaggacagcacacagaggccagcgatatcgccagagtcatgttctgctcctgtggactcaagcaaagcagttcagagactgcactttaacttagatgactctttgaaagctgcaatagcaaatgccaaagaaaaatttgacacttctgtaaatgcactatccattgcaacaatggagttcaagaaaggaggaaaagagttactcaagacacagaagctgagccctgatgctgtgtcacagctgtcctttcagatggcttttctcaggcagtatggcaagacaacggccacatatgaatcctgcagcactgcagcattcaaacatggtcgcacagagactgtaaggccagcttccatatacactaagaagtgctcagaggcttttgttatgcatccgtccaagcatagcccagcagagctccgcagtatgctgcaggactgttccaaataccacggacaactgaccaaggaagcagcaatgggtcagggatttgatcggcatttatttgccctgcgatacttggcatccagcaaggggctttcgcttcctgaaatttaccaggatgcctcatatgcacagattaatcataatgtcctatccaccagcacgctcaccagccctgccgtacagctcgggggttttgctccagtagtgccggatgggtttggcgtaggatatggcgtacatgatgactggattggctgcaatgtttcttcataccagactcgtgatgtgagacagtttgtggagtgcgtgcatcaatccctagatgacatctttacagttttgcaagacaaacccataaaatagtggaacttggaaacctatattgtaacgttttgctctgttatttttttcacaaatttctgcattataccagaagatggcctcttacaggttactaaaaaatgtatccataaagctatatttatatggagccttacaatcatttccttctaaagggaatataaactatagatgtatttttactctaagtattacaggaataattggaaataaaaactattgtatggaaaaaaaaaaaaaaaaaaaaaaaaaaaaaa

SEQ ID NO: 2530 - protein, 658 aa, Xenopus tropicalis
MARLLTSSSALRWGAVSSSQSVGRAYSSGSPDTEYVQRSIVPTMHFQKSLPRLPIPKLEDTIKRYLNAQRPLLDDVQFKKTEQLALNFQNGVGKQLHEELVQQDKQNKHTSYISGPWFDMYLCARESIVLNFNPFISFTPDPRPDYNRQLIRATNMTVSAMRFLKTMRAGYLEPEIFHLNPAKSDTLTFRKLIRFVPSSLSWYGAYMVNAYPLDMSQYFRLFNGTRIPKPNRDELWTDEKGRHLLVLRKGNFYVFDVIDKDGNIVKASEIQAHLQHILSDTTPAPEFPLGYLTSEERNTWAVLRQKLLNNGNQEALAKVDSAVFCLCLDDFPVEDRVSLSHNMLHGSGLNRWFDKSFSIIMTEDGTAAVNFEHSWGDGVAVLRFQNEVFKDSTQRPAISPESCSAPVDSSKAVQRLHFNLDDSLKAAIANAKEKFDTSVNALSIATMEFKKGGKELLKTQKLSPDAVSQLSFQMAFLRQYGKTTATYESCSTAAFKHGRTETVRPASIYTKKCSEAFVMHPSKHSPAELRSMLQDCSKYHGQLTKEAAMGQGFDRHLFALRYLASSKGLSLPEIYQDASYAQINHNVLSTSTLTSPAVQLGGFAPVVPDGFGVGYGVHDDWIGCNVSSYQTRDVRQFVECVHQSLDDIFTVLQDKPIK

SEQ ID NO: 2531 - DNA, 25 bp, artificial sequence
  primer
atgtcaagcggcagtactattgttt

SEQ ID NO: 2532 - DNA, 25 bp, artificial sequence
  primer
ttattgatctaaggtcgccaccttt

SEQ ID NO: 2533 - DNA, 1518 bp, Saccharomyces cerevisiae
  CDS (1)..(1518)
atgagtgaaggccccgtcaaattcgaaaaaaataccgtcatatctgtctttggtgcgtcaggtgatctggcaaagaagaagacttttcccgccttatttgggcttttcagagaaggttaccttgatccatctaccaagatcttcggttatgcccggtccaaattgtccatggaggaggacctgaagtcccgtgtcctaccccacttgaaaaaacctcacggtgaagccgatgactctaaggtcgaacagttcttcaagatggtcagctacatttcgggaaattacgacacagatgaaggcttcgacgaattaagaacgcagatcgagaaattcgagaaaagtgccaacgtcgatgtcccacaccgtctcttctatctggccttgccgccaagcgtttttttgacggtggccaagcagatcaagagtcgtgtgtacgcagagaatggcatcacccgtgtaatcgtagagaaacctttcggccacgacctggcctctgccagggagctgcaaaaaaacctggggcccctctttaaagaagaagagttgtacagaattgaccattacttgggtaaagagttggtcaagaatcttttagtcttgaggttcggtaaccagtttttgaatgcctcgtggaatagagacaacattcaaagcgttcagatttcgtttaaagagaggttcggcaccgaaggccgtggcggctatttcgactctataggcataatcagagacgtgatgcagaaccatctgttacaaatcatgactctcttgactatggaaagaccggtgtcttttgacccggaatctattcgtgacgaaaaggttaaggttctaaaggccgtggcccccatcgacacggacgacgtcctcttgggccagtacggtaaatctgaggacgggtctaagcccgcctacgtggatgatgacactgtagacaaggactctaaatgtgtcacttttgcagcaatgactttcaacatcgaaaacgagcgttgggagggcgtccccatcatgatgcgtgccggtaaggctttgaatgagtccaaggtggagatcagactgcagtacaaagcggtcgcatcgggtgtcttcaaagacattccaaataacgaactggtcatcagagtgcagcccgatgccgctgtgtacctaaagtttaatgctaagacccctggtctgtcaaatgctacccaagtcacagatctgaatctaacttacgcaagcaggtaccaagacttttggattccagaggcttacgaggtgttgataagagacgccctactgggtgaccattccaactttgtcagagatgacgaattggatatcagttggggcatattcaccccattactgaagcacatagagcgtccggacggtccaacaccggaaatttacccctacggatcaagaggtccaaagggattgaaggaatatatgcaaaaacacaagtatgttatgcccgaaaagcacccttacgcttggcccgtgactaagccagaagatacgaaggataattag

SEQ ID NO: 2534 - protein, 505 aa, Saccharomyces cerevisiae
MSEGPVKFEKNTVISVFGASGDLAKKKTFPALFGLFREGYLDPSTKIFGYARSKLSMEEDLKSRVLPHLKKPHGEADDSKVEQFFKMVSYISGNYDTDEGFDELRTQIEKFEKSANVDVPHRLFYLALPPSVFLTVAKQIKSRVYAENGITRVIVEKPFGHDLASARELQKNLGPLFKEEELYRIDHYLGKELVKNLLVLRFGNQFLNASWNRDNIQSVQISFKERFGTEGRGGYFDSIGIIRDVMQNHLLQIMTLLTMERPVSFDPESIRDEKVKVLKAVAPIDTDDVLLGQYGKSEDGSKPAYVDDDTVDKDSKCVTFAAMTFNIENERWEGVPIMMRAGKALNESKVEIRLQYKAVASGVFKDIPNNELVIRVQPDAAVYLKFNAKTPGLSNATQVTDLNLTYASRYQDFWIPEAYEVLIRDALLGDHSNFVRDDELDISWGIFTPLLKHIERPDGPTPEIYPYGSRGPKGLKEYMQKHKYVMPEKHPYAWPVTKPEDTKDN

SEQ ID NO: 2535 - DNA, 1548 bp, Mus musculus (house mouse)
  CDS (1)..(1548)
atggcagagcaggtggccctgagccggacccaggtgtgtgggatcctgagggaagagttgtaccagggtgatgccttccaccaagctgatacacacatatttatcatcatgggtgcatcgggtgacctggccaagaagaagatctatcctaccatctggtggctgttccgggatggccttctacctgaagataccttcattgtgggctatgcccgctcacgactcacagtggacgacatccgaaagcagagtgagcccttctttaaagccactccagaagaaagacctaagctggaggagttctttgcccgtaattcctatgtagctggccagtatgatgatgcagcctcctataagcacctcaacagccacatgaatgccctgcaccaggggatgcaggccaaccgtctattctacctggccttgccccccacagtctatgaagcagtcaccaagaacattcaagagacctgcatgagtcagacaggctggaaccgcatcatcgtggagaagcccttcgggagagacctacagagctccaatcaactgtcgaaccacatctcctctcttttccgtgaggaccagatctaccgcattgaccactacctgggcaaagagatggtccagaatctcatggtgctgaggtttgccaacaggatctttggacccatctggaatcgagacaacattgcttgtgtgatcctcacatttaaagagccctttggtactgagggtcgtgggggctattttgatgaatttgggatcatcagggatgttatgcagaaccacctcctgcagatgttgtgtctggtggccatggaaaagcctgccactacaggttcagatgatgtccgtgatgagaaggtcaaagtgttgaagtgtatctcagaggtggaaactgacaacgtggtccttggccaatatgtggggaaccccaatggagaaggagaagctgccaatggatacttagatgaccccacagtaccccatgggtccaccactgccacttttgcagcagctgtcctctatgtggagaatgaacggtgggacggggtacccttcatcctgcgctgtggcaaagccctgaatgaacgcaaagctgaagtgagactgcagttccgagacgtggcaggtgacatcttccaccaacagtgcaagcgtaatgagctggtcatccgtgtgcagcccaatgaggcagtatacaccaagatgatgaccaagaagcctggcatgttctttaaccctgaggagtcggagctggatctaacttatggcaacagatacaagaatgtgaagctccctgatgcctatgaacgcctcatcctggatgtcttctgtgggagccagatgcactttgtccggagtgatgaactcagggaagcctggcgtatcttcacaccactgctgcacaagattgatcgagaaaagccccagcccatcccctatgtatatggcagccgcggccccacagaggcagatgagctgatgaagagagtgggcttccagtacgagggtacctacaagtgggtgaaccctcacaagctctga

SEQ ID NO: 2536 - protein, 515 aa, Mus musculus (house mouse)
MAEQVALSRTQVCGILREELYQGDAFHQADTHIFIIMGASGDLAKKKIYPTIWWLFRDGLLPEDTFIVGYARSRLTVDDIRKQSEPFFKATPEERPKLEEFFARNSYVAGQYDDAASYKHLNSHMNALHQGMQANRLFYLALPPTVYEAVTKNIQETCMSQTGWNRIIVEKPFGRDLQSSNQLSNHISSLFREDQIYRIDHYLGKEMVQNLMVLRFANRIFGPIWNRDNIACVILTFKEPFGTEGRGGYFDEFGIIRDVMQNHLLQMLCLVAMEKPATTGSDDVRDEKVKVLKCISEVETDNVVLGQYVGNPNGEGEAANGYLDDPTVPHGSTTATFAAAVLYVENERWDGVPFILRCGKALNERKAEVRLQFRDVAGDIFHQQCKRNELVIRVQPNEAVYTKMMTKKPGMFFNPEESELDLTYGNRYKNVKLPDAYERLILDVFCGSQMHFVRSDELREAWRIFTPLLHKIDREKPQPIPYVYGSRGPTEADELMKRVGFQYEGTYKWVNPHKL

SEQ ID NO: 2537 - DNA, 1593 bp, Fugu rubripes (Japanese pufferfish)
  CDS (1)..(1593)
atgatgattattttatttaactgttttttttgtgcctctttcagagaagatggccaacatcccactgtctcgctcggaggtgtttggggagctgcgaaggagctccacgaagacaaagagttccatcaatcagacgttcatgttttcatcatcatgggcgcatcgggagatctggccaagaagaaaatctacccaactctgtggtggttgttcagagacggccttctacctgagcagacatattttgtgggttttgctcgctctgctctgaccgtggatgctattcgaacatcttgcatgccttacctgaaggtgacagaaacagaatcggaccggctgtcggccttcttcagcaggaactcgtacatcagcgggaattacaccgccgggggctccttctccgagctcaacgcacacatcatgtctctgcctggggcgtccgacgcaaaccgcctcttctacctggcactgcctcccaccatctaccacagcgttactgagaacatcaagcacttctgtatgagcgccaaaggctggaacagggtgattgtagagaaaccgttcggacacgatctgcagagctccgaagagctgtccactcacctctcctcgctcttcactgaagaccagatctaccgaatagatcactacctcggcaaggaaatggtccagaacctaatggtgctcaggttcgggaaccgcatctttgggccaatctggaacagggacaacgtagcctgtgtggttcttacctttaaggagccgttcggcactcaggggagaggcggctattttgatgatttcggaatcatacgtgatgtgatgcagaaccacatgcttcagatgctctgtttggttgccatggagaaaccagcatccactaactcggatgacgtcagagatgaaaaggtgaaggtgttgaagtgcatcgttccagcgtccatgtcagatgtggtgctgggacagtatgtgggggacccagagggggagggagatgctaaactgggttatctcgatgatcccaccgttcccaaagggtcaactcaggccacctttgccacggttgtcctctacgtacacaacgaacgctgggatggggttcctttcatccttcgctgtggaaaagctctgaatgagaggaaggccgaggtgaggctgcagttcacagacgtgccgggggacattttccgtaatcagtgttacaggaacgagctcgtggtgcgcgtgcagcctaacgaggccatctacgccaagatgatgagcaagaaacctggtgtgtacttcaccccagaggaaactgagctggacctcacctacaagagcagatacaaggatgtgaaacttccggacgcctatgaacgtctcatcctggatgtcttctgtgggagtcagatgcactttgtcgcgagtgatgaattaagggaggcgtggcggatcttcacccctcttcttcatcagatagagaaggagaagcctaaacctattccttataaatatggcagtcgtggaccagcagaagcagacgagctcgagaagagagtcgggtttcgctatgaaggcacatacaagtgggtcaacccacacagactgtga

SEQ ID NO: 2538 - protein, 530 aa, Fugu rubripes (Japanese pufferfish)
MMIILFNCFFCASFREDGQHPTVSLGGVWGAAKELHEDKEFHQSDVHVFIIMGASGDLAKKKIYPTLWWLFRDGLLPEQTYFVGFARSALTVDAIRTSCMPYLKVTETESDRLSAFFSRNSYISGNYTAGGSFSELNAHIMSLPGASDANRLFYLALPPTIYHSVTENIKHFCMSAKGWNRVIVEKPFGHDLQSSEELSTHLSSLFTEDQIYRIDHYLGKEMVQNLMVLRFGNRIFGPIWNRDNVACVVLTFKEPFGTQGRGGYFDDFGIIRDVMQNHMLQMLCLVAMEKPASTNSDDVRDEKVKVLKCIVPASMSDVVLGQYVGDPEGEGDAKLGYLDDPTVPKGSTQATFATVVLYVHNERWDGVPFILRCGKALNERKAEVRLQFTDVPGDIFRNQCYRNELVVRVQPNEAIYAKMMSKKPGVYFTPEETELDLTYKSRYKDVKLPDAYERLILDVFCGSQMHFVASDELREAWRIFTPLLHQIEKEKPKPIPYKYGSRGPAEADELEKRVGFRYEGTYKWVNPHRL

SEQ ID NO: 2539 - DNA, 1506 bp, Vibrio cholerae
  CDS (1)..(1506)
atgatggtaatacctgaaaacagcagcatcgtaattttcggtgcttcgggagatttgacgtaccgtaagcttattcctgcgttgtatcacctctatgccagtcagcaactgcctaaatcgtttgcgattttaggtgtgagccgtaccgagtacagtgacgagtcttaccgcgagaagctaaagcgctcactgcaagagctggaaaaaacagaacctgccgctctcgaagccttcatgcagcatgtgcattatcaagcgctgaacacctcagaagtagctgattatcagcacttagcgacccgccttgatacactggctaacgattatcagtttgagcagcgtaatacgctgttttatctcgcaactccaccaagcttgtatggcgtgatcccagcttgccttgcggcacatggcctcaacgatgagagccaaggctggaagcgtctgatcatcgaaaaaccttttggttacgatctgcaatctgcacaagatctggatgtggaaatccaccaccacttcaaagagcatcagatctaccgtatcgaccactaccttggtaaagaaaccgtgcaaaacctgctggtgttccgctttgccaacggcatgtttgagccactgtggaaccgtaactttattgattacgtggaaatcacaggcgcagaattcctaggtgtggaagagcgcggcggttattacgatggttctggcgcggtgcgcgatatgttccaaaaccacctgctgcaagtgctggctatggtgggcatggagccgcctgcggcgatcaacgcggattccattcgtaacgaagtgaacaaggtactgcaaagcctacaaccgctttctgaatctgatctgcgcaacaatctggtgctcggtcaatacaccgaatcggaagtgcgtgggcaatttttacccagctaccgtaatgagccgggcgtggcggcggattcacgcaccgaaacttacgtcgcgctaaaaatgttcatcaataactggcgttggaatggtgtgccattctatgtgcgcagcggtaaacgtttaccaacgcgtgtcaccgaagtggtcattcacttcaaacgtacaccgcatcctgtctttgggcaaaatgcgccagagaacaagctgatcatccgtattcagcctgatgaaggcattctgatgagcttcggcttgaaagagcccggcgcaggtttcaaagccaaagaagtgtcgatgaatttccactacgcctcacttgagcagatcaaaatgctgaccgcttatgagcgtttgctgctggatgcactcaatggtgacgcgacactgtttgcccgtactgatgctgtagaagcttgttggaagtttgtgcagccgatcctcgatttcaaacaagatccgcaatcgctgtatggctacgcctgtggcacttggggcccgaaagagtcggatgacttgctgcgccgtgacggccgtgagtggcgcttcccttgtaaaaacctcactaacacggattactgcgaattatga

SEQ ID NO: 2540 - protein, 501 aa, Vibrio cholerae
MMVIPENSSIVIFGASGDLTYRKLIPALYHLYASQQLPKSFAILGVSRTEYSDESYREKLKRSLQELEKTEPAALEAFMQHVHYQALNTSEVADYQHLATRLDTLANDYQFEQRNTLFYLATPPSLYGVIPACLAAHGLNDESQGWKRLIIEKPFGYDLQSAQDLDVEIHHHFKEHQIYRIDHYLGKETVQNLLVFRFANGMFEPLWNRNFIDYVEITGAEFLGVEERGGYYDGSGAVRDMFQNHLLQVLAMVGMEPPAAINADSIRNEVNKVLQSLQPLSESDLRNNLVLGQYTESEVRGQFLPSYRNEPGVAADSRTETYVALKMFINNWRWNGVPFYVRSGKRLPTRVTEVVIHFKRTPHPVFGQNAPENKLIIRIQPDEGILMSFGLKEPGAGFKAKEVSMNFHYASLEQIKMLTAYERLLLDALNGDATLFARTDAVEACWKFVQPILDFKQDPQSLYGYACGTWGPKESDDLLRRDGREWRFPCKNLTNTDYCEL

SEQ ID NO: 2541 - DNA, 1470 bp, Pseudomonas aeruginosa
  CDS (1)..(1470)
atgcctgatgtccgcgttctgccttgcacgttagcgctgttcggtgcgctgggcgatctcgccttgcgcaagctgttcccggcgctctaccaactcgatcgtgagaacctgctgcaccgcgatacccgcgtcctggccctggcccgtgacgaaggcgctcccgccgaacacctggcgacgctggagcagcgcctgcgcctggcagtgccggcgaaggagtgggacgacgtggtctggcagcgtttccgcgaacgcctcgactacctgagcatggacttcctcgacccgcaggcctatgtcggcttgcgcgaggcggtggatgacgaactgccgctggtcgcctacttcgccacgccggcctcggtgttcggcggcatctgcgagaacctcgccgccgccggtctcgccgagcgcacccgggtggtgctggagaagcccatcggtcatgacctggagtcgtcccgcgaggtcaacgaggcagtcgcccggttcttcccggaaagccgcatctaccggatcgaccattacctgggcaaggagacggtgcagaacctgatcgccctgcgcttcgccaacagcctcttcgagacccagtggaaccagaaccacatctcccacgtggagatcaccgtggccgagaaggtcggcatcgaaggccgctggggctacttcgaccaggccgggcaactgcgcgacatggtgcagaaccacctgctgcaactgctctgcctgatcgccatggatccgcccagcgacctttcggcggacagcattcgcgacgagaaggtcaaggtcctccgcgccctcgagccgattcccgcagaacaactggcttcgcgcgtggtgcgtgggcagtacaccgccggtttcagcgacggcaaggcagtgccgggctacctggaggaggaacatgcgaatcgcgacagcgacgcggaaaccttcgtcgccctgcgcgtggacatccgcaactggcgctggtcgggcgtgccgttctacctgcgcaccggcaagcgcatgccgcagaagctgtcgcagatcgtcatccacttcaaggagccgccgcactacatcttcgctcccgagcagcgttcgctgatcagcaaccggctgatcatccgcctgcagccggacgaaggtatctccctgcaagtgatgaccaaggaccagggcctgggcaagggcatgcaattgcgtaccggcccgctgcaactgagtttttccgagacctaccacgcggcgcggattcccgatgcctacgagcgtctgctgctggaggtcacccagggcaaccagtacctgttcgtgcgcaaggacgaggtggagttcgcctggaagtggtgcgaccagctgatcgctggctgggaacgcctgagcgaagcgcccaagccgtatccggcggggagttgggggccggtggcctcggtggccctggtggcccgcgatgggaggagttggtatggcgatttctga

SEQ ID NO: 2542 - protein, 489 aa, Pseudomonas aeruginosa
MPDVRVLPCTLALFGALGDLALRKLFPALYQLDRENLLHRDTRVLALARDEGAPAEHLATLEQRLRLAVPAKEWDDVVWQRFRERLDYLSMDFLDPQAYVGLREAVDDELPLVAYFATPASVFGGICENLAAAGLAERTRVVLEKPIGHDLESSREVNEAVARFFPESRIYRIDHYLGKETVQNLIALRFANSLFETQWNQNHISHVEITVAEKVGIEGRWGYFDQAGQLRDMVQNHLLQLLCLIAMDPPSDLSADSIRDEKVKVLRALEPIPAEQLASRVVRGQYTAGFSDGKAVPGYLEEEHANRDSDAETFVALRVDIRNWRWSGVPFYLRTGKRMPQKLSQIVIHFKEPPHYIFAPEQRSLISNRLIIRLQPDEGISLQVMTKDQGLGKGMQLRTGPLQLSFSETYHAARIPDAYERLLLEVTQGNQYLFVRKDEVEFAWKWCDQLIAGWERLSEAPKPYPAGSWGPVASVALVARDGRSWYGDF

SEQ ID NO: 2543 - DNA, 1485 bp, Staphylococcus aureus
  CDS (1)..(1485)
atgagtactaaaaacaaacacatcccttgtttaatcacaatctttggtgcaactggtgacttaagccatcgtaagttgtttccatcaatattccatctctaccaacaagacaatttagatgaacatattgccatcatcggtattggacgtcgtgacattactaatgatgatttccgtaatcaagtaaaatcatcaattcaaaagcacgtaaaagatacaaacaaaattgacgcgtttatggaacatgtcttctatcatagacatgatgttagtaatgaagaaagctatcaagaattattagattttagtaatgaattagacagccaatttgaattaaaaggtaatcgactattctatttagcaatggcaccacaattctttggcgttatttctgattatctaaaatcttctggtcttactgatacaaaaggatttaaacgccttgttatcgaaaaaccattcggtagtgatttaaaatcagccgaagcattaaacaatcaaattcgtaaatcatttaaagaagaagaaatttatcgtattgaccactatttaggaaaagacatggttcaaaatatcgaggtattacgttttgcgaatgcgatgtttgaaccattatggaataacaaatatatttcaaacatccaagttacatcttctgaaatactaggtgttgaagatcgtggtggttattatgaatcaagtggtgcgctaaaagatatggtgcaaaaccacatgttacaaatggttgcattattagctatggaagcacctattagtttaaatagtgaagatatccgtgctgagaaagtaaaagtacttaaatcactgcgtcatttccaatctgaagatgttaaaaagaactttgttcgtggtcaatatggcgaaggctatatcgatggtaaacaagttaaagcataccgtgatgaagatcgcgttgcagatgactctaacacacctacatttgtttcaggtaaattaacaattgataactttagatgggctggcgtaccattctatatccgtactggtaaacgtatgaaatctaaaacaattcaagttgtcgttgaatttaaagaagtaccaatgaacttatactatgaaactgataaactgttagattcaaacctattagtaatcaatattcaaccaaatgaaggtgtatctttacatctaaatgctaagaaaaatacacaaggtatcgaaactgaacctgttcaattgtcttattcaatgagcgctcaagataaaatgaatactgtagatgcatatgaaaatctattattcgattgtcttaaaggtgatgccactaactttacgcactgggaagaattaaaatcaacatggaaatttgttgatgcaattcaagatgaatggaatatggttgatccagaattccctaactatgaatcaggtactaatggtccattagaaagtgatttattacttgctcgtgatggtaaccattggtgggacgatattcaataa

SEQ ID NO: 2544 - protein, 494 aa, Staphylococcus aureus
MSTKNKHIPCLITIFGATGDLSHRKLFPSIFHLYQQDNLDEHIAIIGIGRRDITNDDFRNQVKSSIQKHVKDTNKIDAFMEHVFYHRHDVSNEESYQELLDFSNELDSQFELKGNRLFYLAMAPQFFGVISDYLKSSGLTDTKGFKRLVIEKPFGSDLKSAEALNNQIRKSFKEEEIYRIDHYLGKDMVQNIEVLRFANAMFEPLWNNKYISNIQVTSSEILGVEDRGGYYESSGALKDMVQNHMLQMVALLAMEAPISLNSEDIRAEKVKVLKSLRHFQSEDVKKNFVRGQYGEGYIDGKQVKAYRDEDRVADDSNTPTFVSGKLTIDNFRWAGVPFYIRTGKRMKSKTIQVVVEFKEVPMNLYYETDKLLDSNLLVINIQPNEGVSLHLNAKKNTQGIETEPVQLSYSMSAQDKMNTVDAYENLLFDCLKGDATNFTHWEELKSTWKFVDAIQDEWNMVDPEFPNYESGTNGPLESDLLLARDGNHWWDDIQ

SEQ ID NO: 2545 - DNA, 1488 bp, Streptococcus pneumoniae
  CDS (1)..(1488)
atgtcatctaaggttattgttacaattttcggtgcgagtggagacctggctaaacgcaagctctacccttccctttttagactatataaatccggcaatctttccaagcactttgccgttattggaactgcccgtagaccttggagtaaggaatattttgaatctgtagttgtcgagtccatccttgatttggcagatagtaccgagcaagcccaagaatttgctagccacttctactatcaaagccatgatgtcaatgattcggaacattatattgctttgcgtcaattacaagctgagcttaatgaaaaataccaagctgaacacaataagctcttcttcttgtctatggcacctcagttctttggaaccattgccaaacacctcaaatctgaaaacattgtcgatggcaaaggttttgagcgcttgatcgttgaaaaaccatttggtacagattacgcaactgcaaacaagttgaatgacgaactcctagcaacatttgacgaagaacaaattttccgtatcgaccattatcttggtaaggaaatgatccaaagcatctttgcagttcgctttgcaaacttgatttttgaaaacgtttggaacaaggattttatcgacaatgttcaaattacctttgcggagcgcttgggtgtagaagaacgtggtggctactatgaccaatccggtgccctccgtgacatggtccaaaaccacactctacaacttctttcgctcctcgccatggacaaaccagcaagcttcacaaaagacgagattcgtgctgaaaagattaaggtctttaaaaacctctatcatccaactgatgaagaactcaaagaacactttatccgtgggcaataccgctctggtaagattgatggcatgaaatacatctcttatcgtagcgagccaaatgtgaatccagaatcaacaactgaaacctttacatctggtgccttctttgtagacagcgatcgattccgtggtgttcctttctttttccgtacaggtaaacgactgactgaaaaaggaactcatgtcaacatcgtctttaaacaaatggattctatctttggagaaccacttgctccaaatattttgaccatctatattcaaccaacagaaggcttctctcttagcctaaatgggaagcaagtaggagaagaatttaacttggctcctaactcacttgattaccgtacagatgcgactgcaactggtgcttctccagaaccatacgaaaaattgatttatgatgtcctaaataacaactcaactaactttagccactgggatgaagtttgtgcgtcatggaagttgattgaccgtattgaaaagctctgggctgaaaatggtgccccacttcatgactataaagctggaagcatgggacctcaagccagctttgacctacttgaaaaattcggtgccaaatggacttggcaaccagatatcacctatcgtcaagatggtcgcttagaataa

SEQ ID NO: 2546 - protein, 495 aa, Streptococcus pneumoniae
MSSKVIVTIFGASGDLAKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATANKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVCASWKLIDRIEKLWAENGAPLHDYKAGSMGPQASFDLLEKFGAKWTWQPDITYRQDGRLE

SEQ ID NO: 2547 - DNA, 1476 bp, Salmonella enterica subsp. enterica serovar Typhi
  CDS (1)..(1476)
atggcggtaacgcaaacagcccaggcatgtgacctggtcattttcggcgcgaaaggcgacctggcgcgccggaaactgctgccttccctgtatcagcttgagaaagccggccagatccatccggatacccggatcattggggtggggcgcgcggactgggataaagaagcttatacccacgttgtgcgtgaggcgctggaaaccttcatgaaggaaaaaattgatgaaggcttgtgggatacgctgagcggccgtctggatttttgtaatcttgacgttaacgatacgcctgcgttcagtcgcctgggcgatatgctggatcaaaaaaaccgcaccaccattaactattttgcgatgccgcccagcacgtttggcgctatttgcaaagggttaggggaggctaaactcaacgccaaaccggcgcgtgtcgtgatggagaaaccgttgggtacttcgctggcgacctcgcgtgagattaacgatcgggtcggcgaatactttgaagagtgccaagtatatcgtatcgaccactatctgggcaaagaaacggttctcaacctgctggcgctgcgttttgccaactcgttattcgttaataactgggataaccgcactatcgatcacgttgagattaccgtagcggaagaggtggggattgaagggcgctggggatattttgaccaggccggtcagatgcgcgatatgatccagaaccacttgctgcaaattctctgcatgattgccatgtcaccgccgtctgacctgagcgccgacagtattcgcgatgaaaaagtaaaagtgttgaaatcgttgcgccgtattgatcgctccaacgtgcgtgaaaaaacggttcgtggtcaatacaccgcgggctttgcgcagggtcaaaaggtgccgggctatctggaagaagagggcgcgaataaaagcagcaacaccgaaactttcgtcgcgatccgcgtcgacatcgataactggcgttgggcgggcgtgccattctatctgcgcaccggcaagcgtctgccaactaagtgctctgaagtcgtggtttatttcaagacgcctgaactgaatctctttaaagagtcctggcaagacctgccgcagaacaaattgacgattcgcctgcagccggatgaaggcgtagatattcaggtacttaacaaagtaccgaggctggatcataagcataatctgcaaatcacgaagcttgatctgagctactccgagacctttaatcagacgcacctggcggatgcatatgagcgcctgctgctggaaacgatgcgtggcattcaggcgctgtttgtccgccgtgacgaagtggaagaagcctggaagtgggtggactccattaccgaagcatgggcgatggacaacgacgcgccgaagccgtatcaggcgggcacctggggaccggtagcgtccgtggcgatgattacccgtgacggtcgttcgtggaatgagtttgagtaa

SEQ ID NO: 2548 - protein, 491 aa, Salmonella enterica subsp. enterica serovar Typhi
MAVTQTAQACDLVIFGAKGDLARRKLLPSLYQLEKAGQIHPDTRIIGVGRADWDKEAYTHVVREALETFMKEKIDEGLWDTLSGRLDFCNLDVNDTPAFSRLGDMLDQKNRTTINYFAMPPSTFGAICKGLGEAKLNAKPARVVMEKPLGTSLATSREINDRVGEYFEECQVYRIDHYLGKETVLNLLALRFANSLFVNNWDNRTIDHVEITVAEEVGIEGRWGYFDQAGQMRDMIQNHLLQILCMIAMSPPSDLSADSIRDEKVKVLKSLRRIDRSNVREKTVRGQYTAGFAQGQKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPRLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 2549 - DNA, 1476 bp, Agrobacterium tumefaciens
  CDS (1)..(1476)
atgagcagtcagatcattcctgttgaaccttttgattgtgtcgttttcggcggcacgggcgatcttgccgagcgcaagcttctgccggccctttatcaccggcaggtcgaaggccagttcacggagccgacccgcatcatcggcgcgtcgcgttcggtcatgacccatgaggaatatcgcaaattcgcgcaggacgccctgaaggaacacctgaaggccggcgaatatgacgatgcgcaggtgaccctgttcctcaaccggcttttctacgtgcccgtcgatgccaagtccggcaatggctgggacgtgctgaagaaactgctcgatgagggcaaggaacgcatccgcgcgttttatctggccgtcgcacccggcattttcggcgacatcgccgacaagatccgtgagcacaagctgatcacccgctcgacccgcatcgtcgttgaaaagccgatcggccgggatctcgcatccgcgcaggaactgaacgacaccatcggtcacgtcttcaaggaagagcagatcttccgcatcgaccactatctcggcaaggagacggtgcagaacctgatggcgctgcgtttcgccaatgcgctttacgagccgctgtggaattccgcccatatcgaccacgttcagatcaccgttgccgaagcggtgggtcttgaaggtcgcgccggttattacgacaaggccggtgcgctgcgcgacatggtgcagaaccacattctccagctgctttgcctcgttgccatggagccgcccgcttccatgaaatcggaggcagtgcgcgacgaaaagctcaaggtactgcgctcgctgaagccaatcgataccagcaatgtcgaaaagctgacggtacgcggccagtaccgcgccggcgcttccgcaggcggccccgtcaagggttatctggaagagctggaaggcggcgtttccaacaccgaaaccttcgtcgccatcaaggctgaaatcgccaactggcgctgggccggcgttcccttctacatccgcaccggcaaacgcctcgcgacccgtgtttcggaaatcgtcgtcaccttcaagcagatcccgcactcgatcttcgacgatgcggctggcaagatcgaagccaacaagctggtcattcgcctgcagccggatgaaggcgtcaagcagtcgctcctcatcaaggatcccggtccaggcggcatgcgcctgcgtcaggtctcgctggacatgagctttgccgaagccttcaacgtgcgcagccccgatgcctatgagcggctgttgatggacaccattcgttccaaccagacattgttcatgcgccgcgacgaggtcgaggccgcgtgggactggatcgaccccatcttgaagagctgggaagagctgggacagagcgtacagggttacactgccggcacctggggcccgagcggttcgatcgcactgatcgagcgcgacggccgcacctggcacgatgccgactga

SEQ ID NO: 2550 - protein, 491 aa, Agrobacterium tumefaciens
MSSQIIPVEPFDCVVFGGTGDLAERKLLPALYHRQVEGQFTEPTRIIGASRSVMTHEEYRKFAQDALKEHLKAGEYDDAQVTLFLNRLFYVPVDAKSGNGWDVLKKLLDEGKERIRAFYLAVAPGIFGDIADKIREHKLITRSTRIVVEKPIGRDLASAQELNDTIGHVFKEEQIFRIDHYLGKETVQNLMALRFANALYEPLWNSAHIDHVQITVAEAVGLEGRAGYYDKAGALRDMVQNHILQLLCLVAMEPPASMKSEAVRDEKLKVLRSLKPIDTSNVEKLTVRGQYRAGASAGGPVKGYLEELEGGVSNTETFVAIKAEIANWRWAGVPFYIRTGKRLATRVSEIVVTFKQIPHSIFDDAAGKIEANKLVIRLQPDEGVKQSLLIKDPGPGGMRLRQVSLDMSFAEAFNVRSPDAYERLLMDTIRSNQTLFMRRDEVEAAWDWIDPILKSWEELGQSVQGYTAGTWGPSGSIALIERDGRTWHDAD

SEQ ID NO: 2551 - DNA, 1530 bp, Nostoc sp. PCC 7120
  CDS (1)..(1530)
atggttagtctcctagaaaatcccttgcgcgttggtctgcaacaacaagggatgcccgaaccccaaattatagtcatctttggcgcttctggtgatcttacctggcgcaaactcgtcccagcactttacaaattgcggcgggaacgacgcattcccccagaaactaccattgttggtgtagcccgtcgggaatggagccacgaatacttccgcgaacaaatgcaaaagggcatggaagaggctcatagcagtgtcgaacttggagaactgtggcaagatttctctcaaggtctgttctactgccctggagacatagataacccggaaagttatcaaaaactgaagaatttgttaagcgaattagacgagaaacgaggtacacggggcaaccggatgttttacctctccgtcgcccctaacttcttccctgaagctatcaagcaactagggggagcaggaatgttagacgacccatacaaacatcgtctagtaattgaaaaaccatttggtagagatttggcatcagcccaaagcctgaacgcagtagtgcagaagtattgtaaagaacaccaagtctaccgcatcgaccactacttgggtaaagaaacagttcaaaacttactggtattccgcttcgccaatgccatttttgaacccctgtggaatcgtcagtttgttgaccacgtacaaattaccgtggcagaaaccgtaggcgtggaagaccgggctggttattacgaaaaagccggcgcactgcgggatatgttgcagaaccacctgatgcagctttattgcctgacagcaatggaagcaccaaactcaatggatgccgatagcatccgtacagaaaaagtcaaagtgttacaagctactcgcctggctgacgtacacaacctatcacgttcagcaatacgcggacaatacagcgctggttggatgaaaggtcaacaagttcctgggtatcggacagaaccaggagttgacccaaattcctccacccctacttatgtaggtatgaagtttttagttgacaactggcgttggcaaggtgttcctttctacctgcgtactggcaaacggatgccgaagaaagtcagtgagatttctatccacttccgcgatgtgccttctcggatgttccaatctgccgcgcaacaaagaaacgccaacattttagctatgcggattcagccaaatgaaggaatttccttgcgttttgatgtgaaaatgccaggagccgaattccgtacccgttccgtagatatggatttcagctatggttcctttgggattgaagctacttccgacgcttacgatcgcctattcttagattgtatgatgggcgaccaaacattattcaccagagccgacgaagtagaagcagcttggcaggtagtcacccccgccctttctgtttgggactcacccgccgaccccgccaccattccccagtacgaagccggaacctgggaaccagcagaagcagaatttctgattaaccaagatggtcgtcgctggcgcagactgtag

SEQ ID NO: 2552 - protein, 509 aa, Nostoc sp. PCC 7120
MVSLLENPLRVGLQQQGMPEPQIIVIFGASGDLTWRKLVPALYKLRRERRIPPETTIVGVARREWSHEYFREQMQKGMEEAHSSVELGELWQDFSQGLFYCPGDIDNPESYQKLKNLLSELDEKRGTRGNRMFYLSVAPNFFPEAIKQLGGAGMLDDPYKHRLVIEKPFGRDLASAQSLNAVVQKYCKEHQVYRIDHYLGKETVQNLLVFRFANAIFEPLWNRQFVDHVQITVAETVGVEDRAGYYEKAGALRDMLQNHLMQLYCLTAMEAPNSMDADSIRTEKVKVLQATRLADVHNLSRSAIRGQYSAGWMKGQQVPGYRTEPGVDPNSSTPTYVGMKFLVDNWRWQGVPFYLRTGKRMPKKVSEISIHFRDVPSRMFQSAAQQRNANILAMRIQPNEGISLRFDVKMPGAEFRTRSVDMDFSYGSFGIEATSDAYDRLFLDCMMGDQTLFTRADEVEAAWQVVTPALSVWDSPADPATIPQYEAGTWEPAEAEFLINQDGRRWRRL

SEQ ID NO: 2553 - DNA, 1386 bp, Agrobacterium tumefaciens
  CDS (1)..(1386)
atgaaagcatcagccacggacagacagcgatcggacgtgctggtggtgttcggcgccacgggtgatcttgcctataagatgatctttccctctctctacgccatggtgaaacgcggcgcgctgcaaacgcccatcatcggagtcgctttcgacgattggccgcgtgagcagctgatagcgcgggcgcgcgatgcggtcgccaaccatttggacaagatcgatgaagccgtcttcgaaaaattcgccgcacagctgacctatgtctccggcgattatcgcaacgaagcgacattcgaaaagctgcgcacggcgcttggcgggcaccagcatccgctttattatctcgccattccgccttccctgttcgaaaccgtggtaaccggcctcaacagggcgggcatcgccgcttcggcccggctgatggtggagaaaccctttggccgtgaccttgcctccgccgaagccttaaatgaagcgttgcacgcggttttcgcagaggatgctattttccgcatcgaccatttcctgggcaaggaagccatccagaaccttctttattttcgttttgccaatgcctttctagagcccgtgtggaatcgcgaccacgttgagagcgtgcagatcaccatggccgaagatttcggcatcagggggcgcggcaagttttatgacgaagtcggatgtatccgcgatgtgatccagaaccatctgatcaatgtgctgttgctgctggccatggagccgccagccaccagcgcctcggatgatctcgtcgatgaaaaagtgcagatactgaaagccatgccgccgctcacccgcgatgatgtggtgcgcggacagttcagaggttatctggacgagccgggtgtcgcctcggcgtccaaccgggaaaccttcgccgccgcccgctttcgcgtcgccacctggcgctggaatggcgtgcctttcttcatccggtccggcaagaacctgccggcgcatgcaaccgaagtcgtggtccgcttcaagcggccgccaattgcgctctttggcgatgtcgagacaacgcccgccaattatgtgcgcttccgtctgggcccggatatcgcgatcggaatcggtgcgcgtcgcaaggcagctggcgatggcatgcgcggcgaggccgtagaactcggcgcggtcgatgacggtatcggtgacatggcgccttatgagcggctgatcggcgatgcgatggccggcgagcgtcagctctttacccgccaggatgcggcggaactggcctggaagatcgtggagcctatcctcgatgatcccgccgtgccgcctgtctatgaggtgggaagctggggcccggcggaaatggcagggtttggcccgccaggcggatgggttgatcccgaataa

SEQ ID NO: 2554 - protein, 461 aa, Agrobacterium tumefaciens
MKASATDRQRSDVLVVFGATGDLAYKMIFPSLYAMVKRGALQTPIIGVAFDDWPREQLIARARDAVANHLDKIDEAVFEKFAAQLTYVSGDYRNEATFEKLRTALGGHQHPLYYLAIPPSLFETVVTGLNRAGIAASARLMVEKPFGRDLASAEALNEALHAVFAEDAIFRIDHFLGKEAIQNLLYFRFANAFLEPVWNRDHVESVQITMAEDFGIRGRGKFYDEVGCIRDVIQNHLINVLLLLAMEPPATSASDDLVDEKVQILKAMPPLTRDDVVRGQFRGYLDEPGVASASNRETFAAARFRVATWRWNGVPFFIRSGKNLPAHATEVVVRFKRPPIALFGDVETTPANYVRFRLGPDIAIGIGARRKAAGDGMRGEAVELGAVDDGIGDMAPYERLIGDAMAGERQLFTRQDAAELAWKIVEPILDDPAVPPVYEVGSWGPAEMAGFGPPGGWVDPE

SEQ ID NO: 2555 - DNA, 1476 bp, Brucella melitensis
  CDS (1)..(1476)
atgaccagtcagacaattccggtagatcccttcgactgcatcgtttttggtggcaccggcgatcttgccgagcgcaagcttattccggcgctttatcagcgccagcgcgcaggccagctttccgaccccacacgcatcatcggcgcctcgcgcagccagatgaccgacgacgaatatcgcaccttcgccggcaatgcgatcaaggaacatgtgaaaccggaagaggtggatcaggccgaagttgaaatcttcctcaagcggctgcactatgtggcggtggacgccaagtccgacgagggctgggatgcgctgaagaccctgatcggcaagaagccggaaaagatccgagccttttatctggccgtcagcccgaccctgttcggcgatatcgccacgcggctcaaggcgcatggcctcatcacgcgcgatacgcgcatcgtcgtggaaaagccgattggccgcgatctcgattccgccaaggcgctcaacgacacgctgggcagtgtgttccgcgaagaccagattttccgcatagaccactatctcggcaaggaaacggtgcagaacctgatggcgctgcgctttgccaatgcgctctacgagccgctgtggaactccgcccatatcgaccatgtgcagatcacggtggcggaagccgtgggccttgaaggccgcgcaggctattacgacaaggcgggcgcgctgcgcgacatggtgcagaaccacattctccagcttctctgccttgttgccatggaaccgccatcctcgattgaggccgacgccgtacacgacgagaaggtaaaggttctgcgctccctgcagccgatctccacgcataatgtcgaggaactgacggtccgcggacaatatcgcgcgggcgcttccgcaggcgggccggtcaagggctatctggaagaccttgaaagcgacaccagcaatacggaaacattcgtggcgctgaaggcggaaatcgccaactggcgctgggcgggtgtgccgttctatctgcgcaccggcaagcgccttgccacgcgtgtttcggaaatcgtcatcacgttcaagcccattccgcattccatctttggcgaaagcgcgggcaaggtgattgccaatcagcttgtcatccgcctgcaaccggacgaaggcgtgaagcaatggctgatgatcaaggatcccggtccgggtggaatgcgcctgcgccacatgccgctcgacatgagctttgcggaatccttcgaggatcgcaacccggatgcctatgagcgcctcatcatggatgtggtgcgcggcaaccagaccctgttcatgcgccgcgacgaagtggaagcggcctggcgctggatcgacccgatccttcaggcatgggagttcaacagccagcccgtgcagggctatacggctggcacatgggggccttcgtcctccatcgcgctcattgagcgcgatggccgcacctggcacgaaagcctctaa

SEQ ID NO: 2556 - protein, 491 aa, Brucella melitensis
MTSQTIPVDPFDCIVFGGTGDLAERKLIPALYQRQRAGQLSDPTRIIGASRSQMTDDEYRTFAGNAIKEHVKPEEVDQAEVEIFLKRLHYVAVDAKSDEGWDALKTLIGKKPEKIRAFYLAVSPTLFGDIATRLKAHGLITRDTRIVVEKPIGRDLDSAKALNDTLGSVFREDQIFRIDHYLGKETVQNLMALRFANALYEPLWNSAHIDHVQITVAEAVGLEGRAGYYDKAGALRDMVQNHILQLLCLVAMEPPSSIEADAVHDEKVKVLRSLQPISTHNVEELTVRGQYRAGASAGGPVKGYLEDLESDTSNTETFVALKAEIANWRWAGVPFYLRTGKRLATRVSEIVITFKPIPHSIFGESAGKVIANQLVIRLQPDEGVKQWLMIKDPGPGGMRLRHMPLDMSFAESFEDRNPDAYERLIMDVVRGNQTLFMRRDEVEAAWRWIDPILQAWEFNSQPVQGYTAGTWGPSSSIALIERDGRTWHESL

SEQ ID NO: 2557 - DNA, 1458 bp, Zymomonas mobilis
  CDS (1)..(1458)
atgacaaataccgtttcgacgatgatattgtttggctcgactggcgacctttcacagcgtatgctgttgccgtcgctttatggtcttgatgccgatggtttgcttgcagatgatctgcgtatcgtctgcacctctcgtagcgaatacgacacagatggtttccgtgattttgcagaaaaagctttagatcgctttgtcgcttctgaccggttaaatgatgacgctaaagctaaattccttaacaagcttttctacgcgacggtcgatattacggatccgacccaattcggaaaattagctgacctttgtggcccggtcgaaaaaggtatcgccatttatctttcgactgcgccttctttgtttgaaggggcaatcgctggcctgaaacaggctggtctggctggtccaacttctcgcctggcgcttgaaaaacctttaggtcaagatcttgcttcttccgatcatattaatgatgcggttttgaaagttttctctgaaaagcaagtttatcgtattgaccattatctgggtaaagaaacggttcagaatcttctgaccctgcgttttggtaatgctttgtttgaaccgctttggaattcaaaaggcattgaccacgttcagatcagcgttgctgaaacggttggtcttgaaggtcgtatcggttatttcgacggttctggcagcttgcgcgatatggttcaaagccatatccttcagttggtcgctttggttgcaatggaaccaccggctcatatggaagccaacgctgttcgtgacgaaaaggtaaaagttttccgcgctctgcgtccgatcaataacgacaccgtctttacgcataccgttaccggtcaatatggtgccggtgtttctggtggtaaagaagttgccggttacattgacgaactgggtcagccttccgataccgaaacctttgttgctatcaaagcgcatgttgataactggcgttggcagggtgttccgttctatatccgcactggtaagcgtttacctgcacgtcgttctgaaatcgtggttcagtttaaacctgttccgcattcgattttctcttcttcaggtggtatcttgcagccgaacaagctgcgtattgtcttacagcctgatgaaaccatccagatttctatgatggtgaaagaaccgggtcttgaccgtaacggtgcgcatatgcgtgaagtttggctggatctttccctcacggatgtgtttaaagaccgtaaacgtcgtatcgcttatgaacgcctgatgcttgatcttatcgaaggcgatgctactttatttgtgcgtcgtgacgaagttgaggcgcagtgggtttggattgacggaattcgtgaaggctggaaagccaacagtatgaagccaaaaacctatgtctctggtacatgggggccttcaactgctatagctctggccgaacgtgatggagtaacttggtatgactga

SEQ ID NO: 2558 - protein, 485 aa, Zymomonas mobilis
MTNTVSTMILFGSTGDLSQRMLLPSLYGLDADGLLADDLRIVCTSRSEYDTDGFRDFAEKALDRFVASDRLNDDAKAKFLNKLFYATVDITDPTQFGKLADLCGPVEKGIAIYLSTAPSLFEGAIAGLKQAGLAGPTSRLALEKPLGQDLASSDHINDAVLKVFSEKQVYRIDHYLGKETVQNLLTLRFGNALFEPLWNSKGIDHVQISVAETVGLEGRIGYFDGSGSLRDMVQSHILQLVALVAMEPPAHMEANAVRDEKVKVFRALRPINNDTVFTHTVTGQYGAGVSGGKEVAGYIDELGQPSDTETFVAIKAHVDNWRWQGVPFYIRTGKRLPARRSEIVVQFKPVPHSIFSSSGGILQPNKLRIVLQPDETIQISMMVKEPGLDRNGAHMREVWLDLSLTDVFKDRKRRIAYERLMLDLIEGDATLFVRRDEVEAQWVWIDGIREGWKANSMKPKTYVSGTWGPSTAIALAERDGVTWYD

SEQ ID NO: 2559 - DNA, 1470 bp, Bacillus subtilis
  CDS (1)..(1470)
atgaaaacaaaccaacaaccaaaagcagtaattgtcatattcggtgcaactggagatttagcaaaacgaaaattgtatccgtctattcaccgtttatatcaaaacggacaaatcggagaagagtttgcagtggtaggagttggaagaagaccttggtctaatgaggatcttcgccaaactgttaaaacatccatttcctcatctgcagataagcatatagatgatttcacgtctcatttttactatcacccgtttgacgtgacaaaccctggttcttatcaagagctaaacgtattgcttaaccagctggaagatacatatcaaattcctaacaacagaatgttctacttggcaatggctcctgaattcttcggaacgattgcaaaaacattaaaatcagagggtgtaacagctacaaccggctggtcccgccttgtcatcgaaaaaccgttcggccatgatctgccaagcgcacaggcattgaataaagaaatccgcgaagcatttacggaagatcaaatttacagaatcgaccattatctaggcaaacaaatggttcagaacattgaagtgattcgatttgccaatgcgattttcgaaccgctttggacaaaccgctacatttcaaacattcaaatcacatctagcgaatcactaggcgttgaagaccgcgcaagatattacgaaaaatcaggcgcccttcgcgacatggtgcaaaaccatattatgcagatggttgcccttcttgcaatggagccgcctatcaaattgaacacagaagaaatccgcagcgagaaagtgaaggtgctgagagcactgcgtcctattgcaaaagacgaagtggatgaatactttgtgcgcggacaatatcatgctggtgaaattgacggtgtaccggttcctgcttatacagatgaagataatgtcgctcctgactccaatacagaaacctttgttgccggcaagctcttgatcgacaacttcagatgggctggtgttccattctacatcagaaccggaaaacgaatgagagaaaagtccacaaaaattgtcgttcaatttaaggacattccgatgaacctgtactacggtaatgaaaacaacatgaatccgaacttgcttgtcattcatattcagcctgacgaaggcattacgctttacttaaatgctaaaaagcttggcggagcagcacacgcacagccaatcaaactcgattattgcagcaattgcaatgacgagttgaacacccctgaagcatatgaaaaactaattcacgactgtcttcttggcgatgcaacaaactttgcacactgggatgaagttgccctttcttggagctttgtcgactctatttctgaaacatgggcagcaaacaaaaccttatctcctaactacgaatcaggctcaatgggaccgaaagaatctgatgatcttttggtgaaagacggcttacactggtggaacatataa

SEQ ID NO: 2560 - protein, 489 aa, Bacillus subtilis
MKTNQQPKAVIVIFGATGDLAKRKLYPSIHRLYQNGQIGEEFAVVGVGRRPWSNEDLRQTVKTSISSSADKHIDDFTSHFYYHPFDVTNPGSYQELNVLLNQLEDTYQIPNNRMFYLAMAPEFFGTIAKTLKSEGVTATTGWSRLVIEKPFGHDLPSAQALNKEIREAFTEDQIYRIDHYLGKQMVQNIEVIRFANAIFEPLWTNRYISNIQITSSESLGVEDRARYYEKSGALRDMVQNHIMQMVALLAMEPPIKLNTEEIRSEKVKVLRALRPIAKDEVDEYFVRGQYHAGEIDGVPVPAYTDEDNVAPDSNTETFVAGKLLIDNFRWAGVPFYIRTGKRMREKSTKIVVQFKDIPMNLYYGNENNMNPNLLVIHIQPDEGITLYLNAKKLGGAAHAQPIKLDYCSNCNDELNTPEAYEKLIHDCLLGDATNFAHWDEVALSWSFVDSISETWAANKTLSPNYESGSMGPKESDDLLVKDGLHWWNI

SEQ ID NO: 2561 - DNA, 1401 bp, Mycobacterium tuberculosis
  CDS (1)..(1401)
atggttgacggcggaggtggcgcgtcagatctgttggtgatcttcggaattaccggtgacctggcccgcaagatgaccttccgcgcgttgtatcggctcgagcgccaccagttgctggactgccccatcctgggtgtggccagtgacgacatgtccgtcgggcagttggtcaagtgggctcgcgagtccatcggtcgtaccgaaaagatcgacgatgcggtgttcgaccggttggcgggccggttgtcctacctgcacggtgacgtcaccgacagccagctctacgattcgctggccgaactgattggctcggcctgtcggccgctgtattacctggaaatgccgccggcgctgttcgcgccgattgtcgaaaatctcgcgaacgtgcggctgttggagcgcgcacgcgttgccgtggaaaagccgttcggccacgacctggcctccgcgctcgaactcaacgcccggctgcgagcggtgttgggcgaagaccaaatcctgcgtgtggaccactttctgggcaagcagcccgtcgtcgagctggagtacctgaggttcgccaatcaggcgttagccgagctctgggatcgcaacagcatctccgagatccacatcaccatggccgaggacttcggggtggaggaccgcggcaagttttacgacgccgtcggtgccctgcgtgacgtcgtgcaaaaccatctgctgcaggtgctggcgctggtgacgatggaaccgccggtcggttccagcgccgatgacctcaacgacaagaaggccgaggtcttccgggcgatggcgccgctggatcccgatcggtgcgtgcgtgggcagtacctcggctacaccgaagttgcgggcgtagcaagcgattcggcgaccgaaacgtatgtcgcgctgcgaaccgagatcgacaactggcgctgggccggggtgccgatcttcgtgcgggccggaaaagagctgcccgcgaaggtcaccgaagtacggctatttttacgccgagttccggcattggcctttctgcccaaccgccgaccggccgagcccaaccagattgtgctgcgtatcgaccccgatccgggtatgcgactgcagatttcggcccacaccgacgactcgtggcgagatatccacctggactcctcgttcgcggtggacctcggtgaaccgatacgaccctatgagcggctgctgtatgccggattggtcggcgatcaccagttgttcgcccgcgaggacagcatcgagcagacgtggcggatcgtgcagccgctgctcgacaacccgggtgaaatccatcggtacgatcgcggttcctggggtccggaagccgcgcagtcgttgctgcgcggtcaccgcggttggcagtcgccgtggctgccccgcggcacggacgcatga

SEQ ID NO: 2562 - protein, 466 aa, Mycobacterium tuberculosis
MVDGGGGASDLLVIFGITGDLARKMTFRALYRLERHQLLDCPILGVASDDMSVGQLVKWARESIGRTEKIDDAVFDRLAGRLSYLHGDVTDSQLYDSLAELIGSACRPLYYLEMPPALFAPIVENLANVRLLERARVAVEKPFGHDLASALELNARLRAVLGEDQILRVDHFLGKQPVVELEYLRFANQALAELWDRNSISEIHITMAEDFGVEDRGKFYDAVGALRDVVQNHLLQVLALVTMEPPVGSSADDLNDKKAEVFRAMAPLDPDRCVRGQYLGYTEVAGVASDSATETYVALRTEIDNWRWAGVPIFVRAGKELPAKVTEVRLFLRRVPALAFLPNRRPAEPNQIVLRIDPDPGMRLQISAHTDDSWRDIHLDSSFAVDLGEPIRPYERLLYAGLVGDHQLFAREDSIEQTWRIVQPLLDNPGEIHRYDRGSWGPEAAQSLLRGHRGWQSPWLPRGTDA

SEQ ID NO: 2563 - DNA, 1545 bp, Mycobacterium tuberculosis
  CDS (1)..(1545)
atgaaaccggcccacgccgcggcgtcgtggcgcaacccgctacgagacaagcgggacaagcgattacccagaatcgccggcccgtgcggcatggtgattttcggcgtcaccggcgacctggcccgcaagaaggtgatgccggccgtctacgatttggccaaccgcggcctgctgccgcccacattctcgctggtggggtttgcccgccgagactggagcacccaggatttcggtcaagtggtgtacaacgccgtccaagagcactgccgaacaccgtttcggcaacagaactgggaccggctggccgagggattccgttttgtgccaggcactttcgacgacgacgacgcgttcgcccaactcgccgagacgctggagaagctcgacgccgagcgcggcaccggcggcaaccacgccttctacctggcgatcccgcccaaatccttcccggtggtgtgtgagcagctgcacaagtccggcctggcccgcccgcaaggcgaccggtggagccgagtcgtgatagagaagccgttcggccacgacctggccagcgcacgcgagctgaacaaggcggtcaacgcggtcttcccggaggaagcggtcttccgcatcgaccactacctgggcaaagagacggtgcagaacatcctggcgctgcggttcgccaaccagctgttcgacccgatctggaatgcgcactacgtcgaccacgtacagatcaccatggccgaagacatcggcctgggcgggcgcgcgggctattacgacggcatcggcgcggcccgcgatgtcatccagaaccatctcatgcagctgctggcgctgaccgcgatggaggagccggtcagcttccacccggcagcgttgcaggccgagaagatcaaggtgctctcggccacccgccttgccgagccactcgaccagaccaccagccgcggccagtacgccgccggctggcaaggcggggagaaggtggttgggctgctcgacgaggaggggttcgccgaggactccaccaccgaaaccttcgccgctatcaccctggaagtcgatacgcgccggtgggccggcgtgccgttctatctgcgaacgggaaaacgattgggccgccgggtgaccgagatcgctctggtcttcaggcgggcgccgcatctgccgttcgacgccaccatgaccgacgagctgggcaccaacgcgatggtcatccgcgtgcagcccgacgaaggtgtcacattgcggttcggctccaaggtgccgggcaccgccatggaagtccgcgacgtcaacatggacttctcctacggctcggcattcgccgaagattcaccggaggcctacgagcggctcatcctcgacgtcctgctcggcgagccctcgctgtttccggtcaacgcggaggtcgaactggcgtgggagatcctcgatccagcgttggaacattgggcggcacacgggacgcccgacgcctacgaggcaggtacctggggtccggaatcatccttggagatgctgcgccgcaccggccgggaatggcggcggccatag

SEQ ID NO: 2564 - protein, 514 aa, Mycobacterium tuberculosis
MKPAHAAASWRNPLRDKRDKRLPRIAGPCGMVIFGVTGDLARKKVMPAVYDLANRGLLPPTFSLVGFARRDWSTQDFGQVVYNAVQEHCRTPFRQQNWDRLAEGFRFVPGTFDDDDAFAQLAETLEKLDAERGTGGNHAFYLAIPPKSFPVVCEQLHKSGLARPQGDRWSRVVIEKPFGHDLASARELNKAVNAVFPEEAVFRIDHYLGKETVQNILALRFANQLFDPIWNAHYVDHVQITMAEDIGLGGRAGYYDGIGAARDVIQNHLMQLLALTAMEEPVSFHPAALQAEKIKVLSATRLAEPLDQTTSRGQYAAGWQGGEKVVGLLDEEGFAEDSTTETFAAITLEVDTRRWAGVPFYLRTGKRLGRRVTEIALVFRRAPHLPFDATMTDELGTNAMVIRVQPDEGVTLRFGSKVPGTAMEVRDVNMDFSYGSAFAEDSPEAYERLILDVLLGEPSLFPVNAEVELAWEILDPALEHWAAHGTPDAYEAGTWGPESSLEMLRRTGREWRRP

SEQ ID NO: 2565 - DNA, 1320 bp, Chlamydia trachomatis
  CDS (1)..(1320)
atgaagcttgccgttcagcatttctctcactcatcggaaatagatattcgagtttgggaaagtctggaaaatagaatcttttaccaccaagctaatttttctgatgccgaaggctactctgttctgaaagcttatttggagcaactagatcaacaatatggaacacaagggaatcgtcttttttatttatcaacaccaccagattatttccaggaaatcatccgcaatttaaatcggcatcagctattctatcatgaacaaggagcacaacagccttggtctcggctaattatagaaaagccttttggagttaatttagaaacagctcgagagcttcaacaatgcattgatgccaatattgatgaagagtcggtttatcgaatagaccattatttaggaaaagaaacggttcaaaacattctgactattcgttttgctaatactctctttgagtcttgctggaattctcagtacatagatcatgtgcaaatcagcgttagcgaatcaattggtataggatctcgagggaatttcttcgaaaagtcgggcatgctacgagacatggtacagaatcatttgacgcagctgctatgtctactgactatggaacctccttctgaatttttttccgaagaaataaaaaaagaaaaaattaaaattctaaagaaaattcttcctatccgcgaagaagatgctgttcgtggccagtatggtgaagggattgtgcaagatgtttcagttctgggctatcgggaggaagaaaatgtcgatccgaattcttcagtagaaacctacgttgcgttaaaattatttatcgacaatcctcgctggaaaggggttcccttttacttacaagcagggaaacgtcttcctaaaagaacaacagatatcgctgtgatctttaaaaaatccagctacaatttattcaatgcagagaattgtcctttgtgtccgttagagaatgatttacttattattcgtattcaaccggatgaaggtgttgcgttacaatttaactgcaaggttccaggaacaaataagctcgtacgtcctgtaaaaatggacttccgttacgacagctattttaatactgttactcccgaagcttatgaacggttactgtgcgactgtatccttggggacagaacgctattcactagcaatgaagaagtcttagcatcttgggaactattttctcctctattagaaaaatggtctcaagtacgccctatattccctaactatatggctggatctttacgtcctcaagaagctgatgaactattatctagagatggaaaagcttggcggccctattaa

SEQ ID NO: 2566 - protein, 439 aa, Chlamydia trachomatis
MKLAVQHFSHSSEIDIRVWESLENRIFYHQANFSDAEGYSVLKAYLEQLDQQYGTQGNRLFYLSTPPDYFQEIIRNLNRHQLFYHEQGAQQPWSRLIIEKPFGVNLETARELQQCIDANIDEESVYRIDHYLGKETVQNILTIRFANTLFESCWNSQYIDHVQISVSESIGIGSRGNFFEKSGMLRDMVQNHLTQLLCLLTMEPPSEFFSEEIKKEKIKILKKILPIREEDAVRGQYGEGIVQDVSVLGYREEENVDPNSSVETYVALKLFIDNPRWKGVPFYLQAGKRLPKRTTDIAVIFKKSSYNLFNAENCPLCPLENDLLIIRIQPDEGVALQFNCKVPGTNKLVRPVKMDFRYDSYFNTVTPEAYERLLCDCILGDRTLFTSNEEVLASWELFSPLLEKWSQVRPIFPNYMAGSLRPQEADELLSRDGKAWRPY

SEQ ID NO: 2567 - DNA, 1773 bp, Deinococcus radiodurans
  CDS (1)..(1773)
atgaccgaccggccccgtcccaaaaagagcagtccgaaaaagagtggccccgagaaggccctcgccaaggaaagtgccgcgcagggcgaggcggccaaggcgacccggcaggccactcagcagaccgaggcggccaagaaggtcggtgtggcccagcccggcgctccggcgcagtcccgcaaagcggcccgcaagtcacgccagcgggtgcccaagcacgccggggacaatgcccccaaaagcgacgcgcccggcgccgacggccagaatccctttcgcaccgccatgcgccgcagccgcgcgcccgaacctgccacgctggtgattttcggcgcgaccggcgaccttgcccggcgcaagttgctgcccgccgtgttcggcctgtggcaagacggcctgctcggcagcgcgttcaacatcgtcggcgtgggccggcaggaaatggacgacgagcagttcaaggactacgccatagacgccctgaagacctccaaggaaaccgacgaaatcaaggaaggcagcctggaaaagttccgcgagctgctctactacgaatacggcgaattcggcgaggacgaggtgtacgacaaggtccgcagtgaactcgaccgcgccgagaccgcccgtggcggcggcaagaacgcgctgttttacctctccaccccgccgagcctcttcgagccgatttcgagcggcctggggcggcagggcctgcaagacgagacggaaggctggcggcgcatcgtcatcgaaaaacccttcgggcgcgacctgcaatcggcccgcgaactcaacgacgccattcaccgcgtctgggacgagtcgcaggtgtaccgcatcgaccattatctcggtaaggagacggtgcagaacctgatggcgatccgtttcgggaacgccattttcgagccgctgtggaaccgggggtttgtcgaccacgtgcagatcacggcgtccgaggacctggggctggagggccgcgccgggtactacgaggaagcgggcatcgtgcgcgacatgctgcaaaaccacctgatgcagctttttaccctgaccgccatggaagcgccctcggcgttcgaggccgacgccatccgcgacgagaaggtcaaggtgctgcgggccgtcaagcgcattccggcggaccgggtgcccgaagtcgccgtgcgcgggcagtacggccccggcgccctcgacggccagaccgtgcccggctacaagcaggagccggacgtaaagcgcggcagccgcacgcccacctacgtcgccgtcaagctcgaggtggacaactggcgctggcagggcgtgccgtttttcctgcgcaccggcaagcgcttgcccaagaaagtcaccgaaatcgccgtggtgttcaagcgcccgccgctgggcctctttcccggcggactggagcgcaacgtgctggccttccgcattcagcccgacgaaggcgtgagcctgaagttctcctccaaatcgccggggcaagagatggtgctgcgcgaggtcgtgatggatttccgttacgacgccttcggggcacagctcgaaagcccctactcgcgcttgctgctcgacgcgatgctcggcgacgccaccctctttccccgcgaggacgaggtggaccacgcctggcaaatcgtctcgggcatcttgcaggcctgggaaggcgcggacgcggcggcccccaaattccccaactacgcggcgggcacctggggccccgacgccgccgatgagctgctcggccccggacggcgctggaggcggctgtga

SEQ ID NO: 2568 - protein, 590 aa, Deinococcus radiodurans
MTDRPRPKKSSPKKSGPEKALAKESAAQGEAAKATRQATQQTEAAKKVGVAQPGAPAQSRKAARKSRQRVPKHAGDNAPKSDAPGADGQNPFRTAMRRSRAPEPATLVIFGATGDLARRKLLPAVFGLWQDGLLGSAFNIVGVGRQEMDDEQFKDYAIDALKTSKETDEIKEGSLEKFRELLYYEYGEFGEDEVYDKVRSELDRAETARGGGKNALFYLSTPPSLFEPISSGLGRQGLQDETEGWRRIVIEKPFGRDLQSARELNDAIHRVWDESQVYRIDHYLGKETVQNLMAIRFGNAIFEPLWNRGFVDHVQITASEDLGLEGRAGYYEEAGIVRDMLQNHLMQLFTLTAMEAPSAFEADAIRDEKVKVLRAVKRIPADRVPEVAVRGQYGPGALDGQTVPGYKQEPDVKRGSRTPTYVAVKLEVDNWRWQGVPFFLRTGKRLPKKVTEIAVVFKRPPLGLFPGGLERNVLAFRIQPDEGVSLKFSSKSPGQEMVLREVVMDFRYDAFGAQLESPYSRLLLDAMLGDATLFPREDEVDHAWQIVSGILQAWEGADAAAPKFPNYAAGTWGPDAADELLGPGRRWRRL

SEQ ID NO: 2569 - DNA, 1467 bp, Pseudomonas aeruginosa
  CDS (1)..(1467)
atgagtacaccagccactccaacgtcctgcgacatcctggtcttcggcggtaccggcgacctggccctgcacaagctgctgccggcgctctatcgcctgcaccgggaggaccgcctgccggccgatacacggatcttcgccctcgcccgcagcgcgctggacaacgccgccttcctcgccctcgccgagcgcaacgtccgcgcggtggtggcgcgcagcgagttcgccgccgaacaatggaaaggcttcgccgcgcgcctcgactacctggccatggacgcctcgcagagcgccgacttcggccgtctcgcgcggcacctgaagagcagcgagggccgggtgctggtgcactacctggcgacctcgccgagcctgttcgcgccgatcgcgcagaacctctccatcgccggcctcgccgggccgcaagcgcgcatcgtgctggaaaaaccgctgggccattcgctggactcggcgagggcgatcaaccagtccatcggccgggtgttcgacgagtcgcgggtgttccgcatcgaccactacctgggcaaggaaaccgtgcagaacctgatggccctgcgcttcgccaatgcgttgttcgagccggtctggcgcgcggcgcacatcgaccatgtgcagatcagcgtcaacgagacccttggcgtggagaaccgtggcggctactacgaccacgccggggcgatgcgcgacatggtgcagaaccatctgctccagttgctctgcctggtggcgatggaggcgccggtgcgtttcgacgccgaggctgtgcgcaacgagaagctcaaggtgctgcaggcgctgaagccgatctccgggctcgacgtgcaggacaagacggtacgcggccagtacgccgccggcaggatcggcggccaggaggtgccggcgtactacttcgagaagaacgtcgacaacgacagcgataccgagaccttcgtcgcgctccaggccgaggtcgagaactggcgctgggccggggtgccgttctacctgcgcaccggcaagcgcatggcgcgcaagtgctcggaaatcgtcatccagttcaagccggtgccgcacagcctgatcgacggcggcggcgggccggccaaccgcctgtggataaggttgcagccggaggagcggatcagcgtgcaactgatggccaagaccccgggcaagggcatgcaactggaaccggtggagctggacctcaacctggccgaggccctcagccgcaacaagcggcgctgggacgcctacgaacgcctgctgctggacgtgatcgagggcgactcgacgctgttcatgcgccgcgacgaggtagaggccgcctggggctgggtcgacccgatcctcgccggctggcgcgagcactaccagagcccgcggccctacccggccggcagcaacggcccggaacaggcgcaactgctgctggaactgcagggtcgacgctggctggaatga

SEQ ID NO: 2570 - protein, 488 aa, Pseudomonas aeruginosa
MSTPATPTSCDILVFGGTGDLALHKLLPALYRLHREDRLPADTRIFALARSALDNAAFLALAERNVRAVVARSEFAAEQWKGFAARLDYLAMDASQSADFGRLARHLKSSEGRVLVHYLATSPSLFAPIAQNLSIAGLAGPQARIVLEKPLGHSLDSARAINQSIGRVFDESRVFRIDHYLGKETVQNLMALRFANALFEPVWRAAHIDHVQISVNETLGVENRGGYYDHAGAMRDMVQNHLLQLLCLVAMEAPVRFDAEAVRNEKLKVLQALKPISGLDVQDKTVRGQYAAGRIGGQEVPAYYFEKNVDNDSDTETFVALQAEVENWRWAGVPFYLRTGKRMARKCSEIVIQFKPVPHSLIDGGGGPANRLWIRLQPEERISVQLMAKTPGKGMQLEPVELDLNLAEALSRNKRRWDAYERLLLDVIEGDSTLFMRRDEVEAAWGWVDPILAGWREHYQSPRPYPAGSNGPEQAQLLLELQGRRWLE

SEQ ID NO: 2571 - DNA, 1422 bp, Caulobacter crescentus
  CDS (1)..(1422)
atggtgctgctgggcggagcgggcgatttggccctccggatgctgctgccttctctgtatttcctggagctcgaccgactgctgccgcacgatctgcggatcattggcgtcgcccgggccgaccatgacgcggccagctacaaggcgctggtccgcgagcaactgggcaagcgcgcgacagtggaggaggcggtttggaatcgcctcgccgcgcgcctcgactacgtgcctgcgaacatcaccagtgaggaagacaccaagaagctggccgaacggatcggtgcgcatggcacgctggtcatcttcttctcgctgtcgcccagcctctacggcccggcttgccaggctttgcaggccgccggcctgacggggcccaacacgcgcttgatcctcgaaaagccgcttggccgcgatctcgaaagctccaaggccaccaacgccgccgtcgccgctgtggtcgacgagagccaagtgttccgcatcgaccactatctgggcaaggaaaccgtccagaacctgacggccctgcgcttcgccaacgtgctgttcgagcccctgtgggatcgcaacacgatcgaccatgtgcagatcaccatcgccgagaccgaaaaggtcggcgaccgctggccctactacgacgaatacggcgcgctgcgggacatggtgcagaaccacatgctgcaactgctgtgtctggtcgccatggaagcgccctcaggcttcgatcccgatgcggtgcgcgacgagaaggtcaaggtgctgcgctccctgcggcccttcaccaaggagaccgtggcccacgacaccgtgcgtggccagtacgtcgccggtgtggtcgagggcggcgcgcgcgctggctatgtcgaggaagtgggcaagcccaccaagaccgagactttcgtggccatgaaggtcgcgatcgacaactggcgttgggacggcgtgccgttcttcctgcgcaccggcaagaacctgccggaccgccgcacccagatcgtcgtccagttcaagcctttgccgcacaacatcttcggtccggcgaccgatggcgagctgtgcgccaaccgcctagtcatcgacctgcagccggacgaagacatctcgctgacgatcatgaacaagcgtccgggtctctcggacgagggcatgcgactgcagtcgctgccgctgtcgctgtcgtttggccagaccggcgggcgccgtcgcatcgcttacgaaaagctgttcgtcgacgccttccgcggcgaccgtacgctgttcgtgcgtcgcgatgaggtcgagcaggcctggcgcttcatcgacggcgtctcggcggcctgggaagaggccagtatcgaaccggcgcactatgcggcgggcacctggggaccgcagtccgcccagggcctgatctcgcccggcggccgagcctggaaggcctga

SEQ ID NO: 2572 - protein, 473 aa, Caulobacter crescentus
MVLLGGAGDLALRMLLPSLYFLELDRLLPHDLRIIGVARADHDAASYKALVREQLGKRATVEEAVWNRLAARLDYVPANITSEEDTKKLAERIGAHGTLVIFFSLSPSLYGPACQALQAAGLTGPNTRLILEKPLGRDLESSKATNAAVAAVVDESQVFRIDHYLGKETVQNLTALRFANVLFEPLWDRNTIDHVQITIAETEKVGDRWPYYDEYGALRDMVQNHMLQLLCLVAMEAPSGFDPDAVRDEKVKVLRSLRPFTKETVAHDTVRGQYVAGVVEGGARAGYVEEVGKPTKTETFVAMKVAIDNWRWDGVPFFLRTGKNLPDRRTQIVVQFKPLPHNIFGPATDGELCANRLVIDLQPDEDISLTIMNKRPGLSDEGMRLQSLPLSLSFGQTGGRRRIAYEKLFVDAFRGDRTLFVRRDEVEQAWRFIDGVSAAWEEASIEPAHYAAGTWGPQSAQGLISPGGRAWKA

SEQ ID NO: 2573 - DNA, 1437 bp, Borrelia burgdorferi (Lyme disease spirochete)
  CDS (1)..(1437)
atgaaagaaagaagtgtttctaattttgatattgtaatttttggggttaccgggaatttgtctagaaaaaagcttattccttcactttttaatttatttaaaaataaatgtattagcaattttagggttattggtttttctcgtaagatttttacagataaagaatttagattgtatattaaagattctttatggcaggaagagaccgattcgttgattgagatttttttaaatttttttgtttatgtatttggcgattttaatgaaaaggagtcttataaaaatttatttaaatttttagatagaagtcgagaaacgatatattatctttcgacgtctcctgcattttatggacctataattaatcatttgaaaaagtattttttaagcgaaaaattgactttgtcaaaaatagttcttgagaagccttttggctctagtcttgagacagcaaaaaaattaaatagtttgctttattctgcttttaaagaagatcaaatttatagaatagatcactatttgggtaaagaaacggttcaaaatatttttacatttagattcggcaattctatttttgaaaatatttggaataatcgttatgtagattttgttcagattacggtagcagaagaattaggtcttgatggaagagtagagtattacgattctgttggcgctttgaaggatatggttcaaaatcatattttacaattgttaagccttgttgcaatggagtctcctattaaatttgattctgagtttattcatgatgaaaaagtaaaagttttaaaaagtttgaggaaaattagcaaagaagatattaagaattacattgttaagggtcaatatataggctcacaagttcaaggggtttttaaaaaaggctataaagatgaaacagaatttttgggaaattcaaataccgaaacttatttagctatgaaagtgtttattaataattggcgttggtctggggttcctttttatcttagaactgggaaaggtcttgctaggaaattttcagaaatatatattcaatttaaaaaaccgagctttactctttttaacaatagttctgttgatttttctaatgctttgatatttagaattcagccaagggatggaattgaaatcaaattcaataccaagaagcccggatataattatgaaattcaaactgctaatatggagttttcatatcacggagcatttaaaagattgtttgatgaggcttatgagcgtttattgttagacgcttttttaggagatggtactttatatgcgacaagtgatgagattgaaagttcttgggaatttgtttcagatattgcaaataaatgggcagatattgaaatttgtaattatttttatggctctgaaggaccaaaagagatagactctattttagaaaaagatcatttttggcgtaaaatttaa

SEQ ID NO: 2574 - protein, 478 aa, Borrelia burgdorferi (Lyme disease spirochete)
MKERSVSNFDIVIFGVTGNLSRKKLIPSLFNLFKNKCISNFRVIGFSRKIFTDKEFRLYIKDSLWQEETDSLIEIFLNFFVYVFGDFNEKESYKNLFKFLDRSRETIYYLSTSPAFYGPIINHLKKYFLSEKLTLSKIVLEKPFGSSLETAKKLNSLLYSAFKEDQIYRIDHYLGKETVQNIFTFRFGNSIFENIWNNRYVDFVQITVAEELGLDGRVEYYDSVGALKDMVQNHILQLLSLVAMESPIKFDSEFIHDEKVKVLKSLRKISKEDIKNYIVKGQYIGSQVQGVFKKGYKDETEFLGNSNTETYLAMKVFINNWRWSGVPFYLRTGKGLARKFSEIYIQFKKPSFTLFNNSSVDFSNALIFRIQPRDGIEIKFNTKKPGYNYEIQTANMEFSYHGAFKRLFDEAYERLLLDAFLGDGTLYATSDEIESSWEFVSDIANKWADIEICNYFYGSEGPKEIDSILEKDHFWRKI

SEQ ID NO: 2575 - DNA, 1539 bp, Chlamydophila pneumoniae, Chlamydia pneumoniae
  CDS (1)..(1539)
atgacgaatgttgttcaggaaactataggtggattgaattccccacgaacgtgccctccttgtattttagttatctttggagcgactggagatctgacggcaaggaaacttttacccgctctatatcacctcactaaagaaggacgcctttcagaccagtttgtttgcgtaggatttgcacgtcgagagaaatcgaatgaactgttccgccaagagatgaaacaagctgtcatacaattttctccttccgaattagatattaaggtatgggaagatttccaacagcgcctcttttatcatcgctcagaattcgataacaatatgggatatacatctctcaaggactccttagaagatttagataaaacgtacggaacacgtggaaatcgtcttttttatctttctactcccccccaatatttttctagaatcattgaaaatttaaataaacataagcttttctataaaaatcaagaccaagggaaaccctggtcccgtgtcattatagaaaaaccttttggaagagacttagatagtgctaagcaacttcagcaatgtatcaatgagaatcttaatgaaaattcggtctatcatatagatcactatttagggaaagaaacggttcaaaacatcttaacaacacgtttcgccaatacgattttcgaatcgtgttggaattcacaatatatcgatcatgtccaaatcagtttgagtgaaacgattggcataggatctcgcggcaatttctttgagaaatctgggatgcttcgggatatggtacagaaccatatgatgcagctactctgtttactcactatggagcctcctacaacttttgatgctgatgaaatcagaaaagaaaaaatcaaaattcttcaacgtatctcaccattttcagaaggttcttcgattgtccgaggacaatatggtccaggaacggttcaaggagtctcggtccttggctatcgtgaagaagagaatgttgacaaagattcccgagtagagacctacgtagctttaaaaacagtcattaataatccccgttggcttggagttcctttctatttacgtgcaggaaaacgactcgccaaaaaatctacagacatttctattatttttaaaaaatcaccctacaatttatttgcagccgaagaatgttcacgttgtccgatagaaaatgatttgctaatcatcagaattcaaccggacgaaggtgtcgctttgaaattcaactgtaaggttccaggaactaataatattgtccgtcctgttaagatggacttccgttacgacagctatttccaaactacaactccagaagcatacgagcgtttattatgtgattgcattataggggatcgtacgttatttactggtggagatgaagttatggcttcttggaagctttttactcctgtattagaggagtgggaccaagattcctcaccctcgtttccaaactatcctgcaggatcttcaggtcctaaagaagctgatgctctcattgaaagagacggaagaagctggagacctttatag

SEQ ID NO: 2576 - protein, 512 aa, Chlamydophila pneumoniae, Chlamydia pneumoniae
MTNVVQETIGGLNSPRTCPPCILVIFGATGDLTARKLLPALYHLTKEGRLSDQFVCVGFARREKSNELFRQEMKQAVIQFSPSELDIKVWEDFQQRLFYHRSEFDNNMGYTSLKDSLEDLDKTYGTRGNRLFYLSTPPQYFSRIIENLNKHKLFYKNQDQGKPWSRVIIEKPFGRDLDSAKQLQQCINENLNENSVYHIDHYLGKETVQNILTTRFANTIFESCWNSQYIDHVQISLSETIGIGSRGNFFEKSGMLRDMVQNHMMQLLCLLTMEPPTTFDADEIRKEKIKILQRISPFSEGSSIVRGQYGPGTVQGVSVLGYREEENVDKDSRVETYVALKTVINNPRWLGVPFYLRAGKRLAKKSTDISIIFKKSPYNLFAAEECSRCPIENDLLIIRIQPDEGVALKFNCKVPGTNNIVRPVKMDFRYDSYFQTTTPEAYERLLCDCIIGDRTLFTGGDEVMASWKLFTPVLEEWDQDSSPSFPNYPAGSSGPKEADALIERDGRSWRPL

SEQ ID NO: 2577 - DNA, 1476 bp, Escherichia coli
  CDS (1)..(1476)
atggcggtaacgcaaacagcccaggcctgtgacctggtcattttcggcgcgaaaggcgaccttgcgcgtcgtaaattgctgccttccctgtatcaactggaaaaagccggtcagctcaacccggacacccggattatcggcgtagggcgtgctgactgggataaagcggcatataccaaagttgtccgcgaggcgctcgaaactttcatgaaagaaaccattgatgaaggtttatgggacaccctgagtgcacgtctggatttttgtaatctcgatgtcaatgacactgctgcattcagccgtctcggcgcgatgctggatcaaaaaaatcgtatcaccattaactactttgccatgccgcccagcacttttggcgcaatttgcaaagggcttggcgaggcaaaactgaatgctaaaccggcacgcgtagtcatggagaaaccgctggggacgtcgctggcgacctcgcaggaaatcaatgatcaggttggcgaatacttcgaggagtgccaggtttaccgtatcgaccactatcttggtaaagaaacggtgctgaacctgttggcgctgcgttttgctaactccctgtttgtgaataactgggacaatcgcaccattgatcatgttgagattaccgtggcagaagaagtggggatcgaagggcgctggggctattttgataaagccggtcagatgcgcgacatgatccagaaccacctgctgcaaattctttgcatgattgcgatgtctccgccgtctgacctgagcgcagacagcatccgcgatgaaaaagtgaaagtactgaagtctctgcgccgcatcgaccgctccaacgtacgcgaaaaaaccgtacgcgggcaatatactgcgggcttcgcccagggcaaaaaagtgccgggatatctggaagaagagggcgcgaacaagagcagcaatacagaaactttcgtggcgatccgcgtcgacattgataactggcgctgggccggtgtgccattctacctgcgtactggtaaacgtctgccgaccaaatgttctgaagtcgtggtctatttcaaaacacctgaactgaatctgtttaaagaatcgtggcaggatctgccgcagaataaactgactatccgtctgcaacctgatgaaggcgtggatatccaggtactgaataaagttcctggccttgaccacaaacataacctgcaaatcaccaagctggatctgagctattcagaaacctttaatcagacgcatctggcggatgcctatgaacgtttgctgctggaaaccatgcgtggtattcaggcactgtttgtacgtcgcgacgaagtggaagaagcctggaaatgggtagactccattactgaggcgtgggcgatggacaatgatgcgccgaaaccgtatcaggccggaacctggggacccgttgcctcggtggcgatgattacccgtgatggtcgttcctggaatgagtttgagtaa

SEQ ID NO: 2578 - protein, 491 aa, Escherichia coli
MAVTQTAQACDLVIFGAKGDLARRKLLPSLYQLEKAGQLNPDTRIIGVGRADWDKAAYTKVVREALETFMKETIDEGLWDTLSARLDFCNLDVNDTAAFSRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSPPSDLSADSIRDEKVKVLKSLRRIDRSNVREKTVRGQYTAGFAQGKKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 2579 - DNA, 1548 bp, Treponema pallidum subsp. pallidum (syphilis spirochete)
  CDS (1)..(1548)
atggggaaaatcagtggcagcggcacggtcgcgccgcacatcctggttatctttggcgcttcaggcgaccttgccgcgcggaagcttatcccctcgctttgggatctctttgagcaagagctcctgccccgtacattcggtatactcggcgcagggcgtacggctctgtctacagagtcttttcgcgcacggcttgcagaggcggtcacaaagcatgcagtgcgcacaccgcacgacccggcgcgcctcaccgaattcctgcagaagatccactacttctcgttcgatcccaccgactctgtcgcctttgccgactttgccacgtacgtgcgcaccctcgaccagtcgctgcacaccgagggcaactttatcttctatcttgccactccccctagcctgtacgaaactatccccacgcagcttgctatgcaccacttgaaccgggaacagggtaattttcgcagggtagttattgaaaaaccctttggctacaacctagaaaccgcgcagcaccttaatgcgagcttgcgtgcccactttcaggaaaaccaaacctatcgcatcgatcactatctgggtaaggaaacggtccaaaacatcctggtcactcgctttgccaatccccttttcgagcccacatggaaccggacccatatcgattacgttgaaattactgcaagcgaatcactaggtgtcgaaaaccgcggcggttactacgaccagtccggtgcattgcgcgatatgatccaaaaccacttgttactcctcttgggtattatcgcgatggaggcgcccgccgtcgtgagttcaagtcgtctacgggatgaaatcgtaaaggtctttgactgcctgcgccctatgggagaacgcgacgtcatgcagcatacggtgcgtgcccaatacgtcgccggcaagatacgcggtgtagccgtccccggctaccttgaggagtcaggcgttgaccctcgctcgtgcactgaaacctttgccgcactcaagtgctacatcgacaattggcggtggatggacgttcccttctacctgcggacgggtaagcgtttgcccacgggcgtcactgaggtgatcgtccattaccgaacgctccccatcgcgcttttcgagcacatcgaacgcccgtgcgcacgcgagggcaacgcgcttgtcattcgcattcaacccgacgaaggaattcagcttaaaatcgacctcaaagagcccggcgcggggttcaagactattcccgtcagtgttgattttcagtattcggctcttacctattcgcacttacccagcgcgtatgagcggctattgcttgactgcatgaatggagacaacacgctctaccatcgagatgacgcggtggagtctgcatggcgcttcatagatcctattcttgccgcatggaaatcaaacaagagtcctctacttacgtaccctgcaggaagctggggtccgaaggctgcagacgacctgatcaaagggagtgctccacggtggcatcacccctcttctacgctgctcagcgatgattttgcctgccgactctag

SEQ ID NO: 2580 - protein, 515 aa, Treponema pallidum subsp. pallidum (syphilis spirochete)
MGKISGSGTVAPHILVIFGASGDLAARKLIPSLWDLFEQELLPRTFGILGAGRTALSTESFRARLAEAVTKHAVRTPHDPARLTEFLQKIHYFSFDPTDSVAFADFATYVRTLDQSLHTEGNFIFYLATPPSLYETIPTQLAMHHLNREQGNFRRVVIEKPFGYNLETAQHLNASLRAHFQENQTYRIDHYLGKETVQNILVTRFANPLFEPTWNRTHIDYVEITASESLGVENRGGYYDQSGALRDMIQNHLLLLLGIIAMEAPAVVSSSRLRDEIVKVFDCLRPMGERDVMQHTVRAQYVAGKIRGVAVPGYLEESGVDPRSCTETFAALKCYIDNWRWMDVPFYLRTGKRLPTGVTEVIVHYRTLPIALFEHIERPCAREGNALVIRIQPDEGIQLKIDLKEPGAGFKTIPVSVDFQYSALTYSHLPSAYERLLLDCMNGDNTLYHRDDAVESAWRFIDPILAAWKSNKSPLLTYPAGSWGPKAADDLIKGSAPRWHHPSSTLLSDDFACRL

SEQ ID NO: 2581 - DNA, 1476 bp, Buchnera sp
  CDS (1)..(1476)
atgataatagaaacaaatcacgcttgcgatttagtaatttttggcgctaaaggagatctaacaaaaagaaaattattaccagctttatataaattagaaaaatctaaaaaaatacataaatatacacgcattatcgcttctggtcgtgctgattggagcacagaagactatatagaaaaaataaaaacagaagtaaaaaattttttaaatgaagaaataaatgatcttatttggaaaaatttgagttctcgtatatttttttgtaatattgatgtacatgaaccattgcatttttttagactaaaaacgatacttaaacaaaaaaaaaatatcatagtttactattgcgctgttccttctaatacgttgaattctatttttatcggtttaggaaatgcacatttaaattctgttccatcgcgtatagtattagaaaaaccattaggagtttgtttgaaaacatcaaaaaaaatcaatgatcaaatttctaaatattttctagaatcgcaaatttttcgtattgatcactatttaggaaaagaatcaatacttaatctttttgctttacgattttctaatacatgtcttttttataattggaataataaaacaattgatcatattcaaattactgtatctgaggaagttggaattgaagatagatggaattattttaatatgatgggacaaatgaaagatatggtgcaaaatcatcttttacaaatattaactattcttacgatggatcaaccaaaaaatattagttctgaaagtattcaacatgaaaaagtaaaaatactacgttctttaaaccccattaatattcataacataaataaaaaaactgttcgaggacaatattgttcaggagttatcaacgagaaaaaagtaccttcttatttagaagaaaatggtgcaaataaaaatagtttaactgaaacctttgttgctataaaagttgatctaaataataagcaatggtccggtgtcccattttaccttagaactggaaaacgtttagcacataaatattctgaaatagtcgttttttttaagaaaaaacctacaaatttgtttaaaaatttaaattcagaattattacaaaataaattaattatacgcttagaacctaatccaaatattatatttgatttttcagtaaaagcaccaggattagaacaagaatataaaatagaaaattcccagctaaaatccagtcaatttagtaagaaatattctaaaaattcaattgatgcttacgaaagattgttatttgaaattatgagaggtgtacaatctttattcgtatgccgagatgaaatagaagctgcgtggaaatggatagatcccatcatacatgcatggaaaaattctaaaaataatgcccctcaattatatatgtctggtacttgggggcctaaaaattctgatttgctacttgctcatgatggtcgtgtttggtatgaatttcattaa

SEQ ID NO: 2582 - protein, 491 aa, Buchnera sp
MIIETNHACDLVIFGAKGDLTKRKLLPALYKLEKSKKIHKYTRIIASGRADWSTEDYIEKIKTEVKNFLNEEINDLIWKNLSSRIFFCNIDVHEPLHFFRLKTILKQKKNIIVYYCAVPSNTLNSIFIGLGNAHLNSVPSRIVLEKPLGVCLKTSKKINDQISKYFLESQIFRIDHYLGKESILNLFALRFSNTCLFYNWNNKTIDHIQITVSEEVGIEDRWNYFNMMGQMKDMVQNHLLQILTILTMDQPKNISSESIQHEKVKILRSLNPINIHNINKKTVRGQYCSGVINEKKVPSYLEENGANKNSLTETFVAIKVDLNNKQWSGVPFYLRTGKRLAHKYSEIVVFFKKKPTNLFKNLNSELLQNKLIIRLEPNPNIIFDFSVKAPGLEQEYKIENSQLKSSQFSKKYSKNSIDAYERLLFEIMRGVQSLFVCRDEIEAAWKWIDPIIHAWKNSKNNAPQLYMSGTWGPKNSDLLLAHDGRVWYEFH

SEQ ID NO: 2583 - DNA, 1512 bp, Lactococcus lactis subsp. lactis
  CDS (1)..(1512)
atgaccgaacaaaaacaagcacttttcaccatcttcggagcaactggtgacctcgctaaaagaaagctctacccttcactctttcgcctcttcaaaaaaggtgaactagctgacaattttgcagtcatcggtaccgctcgccgtccatggacaaacgagtattatcgtgaagttgttttagagtctatcaaagatttaatgaactcaaaaacggaagccgaaaatttcgccagccatttttattatcaaagtcacgatgttagcgacagctcacattacgttaacttaaaagatttgggtgaaaaattgcgtaaacagtataaaactgctggcaatcaagtcttctttttagcaatggctcctcaattttttggcactatctctgaacaccttaaatcagaaaatattttgacaggtgagggttttgagagaatcgtcattgaaaaaccatttggaacaagctacgatacggcaaaatcacttaatgacagcctcgcaaaagtatttagtgaagaacaaattttccgaatcgaccactaccttggaaaagaaatgatccaggccgtttctgccgttcgttttgccaatccaatctttgaatcgctttggaataatcaacacattgataacgttcagattacttttgccgaatttatcggtgttgaagaccgtggcggttactacgaaacttctggtgctttaaaagatatgattcaaaaccatgtcttacaagtactcagcctcattgccatggaaaaacctgaaaaatttgatgaatcttatattgtaaaagaaaaagttaaagcccttaatgcaatccgtcaatattcttctgaggaagctttagaaaacttcgttcgtggtcaatatatcgcaggacgttttgacggtgaagattacctaggctatcgcgaagaagattctgttgcaacagacagtcgaactgaaactttcgccgctggaaaatttgtcattgataatgagcgttggtcaggcgtccctttctatgttcgctcaggaaaacgtatgactgaaaaaggaactcgtattaatatcgttttcaaaaaagataaagacaatctctttgcagaaaattgcgatgaccaatccgttcaaaatgttttgaccatttatattcaaccaactgaagggttttcactttcagtaaatggaaaagcggctggtcaaggcttccatttagagcctttgcggttaaatttccgacacgatagtgaatttcttggaaattctcctgaagcatatgaaaaacttttcctagatgtccttaatggagacggaacaaatttctcacattgggaagaagcggctcgcgcctgggaacttattgatgttattcgagaagcttgggataaagaaacttctgagcttccaacttatgcggctcgcacaatgggacctaaggctgcatttgacttactagaaaaaaatggtcacgaatgggcttggcaacctgatttatggtatcaagaacgtggttactacaataaataa

SEQ ID NO: 2584 - protein, 503 aa, Lactococcus lactis subsp. lactis
MTEQKQALFTIFGATGDLAKRKLYPSLFRLFKKGELADNFAVIGTARRPWTNEYYREVVLESIKDLMNSKTEAENFASHFYYQSHDVSDSSHYVNLKDLGEKLRKQYKTAGNQVFFLAMAPQFFGTISEHLKSENILTGEGFERIVIEKPFGTSYDTAKSLNDSLAKVFSEEQIFRIDHYLGKEMIQAVSAVRFANPIFESLWNNQHIDNVQITFAEFIGVEDRGGYYETSGALKDMIQNHVLQVLSLIAMEKPEKFDESYIVKEKVKALNAIRQYSSEEALENFVRGQYIAGRFDGEDYLGYREEDSVATDSRTETFAAGKFVIDNERWSGVPFYVRSGKRMTEKGTRINIVFKKDKDNLFAENCDDQSVQNVLTIYIQPTEGFSLSVNGKAAGQGFHLEPLRLNFRHDSEFLGNSPEAYEKLFLDVLNGDGTNFSHWEEAARAWELIDVIREAWDKETSELPTYAARTMGPKAAFDLLEKNGHEWAWQPDLWYQERGYYNK

SEQ ID NO: 2585 - DNA, 1572 bp, Drosophila melanogaster
  CDS (1)..(1572)
atggcaacgcaaaaggaagatcacaccgccctggatctcataatcaagtcactcaagtcgcctacaatggtctgcgagggaacccactttgacggcaagattccgcacacgttcgtcatctttggggcgtcgggcgatctggccaagaagaagatctaccccacgctctggtggctctaccgcgatgacctgctgcccaagccgaccaagttctgcggctatgcccgttccatgctgaccgtcgatagcatcaaggagcagtgtctgccgtacatgaaggtccagccgcacgagcagaagaagtacgaggagttctgggccctcaatgagtacgtgtccggcagatatgacggacgcactggcttcgagctgcttaaccagcagctggagattatggagaacaagaacaaggccaaccgcatcttctatctggccctgccgcccagcgtcttcgaggaggtgactgtcaacatcaagcagatctgcatgtcggtctgcggttggaaccgcgtgatcatcgagaagcctttcggccgggatgacgcctcctcggcaggcctgagcgaccatctggccggtctgttccaggaggatcagctgtaccgcatcgatcactacctgggcaaggagatggtgcagaagctgatgaccatacgcttcggcaacaagatcctcagctcgacgtggaaccgcgagaacatcgcctccgtgctgatcacgttcaaggagcccttcggcacgcagggtcgtggcggctacttcgacgagtttggcatcatacgcgacgttatgcagaaccatctgctgcagatcctctcgctggtggccatggagaagccggtgagctgccacccggacgacattcgtgacgagaaggtcaaggtgctgaagagcatcgaggccctgacgctggatgacatggtgctgggccagtacctgggcaatccgcagggtacaaacgatgatgcgcgcacgggctacgtggaggaccccaccgttagcaacgattcgaacacgcccacctacgccgctcggtcgctcaagatcaacaacgagcgctggcagggagtgcccttcatcctgcgctgcggcaaggcgctgaacgagcgaaaggcggaggtgcgcatccagtaccaggacgtgctcggcgacatcttcgagggcaatacgaagcgcaacgagctggtgatacgcgtccagccgggcgaggccctgtactttaagatgatgaccaagagccccggcataacgttcgacatcgaggagacggagctggacctcacctacgagcaccgctacaaggactcctacctgccggacgcgtacgagcgtctcatcctcgacgtcttctgcggctcccagatgcacttcgtccgctcggcagctgcgcaggcgtggcgcatcttcacgcccattctgcaccagatcgagaaggagcacattcgtccaatcacctaccagtacggatcgcgcggtcccaaggaggcggaccgcaagtgcgaggagaacaatttcaagtactccggctcctacaagtggcacggcggcaaggcggccacgtccaatcactga

SEQ ID NO: 2586 - protein, 523 aa, Drosophila melanogaster
MATQKEDHTALDLIIKSLKSPTMVCEGTHFDGKIPHTFVIFGASGDLAKKKIYPTLWWLYRDDLLPKPTKFCGYARSMLTVDSIKEQCLPYMKVQPHEQKKYEEFWALNEYVSGRYDGRTGFELLNQQLEIMENKNKANRIFYLALPPSVFEEVTVNIKQICMSVCGWNRVIIEKPFGRDDASSAGLSDHLAGLFQEDQLYRIDHYLGKEMVQKLMTIRFGNKILSSTWNRENIASVLITFKEPFGTQGRGGYFDEFGIIRDVMQNHLLQILSLVAMEKPVSCHPDDIRDEKVKVLKSIEALTLDDMVLGQYLGNPQGTNDDARTGYVEDPTVSNDSNTPTYAARSLKINNERWQGVPFILRCGKALNERKAEVRIQYQDVLGDIFEGNTKRNELVIRVQPGEALYFKMMTKSPGITFDIEETELDLTYEHRYKDSYLPDAYERLILDVFCGSQMHFVRSAAAQAWRIFTPILHQIEKEHIRPITYQYGSRGPKEADRKCEENNFKYSGSYKWHGGKAATSNH

SEQ ID NO: 2587 - DNA, 1575 bp, Synechococcus sp
  CDS (1)..(1575)
atgactcccaaactgcttgagaacccgcttcgcattggactccgccaagacaaagtccctgaaccgcaaatcctcgtcatctttggggccaccggcgacttaacccagcgcaaactggtgcctgccatctacgagatgcacctcgaacggcgtttgccgccagaactgacgatcgtgggggtggctcggcgcgactggagcgatgactatttccgagagcaccttcgccaaggggttgaacagtttggcggcggcattcaagcagaggaagtttggaacacctttgcacaaggcctcttctttgcgccgggcaacattgatgacccccagttttatcaaacccttcgcgatcgccttgcgaatctggatgagctgcgcggcacgcggggcaatcgcactttttacctctcggtcgcaccccgtttctttggtgaagctgcaaaacaactcggggcagccggaatgcttgccgatccagctaaaacgcggctggtcgtcgaaaaaccttttggccgcgatctcagctccgctcaggtgctgaatgccatcttgcagaacgtttgccgcgaaagccagatctatcggattgaccattacctcggcaaagaaacagttcaaaacctcttagttttccggtttgccaatgccatttttgagccgctctggaaccggcaatacattgaccatgtccaaatcacggtggctgaaactgtggggttggaagggcgagctggctactacgaaactgctggtgctctgcgggatatggtgcaaaaccacttgatgcagctcttcagcctgacggcgatggagccgccaaactctctaggtgctgacggtatccgtaacgaaaaggtcaaggtggtgcaagccacacggctggcggatatcgacgatctcagtttgtctgcggtgcgggggcagtacaaagcgggctggatgaatggccgctctgtgcccgcctatcgggatgaggagggagcggatccccagtcgtttacgcccacctatgtcgccatgaaattgctggtcgacaactggcgctggcagggagtgccgttctatctacggacgggtaaacggatgcccaaaaaggtgacggagattgccattcagttcaaaaccgtgccgcacttgatgttccagtcagccacccaaaaagtgaatagtcccaacgtcttagtgctgcggattcagcccaatgaaggcgtgtccttgcgctttgaagtgaaaacaccgggttcctcgcaacggacgcgatcggtggatatggacttccgctacgacacggcttttggctcccccacccaagaggcctatagccgcctgctggtggactgcatgctcggcgatcagacgctgttcacccgcgctgatgaggttgaagcgtcttggcgggttgtgacgccgttactcgaatcttgggatgacccgcgccaagccgctggcatttctttttacgaagctggcacttgggagccggcagaggcggagcagttgatcaaccgtgatggtgccgttggcgtcgtctctaggatccctgcaacccagctcaattcttctggagatgtttga

SEQ ID NO: 2588 - protein, 524 aa, Synechococcus sp
MTPKLLENPLRIGLRQDKVPEPQILVIFGATGDLTQRKLVPAIYEMHLERRLPPELTIVGVARRDWSDDYFREHLRQGVEQFGGGIQAEEVWNTFAQGLFFAPGNIDDPQFYQTLRDRLANLDELRGTRGNRTFYLSVAPRFFGEAAKQLGAAGMLADPAKTRLVVEKPFGRDLSSAQVLNAILQNVCRESQIYRIDHYLGKETVQNLLVFRFANAIFEPLWNRQYIDHVQITVAETVGLEGRAGYYETAGALRDMVQNHLMQLFSLTAMEPPNSLGADGIRNEKVKVVQATRLADIDDLSLSAVRGQYKAGWMNGRSVPAYRDEEGADPQSFTPTYVAMKLLVDNWRWQGVPFYLRTGKRMPKKVTEIAIQFKTVPHLMFQSATQKVNSPNVLVLRIQPNEGVSLRFEVKTPGSSQRTRSVDMDFRYDTAFGSPTQEAYSRLLVDCMLGDQTLFTRADEVEASWRVVTPLLESWDDPRQAAGISFYEAGTWEPAEAEQLINRDGAVGVVSRIPATQLNSSGDV

SEQ ID NO: 2589 - DNA, 1485 bp, Haemophilus influenzae
  CDS (1)..(1485)
atgcaaactgataataattgtatcgtcatttttggcgcgtctggtgacttaactcatcgtaaactcattccagccctttataatctctacaaaatcgggcgtttgagtgaaaacttttccgttcttggtgttgcacgttctgacttgaacgatgaaactttccgcgaaaaaatgcgtgaggcgttaattcataatgaagaaacaacaccagaaaccttagatgctttctgctctcatctttattaccaagcagtgaatacttcggatgctcaagattacggcaaacttgttccacgcttagacgatcttcacgataaatatcaaacctgtggtaacaccttttactatatgtccactccaccaagtctttatggcgtgattcctgagtgtttggctgcacatggtttaaatacggaagaatatggctggaaacgtattatcgttgaaaaaccttttggttacgatgaaaaaacagcgcaaacattagacgtacaaatccaccgtttctttgaagaacaccaaatttatcgtatcgatcattatttaggtaaagaaaccgttcaaaacttgctcgtattacgtttttcaaatggttggtttgaaccgctttggaaccgtaatttcattgattatgtagaaattactggtgcagaatctattggcgtggaagagcgcgggggctattatgatggttctggcgcaatgcgagatatgttccaaaaccatttattgcaagtgttagcgatggtggcaatggagccgccagcgattattaacgcgaattcaatgcgtgatgaagtagcaaaagtgatgcatagtttgcgtccattaacttcggaggatatggagaataaccttgttttgggtcaatacacagcggctgaaattaacggcaaaatggaaaaaggctatctagaagaaaaaggcgtaccggcaaattctcgtactgaaacctacatcgcattacgttgtgaaattgaaaactggcgttgggctggtgtgccgttctatgttcgtacgggtaaacgcttaccagctcgtgtgactgaaattgtgatccattttaaaactacgccacatcctgtattcagccaaaatgcaccagagaataaattaattattcgtattcaacctgatgaagcgatttcaatgcgttttggtttgaaaaaaccaggtgcaggttttgaggcgaaagaagtatcaatggatttccgttatgcagatttagcaggtgcgcaagtattaaccgcttatgaacgtttattgttggatgcgatgaaaggcgatgcaaccttgtttgctcgtactgatgctgtgcatgccgcatggaaatttgtgcaaccgattttagattacaaagccaatggtggtcgtattcacgaatatgaagctggcacttgggggcctgttgcagctgataaattaatcgcaaaacaaggcaaagtgtggcgtaaaccaagtggattgatgaagaaaaaagtttaa

SEQ ID NO: 2590 - protein, 494 aa, Haemophilus influenzae
MQTDNNCIVIFGASGDLTHRKLIPALYNLYKIGRLSENFSVLGVARSDLNDETFREKMREALIHNEETTPETLDAFCSHLYYQAVNTSDAQDYGKLVPRLDDLHDKYQTCGNTFYYMSTPPSLYGVIPECLAAHGLNTEEYGWKRIIVEKPFGYDEKTAQTLDVQIHRFFEEHQIYRIDHYLGKETVQNLLVLRFSNGWFEPLWNRNFIDYVEITGAESIGVEERGGYYDGSGAMRDMFQNHLLQVLAMVAMEPPAIINANSMRDEVAKVMHSLRPLTSEDMENNLVLGQYTAAEINGKMEKGYLEEKGVPANSRTETYIALRCEIENWRWAGVPFYVRTGKRLPARVTEIVIHFKTTPHPVFSQNAPENKLIIRIQPDEAISMRFGLKKPGAGFEAKEVSMDFRYADLAGAQVLTAYERLLLDAMKGDATLFARTDAVHAAWKFVQPILDYKANGGRIHEYEAGTWGPVAADKLIAKQGKVWRKPSGLMKKKV

SEQ ID NO: 2591 - DNA, 1446 bp, Neisseria meningitidis
  CDS (1)..(1446)
atgagtacacaaacaaattttgatttggtgttgttcggtgcgaccggcgatttggcaatgcgcaaacttttgccctgcctgtatcaggcgcacgtggccggtttgcttcatcccgaaggtcgtattttgggtgtgagccgcagcgaattggataccgaaggttttctggcgaaggtggaaaccagttccaaaatccatgtgaaagaaaatttttccgatgaggcttgggcatcgtttgtcgaacgtctcgcatatctcaaagtcgatgttacgcagccggacgattttgctgctttgggcgatttggtcaaagcgcgcaagaatactgaaaatgtcgtgatctacctctcaactgcgccgaaattctttgcgcaagcctgcgagaaccttgctgcgatcggtttgaatgccgacaacgtgcgcgtggttttggaaaaaccgttgggtacggacttggcttcttcccaacaaatcaatactgatgttgcgcgttatttcaaagaagggcaaatttaccgcatcgaccactaccttggcaaagaaagcctgcaaaacctgcttgcgctgcgttttgccaatgtaatgttcgagccgctgtggaacaataaatatatcgaaagcgtgcagttgaccatcgccgaacagctcggtgtggaagagcgcggtgagttttacgacattaccggcgcgttgcgcgatatggtgcaaaaccatttgatgcagatgttgtgcatgactgcgatggaagcccccgccagcttggatgccgacgcggtgcgcgatgaaaaagtcaaagtcatcaagtcattgaagccgctgaccgtcgaatctgtcaatgaaaacgtcgtgcgcggacaatataccgccgccaaaggcatgaacggctatcttgaagaaatcaacgttctgcaagacagctttaccgaaacctacgtcgccattaaagccgaaatcgaaaacgaacgctggaagggcgttcccttctacctgcgtaccggcaagcgcatggcgggcaaagtggcggaaatcgttttgaacttcaaagatttgaacagccatatttttgaaggcagccgcaccgcgcccaaccggctcgttatcgagttgcaaccatatgaatccgtgcgcctctatacgcagatgaaaaccccgggggcaggaaataaggtcgaaaccgtgccgctggcaaccgatttgggcaaggcattggaaagccgccgcgcggaagcttacgagcgcctgctgctggatgtgattaacggcaaactcgctttgtttaaccgccgcgacgaacttgaagccgcgtgggaatatgtgatgccgattttggaaaactggacaaataacaccacgccgccgcacggctacggcgcacactcgtgggggcctgaagccgcgcgcgaactattggcgcgcgacggacacaagtggcacgaagagcagtaa

SEQ ID NO: 2592 - protein, 481 aa, Neisseria meningitidis
MSTQTNFDLVLFGATGDLAMRKLLPCLYQAHVAGLLHPEGRILGVSRSELDTEGFLAKVETSSKIHVKENFSDEAWASFVERLAYLKVDVTQPDDFAALGDLVKARKNTENVVIYLSTAPKFFAQACENLAAIGLNADNVRVVLEKPLGTDLASSQQINTDVARYFKEGQIYRIDHYLGKESLQNLLALRFANVMFEPLWNNKYIESVQLTIAEQLGVEERGEFYDITGALRDMVQNHLMQMLCMTAMEAPASLDADAVRDEKVKVIKSLKPLTVESVNENVVRGQYTAAKGMNGYLEEINVLQDSFTETYVAIKAEIENERWKGVPFYLRTGKRMAGKVAEIVLNFKDLNSHIFEGSRTAPNRLVIELQPYESVRLYTQMKTPGAGNKVETVPLATDLGKALESRRAEAYERLLLDVINGKLALFNRRDELEAAWEYVMPILENWTNNTTPPHGYGAHSWGPEAARELLARDGHKWHEEQ

SEQ ID NO: 2593 - DNA, 1278 bp, Helicobacter pylori
  CDS (1)..(1278)
atgctggattttgatttggttctttttggcgcgactggggatttagccatgcgaaagctctttgtttcgctttatgaaatttatattcattatggttttaaaaacgattctaggattatcgcatcggggcgtaaggagctatccaatgaagagtttttagcgcttctttgtgaaaaaacacaactgcattcaagagaaaagggtgaggaatttttaacccatatcagttatttgcgcgtccgtttggataaccctaaagactttgaagaattgagtaaaatcgccacaaacaataagcccttgattttctacttttctatctcccctagtttttttgcaacgaccgctcaaaatttagcccaaaacgcgctcaatcacgctaacactcgtttgattctagaaaagcctttagggcatgatttaaagacttgtaaagagattttccaaagcattagcgctttttttaaagaagaacaaatttttagaatcgatcattatttagggaaaaagggcgttcaaaatatccttgaattgcgcctgaataaccctatcttaaacattttatgggatcaaatcagcgcggttgaaatctgcgtgtatgagactttaggggtggaagaaaggggcgaattttacgataaaatcggggctttaagggatatggttcaaaaccatctcttgcaagttttatcccttatcgctacagatttacccaacgatttaaaagatttgaggcaagaaaaaatcaaagttttaaagaccttacaaccccctaaagatttcacaaaacaggttattcgggcccaatatcaaggctatagagatgaaaataaggtccataaagagagccagacagagacttttgtcgctattaaagcctttttggatacgcccaaatttaaaggcgtgcctttctaccttaagcacgctaaaaaaatgccccgcaatcaagcgagtgtgaaaatccattttaatgcagtcaatacgctggaatttttcctctctcaagataaaatcaccctcaccctaaaagatcatcaaaacccccttattttagaaacccacaacaaacaagaatttttacagccctacgctaaattgctctatgatgcgataccaaataaccactataatttcgcccaccagttggaattagaagcgtcatgggtttttattgacacgctcatagagggttttatcaataacgctacgcccttatattcctatgaaagccacaatctcaacgaatcagaatttttaaaaccactctatcaataa

SEQ ID NO: 2594 - protein, 425 aa, Helicobacter pylori
MLDFDLVLFGATGDLAMRKLFVSLYEIYIHYGFKNDSRIIASGRKELSNEEFLALLCEKTQLHSREKGEEFLTHISYLRVRLDNPKDFEELSKIATNNKPLIFYFSISPSFFATTAQNLAQNALNHANTRLILEKPLGHDLKTCKEIFQSISAFFKEEQIFRIDHYLGKKGVQNILELRLNNPILNILWDQISAVEICVYETLGVEERGEFYDKIGALRDMVQNHLLQVLSLIATDLPNDLKDLRQEKIKVLKTLQPPKDFTKQVIRAQYQGYRDENKVHKESQTETFVAIKAFLDTPKFKGVPFYLKHAKKMPRNQASVKIHFNAVNTLEFFLSQDKITLTLKDHQNPLILETHNKQEFLQPYAKLLYDAIPNNHYNFAHQLELEASWVFIDTLIEGFINNATPLYSYESHNLNESEFLKPLYQ

SEQ ID NO: 2595 - DNA, 1434 bp, Xylella fastidiosa
  CDS (1)..(1434)
atgcacaacaccctcttattgtttggcgccaccggcgacctcgcccaacgctatctcttcccctccttactgcacctgtttactgatggcttattgccacaagacttccgcattcgtgctctggccttgtcgccccataacaccacacaattccgcgacatcctgcgcccgcgcttggaacaagcactacccatcgccaacactgcgcacatccaagccctactacaacgtgtcgactacctttccgtagacttgaacgacccaacatcaatcgccgaagcagtccgagatctgacggaacatccctgcatcagctacttggcaatcccaccaggcctgtacaccaacaccgccctaggattggcacagggaggggcactgcagacaccacaccgattgatgctggaaaaaccgatcggacgcgactcaataaacgcacgcgaaatcctaaacaccatcggcacactgattgacgaagatcgcatcttccgcgtagaccactatctaggcaaagcagcagtgcagaacctcgtcgcactgcgcttcggaaacaccctgctagaagcggtatggaaccgaaaccacattgagtcagtacacatcctcatcgccgaaaccgaaggcgtcgatggccgcaatgcttactacgcacgtgctggcgcactacgcgacatgatgcaaagccacatcctgcaactcctatgcctggtcgccatggaacccccggcctctctggaagccgaccgcatccgcgacgaaaaagtcaaaatcctgcgcgcactacgcccactgaacgcccaaaacgccgcaatgcacagcgtgcgtggacgctacagcgcgggcaccattaacagccaaccagtgccagcctatcaaccaccggaaggcagcaatgtagagacctttgtcggtgtcaccgcatacatcgacaactggcgctgggcgggcgtaccgttccacctatgcacaggaaaacgcttggccgaacgctcaacccagatcgtcgtcaccctcaaacccgtcacacactggctatttgaacgtccagaccggaacaatgcagcaccaaaccgcctgtgcttcaaactacagccccaggaaaatatcgaactaaacctgatgagcagcctggccggccccgaatggggaaccctggaactgcaaccgctggaattggagctatccgtcccgaccggaaaacatcgccacatcgcctatgagcgcctattcctcgacgcattcaacggcaacccggcgctatttgtacgtcacgacgaagtcacagccgcctgggattggatcgacagcgtcagcaatgcctgggaactgtccgacttaccactgcaaccctaccccgccggcagctggggcccacctcaagcccaccaatttctgccgccattggggattgatggccatggaaacgacgcatga

SEQ ID NO: 2596 - protein, 477 aa, Xylella fastidiosa
MHNTLLLFGATGDLAQRYLFPSLLHLFTDGLLPQDFRIRALALSPHNTTQFRDILRPRLEQALPIANTAHIQALLQRVDYLSVDLNDPTSIAEAVRDLTEHPCISYLAIPPGLYTNTALGLAQGGALQTPHRLMLEKPIGRDSINAREILNTIGTLIDEDRIFRVDHYLGKAAVQNLVALRFGNTLLEAVWNRNHIESVHILIAETEGVDGRNAYYARAGALRDMMQSHILQLLCLVAMEPPASLEADRIRDEKVKILRALRPLNAQNAAMHSVRGRYSAGTINSQPVPAYQPPEGSNVETFVGVTAYIDNWRWAGVPFHLCTGKRLAERSTQIVVTLKPVTHWLFERPDRNNAAPNRLCFKLQPQENIELNLMSSLAGPEWGTLELQPLELELSVPTGKHRHIAYERLFLDAFNGNPALFVRHDEVTAAWDWIDSVSNAWELSDLPLQPYPAGSWGPPQAHQFLPPLGIDGHGNDA

SEQ ID NO: 2597 - DNA, 1296 bp, Aquifex aeolicus
  CDS (1)..(1296)
atgagttcgggagacacagagttaagaaaaaggattgaatttataatcttcggcggaaccggggatctgagcagaaataaattaattcccgcaatcctgaaactgaaagacaaaatagatttaaagaagatttacattttaggcaggaataggaaaaagtttgaagaaataaaagaaaagtttaaggatttttcagagttattcgtgttcgtagaattcctcgcggagagggaagagagttataaaaatatatcaagtattttaggaaaagaatctttaaaagttttttaccttgcggtacctcccgacctattcaaggaaattctagaaaacgtaggaaaatacctgaactttccagaaaaacgtattgttattgaaaaacctttcggcctcagcttaaagcacgcaaaggacttaaacaaaataatttccgtttatttcaaagaagaagaaatcttcagaatagatcactacctcggaaagccgcaggttcaaaatatactcgcctttaagttctcaaattacgtgttttccgaagtcttaaacaagtgtcttgtagagaaggtggaggtaattgcccttgaagaggtgggagtagagggcagaaaagcttattacgagaaagtgggagtcataagggacatgctacagaatcacatgttgctcctctcctctttaatcgttatgagactccctccaagggcggaggacttccactttgagctgaagaacgccttaaagcgtgccgagtttgagtccgagagcttgatactcggaaagtacaaaagttatcaaggaaaagctcccacttttgcccttgtaaaactccactttgacgacgagcgtttcaccggagtgcctttcgtactcgccacgggaaaaaagttaaagaaaaaattgacgagggtgtgcatccactttaagaacttcccgaaggagattgaacggcttctcggctgcgttcctgagagaaatttactcgtttttgaactctatccagagcaggaagtttcctttagggtaaacgttatatctccacttggctttttgaggtgtacggaaagtattaactggagagtttccctcaaagacgttctgggagaaattcccgaagcttacgagtccctccttctggacgtcataaggggagacaagacgctctttctggacgcagaggagacggagatactctgggaaaaaacagaacctctattgaaaaaagaaaaggaagttttgacttacgatgacagagtccttattccagaatttgcagaggatttcatttcctgcctttga

SEQ ID NO: 2598 - protein, 431 aa, Aquifex aeolicus
MSSGDTELRKRIEFIIFGGTGDLSRNKLIPAILKLKDKIDLKKIYILGRNRKKFEEIKEKFKDFSELFVFVEFLAEREESYKNISSILGKESLKVFYLAVPPDLFKEILENVGKYLNFPEKRIVIEKPFGLSLKHAKDLNKIISVYFKEEEIFRIDHYLGKPQVQNILAFKFSNYVFSEVLNKCLVEKVEVIALEEVGVEGRKAYYEKVGVIRDMLQNHMLLLSSLIVMRLPPRAEDFHFELKNALKRAEFESESLILGKYKSYQGKAPTFALVKLHFDDERFTGVPFVLATGKKLKKKLTRVCIHFKNFPKEIERLLGCVPERNLLVFELYPEQEVSFRVNVISPLGFLRCTESINWRVSLKDVLGEIPEAYESLLLDVIRGDKTLFLDAEETEILWEKTEPLLKKEKEVLTYDDRVLIPEFAEDFISCL

SEQ ID NO: 2599 - DNA, 1491 bp, Thermotoga maritima
  CDS (1)..(1491)
atgaagtgcagtctgggattggagaaatgtccggatgataccctccggtgttttccaaagatcgaacaacctttcggaattgtgatcttcggtgcttctggtgacctcacaaaaagaaagctcattcccgctttgaacaggttgttcgaggcaggtattctgcccgaacgctttttcgttctcggtgcggcacgaacgaaaatggacgataagaaattcagatccagattcgatgccaaccctgattttttggaacattgcagttacatcagcgtggattatcaggatcctgagagcttcaaacagttgaaaaacaccatcgagactctcataaaaaggatcgattccagcaatctggtcttctatctcgctgttcctccggatctttacatccctattctggaaaacctctcgaaaactggattgaacgaaaaacctgcgcgcgttgtgatcgaaaaaccgttcgggaaagacctggaatcggccagaagactggaagacactcttcagaaatacttccaggaagatcagattttcagaatcgatcattaccttggaaaagaaaccgttcagaacatactggtgttcaggtttgccaacttcatattcgaggaaatctggaacaacaagttcgtggatcacgttcagatcacgatggccgaagacataggtgttgaacacagggcaggatacttcgaaaacgtgggactcctcagggatatcttccagaaccacatgcttcagatcctcgcactgatcgccatggaacctccttcttctttcaatggagagaatttcagaaacgagcgggtgaagcttctcagatcgatcagaccgttccctgtggaggaactggaaagctggatcgtcagaggccagtatggaagaggggttgtgaacggaaaagaagtgccggcttacagagaggaaccgggtgtggccaaagactccaacgtggaaaccttcgttgccatgaaactcttcatagacaactggagatggagcggtgtacccttctatctgaggtccgggaagagactccccaagaaaataaccgaggttgctgttgttttcaagaagattcctcattcgatctttgccggtgtaccttctgatgaactggagccgaacacgatagttttcaccttgcagccaaacgagggaatctctcttgagtttcaggtgaaaaggccctgtcccggcatgtttccacagcttctcagtatggacttcagatacgaggattactttggagtgaaactgcccgacgcttacgaaagactccttctggacgtgatacttggagatcctacacttttcatgagaagagacgacctcgaagtttcctgggaacttctcgatcccgttctcaaagcctgggaaaacgatcccgttcgcttttcaccttatgtgtatccggcgggaacgtggggaccgagagaagccgatctactcatagaaagggacggtagaaaatggagaaaactgtga

SEQ ID NO: 2600 - protein, 496 aa, Thermotoga maritima
MKCSLGLEKCPDDTLRCFPKIEQPFGIVIFGASGDLTKRKLIPALNRLFEAGILPERFFVLGAARTKMDDKKFRSRFDANPDFLEHCSYISVDYQDPESFKQLKNTIETLIKRIDSSNLVFYLAVPPDLYIPILENLSKTGLNEKPARVVIEKPFGKDLESARRLEDTLQKYFQEDQIFRIDHYLGKETVQNILVFRFANFIFEEIWNNKFVDHVQITMAEDIGVEHRAGYFENVGLLRDIFQNHMLQILALIAMEPPSSFNGENFRNERVKLLRSIRPFPVEELESWIVRGQYGRGVVNGKEVPAYREEPGVAKDSNVETFVAMKLFIDNWRWSGVPFYLRSGKRLPKKITEVAVVFKKIPHSIFAGVPSDELEPNTIVFTLQPNEGISLEFQVKRPCPGMFPQLLSMDFRYEDYFGVKLPDAYERLLLDVILGDPTLFMRRDDLEVSWELLDPVLKAWENDPVRFSPYVYPAGTWGPREADLLIERDGRKWRKL

SEQ ID NO: 2601 - DNA, 1494 bp, Kluyveromyces marxianus var. lactis, Candida sphaerica
  CDS (1)..(1494)
atggctactcagtttgacgagaacactgtgatcactatttttggtgcttcaggtgatttatcaaagaagaaaacgtttcctgcattattcgggttatatcgtgaaggatatttgaatccaactacaaaaattattgggtatgcgcgttccaagttgagcaacgaggatttaagagaaaaggtaaagccatttttaaagaaacctaacggagctaaggatgatgctaaagtcaatgaatttttatcgatggtttcttaccatgctggtccgtatgattctgatgaaggttacttggagttgaaaaagattatcgaagagtttgaggctgaaaaaaaggtcgatgaacctcatagactcttttacttagccttgcctcctagtattttcattgacgtgtgttcgaaactaaaggaaaacctatacacagaatctggaattcaaagggttattgtggaaaagccttttggtcacgatctacagtctgctactgaattacaggagaagttggcgccattgttttccgaggacgaattgttcagaattgatcattatttgggtaaagagatggtaaaaaatctattgttgatgagattcggtaacactttcttgaacgccgcttggaacaaagaaaatatacaatctgttcaggtggttttcaaggaaccatttggaactgaaggtcgtggtggttacttcgattcaattggtattataagagatgtgatgcagaatcatttgctacaagtgttaactctattgacgatggaaagaccagtatctttcgacccagaatctgtacgtgacgaaaaggtcaaggttttgaaagcattctctccaattgatcatgacgatatattgataggccaatacggaagatctgtggatggtagcaagcctagctacctagatgatgaaactgtcaaagaggactccaagtgtgtcacctttgcagcaatcggattcaaaattgcaaatgaacgttgggatggagttcccatcgttatgagagcaggaaaagcgttgaacgaaggtaaagtagaaatcagaatccagttcagaagagttgcatctggcatgttcactgatattcctaataatgaattggttattagaattcaaccaaatgaagccatctacttgaagtgtaatgccaaaacacctggtcttgcgaatgaaaaccaaaccacagaactagacttgacttactcagagagatacaaaaactattggattcctgaagcatatgaatctttgataagagatgcccttttaggagatcattcaaatttcgtcagagacgatgaattagacgtaagctggaagctatttactccattgcttaattacttggaaggaccagatggacctcaaccaaagatctatccatatggctgtagaagccctgacggactcgttgagtttttagcagaccatggttacaccttttccaaaccaggatcctaccaatggcctgtcaccactcctaaaatgtaa

SEQ ID NO: 2602 - protein, 497 aa, Kluyveromyces marxianus var. lactis, Candida sphaerica
MATQFDENTVITIFGASGDLSKKKTFPALFGLYREGYLNPTTKIIGYARSKLSNEDLREKVKPFLKKPNGAKDDAKVNEFLSMVSYHAGPYDSDEGYLELKKIIEEFEAEKKVDEPHRLFYLALPPSIFIDVCSKLKENLYTESGIQRVIVEKPFGHDLQSATELQEKLAPLFSEDELFRIDHYLGKEMVKNLLLMRFGNTFLNAAWNKENIQSVQVVFKEPFGTEGRGGYFDSIGIIRDVMQNHLLQVLTLLTMERPVSFDPESVRDEKVKVLKAFSPIDHDDILIGQYGRSVDGSKPSYLDDETVKEDSKCVTFAAIGFKIANERWDGVPIVMRAGKALNEGKVEIRIQFRRVASGMFTDIPNNELVIRIQPNEAIYLKCNAKTPGLANENQTTELDLTYSERYKNYWIPEAYESLIRDALLGDHSNFVRDDELDVSWKLFTPLLNYLEGPDGPQPKIYPYGCRSPDGLVEFLADHGYTFSKPGSYQWPVTTPKM

SEQ ID NO: 2603 - DNA, 2813 bp, Erwinia chrysanthemi
  CDS (322)..(1797)
atcgatgcggattttgtgaaatatactacgagcccgtaacggttggcagaggtcgacacaacaagtcatcagctttttttgtcagaatatgacgtgtgtctaacctttcaaaatagtaactggcctgtcagaaacgatgggaaatttctcttttaggcagatgccagacccgttttcttcatcggcacaataggttctgaggccttgtagtatcggaatcagccgataatgtggttttcttacgggtttactggtttgtgtcaaaaagagtacattattaatgtaataaaattacagcgtcgtgcaatgaggagattgaaaatggcggtaacgtcaacagcccaggcgtgtgacctggttattttcggtgcaaagggcgaccttgcgcgccgcaaattgctgccttcactgtatcaactggaaaaagcaggccatattcatccggaaacccgcattatcggcgtgggacgggcggagtgggaccgagacgcctatatcaaagtggtgcgcgaagcgctggaaacctttctcaaggagccgctcgacccggcattgtggacaaccctgagcaatcggctcgacttttgcaaccttgatgtggaagacaccgagggattcaaacggttgggtacgatgctcgatcagcaaaatcgcaccaccatcaattatttcgccatgccgccgagcaccttcggcgctatctgccgcggtctggggcaggccggcctgaacaaggagccggcacgcgtggtgatggaaaaaccgctgggcaccaatctggcgtcgtcacgggtgatcaacaatcaggtagcggagtttttcaacgaatgtcaggtctaccgcatcgaccactatctcggcaaggaaaccgtgctgaacctgctggcactgcgtttcgccaactccctgttcgccaacaactgggataaccgcactatcgatcacgtgcagattaccgtggcggaagaggtgggtattgaagggcgctgggggtatttcgatcaggccgggcaaatgcgcgacatgatccagaaccacctgttgcagattctgaccatgattgccatgtcgccgccggcggatctgagcaccgatcgcattcgtgatgaaaaggtgaaagtcctgcgttcgctgcgccgtatcgatcgttccaatgtgcatgaagtgacggtccgtgggcagtacaccagcggttttgtgcagggcaagaaagtgccgggctacctggaagaagaaggggccaacaagaccagtaataccgaaaccttcgtggccattcgcgtcgatatcgacgactggcgctggtccggcgtgccgttttatctgcgcaccggcaagcgtctgccgtcaaaatgttcggaagtggtggtctactttaaaaacccggcgctcaacctgttccatgattcctatcagcagttgccgcagaataagctgatcatccgcctgcagccggacgaaggggtagaaattcagattctgaacaagattccggggctggaccacaaacatcggttgcagaccaccaagctcgacctgagcttctcggaaacttttaaccagcaacatctggcggacgcctatgagcgcctgttgctggaaaccatgcgtggtattcaggcgctgttcgtgcgccgcgacgaagtggaagaagcctggaaatgggtggattccattatggatgcctgggcaatggacaatgattcccccaaaccttatcaggccgggacctgggggccggtcgcgtccgtcgccatgattacccgcgatgggcgttcctggaacgaagtggaataagcggttttgccccgtcggcaggcgggcgaagccgttagcgttttttagctgacggtgcggtcggacgtccgtgggtaaccgcggatccctgtggcaggggcgcgccagatcattaatcgatgcccgttgggcatgactggagattaccctcgatgaaaaactggaaaaccagtgcggaacagattctgacagccggtccggttgttcctgtgattgtgattaacaaactggaacacgcggtaccgatggcgaaagccctggtagcgggtggcgtgcgtgtgctggagctgacgctgcgtaccgagtgtgcggtagaggcgattcgcctgatcgcgcaggaagtgccggatgctatcgtcggcgccggtacggtcaccaacccgcaacagctggcggaagtgaccgcagccggtgcgcagtttgccatcagccccggcctgaccgagccgctgctgaaagccgcaacggaaggcactattccattgatcccagggatcagcaccgtatccgaactgatgctggggatggattacggtttgcgcgagtttaaatttttcccggcggaagctaacggcggggtaaaagcgctgcaggcgattgccggtccgttcggcaagattcgtttctgcccgaccggtgggatctcactgaagaattaccgcgactacctggcgctgaagagcgtgctgtgcgtcggcggctcctggctggtgccggccgatgcgctggaaagcggcgattacgatcgcatcacggcgttggcgcgtgaagctgttgccggcgcgacagcctgatcgacgttttaccttattctttctcaagcccgctttcgcgggcttttttgtgctcggtaggcgagccgacaaaccgcgttgtgcctgtttaagcgacatcggtcgtcacaacaaaccgctgtctggaaaccgttgtctggataccattgtctggcgtacgattctggcgttatcgggagagaattcaggctcatgccggcgcatgagcctgatatgacctca

SEQ ID NO: 2604 - protein, 491 aa, Erwinia chrysanthemi
MAVTSTAQACDLVIFGAKGDLARRKLLPSLYQLEKAGHIHPETRIIGVGRAEWDRDAYIKVVREALETFLKEPLDPALWTTLSNRLDFCNLDVEDTEGFKRLGTMLDQQNRTTINYFAMPPSTFGAICRGLGQAGLNKEPARVVMEKPLGTNLASSRVINNQVAEFFNECQVYRIDHYLGKETVLNLLALRFANSLFANNWDNRTIDHVQITVAEEVGIEGRWGYFDQAGQMRDMIQNHLLQILTMIAMSPPADLSTDRIRDEKVKVLRSLRRIDRSNVHEVTVRGQYTSGFVQGKKVPGYLEEEGANKTSNTETFVAIRVDIDDWRWSGVPFYLRTGKRLPSKCSEVVVYFKNPALNLFHDSYQQLPQNKLIIRLQPDEGVEIQILNKIPGLDHKHRLQTTKLDLSFSETFNQQHLADAYERLLLETMRGIQALFVRRDEVEEAWKWVDSIMDAWAMDNDSPKPYQAGTWGPVASVAMITRDGRSWNEVE

SEQ ID NO: 2605 - DNA, 3244 bp, Plasmodium falciparum
  CDS (184)..(2916)
tttataaattatttcataaatctaatatttatataatataggtttgtgttagtgtaattgtatgaatatataaatacattaatataatatatttaaataaaaacatataggatatatatattttatttatcacgtttattttatattacgtataaatacttgaaaggtataataaaaatcaaaatggattatgagaattttgtaaaaagtgcagaagaaataaataatttacacaatgtaaattatttggaaacaaaagacctgaatgattttaattggaaagcagcttattatatatgtaaagaaatatatgataagcaacaaattaataaagatggttatgttgtgataggtttatcgggaggtcgaactccgatagatgtttataaaaatatgtgtttaattaaagacattaagatagataaatctaaattaatattttttattattgatgaaaggtataaaagtgatgatcataaatttagtaattataataatataaaatttttatttcataatttaaatataaatgaaaaagaacaattatataaacctgacactaccaaaagtattgtagattgtatattagattataatgacaaaataaaaataatgatagagaaatataaaaaagttgatatagcaatattaggtatgggtagtgatttccatattgccagtttatttccaaatatattttataatatatatatgaataactatcaaaataattatatatataatgaaaaaacattagattttataaataatgatcaagataatgataatttaaaatatttgaaagaatatgtatattttacgacaacaaatcaatttgatgttaggaaaagaattacagtatctttaaatttattagctaatgcatcaagtaaaatatttttattaaattctaaagacaaattagatttatggaaaaatatgttgattaaatcatatattgaagtgaattataatttatatccagctacttatttaatagatacatcatgcaccaacgaaaatgttaatattaacaataacaacaataataataataagaataagaataattattgttatagtaataccactgttatatcttgtggttatgaaaattatacaaaatctattgaagaaatttatgattctaaatatgctctatctctttattctaatagtttgaataaagaagaattattaactataataatttttggctgttcaggtgatttagccaaaaaaaaaatatatccagctttatttaaattattttgtaataattccttaccaaaagatttattaatcattggatttgctagaacagttcaagatttcgatacattttttgataaaatagttatatatttaaaacgatgtttattatgttatgaagattggtctatatcaaaaaagaaggatcttttaaatggttttaaaaataggtgtcgatattttgttggtaattattcgtcttcagaaagttttgaaaattttaataaatatttaacaactattgaagaagaagaagcaaaaaaaaaatattatgcaacatgttataaaatgaatggttcagattataatatatcaaataatgttgcagaggataatattagtatagatgatgaaaataaaacaaatgaatattttcaaatgtgtactccaaaaaattgccctgataatgtattttcatcaaattataattttccatatgttataaatcgtatgttatatttagcattacctccacatatatttgttagtactttaaaaaattataaaaaaaattgtttaaatagtaaaggcactgataaaatattactagaaaaaccatttggaaatgatttagattcatttaaaatgttatcaaaacaaatattagagaattttaatgaacaacaaatatatagaatagatcattatttgggtaaggatatggtttcaggattgttgaaattaaaatttacaaatacatttttattatctttaatgaatagacattttataaaatgtattaaaattactcttaaagaaactaaaggtgtatatggtagaggacaatattttgatccctatggtattattagagatgttatgcaaaatcatatgttacaattattaacattaataactatggaagatcctatagatttaaatgatgaatctgtaaaaaatgagaaaataaaaattcttaaatcaattccttcgatcaaattagaagatactattattggacaatatgaaaaagctgaaaattttaaagaagatgaaaataatgatgatgaatcgaaaaaaaatcatagttatcatgatgatccacatatagataaaaattcgattactccaacattttgtacatgtatcttatatattaattcaattaattggtatggtgtaccaatcatttttaaatctggaaaaggtctgaataaagatatatgtgaaatacgtatacaattccataatattatggggtcgtctgatgaaaatatgaataataatgaatttgttattatattacaacctgttgaagctatatacctaaaaatgatgattaaaaaaacgggttgtgaagaaatggaagaagtacaattaaacctaacagtgaatgagaaaaataaaaaaattaatgtaccagaagcatatgaaacattactcttagaatgttttaaaggacacaaaaaaaaattcatctcagacgaggaattgtatgaatcatggagaatatttactcctttacttaaggaactccaggaaaaacaagtcaagcctcttaaatattcttttggatcatcaggccctaaagaggtatttggacttgtcaaaaaatattacaattatggtaaaaattatacgcacagacctgagtttgttagaaaatcctctttttatgaagacgatttgttagatattaattgatatatgtatatatttaaattaacaaattaacacccaatgaatatgaaaataatatatatatatatatatattatatgattgtttagtatattattatcttttataagataacataaatgtatatattatgacatatatatatatatatattatttcacttatctgcccacgaactttatttttgttttaaaattctagtataattaaataaaagaaaatatttggaacaatttgcattttttatgtataaataaaatttatataataatatactttcatacttactttttattttattttattttatttattttttaaatgtggaatt

SEQ ID NO: 2606 - protein, 910 aa, Plasmodium falciparum
MDYENFVKSAEEINNLHNVNYLETKDLNDFNWKAAYYICKEIYDKQQINKDGYVVIGLSGGRTPIDVYKNMCLIKDIKIDKSKLIFFIIDERYKSDDHKFSNYNNIKFLFHNLNINEKEQLYKPDTTKSIVDCILDYNDKIKIMIEKYKKVDIAILGMGSDFHIASLFPNIFYNIYMNNYQNNYIYNEKTLDFINNDQDNDNLKYLKEYVYFTTTNQFDVRKRITVSLNLLANASSKIFLLNSKDKLDLWKNMLIKSYIEVNYNLYPATYLIDTSCTNENVNINNNNNNNNKNKNNYCYSNTTVISCGYENYTKSIEEIYDSKYALSLYSNSLNKEELLTIIIFGCSGDLAKKKIYPALFKLFCNNSLPKDLLIIGFARTVQDFDTFFDKIVIYLKRCLLCYEDWSISKKKDLLNGFKNRCRYFVGNYSSSESFENFNKYLTTIEEEEAKKKYYATCYKMNGSDYNISNNVAEDNISIDDENKTNEYFQMCTPKNCPDNVFSSNYNFPYVINRMLYLALPPHIFVSTLKNYKKNCLNSKGTDKILLEKPFGNDLDSFKMLSKQILENFNEQQIYRIDHYLGKDMVSGLLKLKFTNTFLLSLMNRHFIKCIKITLKETKGVYGRGQYFDPYGIIRDVMQNHMLQLLTLITMEDPIDLNDESVKNEKIKILKSIPSIKLEDTIIGQYEKAENFKEDENNDDESKKNHSYHDDPHIDKNSITPTFCTCILYINSINWYGVPIIFKSGKGLNKDICEIRIQFHNIMGSSDENMNNNEFVIILQPVEAIYLKMMIKKTGCEEMEEVQLNLTVNEKNKKINVPEAYETLLLECFKGHKKKFISDEELYESWRIFTPLLKELQEKQVKPLKYSFGSSGPKEVFGLVKKYYNYGKNYTHRPEFVRKSSFYEDDLLDIN

SEQ ID NO: 2607 - DNA, 1785 bp, Medicago sativa (alfalfa)
  CDS (38)..(1585)
ccaccagatataattaagtagatcagagtagaagaagatgggaacaaatgaatggcatgtagaaagaagagatagcataggtactgaatctcctgtagcaagagaggtacttgaaactggcacactctctattgttgtgcttggtgcttctggtgatcttgccaagaagaagacttttcctgcactttttcacttatataaacaggaattgttgccacctgatgaagttcacatttttggctatgcaaggtcaaagatctccgatgatgaattgagaaacaaattgcgtagctatcttgttccagagaaaggtgcttctcctaaacagttagatgatgtatcaaagtttttacaattggttaaatatgtaagtggcccttatgattctgaagatggatttcgcttgttggataaagagatttcagagcatgaatatttgaaaaatagtaaagagggttcatctcggaggcttttctatcttgcacttcctccttcagtgtatccatccgtttgcaagatgatcaaaacttgttgcatgaataaatctgatcttggtggatggacacgcgttgttgttgagaaaccctttggtagggatctagaatctgcagaagaactcagtactcagattggagagttatttgaagaaccacagatttatcgtattgatcactatttaggaaaggaactagtgcaaaacatgttagtacttcgttttgcaaatcggttcttcttgcctctgtggaaccacaaccacattgacaatgtgcagatagtatttagagaggattttggaactgatggtcgtggtggatattttgaccaatatggaattatccgagatatcattccaaaccatctgttgcaggttctttgcttgattgctatggaaaaacccgtttctctcaagcctgagcacattcgagatgagaaagtgaaggttcttgaatcagtactccctattagagatgatgaagttgttcttggacaatatgaaggctatacagatgacccaactgtaccggacgattcaaacaccccgacttttgcaactactattctgcggatacacaatgaaagatgggaaggtgttcctttcattgtgaaagcagggaaggccctaaattctaggaaggcagagattcgggttcaattcaaggatgttcctggtgacattttcaggagtaaaaagcaagggagaaacgagtttgttatccgcctacaaccttcagaagctatttacatgaagcttacggtcaagcaacctggactggaaatgtctgcagttcaaagtgaactagacttgtcatatgggcaacgatatcaagggataaccattccagaggcttatgagcgtctaattctcgacacaattagaggtgatcaacaacattttgttcgcagagacgaattaaaggcatcatggcaaatattcacaccacttttacacaaaattgatagaggggagttgaagccggttccttacaacccgggaagtagaggtcctgcagaagcagatgagttattagaaaaagctggatatgttcaaacacccggttatatatggattcctcctaccttatagagtgaccaaatttcataataaaacaaggattaggattatcaggagcttataaataagtcttcaataagcttgtgaaattttcgttataatctctctcattttggggtgtatatcaagcatttaagcgcgtgtttgacacagtttgtgtaatagatttggctctgaatgaaaataaacgggaattgtttctttttgtttta

SEQ ID NO: 2608 - protein, 515 aa, Medicago sativa (alfalfa)
MGTNEWHVERRDSIGTESPVAREVLETGTLSIVVLGASGDLAKKKTFPALFHLYKQELLPPDEVHIFGYARSKISDDELRNKLRSYLVPEKGASPKQLDDVSKFLQLVKYVSGPYDSEDGFRLLDKEISEHEYLKNSKEGSSRRLFYLALPPSVYPSVCKMIKTCCMNKSDLGGWTRVVVEKPFGRDLESAEELSTQIGELFEEPQIYRIDHYLGKELVQNMLVLRFANRFFLPLWNHNHIDNVQIVFREDFGTDGRGGYFDQYGIIRDIIPNHLLQVLCLIAMEKPVSLKPEHIRDEKVKVLESVLPIRDDEVVLGQYEGYTDDPTVPDDSNTPTFATTILRIHNERWEGVPFIVKAGKALNSRKAEIRVQFKDVPGDIFRSKKQGRNEFVIRLQPSEAIYMKLTVKQPGLEMSAVQSELDLSYGQRYQGITIPEAYERLILDTIRGDQQHFVRRDELKASWQIFTPLLHKIDRGELKPVPYNPGSRGPAEADELLEKAGYVQTPGYIWIPPTL

SEQ ID NO: 2609 - DNA, 1689 bp, Solanum tuberosum (potato)
  CDS (46)..(1581)
gatcacaactcacaaggctgaattgagttcaagctggttgtcaagatggcggcatcatggtgtattgagaaaaggggttctattaggaatgactcttttagagacaatgataatatacctgaaactgggtgtctttctattattgttcttggtgcttctggtgatcttgccaagaagaaaacttttcctgctctcttcaacctctaccgccagggatttcttcaatccaatgaagttcacatttttggctacgcaaggacaaaaatttctgatgatgacttgagaagccgtatccgtgggtatctttctcaggggaaagaaaatgaaggagaagtatcagagtttctgcaactgattaaatacgtcagtggttcttatgattctgctgagggatttacgtcactggataaggcaatatctgagcacgaattctcaaaaaatagcacagaaggatcatccagaagactcttctattttgctcttcctccatcagtatatccctctgtttgcagaatgataaaaagttattgtatgaacaaatctgatcttggtggttggacacggactgttgttgagaagcccttcggcaaggatttagcttcatctgaacaactaagttcccagatcggagaactatttgacgaaccccaaatttatcgcattgaccattatttggggaaggagttggttcagaatttgttggtgctgcgttttgcaaatcgcttctttttgccgctctggaatcgtgacaacattgataatatacagattgtctttagagaggactttggaactgagggccgcggtggatattttgatgaatatgggattatacgtgacattattcagaaccatctattgcaggtcctttgccttgttgccatggagaagcctgtttctcagaagcccgaacacattcgggacgagaaagttaaggttcttcaatcaatgcttccaattgaagatgaagaggttgttcttggacaatatgaaggctataaggatgatccaacggttcctaacaactcaaatactcctacttttgctactatggttttacgcatacacaatgaaagatgggaaggtgtcccctttataatgaaggctggaaaagcactaaattcaagaaaggcagaaatacgagtgcagtttaaggatgttcctggtgatatatttagatgtcaaaagcaggggagaaatgagtttgtgatacgcctccaaccttcagaagccatgtacatgaagcttacggtcaagaaacctgggcttgaaatgtcaactgttcaaagtgaattagacctgtcgtatgggcagcgttaccaaggggtcgtcattccagaggcttatgaacgtctgattctcgacacaataagaggggatcagcagcattttgtgcgtagggatgagctcaaggcggcttgggagatttttacccctcttttgcatagaattgacaatggagaggtgaagccaattccatacaagccaggcagcagaggccctgctgaagcagatgagttgttgcaaaatgccggttacgttcaaactcatggctatatatggatccctcccacactataagtttggaaaagtattgcagatgagtgttaccttgtcacttttgccatgtagtaccctgcctatgtgcaaacttattgagaagtaacaaatagtccgtgtatcacaaat

SEQ ID NO: 2610 - protein, 511 aa, Solanum tuberosum (potato)
MAASWCIEKRGSIRNDSFRDNDNIPETGCLSIIVLGASGDLAKKKTFPALFNLYRQGFLQSNEVHIFGYARTKISDDDLRSRIRGYLSQGKENEGEVSEFLQLIKYVSGSYDSAEGFTSLDKAISEHEFSKNSTEGSSRRLFYFALPPSVYPSVCRMIKSYCMNKSDLGGWTRTVVEKPFGKDLASSEQLSSQIGELFDEPQIYRIDHYLGKELVQNLLVLRFANRFFLPLWNRDNIDNIQIVFREDFGTEGRGGYFDEYGIIRDIIQNHLLQVLCLVAMEKPVSQKPEHIRDEKVKVLQSMLPIEDEEVVLGQYEGYKDDPTVPNNSNTPTFATMVLRIHNERWEGVPFIMKAGKALNSRKAEIRVQFKDVPGDIFRCQKQGRNEFVIRLQPSEAMYMKLTVKKPGLEMSTVQSELDLSYGQRYQGVVIPEAYERLILDTIRGDQQHFVRRDELKAAWEIFTPLLHRIDNGEVKPIPYKPGSRGPAEADELLQNAGYVQTHGYIWIPPTL

SEQ ID NO: 2611 - DNA, 1530 bp, Synechocystis sp
  CDS (1)..(1530)
atggtaacgctactcgaaaatcccttccgcactggactccgtcaagaacgcactccagaacccctcattttgaccatttttggtgcatccggggaccttacccaacggaaattggtgccagccatctaccaaatgaaacgagagcgccgcttgcctccagagttaacggtggtcggttttgcgagaagggactggagccacgaccattttcgtgagcagatgcgtaagggcatcgaagaattttccaccggcattggcagtgaagacctgtggaatgagtttgcccagggtttattctactgctctggcaatatggatgacccagaaagctatctcaaattgaaaaacttcctgggggaattggatgaaaaacgtaacaccagaggcaatcgagtcttttatttagctgtttcccccaacttctttcccccgggtattaaacaattgggggcagcgggtatgctgagtgacccggttaaaagtcgcattgtgatcgaaaagccctttggtcgggatttgagttcagcccaaagcttgaaccgggtagtgcagagtgtctgcaaagaaaatcaggtgtatcgcatcgatcattacctgggcaaagaaacggtgcaaaatctgatggtgttccgctttgccaacgctatttttgagccactgtggaaccgtcagtttgttgatcatgtgcaaattaccgtagcagaaacggtaggggtagaagaacgagccggttattacgaatccgccggggctttacgagatatggtgcagaatcacctcatgcaactgttttgtctcaccgccatggacccccccaatgccattgacgcggacagcattcgcaacgaaaaggttaaagtgttgcaggctacccgtttagcggatattaataatttggaaaatgccggtatccggggccaatataaagctggttggatgggaggcaaaccagtgccgggttatcgagaagaaccgggggtagatccaagttccaccactcctacctttgcggccctcaaactgatggtggataactggcgttggcagggggtgcccttctatctacgcacgggtaagcgcatgcctaaaaaagtgagtgaaatcgcaattcaattccggcaagtacctctgttaatttttcaatcggtggcccaccaagctaatcccaatgtgttgagtctaagaattcagcccaacgaaggcatttccctgcgttttgaggcaaaaatgcccggttcagaactgcgtacccgcactgtagatatggattttagttatggttcatcctttggagtggccgcagcggatgcctatcaccgccttttattagattgtatgttgggagaccaaaccctgttcacaagagccgacgaggtagaagaagcttggcgagtagtaactccggtgttgtcggcttgggatgcccccagtgatcctctttccatgcccttgtacgaagctggaacctgggaaccagcggaggcagaatggttaattaataaagatggccgtcgctggcgccgactttag

SEQ ID NO: 2612 - protein, 509 aa, Synechocystis sp
MVTLLENPFRTGLRQERTPEPLILTIFGASGDLTQRKLVPAIYQMKRERRLPPELTVVGFARRDWSHDHFREQMRKGIEEFSTGIGSEDLWNEFAQGLFYCSGNMDDPESYLKLKNFLGELDEKRNTRGNRVFYLAVSPNFFPPGIKQLGAAGMLSDPVKSRIVIEKPFGRDLSSAQSLNRVVQSVCKENQVYRIDHYLGKETVQNLMVFRFANAIFEPLWNRQFVDHVQITVAETVGVEERAGYYESAGALRDMVQNHLMQLFCLTAMDPPNAIDADSIRNEKVKVLQATRLADINNLENAGIRGQYKAGWMGGKPVPGYREEPGVDPSSTTPTFAALKLMVDNWRWQGVPFYLRTGKRMPKKVSEIAIQFRQVPLLIFQSVAHQANPNVLSLRIQPNEGISLRFEAKMPGSELRTRTVDMDFSYGSSFGVAAADAYHRLLLDCMLGDQTLFTRADEVEEAWRVVTPVLSAWDAPSDPLSMPLYEAGTWEPAEAEWLINKDGRRWRRL

SEQ ID NO: 2613 - DNA, 1953 bp, Nicotiana tabacum (common tobacco)
  CDS (43)..(1824)
gtagatacagattcttcatagagaagtgaagaaatcaagaaaatggtgaccctttattcttctccttcaacccattcttctgggccagttgcttcttactctaattcctctattgggctctataattatcatcataataagcagatagcagtttcttcaattttgtcgagaaagtttggttctttgcaaattaatcagaagccattttggaatgccgttcgcatgcaagatggtgcagtagcgactccgcctagcaaaatcgaaaatgagactcctttgaagaaattaaaaaatggaattttgccagtcgcacctccaaaggagcagaaagatacaattgatttcgacagcaacaaagctaaatcaactgtcagtattactgttgttggtgcttcaggagatcttgccaagaaaaagatatttcctgcactgtttgcactttattatgagggttgcctccctgagcatttcactatctttggctatgcccggagtaagatgactgatgctgaactacggaacatggttagcaagacccttacttgcaggattgacaagagggaaaattgtggtgaaaagatggaacagtttttagaaaggtgcttctaccacagcggccaatacgattccctggaaaactttgcggagctcgataaaaagctgaaggaacatgaggctggaaggttttccaatcgtctattctacttatccattccaccaaatatttttataaatgcggttcgatgtgctagcctctctgcatcatctgctcatggctggacaagagtcattgtagagaaaccctttggtcgggattctgaatcctctgctgcattgacaagatcacttaagcagtacttgaatgaagaccaaatttttaggatcgatcactatttagggaaggagcttgtggaaaacctttctgtccttcgtttctccaacttgatatttgaacccttgtggtcaaggcagtgtataaggaatgtgcagtttattttctcagaagattttggcactgaaggacggggaggttattttgatcattatgggataatcagagacatcatgcaaaaccatctgcttcaaattctggccctctttgccatggaaacacctgtgagtttggatgcggaagatatcagaaatgaaaaggtaaaagttctgcgttccatgagacctttacaactagacgatgttatcattgggcagtacaaatgtcacacaaaaggagatgttacctatcccggttatactgacgacaagactgtaccgaaggacagtctaaccccaacttttgctgcagctgctcttttcatagataatgcacgatgggatggggtgcctttccttatgaaagctgggaaagctttacatactaggagtgcggaaataagagtacaattcaggcacgtaccaggaaatttatacaataagaactttggctcagatcttgaccaggcgaccaacgagcttgttatccgtgtccagcctaatgaagctatatacctaaagatcaataacaaagttcctggtctaggaatgagattggatcgcagtaatcttaatcttctttactcggcaagatactcgaaggagatccctgatgcatatgagcggctgcttcttgatgctatagaaggtgaaaggcggcttttcatccgcagtgatgagctggatgctgcttggtctcttttcactccagtgttaaaagaacttgaggataagaaaatagttccagaatattacccctatggaagtcgaggacctattggagcacattatctcgcagcacgatataaagtaagatggggtgatcttgtgtagacaagtgatttccagactttgctatcactgtcagaaaaccatatgtcgcctttctacttcttgagcttagtatgtcgcaaccaaatttgttgtactgcaattctagaaccaagactagcaaagcgtgaa

SEQ ID NO: 2614 - protein, 593 aa, Nicotiana tabacum (common tobacco)
MVTLYSSPSTHSSGPVASYSNSSIGLYNYHHNKQIAVSSILSRKFGSLQINQKPFWNAVRMQDGAVATPPSKIENETPLKKLKNGILPVAPPKEQKDTIDFDSNKAKSTVSITVVGASGDLAKKKIFPALFALYYEGCLPEHFTIFGYARSKMTDAELRNMVSKTLTCRIDKRENCGEKMEQFLERCFYHSGQYDSLENFAELDKKLKEHEAGRFSNRLFYLSIPPNIFINAVRCASLSASSAHGWTRVIVEKPFGRDSESSAALTRSLKQYLNEDQIFRIDHYLGKELVENLSVLRFSNLIFEPLWSRQCIRNVQFIFSEDFGTEGRGGYFDHYGIIRDIMQNHLLQILALFAMETPVSLDAEDIRNEKVKVLRSMRPLQLDDVIIGQYKCHTKGDVTYPGYTDDKTVPKDSLTPTFAAAALFIDNARWDGVPFLMKAGKALHTRSAEIRVQFRHVPGNLYNKNFGSDLDQATNELVIRVQPNEAIYLKINNKVPGLGMRLDRSNLNLLYSARYSKEIPDAYERLLLDAIEGERRLFIRSDELDAAWSLFTPVLKELEDKKIVPEYYPYGSRGPIGAHYLAARYKVRWGDLV

SEQ ID NO: 2615 - DNA, 1869 bp, Nicotiana tabacum (common tobacco)
  CDS (22)..(1788)
cggatcggccgaaaaaactgcatgggtgggcagttgcaattgaatccttgttcttcatcttcagttgctactactttccataatggggcacataagttttgcagaaattttaatattttaccatttaaagcccattcccttgaatcttcagttgctagtactttccataatggaatttattcaagaatccagccaagaaagcattttgagatcatgtcatcaaatggttttcatctgaatgctgtgtctttgctggatggttcggcgtcaaaatctatgccagaacaagtgcctttgacagagttagaaaatgcagagacaactgtcagcataactgttattggagcttcaggtgacctagccaagaagaagattttcacagctttatttgctcttttctatgaagattgtttgcctgagaattttatagtttttggttattcacgaacaaaaatgagtgatgaagagctgagaaacatgatcagcaagaccttaacttgtagaattgatcagagagagaattgcgaggctaaaatggaccactttctggaaagatgcttttaccactccggtcagtaccattctgaggatgattttgcagaactggattacaaattaaaggcaaaggaggggtctagggtttctaataggttgttttacttatcaatacctccaaatatattcgtggatgtggtgagatgtgcaagtcttaaagcttcttcaacaagtgggtggacaagagtcattgttgagaaaccgtttggtcgtgacttagaatcatctagtgagctgaccagatgcctaaagaagtatctaactgaggagcaaatattccgaattgaccattacttgggaaaggaacttgttgagaatctctcagttcttcgtttctcgaatcttgtctttgagcctctctggtccagaaactacatacgcaatgtccaattcatattttccgaggactctggtaccgagggacgaggagggtactttgacaattacgggatcatccgagatataatgcaaaatcatctccttcaaatattagcattgtttgctatggaaacacctgtcagcatggatgccgaggacatcagaaatgaaaaggttaaagttttaaggtcaatgaggccattgcagcttgaagatgtggtacttggccagtataaaggtcatagcaagggtggtaaattatatccagcttatacagacgatccaactgtgccaaacggtagtgtcactccaacgttttctgctgctgcactctttattaataatgcacgctgggacggcgttcctttcctcatgaaagctggaaaagctctccatactaggagggcggagatcagggtacagttcagacatgttcctggaaatttgtacaaaaggaactttggaactgatctagataaggccacaaatgagctagttctgcgcttacaacctgatgaagccatatatctgaagatcaacaacaaggttcctggtcttggaatgagacttgaccggagtgaccttaatcttctttacaaagcaaagtatcgaggtgaaataccagatgcatatgagcggcttctgttagatgcaatagaaggagagcgaagattgttcattagaagtgatgagctggatgctgcatgggctctatttacaccattgctgaaggagctagaagagaagaagattgcgccagagctttatccgtatggcagtaggggtccagtaggagcacattatctagctgcaaagcacaacgttcgttggggagatctgtctggtgatgattgatgtatccgacacatcttctccccaaaattggagcgcgaactttcaaaaatattgactataaatgtatgaatattgaggagg

SEQ ID NO: 2616 - protein, 588 aa, Nicotiana tabacum (common tobacco)
MGGQLQLNPCSSSSVATTFHNGAHKFCRNFNILPFKAHSLESSVASTFHNGIYSRIQPRKHFEIMSSNGFHLNAVSLLDGSASKSMPEQVPLTELENAETTVSITVIGASGDLAKKKIFTALFALFYEDCLPENFIVFGYSRTKMSDEELRNMISKTLTCRIDQRENCEAKMDHFLERCFYHSGQYHSEDDFAELDYKLKAKEGSRVSNRLFYLSIPPNIFVDVVRCASLKASSTSGWTRVIVEKPFGRDLESSSELTRCLKKYLTEEQIFRIDHYLGKELVENLSVLRFSNLVFEPLWSRNYIRNVQFIFSEDSGTEGRGGYFDNYGIIRDIMQNHLLQILALFAMETPVSMDAEDIRNEKVKVLRSMRPLQLEDVVLGQYKGHSKGGKLYPAYTDDPTVPNGSVTPTFSAAALFINNARWDGVPFLMKAGKALHTRRAEIRVQFRHVPGNLYKRNFGTDLDKATNELVLRLQPDEAIYLKINNKVPGLGMRLDRSDLNLLYKAKYRGEIPDAYERLLLDAIEGERRLFIRSDELDAAWALFTPLLKELEEKKIAPELYPYGSRGPVGAHYLAAKHNVRWGDLSGDD

SEQ ID NO: 2617 - DNA, 2058 bp, Solanum tuberosum (potato)
  CDS (41)..(1774)
aagaaaactcattcttgaaaaaaggcatttctctgtctgtatgggtgtgcaattgagattgaacccttgttcttcatcttcagctgcaacttctccttcaactttccataatgggacaccatatttctgcaaaaagtttaactttttaccatttagaacccaacccctcaattgggtatctggaatttactcaagaatccaaccaagaaagcattttgaagtcttttcctcaaatgggtttccacttaatgctgtgtctgtgcaagatgtacaagtgcctttgacagagttaggaagtggagataccactgtcagcataactgttattggagcttcaggtgacctagccaagaagaagattttaccagctttatttgctcttttctatgaagattgtctgcctgagaattttgtagtttttggctactcacgaacaaaattgagtgatgaagagctgagaaatatgatcagtacaaccttaacttgtcgaattgataagagagagaattgcgatgccaaaatggagcattttctggaaagatgcttttatcattcgggtcagtacaattctgaggatgattttgcagaactggattacaaattaaaggaaaaggagggttgtagggtttctaataggttgttttacttatcaatacctccaaatatattcgtggatgtggtgcgatgtgcaagtcttaaagcttcttcaacaagtgggtggacaagggtcattgttgagaaaccatttggtcgtgatttagaatcatctagtgagctgaccagatccctaaagaagtacctaactgaggagcaaattttccgaattgaccattacttgggaaaggaacttgttgagaatctctcagttcttcggttctcgaatcttgtctttgagcctctttggtccagaaactacatccgcaatgtccaatttatattttccgaagattttggtaccgagggacgaggagggtactttgaccactacggcatcatccgtgatattatgcaaaatcatctccttcaaatattagcattgtttgctatggaaacacctgtcagcttggatgctgaggacatcagaaatgagaaggttaaagttttaaggtcaatgaggccattgcaacttgaagatgttgttcttggacagtataagggtcatagcaatggtgctaaatcatatccagcttacacagatgatccaactgtgccaaatggcagtatcactccaacattttctgctgctgcactcttcattgataatgcacgttgggacggggttcctttcctcatgaaagcaggaaaagctctccatacgaagagggcagagatcagggtccagttcagacatgttcccggaaatttgtacaaaaggaactttggaactgacatggataaagcaaccaatgagctagttctgcgcctacaacctgatgaagccatatatctgaaaattaacaacaaggtccctggtcttgggatgagacttgaccggagtgaccttaatcttctttataaagcaaagtatcgaggtgaaataccagatgcatatgagcggcttttgttagatgcaatagaaggagagcgaagattgttcataagaagcgatgaacttgatgctgcatgggctctatttacaccgttgctgaaggagctggaagagaagaagattgcaccagagctttatccatacggaagtagggggccagtgggagcacattatctagctgcaaagcacaacgttcgttggggagatctatctggtgatgattgattgtatgtgagatcttcttgaggagtactatgaaatggaggaaatctctaatttcctcacaaagggggacaattgatattcatttagttttataggaattgatctacttgctgtttcagctcatcaagaatgcaaaaattatggacaacttggaactgctgtcagcaattgttgtatagctagcttgtctattttgttaagaaaatactcatgttttattcttcttgttgtgttacatcctgggctatattttgctaatgactaataatataccctactcttca

SEQ ID NO: 2618 - protein, 577 aa, Solanum tuberosum (potato)
MGVQLRLNPCSSSSAATSPSTFHNGTPYFCKKFNFLPFRTQPLNWVSGIYSRIQPRKHFEVFSSNGFPLNAVSVQDVQVPLTELGSGDTTVSITVIGASGDLAKKKILPALFALFYEDCLPENFVVFGYSRTKLSDEELRNMISTTLTCRIDKRENCDAKMEHFLERCFYHSGQYNSEDDFAELDYKLKEKEGCRVSNRLFYLSIPPNIFVDVVRCASLKASSTSGWTRVIVEKPFGRDLESSSELTRSLKKYLTEEQIFRIDHYLGKELVENLSVLRFSNLVFEPLWSRNYIRNVQFIFSEDFGTEGRGGYFDHYGIIRDIMQNHLLQILALFAMETPVSLDAEDIRNEKVKVLRSMRPLQLEDVVLGQYKGHSNGAKSYPAYTDDPTVPNGSITPTFSAAALFIDNARWDGVPFLMKAGKALHTKRAEIRVQFRHVPGNLYKRNFGTDMDKATNELVLRLQPDEAIYLKINNKVPGLGMRLDRSDLNLLYKAKYRGEIPDAYERLLLDAIEGERRLFIRSDELDAAWALFTPLLKELEEKKIAPELYPYGSRGPVGAHYLAAKHNVRWGDLSGDD

SEQ ID NO: 2619 - DNA, 2049 bp, Spinacia oleracea (spinach)
  CDS (147)..(1871)
taaaattctaaactaggattttttttttctttttccatttaaatttcttctgcttaaaaacttccattttcggcaacccaattacatggctaagcatttgagtttgagcgcttgttcgtcttttttagcagcagtcaaaattaaggatggaggaacttgtttcttgccaccatcttccattattatgcctccaaagctctgttcctccaaatgggtgtctcacattctttcaagattctgcctgccaaaggtgttcccattctgaattttcaaatgggcatcctttaaatgatgtctctcttcaaaatgatgtggctgtaaacccaattgttgcaaaaagtattgatccgtcagcagatcttcagttgcttcccctattggagtccgtcaaagaagagcccacactgagcataattgtagttggtgcctcaggagatcttgccaaaaagaagatatttcctgccctttttgctctcttttatgaaaactgtcttcctgagaacttcacagtctttggtttttcacgaacggaaatgaatgatgaagagctgcggactatgatcagtaaaaccttaacctgtagaatagaccagagggaaaactgtggtgaaaaaatggatcattttttgcaaagatgcttttaccattctggtcagtataattctgaggatgacttttcaggattggactgtaagcttaaagaaaaagaggctggtagactgcaaaataggctattctacctttcaataccaccaaacatttttgtggatgtggtgagatgtgttagccatcgagcttcttctgcaagtggatggacaagggttatagtagaaaagccttttggacgtgactcggattcttctcgtgagctaactagaagcttcaagcagtacttgagcgaggaccagatattcaggattgaccattacttggggaaggagttggtggagaatttatctgttctacgcttttcaaatctagtttttgaacctctatggtcaaggaactacatccgaaatgtccagctgatattctctgaagattttggtacagagggacgagggggatactttgataattatggaataatccgagatataatgcaaaaccatcttcttcaaattctagccttgtttgcaatggagacacctgttagcttagatgctgaggacattaggaatgaaaaggtgaaagtgcttaggtcaatgaaaccacttaaactgcaagatgtggtagtgggtcagtacaagggtcacagcaaagggaacaaatcatattctggttacacagatgatccaacggtgccaaacaatagtgtgactccaacatttgcagctgcagcgttgttcatcgacaatgctcgatgggatggagttcctttcctgatgaaagctggaaaagctcttcatacgaagagagctgaaatccgagtgcagtttagacatgttcctggaaacttgtacaagaaaacttttgggacggatttggacaaagctacgaatgagcttgtactacgggtacaacctgatgaagcaatatacttgaagatcaataacaaggttcctggccttgggatgagattggaccgtactgaccttaatttgtgttacagtactaggtaccggggagaaatacctgacgcgtatgagaggctacttctggacgcaatagaaggagagcgtagattgttcatcagaagtgataaactggatgcggcttggtcattgttcacgccgttgttaaaggaactagaggagaaaaaggtagcaccagagctgtacccttacggtagcaggggaccagtcggagctcattatcttgccgccaagcacaatgtccggtggggggatcttagtggtgaagactcgtgagggctttgttgatactgattcacatatacactttcaagatcacttccatgtatgatttgtattgtgaaaatccaaggtatatatatttttcatgtacaacaacctcctactaaagcaatgttgatgcttctgcaattcacactgtagatcttttttaatataaattttacagaaaatt

SEQ ID NO: 2620 - protein, 574 aa, Spinacia oleracea (spinach)
MEELVSCHHLPLLCLQSSVPPNGCLTFFQDSACQRCSHSEFSNGHPLNDVSLQNDVAVNPIVAKSIDPSADLQLLPLLESVKEEPTLSIIVVGASGDLAKKKIFPALFALFYENCLPENFTVFGFSRTEMNDEELRTMISKTLTCRIDQRENCGEKMDHFLQRCFYHSGQYNSEDDFSGLDCKLKEKEAGRLQNRLFYLSIPPNIFVDVVRCVSHRASSASGWTRVIVEKPFGRDSDSSRELTRSFKQYLSEDQIFRIDHYLGKELVENLSVLRFSNLVFEPLWSRNYIRNVQLIFSEDFGTEGRGGYFDNYGIIRDIMQNHLLQILALFAMETPVSLDAEDIRNEKVKVLRSMKPLKLQDVVVGQYKGHSKGNKSYSGYTDDPTVPNNSVTPTFAAAALFIDNARWDGVPFLMKAGKALHTKRAEIRVQFRHVPGNLYKKTFGTDLDKATNELVLRVQPDEAIYLKINNKVPGLGMRLDRTDLNLCYSTRYRGEIPDAYERLLLDAIEGERRLFIRSDKLDAAWSLFTPLLKELEEKKVAPELYPYGSRGPVGAHYLAAKHNVRWGDLSGEDS

SEQ ID NO: 2621 - DNA, 2359 bp, Petroselinum crispum (parsley)
  CDS (172)..(1986)
gaagaggaaggcagcctttcggagataccaaaggactcaaccccctcgaactctccgaagtattttagtcccccctgtgtcttctcaacccccccaatactcctctttcattttcagttttgatacaacaactaatcatttgagattggattacattgtttcacacaacaaatggccaccctttcttcagctaccaattgtcgctcctcctcctcctcctcctattcctcttcatcttctctctttccaaggattcatcatcaacaacacttcatcgtttcgttggcttctcccaaacctctattcaacaagctttctttccattccaatcaaccttctttttccttcactcctgctcctgctcctgctgctgcatcccaagatggtgcaatatccacaacggtgccacatattgaaaatgaaactccactcaagaaagtcaagaatgcaaatttatcagttccaccccctcaggagtccaaaggcattactccttttcgtctcaacaaagacaagtcctctgtcactatcactgtcgtcggagcttctggggacctggccaagaagaagatatttcctgcactttttgcactttattacgaggactgcctacctgagcacttcacaatttttggttatgcccgaagtaagatgactgatgctgaacttagggacatggtgagcaagaccctcacttgcaggattgataagagggcaaactgtggggaaaagatggaacaatttttgaaacgatgcttctatcattctggtcaatatgattctgaagccaattttgccgaacttgacaaaaaactgaaggaacacgaggctggaacaattgccaatcgtcttttctatctatcaattccaccaaacatttttataaatgctgtaaaatctgcaagcatatccgcttcttctgcaaatggctggacaagggtcatcgtagagaaaccatttggtcgggattctgaatcctctgctgcactgacaacagctctcaaacagtatctggaggaagatcaaatattcaggatagatcactatcttggaaaagagctagtggagaatctttctgtccttcgattctccaatctcatatttgaacctttatggtctagacagtttattagaaacgtgcagctgatattttctgaagattttggaaccgaaggcaggggagggtactttgataactatggaatagtcagagacataatgcaaaaccatctgctacaaattttggcactctttgccatggaaacacctgttagtttggatgcagaagatatcaggaatgaaaaagtcaaagttctccgatcaatgaggcccattcaacttgatgatgtggttatagggcagtataagagccacacaaggggaggtgtcaattaccctgcatacaccgacgacaagactgtcccccataatagtctgacaccaacatttgctgcagccgccctttttatagataatgcaagatgggatggtgtaccgtttttaatgaaagctggaaaagccctccatgataggaggactgagataagagtacagtttagacatgtacctggtaatctatacaaacggaactttggaacaaatcttgaccatgagaccaatgagcttgttattcgcgtacaacctgatgaagctatatatctgaagattaataataaggtgccaggtttaggaatgagactggatcgcagcaatctgaatctcttatattcgacaaggtactcgggggagatccccgatgcatacgaaaggcttcttcttgatgccgtcgaaggtgaaaggagactgtttatccgcagtgacgaactggatgctgcttggtcgctctttacacccgtattgaaagatctagaagacaagaaaactgttcccgaatattacccttatgggagtcgaggacccgttggtgctcactatcttgcagccaaatataaagttaggtggggagattttgcaggagatcaatgactagcaagtattttgcatcgcttccaaacagtagaatgtaggaagaacttggccctgaggttggttttctttgttttagtgcatctatcagcattgtaccgcgtgttcaaagaagtaaaatggtatgtccaaaggccttgagatctgtggatgaatgctttgagcaattgagcttataataatttacagagtagtcttagtatttgtaagatgctgtaatggttttctttatgtatctagggatagtaagatagcatctgcaagatctgttttcattttaactgcaacaaatctgagaagaataatggtacatgtttcattgaccttttatagtacaaagttattgttttcataaaaaaaaaaaaaaaaaaaa

SEQ ID NO: 2622 - protein, 604 aa, Petroselinum crispum (parsley)
MATLSSATNCRSSSSSSYSSSSSLFPRIHHQQHFIVSLASPKPLFNKLSFHSNQPSFSFTPAPAPAAASQDGAISTTVPHIENETPLKKVKNANLSVPPPQESKGITPFRLNKDKSSVTITVVGASGDLAKKKIFPALFALYYEDCLPEHFTIFGYARSKMTDAELRDMVSKTLTCRIDKRANCGEKMEQFLKRCFYHSGQYDSEANFAELDKKLKEHEAGTIANRLFYLSIPPNIFINAVKSASISASSANGWTRVIVEKPFGRDSESSAALTTALKQYLEEDQIFRIDHYLGKELVENLSVLRFSNLIFEPLWSRQFIRNVQLIFSEDFGTEGRGGYFDNYGIVRDIMQNHLLQILALFAMETPVSLDAEDIRNEKVKVLRSMRPIQLDDVVIGQYKSHTRGGVNYPAYTDDKTVPHNSLTPTFAAAALFIDNARWDGVPFLMKAGKALHDRRTEIRVQFRHVPGNLYKRNFGTNLDHETNELVIRVQPDEAIYLKINNKVPGLGMRLDRSNLNLLYSTRYSGEIPDAYERLLLDAVEGERRLFIRSDELDAAWSLFTPVLKDLEDKKTVPEYYPYGSRGPVGAHYLAAKYKVRWGDFAGDQ

SEQ ID NO: 2623 - DNA, 1848 bp, Petroselinum crispum (parsley)
  CDS (41)..(1528)
ttctcttgaagcattcttcattcttgctttcagcttgaagatgacatctgataaatggagtatagagaaaagagcacctcttagaaatgattctgttttgaaagaagaaaatgtgccagaaattggatgtctttcaattgttgttcttggtgcttctggtgatcttgccaagaaaaagacttttccagcacttttcaatctttatcgtcaggggtttttgcaatcacatgaagtctacattttcggctatgcaaggacaaagatatcggacgaagagttgagagatcgaattcgtggatatcttgttccaagcaagaatactgtggaggggcatgaagaagatttaactaactttctgcaattgatcaaatatgtttgcggatcttatgacaccgaggaggggtatcaattactggataaagaaatatctgagcacgaaatatacagaaattgcacggaaggatcatcccgtagactattttaccttgctcttcctccatcagtatatcctcctgtctgcaagatgatcaggaaatgctgcatgaataaatctgatcttggtggatggactcggattgttgttgaaaagccctttggcagggatttggagtcggctgagcaactcagtaaccagataggggagttgtttgaagagccccagatttaccgtattgatcattatctgggaaaagaattggtgcagaacttgttggtacttcgtttcgcaaatcgtttcttcatgccactttggaatcgtgacaacattgacaatattcagattgtatttagggaggattttggaactgatggccgtggtggatattttgatcagtacggaattatccgcgatatcatccaaaaccatctattgcaggtcctatgccttgttgccatggagaagcctgtctctcttaagcctgagcatattcgagatgagaaagtgaaggttcttcaatctgtagttcctataaaagatgaagaggttgtgctcggacagtacgatggctatttggaagacccgacagttcctgatggctcgtacactcccacatttgctactatggttttaagaatacacaatgagagatgggaaggtgtaccctttatactcaaggccgggaaagctttgaattctagaaaggcagaaatccgggttcagttcaaggatgttcctggtgatatattcaaaagtaagaagcaaggaaggaacgaatttgtaatacgcctgcaaccttcagaggcaatgtatatgaagcttacagtcaaacaaccaggacttaagatgtcaactgtgcaaagtgagatggacttgtcatacggacagcgttatcaggacgttaccattccagaagcttatgaacgtctgattcttgatacgataagaggtgaccaacaacattttgttcggagagatgaacttaaggcggcctgggagattttcactcctctcctgcacagaatcgacaagggagagtttaaatcacttccgtacaagccaggcagcagagggccagaggaaagcggataagctgcttgagaaggccggttatgttcagacacatggctacatttggatccctcccaccctatagaaatccttagcttataaatgcaaacatgatcagataatgtatcagtataatcacttgaggttgtgatatttgtaagttagtttactatcagcgtttgttctcattatgtaaccttgtaatctgtttattttggtttgtatacgttatatgttgaattataaaaagtaaggaatattctccttagtttatcaaaaaaaaaaaaaaaaaaaaaaaaaaaaaaaaaaaaaaaaaaaaaaaaaaaaaaaaaaaaaaaaaa

SEQ ID NO: 2624 - protein, 495 aa, Petroselinum crispum (parsley)
MTSDKWSIEKRAPLRNDSVLKEENVPEIGCLSIVVLGASGDLAKKKTFPALFNLYRQGFLQSHEVYIFGYARTKISDEELRDRIRGYLVPSKNTVEGHEEDLTNFLQLIKYVCGSYDTEEGYQLLDKEISEHEIYRNCTEGSSRRLFYLALPPSVYPPVCKMIRKCCMNKSDLGGWTRIVVEKPFGRDLESAEQLSNQIGELFEEPQIYRIDHYLGKELVQNLLVLRFANRFFMPLWNRDNIDNIQIVFREDFGTDGRGGYFDQYGIIRDIIQNHLLQVLCLVAMEKPVSLKPEHIRDEKVKVLQSVVPIKDEEVVLGQYDGYLEDPTVPDGSYTPTFATMVLRIHNERWEGVPFILKAGKALNSRKAEIRVQFKDVPGDIFKSKKQGRNEFVIRLQPSEAMYMKLTVKQPGLKMSTVQSEMDLSYGQRYQDVTIPEAYERLILDTIRGDQQHFVRRDELKAAWEIFTPLLHRIDKGEFKSLPYKPGSRGPEESG

SEQ ID NO: 2625 - DNA, 1957 bp, Petroselinum crispum (parsley)
  CDS (74)..(1678)
gttggttaaggagtcgctgcaacaaagtcaaatatattggaatcgaaaactcaatctgtgttgtatacgggttatgaaatcagcagtgtgtgacatagttcataagatgtcggataaatggtgcttagaggaaagagcccctgttgttgaggatagtgccggagatcctattgttaaagatactcaaccaccaccacccgtgtctgaagatggttgcctatcaattgttgtgcttggtgcttctggtgatcttgccaagaaaaagacttttcctgctctctttaacctttaccgccagggtttcttgcagtcacatgaagtatacatttttggctatgccaggaccaagatttctgatgatgacttgagagaccgcattcgtggatatcttactccaaacaagaacactgcagaaggacacacagaagatgtatcaaaatttctgcaactgatcaaatacgtctgtggttcttatgacgcagcggagggttttcagtgtttggataaggaaatatctgagcatgaaatatcaagaaacagtattgaaggatcgtcccggagactattttaccttgcacttcctccttcagtatatcctcctgtctgcaaaatgattaagacttactgcatgaataaatctgatcttggtggatggactcgtattgttgttgagaagccctttggtagggacttggagtcagctgagcatctcagtaaccagataggagaactgtttgaggagccacagatatatcggattgatcactatttgggaaaagagctggtgcagaatttgttggtgcttcgttttgctaatcgtttcttcctgccttcatggaatcgtgacaacatcagtagtgtgcagattgtcttccgagaggattttggaactgaaggccgtggcggatattttgatcagtatggaatcatccgggatattatccaaaatcatctcttgcaggttctttgcctcgttgctatggaaaaacctatttctcttaaacctgagcacattcgagatgagaaagtgaaggttcttcaatctgtagctccacttaatgatgaagaggttgtgcttggacaatatgatggttacttggatgatcccactgtgcccgctggctctaacactccaacttttgcaaccatggtattgcgtatacacaatgaaagatgggaaggtgttcctttcgtacttaaggctggaaaagcattggaatctagaaaggcagaaattcgtatccaattcaaggaagtcccgggtgatatatttaaatgtcaaaagcaggggagaaatgaatttgtgatacggttacaaccttcagaggccatgtatatgaaacttacagtcaagaagcctggacttgagatgtctactgctcagagtgagctcgacttgtcatatgggcagcgttatcaggatgtaaccataccggaggcttatgaacgacttattcttgacactataaggggtgatcagcagcattttgttcgcagagatgagttgaaggcagcctgggagattttcacccctcttcttcacagaatagataaaagtgaacttaaatcagtttcatacaaaccaggcagccgaggcccagaggaagcggatgagttgctgaaaaaagttggctatgttcagacacatggctatacatggattcctccaaccctataatctgaacaggctgcattgatgcttggttgacggcttatcggtaatataagatgggaagttcccaaggtcccctgtgaaataataaatacatcagtacaaatgtatctctgtgatacacgtgatgtttttacgaggatcaaccttttcaaagtaagcttgatctatttacttaaccttgttcgctaaagtgtgtctctgtaatgtgttttgacgaacatgcactatttataagttgttgaaaatgtgaagcttatatactgtaaaaaaaaaaaaaaaaaa

SEQ ID NO: 2626 - protein, 534 aa, Petroselinum crispum (parsley)
MKSAVCDIVHKMSDKWCLEERAPVVEDSAGDPIVKDTQPPPPVSEDGCLSIVVLGASGDLAKKKTFPALFNLYRQGFLQSHEVYIFGYARTKISDDDLRDRIRGYLTPNKNTAEGHTEDVSKFLQLIKYVCGSYDAAEGFQCLDKEISEHEISRNSIEGSSRRLFYLALPPSVYPPVCKMIKTYCMNKSDLGGWTRIVVEKPFGRDLESAEHLSNQIGELFEEPQIYRIDHYLGKELVQNLLVLRFANRFFLPSWNRDNISSVQIVFREDFGTEGRGGYFDQYGIIRDIIQNHLLQVLCLVAMEKPISLKPEHIRDEKVKVLQSVAPLNDEEVVLGQYDGYLDDPTVPAGSNTPTFATMVLRIHNERWEGVPFVLKAGKALESRKAEIRIQFKEVPGDIFKCQKQGRNEFVIRLQPSEAMYMKLTVKKPGLEMSTAQSELDLSYGQRYQDVTIPEAYERLILDTIRGDQQHFVRRDELKAAWEIFTPLLHRIDKSELKSVSYKPGSRGPEEADELLKKVGYVQTHGYTWIPPTL

SEQ ID NO: 2627 - DNA, 1569 bp, Caenorhabditis elegans
  CDS (1)..(1569)
atggcatgcaaacgtcattcagtgtccgatcccatttcgaaggatctcgtcgagtgtcttcgtgaatcaatgcaaagagatctcaaatttgagactccgtacgttttcgtgatatttggagcatcgggagatctcgcaaaaaagaaaatatacccaacactgtggtggttgttccgtgacaaccttttgccagtcaacatcaaatttattggatatgcccgttccgatctgacagttttcaagcttcgtgaatcttttgagaaaaactgtaaagttcgagaaaatgagaaatgtgcttttgatgacttcatcaagaagtgctcatacgttcagggccaatacgacacttctgaaggattccaacgccttcaatcttcaattgatgatttccaaaaagaaagcaataatcaagccgtcaatcgtctctactacctcgctcttcctccatcagttttcaacgtggtttctacggaattaaagaagaattgtatggatcatggtgattcatggacacgtgttatcatagaaaaaccatttggacatgatttgaaatcatcttgtgaactttcaactcatttggcgaaactttttaaagaagatcaaatctaccgtattgatcattatctcggaaaagaaatggttcagaatttgatggttatgcgatttggaaaccgaattctcgctccatcttggaaccgcgatcacattgcatcagttatgatctcatttaaagaagattttggaactggtggccgtgctggatattttgatacagctggaattatccgtgatgttatgcagaatcatttgatgcaaattctaactttagtcgccatggagaaaccagcaagtttgaatgctgaagatattcgtgatgaaaaggtcaaagtgttgaaagctgctaaagttgtagaattaaaggatgtagtagttggacaatacattgccagtcctgaatttgatcacccagaagcatcacaaggatacaaagatgacaaatcagttccagccgattcgactactccaacgtatgctcttgctgttgttcacatcaataatgaacgttgggagggtgttccattcttcttgcgttgtggaaaagctctcaacgagaagaaagcagaagttcgtatacaattcaaagaagtcagtggagatatctatccgtctggtgaattaaagcgatccgaattagtgatgagagtgcaaccaaatgaggcagtttacatgaaactgatgaccaagaaacctggaatgggattcggtgttgaagaaactgaacttgatttgacttataataatagattcaaagaagtccgtcttcctgatgcttatgaacgcctatttctcgaagtattcatgggatctcaaattaatttcgttcgaactgatgagcttgaatacgcttggcgtattttgacgccagttctcgaagagcttaaaaagaagaaagttcaaccggttcaatataaatttggaagtcgtggtccaactgaaggtgacgaattgatgaaaaagtacggtttcatcttcactggaacatacaaatgggttgctccaaagctataa

SEQ ID NO: 2628 - protein, 522 aa, Caenorhabditis elegans
MACKRHSVSDPISKDLVECLRESMQRDLKFETPYVFVIFGASGDLAKKKIYPTLWWLFRDNLLPVNIKFIGYARSDLTVFKLRESFEKNCKVRENEKCAFDDFIKKCSYVQGQYDTSEGFQRLQSSIDDFQKESNNQAVNRLYYLALPPSVFNVVSTELKKNCMDHGDSWTRVIIEKPFGHDLKSSCELSTHLAKLFKEDQIYRIDHYLGKEMVQNLMVMRFGNRILAPSWNRDHIASVMISFKEDFGTGGRAGYFDTAGIIRDVMQNHLMQILTLVAMEKPASLNAEDIRDEKVKVLKAAKVVELKDVVVGQYIASPEFDHPEASQGYKDDKSVPADSTTPTYALAVVHINNERWEGVPFFLRCGKALNEKKAEVRIQFKEVSGDIYPSGELKRSELVMRVQPNEAVYMKLMTKKPGMGFGVEETELDLTYNNRFKEVRLPDAYERLFLEVFMGSQINFVRTDELEYAWRILTPVLEELKKKKVQPVQYKFGSRGPTEGDELMKKYGFIFTGTYKWVAPKL

SEQ ID NO: 2629 - DNA, 1779 bp, Streptomyces coelicolor
  CDS (1)..(1779)
atgagcgaggagcttcccgctggggcgccccaggagaccaaggcgacgaaggaagccaaggagacccggacggcccaggaggcggcggggccgctgcacgcggaggaggccgaggaggcccgcgccgccgaggcggcgaaggcgtccggccgggcgaaggctccccgcggcgcgaagaagtccgcgacgaaccgcgccgccaaggaggcgaagggcaagggcgcggccggggagggcgtcgagccggtggcaccgctcgactggagcaacccgctgcgcgatccccaggaccgccgtctcccccgcatcgcgggcccgtccgggctggtcatcttcggcgtcaccggcgacctgtcccgcaagaagctgatgcccgccgtgtacgacctggccaaccgcggcctgctgccgcccggcttctcgctggtcggcttcgcccgccgggactgggaggaccaggacttcgccgaggtcgtgcacgacgccgtcagggagcacgcgcgcacgccgttccgcgaggaggtctggcagcagctctccgagggcatgcgcttcatccccggcgacttcgacgacgacaacgcgttcgaacagctgcgcaaggccgtcgaggagctggacgcgtcccgcggcaccagcggcaactacgccttctacctctccgtgccgccgaagttcttcccgaaggtcgtccagcagctcaagaagcacgggctgaccgacgcgcccgcgggctcctggcgccgtgcggtgatcgagaagccgttcggccacgacctggacagcgcccgcgacctgaacgcgctggtgcacgaggtgttcgacccggagcaggtcttccgcatcgaccactacctgggcaaggagacggtccagaacatcctggcgctgcgcttcgccaaccagatgtacgagccgatctggaaccggtcctacgtggaccacgtgcagatcacgatggccgaggacatcggcatcggcggccgggccggctactacgacggcatcggcgccgcccgcgacgtcatccagaaccacctgctccagctgatggcgctgaccgccatggaggagccggccgccttcgacgcgcggtcgctgctcaccgagaagctgaaggtgctgcgggcggtgcggctgcccgacgacctgggcgagcacaccgtgcgcgggcagtacgcgggcggctggcagggcggcgcgcaggtgcccggctacctggaggaggagggcatcgacccggcctccaccaccgacacctacgcggcgatcaagctcggcatcgacaaccgccgctgggccggggtgcccttctacctgcgcaccggcaagcgcctgggccgccgggtcaccgagatcgcggtcgtcttccagcgggccccgcactcccccttcgactccacggcgacggaggagctgggcgagaacgccatcgtcatccgcgtccagcccgacgagggcatgacggtgcgcttcggctccaaggtgccgggcacgtcgatggagatccgggacgtgtcgatggacttcgcgtacggcgagtccttcaccgagtccagcccggaggcgtacgaacggctgatcctggacgtccttctgggtgacgccaacctgttcccgcgccaccaggaggtggaagagtcctggcggatcctcgacccgatcgaggagtactgggcctcgcacgacaagcccgcgcagtacgcgtcgggcggctggggaccgcgggaagcggacgagatgctcgcacgagacggacggagctggcgcaggccatga

SEQ ID NO: 2630 - protein, 592 aa, Streptomyces coelicolor
MSEELPAGAPQETKATKEAKETRTAQEAAGPLHAEEAEEARAAEAAKASGRAKAPRGAKKSATNRAAKEAKGKGAAGEGVEPVAPLDWSNPLRDPQDRRLPRIAGPSGLVIFGVTGDLSRKKLMPAVYDLANRGLLPPGFSLVGFARRDWEDQDFAEVVHDAVREHARTPFREEVWQQLSEGMRFIPGDFDDDNAFEQLRKAVEELDASRGTSGNYAFYLSVPPKFFPKVVQQLKKHGLTDAPAGSWRRAVIEKPFGHDLDSARDLNALVHEVFDPEQVFRIDHYLGKETVQNILALRFANQMYEPIWNRSYVDHVQITMAEDIGIGGRAGYYDGIGAARDVIQNHLLQLMALTAMEEPAAFDARSLLTEKLKVLRAVRLPDDLGEHTVRGQYAGGWQGGAQVPGYLEEEGIDPASTTDTYAAIKLGIDNRRWAGVPFYLRTGKRLGRRVTEIAVVFQRAPHSPFDSTATEELGENAIVIRVQPDEGMTVRFGSKVPGTSMEIRDVSMDFAYGESFTESSPEAYERLILDVLLGDANLFPRHQEVEESWRILDPIEEYWASHDKPAQYASGGWGPREADEMLARDGRSWRRP

SEQ ID NO: 2631 - DNA, 1524 bp, Streptomyces coelicolor
  CDS (1)..(1524)
atgtcaagcagcaatccgctgcgtgaccccgcagaccgacggctcccgcgcatcgcggggccgtcgggtctggtcatcttcggcgtcaccggcgatctgtcccgcaagaagctcatgcccgccgtgtacgacctcgccaaccggggtctgctgccgccgggcttctcgctcgtcgggttcgcccgccgggactgggagcacgaggacttcgcccaggtcgtgcacgacgccgtcaaggagcactcccgcacgccgttccgcgaggaggtctggcagcagctcatccaggggatgcgcttcgtgcagggcaccttcgacgacgacgacgccttcgagcggctgcgcggcaccatcgaggagctggacaaggcacagggcacgggcggcaacttcgccttctacctgtcggtgccgccgaagtccttcccggtggtcatccagcagctcaagaagcacggactggccgaccagacgaacggctcctggcggcgggcggtgatcgagaagcccttcggccacgacctgaagtcggccgaggagctgaacgccatcgtccacgaggtcttcggctccgaccaggtcttccgcatcgaccactacctgggcaaggagaccgtccagaacatcctggcgctgcgcttcgccaacacgatgttcgagccgatctggaaccggtcctacgtcgaccacatccagatcaccatggccgaggacatcggcatcggcggccgggccggctactacgacgggatcggcgcggcgcgtgacgtcatccagaaccacctgctccagctgctcgcgctgaccgcgatggaggagcccgcctccttcgacgcggacgcgctggcggcggagaagaccaaggtgctcggcgcggtccgcctccccaaggacctgggccgggacaccgtgcgcggccagtacgcggcggggtggcagggcggcgccaaggccgtcggttacctcgaagaggacggcatcgaccccaagtcgaagaccgacacctacgccgcgatcaaggtgggcatcgacaaccgccgctgggcgggtgtccccttctacctgcgcaccggcaagcggctgggccgccgggtcacggagatcgcggtcgtcttccagcgggccccgcactcccccttcgacacgacggccaccgaggaactcggctcgaacgcgatcgtcatccgcgtccagcccgacgagggcgtcaccgtccgcttcggttccaaggtgccgggcacgtcgatggagatccgggacgtgtcgatggacttcgcctacggcgagtccttcaccgagtccagcccggaggcgtacgagcgcctgatcctggacgtcctgctcggcgacgccaacctcttcccgcgcaccgaggaggtcgagctgtcctggaagatcctcgacccgatcgaggagtactgggacgagcacggcaccccggcccagtacccggccggcacctgggggcccgtcgaggcggacgacatgctggaacgagacggacggagctggcgccggccatga

SEQ ID NO: 2632 - protein, 507 aa, Streptomyces coelicolor
MSSSNPLRDPADRRLPRIAGPSGLVIFGVTGDLSRKKLMPAVYDLANRGLLPPGFSLVGFARRDWEHEDFAQVVHDAVKEHSRTPFREEVWQQLIQGMRFVQGTFDDDDAFERLRGTIEELDKAQGTGGNFAFYLSVPPKSFPVVIQQLKKHGLADQTNGSWRRAVIEKPFGHDLKSAEELNAIVHEVFGSDQVFRIDHYLGKETVQNILALRFANTMFEPIWNRSYVDHIQITMAEDIGIGGRAGYYDGIGAARDVIQNHLLQLLALTAMEEPASFDADALAAEKTKVLGAVRLPKDLGRDTVRGQYAAGWQGGAKAVGYLEEDGIDPKSKTDTYAAIKVGIDNRRWAGVPFYLRTGKRLGRRVTEIAVVFQRAPHSPFDTTATEELGSNAIVIRVQPDEGVTVRFGSKVPGTSMEIRDVSMDFAYGESFTESSPEAYERLILDVLLGDANLFPRTEEVELSWKILDPIEEYWDEHGTPAQYPAGTWGPVEADDMLERDGRSWRRP

SEQ ID NO: 2633 - DNA, 1422 bp, Schizosaccharomyces pombe
  CDS (1)..(1422)
atggttacttttatggtatttggtgcatcaggcaacctcgccaacaaaaagacattccctgccctgttccatctcttcaaacgaaacctggtagatcgttcttccttttacgtacttggatatgctagaagtaagatacctatcggtgaattcagggaaagtattcgtgaatctgtgaagccagatactgaaagcaaacaggtgtttcaggacttcattgaccgagtatcttacttcagtggtcagtatgatcagagcagttcttatgtggaatttcgaaaacacctagaatcagttgaaaaaaaagcagactcttcgaaagcacttcgtatcttttatatcgccttaccaccatctgtttacgtgacagtcagttctcatatatatgagaatttatatttaccaggaaaatcgcggttagttattgaaaaaccgtttggtaaaaactatcaatcggctgttaaactcaaagaagaagttcataagcattggaaagaggaagaaatttatcggattgatcattatacagccaaagatatggttaacaattttttcacccttcgttttgcaaactcttcgtccattgacgcagttttaaatcgccattctattcaatccgtcgaaatacacatgtatgaaacgggaggctgtgaaggccgtattggttactatgatgcgaatggagtcgttcgcgacgtcgtacagaatcatttaactcaaattttttgtattgctgctatgaatgaaccgaagtctgcttctgcgagtgatgttcgtgctgaaaaggtcaatttgttgaaagctaccagaccagcatctttgaaagaaagtatgcttggtcagtatacaactagcgaagacggtaaaataccgggctacttagacttggagggagtccctaaagatagtaaagccaccacatttgctgcatccactcttcatgttgataatgatcgatggaagggcgtacccttcgtatttgtctctggtaagcggatgaaaaaaggtgaagtatatatcaagtactatttccgtctaaaagactccggaattttctccgacgtaaaacgacgtcggtacttgattcttcatgttcagccggaggagtttgtcaatttgacatgtactattaataaacccatgactactgaccttcaaccgattgacgcctatgcttcgctcaattataatgagcaatttaaagatctgatgaaggaaaaacgagatggctatgaaattttattcgaagatgcaattcgcggtgatcccactaagttcattcgttatgatgaggttgagtatgcttggaagatatgggacgaaatcctcgattctcccaaaaaacctattccctatccagctggttcagatggtcctgagggtttggaagcttatatgaaaaggcatctaggccatgaatag

SEQ ID NO: 2634 - protein, 473 aa, Schizosaccharomyces pombe
MVTFMVFGASGNLANKKTFPALFHLFKRNLVDRSSFYVLGYARSKIPIGEFRESIRESVKPDTESKQVFQDFIDRVSYFSGQYDQSSSYVEFRKHLESVEKKADSSKALRIFYIALPPSVYVTVSSHIYENLYLPGKSRLVIEKPFGKNYQSAVKLKEEVHKHWKEEEIYRIDHYTAKDMVNNFFTLRFANSSSIDAVLNRHSIQSVEIHMYETGGCEGRIGYYDANGVVRDVVQNHLTQIFCIAAMNEPKSASASDVRAEKVNLLKATRPASLKESMLGQYTTSEDGKIPGYLDLEGVPKDSKATTFAASTLHVDNDRWKGVPFVFVSGKRMKKGEVYIKYYFRLKDSGIFSDVKRRRYLILHVQPEEFVNLTCTINKPMTTDLQPIDAYASLNYNEQFKDLMKEKRDGYEILFEDAIRGDPTKFIRYDEVEYAWKIWDEILDSPKKPIPYPAGSDGPEGLEAYMKRHLGHE

SEQ ID NO: 2635 - DNA, 1503 bp, Schizosaccharomyces pombe
  CDS (1)..(1503)
atgagttctgcaaatttatctatcaaggaaaatggcgcaatggtcgttttcggcgcttccggtgatctatccaagaaaaagacgtttccagctcttttctctttgtttagcgaaggacgtctccccaaagatattagaatcgttggctatgcgcgctccaagattgaacatgaagactttttagatcgcattacccaaaacatcaaaattgatgaagaggattcccaggccaaagagaagcttgaggaatttaaaaagagatgctcttactatcgtggctcttacgacaagcctgaagatttcgagggcttgaactctcatttgtgtgagagggaaggcgaccgttctacccacaaccgcattttctatctcgcgttacctcccgacgttttcgtatctgtagctacaaaccttaaaaaaaaatgtgtgcccgaaaaaggtattgctcgtcttgtaatcgagaagccatttggcgtcgatttgaaatccgcccaggaactccaatcccaattagctcccctttttgatgagaaggaaatttatcgtattgatcactatttaggcaaggagatggttcaaaatttggttcatcttcgtttttgcaatcctgttatttctcatctttgggacaaaaacagtatttccagtgttcaaattacattcaaagagcctattggtacggaaggccgtggtgggtactttgactctagtactattgtccgtgatatcgtgcaaaaccaccttgtccaaattctgacccttttgaccatggaaaccccgaccactttctctgcagacgatcttcgtgacgagaaagtcaaggtattgcgtcgcactcgattgggagatctcaaagatattgttcttggtcaatatgtcaaaagcaaggacggtaaaaaacctggctaccttgatgacgagactgttcccaagggtagtaggtgtcccacttactcagctattccctgttttattgataccgaaagatggcgcggcgttcctttcttacttaaagctggtaaagccatggatattggcaaggtagagattcgtgttcagttcaaagctgctgcaaatggtttatttaaggacgcatatcataatgagctcgtaatccgtgttcagccagacgaagctatttacttcaagatgaacattaagcaacccggtcttagtgaggctcccctccttactgatttggacttgacttactctcgtagatttaagaacatgaagctccatgaagcatatgaagcattgtttttggacgcgtttgccggtgaccaatcccgttttgctcgtatcgacgaattagaatgtgcctggtctttagttgatcctcttttgaaatatatggaggaagagaaacctgtacccgagccttacgagtatggttccgatggtcccgaatgtttatactcttttttgaaaaagttcggatatatttatgattcccctgattactatgattatccagtcatgtccgttccttccgatcactaa

SEQ ID NO: 2636 - protein, 500 aa, Schizosaccharomyces pombe
MSSANLSIKENGAMVVFGASGDLSKKKTFPALFSLFSEGRLPKDIRIVGYARSKIEHEDFLDRITQNIKIDEEDSQAKEKLEEFKKRCSYYRGSYDKPEDFEGLNSHLCEREGDRSTHNRIFYLALPPDVFVSVATNLKKKCVPEKGIARLVIEKPFGVDLKSAQELQSQLAPLFDEKEIYRIDHYLGKEMVQNLVHLRFCNPVISHLWDKNSISSVQITFKEPIGTEGRGGYFDSSTIVRDIVQNHLVQILTLLTMETPTTFSADDLRDEKVKVLRRTRLGDLKDIVLGQYVKSKDGKKPGYLDDETVPKGSRCPTYSAIPCFIDTERWRGVPFLLKAGKAMDIGKVEIRVQFKAAANGLFKDAYHNELVIRVQPDEAIYFKMNIKQPGLSEAPLLTDLDLTYSRRFKNMKLHEAYEALFLDAFAGDQSRFARIDELECAWSLVDPLLKYMEEEKPVPEPYEYGSDGPECLYSFLKKFGYIYDSPDYYDYPVMSVPSDH

SEQ ID NO: 2637 - DNA, 1428 bp, Schizosaccharomyces pombe
  CDS (1)..(1428)
atgctatccatcattgttttcggtgcatccggcgatctcgctaccaaaatgactttcccggccttgtttgccctttacgtccgcaaaattattcccgaggactttcaaatcatcggctatgcccgttccaaattgtcccaagaggccgctaacaaaatcgtcaccgcccatattcccattgacgatactgtcggtgcttctcaaaaggccttaaacacctttgtcgagcattacaagtatgtccccggtacttatgataagcccgagtcttttgagatgctaaacagcattattgctgaaaaggagactgctcccgcctccgaatgcacacgtatcttttacttggttctgcctcctcatctctttgctcccgtttccgagctaatcaagagtaaggctcatcccaatggtatggtcactcgtcttattgttgagaagcccatcggcttcgactacaagtctgccgatgccattctcagcgatctcagcaagcactggtctgccaaggatactttcaaagtcgaccatttccttggcgaggatatgattgatggattcactgcaattcgctttgcaaactccatgttcgagcccatctggaatcgtgaacacattgaaagtgttcgtgtcgactttcgtgaagactttggttgtgagggacgtggaggttattttgagggcgctggtatccttcgcgatgtcgttcaaaatcatcttttgcaactacttaccttactttgcatcgaagagccaaagtctcaagatgccgaagatatcatcaaatgcaaggttgacttcttgaaatcccttcatcccgtttccaaggaggacatcgtctatggacagtacactaaaagtgcaaatggaaaggtccccggttatcgtgaactggatggtgttgctgatgacagtgaagtttctacattctgtgctcttcaacttcgctctgaagcacctcgttggaagggtattcccatcatcatttctgccggtaaaggtttggaccgcgattactttgaagctcgtatcacttttaagcgtagggaaggaggtatgttccctaccgttgatagcagcaatgttctagtccttcgtgtttatcccaaggaattcattgccctcaagggacacattaaacaacctggtttctctcgtcaaattgttcctgtgactttggacgttaagtatcccgaagctttccctgatacatggatccataaggcctatgaagtggttattgccgatgccattaatggaaagcatacacactttattagtgatgatgaggttcgtacctcttggaaaatctttgatgatgtccttgacactacaggcgatttgtcacctcttccttatgcttttggttcccaccatggtccagatgccacactcgaatttttcaagaagcgtaatttagagtgggattaa

SEQ ID NO: 2638 - protein, 475 aa, Schizosaccharomyces pombe
MLSIIVFGASGDLATKMTFPALFALYVRKIIPEDFQIIGYARSKLSQEAANKIVTAHIPIDDTVGASQKALNTFVEHYKYVPGTYDKPESFEMLNSIIAEKETAPASECTRIFYLVLPPHLFAPVSELIKSKAHPNGMVTRLIVEKPIGFDYKSADAILSDLSKHWSAKDTFKVDHFLGEDMIDGFTAIRFANSMFEPIWNREHIESVRVDFREDFGCEGRGGYFEGAGILRDVVQNHLLQLLTLLCIEEPKSQDAEDIIKCKVDFLKSLHPVSKEDIVYGQYTKSANGKVPGYRELDGVADDSEVSTFCALQLRSEAPRWKGIPIIISAGKGLDRDYFEARITFKRREGGMFPTVDSSNVLVLRVYPKEFIALKGHIKQPGFSRQIVPVTLDVKYPEAFPDTWIHKAYEVVIADAINGKHTHFISDDEVRTSWKIFDDVLDTTGDLSPLPYAFGSHHGPDATLEFFKKRNLEWD

SEQ ID NO: 2639 - DNA, 1461 bp, Leuconostoc mesenteroides
  CDS (1)..(1461)
atggtttcagaaatcaaaacgttggtaactttctttggcggaactggtgatttagcaaagcgtaagctttacccatcagttttcaacctctacaaaaaaggatacttacaagaacactttgccattgttgggacagcacgtcaacaattaagtgatgacgagtttaagcaattggttcgtgattcaattaaagactttactgaagatcaagcacaagccgaagcgtttattgcgcatttttcttaccgtgcgcacgatgtcacagatgccgcttcttatggtatcttgaagtcagcgatcgaagaagcagcaaccaaatttgacattgatggcaatcgtattttctatatgtcagttgcccctcgtttcttcggtacaatcgctaaatatttgaaatcagaaggtttgctagctgagactggctacaatcgtttgatgattgaaaagccttttggtacatcatacgccaccgcagaagaattgcaaagtgatttggaaaatgcatttgatgatgaccaactgttccgtattgaccactatcttggaaaagaaatggtacaaaatattgcagcattacgttttggtaacccaatctttgatgccgcttggaataaggactatatcaaaaacgtacaagtaactttggctgaagttctaggtgttgaagagcgtgctggttactacgataccactggcgcccttttggatatgattcaaaaccacacaatgcaaattgttggttggttagcaatggaaaaacctgaatcattcaatgataaggatatccgtgcagctaaaaacgccgccttcaatgcattaaagatttataacgaagaagaagtgaataagtacttcgttcgtgcacaatatggtgctggtgatacagctgattacaagccatatttggaagaagcagatgtccctgctgactcaaagaacaacacattcattgctggtgaattgcagttcgatttgccacgttgggaaggtgttcctttctatgttcgttcaggtaagcgtttggctgccaagcaaacacgtgttgatattgtatttaaggctggcacattcaactttggttcagaacaagaagcacaagaatcagtactctcaatcatcattgatccaaagggtgctattgaattgaagcttaacgctaagtcagttgaagatgccttcaacacccgcacaatcaacttggattgggcagtatctgatgaagacaagaagaacacaccagaaccatacgaacgtatgattcacgatacaatgaatggtgacggatcaaactttgctgattggaacggtgtatcaattgcttggaagtttgttgacgcaattactgccgtttacgatgcagataaagcaccattggagacatataagtcaggttcaatgggtcctgaagcatcagacaagctattagctgaaaatggcgatgcttgggtatttaaaggatag

SEQ ID NO: 2640 - protein, 486 aa, Leuconostoc mesenteroides
MVSEIKTLVTFFGGTGDLAKRKLYPSVFNLYKKGYLQEHFAIVGTARQQLSDDEFKQLVRDSIKDFTEDQAQAEAFIAHFSYRAHDVTDAASYGILKSAIEEAATKFDIDGNRIFYMSVAPRFFGTIAKYLKSEGLLAETGYNRLMIEKPFGTSYATAEELQSDLENAFDDDQLFRIDHYLGKEMVQNIAALRFGNPIFDAAWNKDYIKNVQVTLAEVLGVEERAGYYDTTGALLDMIQNHTMQIVGWLAMEKPESFNDKDIRAAKNAAFNALKIYNEEEVNKYFVRAQYGAGDTADYKPYLEEADVPADSKNNTFIAGELQFDLPRWEGVPFYVRSGKRLAAKQTRVDIVFKAGTFNFGSEQEAQESVLSIIIDPKGAIELKLNAKSVEDAFNTRTINLDWAVSDEDKKNTPEPYERMIHDTMNGDGSNFADWNGVSIAWKFVDAITAVYDADKAPLETYKSGSMGPEASDKLLAENGDAWVFKG

SEQ ID NO: 2641 - DNA, 3038 bp, Corynebacterium glutamicum
  CDS (115)..(1659)
cctgaagtagaatcagcacgctgcatcagtaacggcgacatgaaatcgaattagttcgatcttatgtggccgttacacatctttcattaaagaaaggatcgtgacactaccatcatgagcacaaacacgaccccctccagctggacaaacccactgcgcgacccgcaggataaacgactcccccgcatcgctggcccttccggcatggtgatcttcggtgtcactggcgacttggctcgaaagaagctgctccccgccatttatgatctagcaaaccgcggattgctgcccccaggattctcgttggtaggttacggccgccgcgaatggtccaaagaagactttgaaaaatacgtacgcgatgccgcaagtgctggtgctcgtacggaattccgtgaaaatgtttgggagcgcctcgccgagggtatggaatttgttcgcggcaactttgatgatgatgcagctttcgacaacctcgctgcaacactcaagcgcatcgacaaaacccgcggcaccgccggcaactgggcttactacctgtccattccaccagattccttcacagcggtctgccaccagctggagcgttccggcatggctgaatccaccgaagaagcatggcgccgcgtgatcatcgagaagcctttcggccacaacctcgaatccgcacacgagctcaaccagctggtcaacgcagtcttcccagaatcttctgtgttccgcatcgaccactatttgggcaaggaaacagttcaaaacatcctggctctgcgttttgctaaccagctgtttgagccactgtggaactccaactacgttgaccacgtccagatcaccatggctgaagatattggcttgggtggacgtgctggttactacgacggcatcggcgcaccgcgcgacgtcatccagaaccacctgatccagctcttggctctggttgccatggaagaaccaatttctttcgtgccagcggcacggcaggcagaaaagatcaaggtgctctctgcgacaaagccgtgctacccattggataaaacctccgctcgtggtcagtacgctgccggttggcagggctctgagttagtcaagggacttcgcgaagaagatggcttcaaccctgagtccaccactgagacttttgcggcttgtaccttagagatcacgtctcgtcgctgggctggtgtgccgttctacctgcgcaccggtaagcgtcttggtcgccgtgttactgagattgccgtggtgtttaaagacgcaccacaccagcctttcgacggcgacatgactgtatcccttggccaaaacgccatcgtgattcgcgtgcagcctgatgaaggtgtgctcatccgcttcggttccaaggttccaggttctgccatggaagtccgtgacgtcaacatggacttctcctactcagaatccttcactgaagaatcacctgaagcatacgagcgcctcattttggatgcgctgttagatgaatccagcctcttccctaccaacgaggaagtggaactgagctggaagattctggatccaattcttgaagcatgggatgccgatggagaaccagaggattacccagcgggtacgtggggtccaaagagcgctgatgaaatgctttcccgcaacggtcacacctggcgcaggccataatttaggggcaaaatgatctttgaacttccggataccaccacccagcaaatttccaagaccctaactcgactgcgtgaatcgggcacccaggtcaccaccggccgagtgctcaccctcatcgtggtcactgactccgaaagcgatgtcgctgcagttaccgagtccaccaatgaagcctcgcgcgagcacccatctcgcgtgatcattttggtggttggcgataaaactgcagaaaacaaagttgacgcagaagtccgtatcggtggcgacgctggtgcttccgagatgatcatcatgcatctcaacggacctgtcgctgacaagctccagtatgtcgtcacaccactgttgcttcctgacacccccatcgttgcttggtggccaggtgaatcaccaaagaatccttcccaggacccaattggacgcatcgcacaacgacgcatcactgatgctttgtacgaccgtgatgacgcactagaagatcgtgttgagaactatcacccaggtgataccgacatgacgtgggcgcgccttacccagtggcggggacttgttgcctcctcattggatcacccaccacacagcgaaatcacttccgtgaggctgaccggtgcaagcggcagtacctcggtggatttggctgcaggctggttggcgcggaggctgaaagtgcctgtgatccgcgaggtgacagatgctcccaccgtgccaaccgatgagtttggtactccactgctggctatccagcgcctggagatcgttcgcaccaccggctcgatcatcatcaccatctatgacgctcatacccttcaggtagagatgccggaatccggcaatgccccatcgctggtggctattggtcgtcgaagtgagtccgactgcttgtctgaggagcttcgccacatggatccagatttgggctaccagcacgcactatccggcttgtccagcgtcaagctggaaaccgtctaaggagaaatacaacactatggttgatgtagtacgcgcacgcatactgaagatttggttgcacaggctgcctccaaattcattgaggttgttgaagcagcaactgccaataatggcaccgcacaggtagtgctcaccggtggtggcgccggcatcaagttgctggaaaagctcagcgttgatgcggctgaccttgcctgggatcgcattcatgtgttcttcggcgatgagcgcaatgtccctgtcagtgattctgagtccaatgagggccaggctcgtgaggcactgttgtccaaggtttctatccctgaagccaacattcacggatatggtctcggcgacgtagatcttgcagaggcagcccgcgcttacgaagctgtgttggatgaattcgcaccaaacggctttga

SEQ ID NO: 2642 - protein, 514 aa, Corynebacterium glutamicum
MSTNTTPSSWTNPLRDPQDKRLPRIAGPSGMVIFGVTGDLARKKLLPAIYDLANRGLLPPGFSLVGYGRREWSKEDFEKYVRDAASAGARTEFRENVWERLAEGMEFVRGNFDDDAAFDNLAATLKRIDKTRGTAGNWAYYLSIPPDSFTAVCHQLERSGMAESTEEAWRRVIIEKPFGHNLESAHELNQLVNAVFPESSVFRIDHYLGKETVQNILALRFANQLFEPLWNSNYVDHVQITMAEDIGLGGRAGYYDGIGAPRDVIQNHLIQLLALVAMEEPISFVPAARQAEKIKVLSATKPCYPLDKTSARGQYAAGWQGSELVKGLREEDGFNPESTTETFAACTLEITSRRWAGVPFYLRTGKRLGRRVTEIAVVFKDAPHQPFDGDMTVSLGQNAIVIRVQPDEGVLIRFGSKVPGSAMEVRDVNMDFSYSESFTEESPEAYERLILDALLDESSLFPTNEEVELSWKILDPILEAWDADGEPEDYPAGTWGPKSADEMLSRNGHTWRRP

SEQ ID NO: 2643 - DNA, 1852 bp, Nicotiana tabacum
  CDS (102)..(1634)
acgttttgtctctcataatttcttcagatcagaaatcacaaggttgaagtgatcacaactacttggctgtattgagttcaagctggtcgtgggccttgaagatggcagcatcatggtgcattgaaaaaagaggttctcttcggctcgactcttttagagagaatgataatatacctgaaaccgggtgtctttccattattgttcttggcgcttctggtgatcttgccaagaagaaaacttttcctgctctcttcaacctctaccgacagggattcctgcaatccaatgaagttcacatttttggctatgcaaggacaaaaatttctgacgatgacttgagaagccgtatccgtgggtatctttctaaggggaaagaatatgaagaagtatcggagtttctgcaactgattaaatacgtcagtggctcttatgattctggggagggctttagtttactggacaaggcgatagctgagcacgaattcgcaaaaaatagcacggaaggatcatccagaagactcttctactttgctcttcctccatcagtatatccctctgtttgcaggatgataaaaaactattgtatgaacaaatctgatcttggtggttggactcgcattgttgttgagaagcccttcggcaaggatttagcttcagctgagcaactaagttcccagataggagaactatttaatgaaccccaaatttaccggattgaccattatttggggaaggagttggttcagaatgtgttggttctgcgttttgcaaaccgcttctttttgccgctctggaatcgtgacaacattgataatatacagattgtctttagggaggactttggaactgaaggccgcggtggatattttgatgaatatgggattatacgtgacattattcagaatcagctactgcaggtcctttgccttgttgctatggagaagcccgtgtctcagaagcccgagcacgtccgggatgagaaagttaaggttcttcaatcaatgcttccaatcaaagatgaagaggtcgttcttgaacaatatgaaggctataaggatgacccaacggttcctggcaactcaaatactcctacttttgcaactatggttttacgcatacacaatgaaagatgggaaggtgtgccctttataatgaaggctggaaaagcactaaattcaagaaaagcagaaatacgagtgcagtttaaggatgttcctggtgatatatttagatgtaaaaagcaggggagaaatgagtttgttatacgcctccagccttcagaagccatgtacatgaagcttacggtcaagaagcctgggcttgaaatgtcaactgttcaaagtgaattagacctgtcatatgggcagcgttatcaaggggttgtcattccagaggcttatgaacgtctgattctcgacacaataagaggggatcagcagcattttgtgcgcagagatgagctcaaggccgcttgggagatttttaccccacttttgcatagaattgacgatggagagatcaagccaattccatacaagccgggcagcagaggtcctgctgaagcagatgagttgctgcaaaatgtcggttacgttcaaactcatggctatatatggattcctcccacattataagtttgcaatgcgtgtcgcgaattacatcctactgtcccctaaatatgagtattaccttgtaacttttgccatgtatgatcctacctatgtgcaaactcgatgagaagtaagattttagtcggtataggagaaatatatctgcatgtaataatgtcatcttttttaagctaatgcatggaagtttgaatatatctcaagtttttcgcggccgcgaattc

SEQ ID NO: 2644 - protein, 510 aa, Nicotiana tabacum
MAASWCIEKRGSLRLDSFRENDNIPETGCLSIIVLGASGDLAKKKTFPALFNLYRQGFLQSNEVHIFGYARTKISDDDLRSRIRGYLSKGKEYEEVSEFLQLIKYVSGSYDSGEGFSLLDKAIAEHEFAKNSTEGSSRRLFYFALPPSVYPSVCRMIKNYCMNKSDLGGWTRIVVEKPFGKDLASAEQLSSQIGELFNEPQIYRIDHYLGKELVQNVLVLRFANRFFLPLWNRDNIDNIQIVFREDFGTEGRGGYFDEYGIIRDIIQNQLLQVLCLVAMEKPVSQKPEHVRDEKVKVLQSMLPIKDEEVVLEQYEGYKDDPTVPGNSNTPTFATMVLRIHNERWEGVPFIMKAGKALNSRKAEIRVQFKDVPGDIFRCKKQGRNEFVIRLQPSEAMYMKLTVKKPGLEMSTVQSELDLSYGQRYQGVVIPEAYERLILDTIRGDQQHFVRRDELKAAWEIFTPLLHRIDDGEIKPIPYKPGSRGPAEADELLQNVGYVQTHGYIWIPPTL

SEQ ID NO: 2645 - DNA, 1821 bp, Nicotiana tabacum
  CDS (88)..(1623)
ggcgtctcacaatttcttcagaaatcacaaggttggattgatcatacttcgctgagttgagggtgagctggttgtgaggccttgaagatggcagcatcatggtgcattgaaaaaaggggttctattcggctcgactcttttagagataatgataatatacctgaaactgggtgtctttccattattgttcttggtgcttctggtgatcttgccaagaagaaaacttttcctgcgctcttcaacctctaccggcagggatttctgcaatccaatgaggttcacatttttggctatgcaaggaccaaaatttctgacgacgacttgagaggccgtatccgtgggtatctttctcaggggaaagaaaatgaagaagaagtatcggagtttctgcagctgattaaatacgtcagtggctcttatgattctggggagggctttagtttactggacaaggctatagctgagcacgaaattgcaaaaaatagcacagaaggatcatccagaagactcttctactttgctcttcctccatcagtatatccctccgtttgcagaatgataaaaaattactgtatgaacaaatctgatcttggtggttggactcgcattgttgttgagaagcccttcggcaaggatttagcttcagctgagcaactaagttctcagataggagaactatttgatgaaccacaaatttaccggattgaccattatttgggaaaggagttggtgcagaatttgttggtgctgcgttttgcaaatcgcttctttttgccgctctggaatcgtgacaacattgataatatacagattgtctttagggaggactttggaactgaaggtcgctgtggatattttgatgaatatgggattatacgtgacattattcagaatcagctattgcaggtcctttgccttgttgccatggagaagcctgtgtcccagaagcccgaacacattcgggatgagaaagttaaggttcttcaatcaatgcttccaattaaagatgaagaggttgttcttggacaatatgaaggctataaggatgacccaacggttcctgacaactcaaatactcctacttttgcaactatggttttacgcatacacaatgaaagatgggaaggtgtgccctttataatgaaggctggaaaagcactaaattcaagaaaagcagaaatacgagtgcagtttaaggatgttcctggtgatatatttagatgtaaaaagcaggggagaaatgagtttgttatacgcctccagccttcagaagccatgtacatgaagcttacggtcaagaagcctgggcttgaaatgtcaactgttcaaagtgaattagacctgtcatataggcagcgttatcaaggggttgtcattccagaggcttatgaacgtctgattctcgacacaataagaggggatcagcagcattttgtgcgcagagatgagctcaaggccgcttgggagatttttaccccacttttgcatagaattgacgatggagaggtcaagccaattccatacaagccaggcagcagaggtcccgctgaagcagatgagttgctgcaaaatgtcggttacgttcaaactcatggctatatatgtattcctcccacattataagtttgcaatgcgtgtcgcgaattacatcctactgtcccctaaatatgagtattaccttgtaacttttgccaggtatgatcctgcctatgtgcaaactcgatagaagtaagattttcgtcggtataggagaaatatatctgcatgtaataatgtcatcttttttaagctaatgcatggaagtttggcggccgcgaattc

SEQ ID NO: 2646 - protein, 511 aa, Nicotiana tabacum
MAASWCIEKRGSIRLDSFRDNDNIPETGCLSIIVLGASGDLAKKKTFPALFNLYRQGFLQSNEVHIFGYARTKISDDDLRGRIRGYLSQGKENEEEVSEFLQLIKYVSGSYDSGEGFSLLDKAIAEHEIAKNSTEGSSRRLFYFALPPSVYPSVCRMIKNYCMNKSDLGGWTRIVVEKPFGKDLASAEQLSSQIGELFDEPQIYRIDHYLGKELVQNLLVLRFANRFFLPLWNRDNIDNIQIVFREDFGTEGRCGYFDEYGIIRDIIQNQLLQVLCLVAMEKPVSQKPEHIRDEKVKVLQSMLPIKDEEVVLGQYEGYKDDPTVPDNSNTPTFATMVLRIHNERWEGVPFIMKAGKALNSRKAEIRVQFKDVPGDIFRCKKQGRNEFVIRLQPSEAMYMKLTVKKPGLEMSTVQSELDLSYRQRYQGVVIPEAYERLILDTIRGDQQHFVRRDELKAAWEIFTPLLHRIDDGEVKPIPYKPGSRGPAEADELLQNVGYVQTHGYICIPPTL

SEQ ID NO: 2647 - DNA, 1808 bp, Chlamydia trachomatis
  CDS (105)..(1643)
taggacccctcatggcaaagccatgttttatgagagagaaatctttttaggcacatattcgtttttttggtattgtgggctctctcttaaaaaattaacactctatgctaggttgtaccttggaagaaattaaagactttggccccacattaccagcctgccctccctgtatcgtggttatttttggtgctacaggagacttgacctctaggaagctctttcctgctttatacaatttaacaaaggaaggacgtctatccgaaaactttgtttgtgttgggtttgctaggcgacctaagtctcatgagcaatttctcgaagaaatgaagcttgccgttcagcatttctctcactcatcggaaatagatattcgagtttgggaaagtctggaaaatagaatcttttaccaccaagctaatttttctgatgccgaaggctactctgctctgaaagcttatttggagcaactagatcaacaatatggaacacaagggaatcgtcttttttatttatcaacaccaccagattatttccaggaaatcatccgcaatttaaatcggcatcagctattctatcatgaacaaggagcacaacagccttggtctcggctaattatagaaaagccttttggagttaatttagaaacagctcgagagcttcaacaatgcattgatgccaatattgatgaagagtcggtttatcgaatagaccattatttaggaaaagaaacggttcaaaacattctgactattcgttttgctaatactctctttgagtcttgctggaattctcagtacatagatcatgtgcaaatcagcgttagcgaatcaattggtataggatctcgagggaatttcttcgaaaagtcgggcatgctacgagacatggtacagaatcatttgacgcagctgctatgtctactgactatggaacctccttctgaattttcttcagaagaaataaaaaaagaaaaaattaaaattctaaagaaaattcttcctatccgcgaagaagatgctgttcgtggccaatatggtgaagggattgtgcaagatgtttcagttctgggctatcgggaggaagaaaatgtcgatccgaattcttcagtagaaacctacgttgcattaaaattatttatcgacaatcctcgctggaaaggggttcccttttacttacaagcagggaaacgtcttactaaaagaacaacagatatcgctgtgatctttaaaaaatccagctacaatttattcaatgcagagaattgtcctttgtgtccgttagaaaatgatttacttattattcgtattcaaccggatgaaggtgttgcgctacaatttaactgcaaggttccaggaacaaataagctcgtacgtcctgtaaaaatggacttccgttacgacagctattttaatactgttactcccgaagcttatgaacggttactgtgcgactgtatccttggggacagaacgctattcactagcaatgaagaagtcttagcatcttgggaactattttctcctctattagaaaaatggtctcaagtacaccctatattccctaactatatggccggatctttacgtcctcaagaagctgatgaactattatctagagatggaaaagcttggcggccctattaatttgttttgcaagaggttatatacatggctacccttattagctaaatgatgcgaatagaatgcttatcgctgactctcaagaagagtttttacaaatcgcatgttatgattggatctctacagcaaataaagcgattcacaaacgcggtgcattctatgtcgctc

SEQ ID NO: 2648 - protein, 512 aa, Chlamydia trachomatis
MLGCTLEEIKDFGPTLPACPPCIVVIFGATGDLTSRKLFPALYNLTKEGRLSENFVCVGFARRPKSHEQFLEEMKLAVQHFSHSSEIDIRVWESLENRIFYHQANFSDAEGYSALKAYLEQLDQQYGTQGNRLFYLSTPPDYFQEIIRNLNRHQLFYHEQGAQQPWSRLIIEKPFGVNLETARELQQCIDANIDEESVYRIDHYLGKETVQNILTIRFANTLFESCWNSQYIDHVQISVSESIGIGSRGNFFEKSGMLRDMVQNHLTQLLCLLTMEPPSEFSSEEIKKEKIKILKKILPIREEDAVRGQYGEGIVQDVSVLGYREEENVDPNSSVETYVALKLFIDNPRWKGVPFYLQAGKRLTKRTTDIAVIFKKSSYNLFNAENCPLCPLENDLLIIRIQPDEGVALQFNCKVPGTNKLVRPVKMDFRYDSYFNTVTPEAYERLLCDCILGDRTLFTSNEEVLASWELFSPLLEKWSQVHPIFPNYMAGSLRPQEADELLSRDGKAWRPY

SEQ ID NO: 2649 - DNA, 2750 bp, Plasmodium falciparum
  CDS (48)..(2258)
atttccatattgccagtttatttccaaatatattttataatatatatatgaataactatcaaaataattatatatataatgaaaaaacattagattttataaataatgatcaagataatgataatttaaaatatttgaaagaatatgtatattttacgacaacaaatcaatttgatgttaggaaaagaattacagtatctttaaatttattagctaatgcatcaagtaaaatatttttattaaattctaaagacaaattagatttatggaaaaatatgttgattaaatcatatattgaagtgaattataatttatatccagctacttatttaatagatacatcatgcaccaacgaaaatgttaatattaacaataacaacaataataataataagaataagaataattattgttatagtaataccactgttatatcttgtggttatgaaaattatacaaaatatattgaagaaatttatgattctaaatatgctctatctctttattctaatagtttgaataaagaagaattattaactataataatttttggctgttcaggtgatttagccaaaaaaaaaatatatccagctttatttaaattattttgtaataattccttaccaaaagatttattaatcattggatttgctagaacagttcaagatttcgatacattttttgataaaatagttatatatttaaaacgatgtttattatgttatgaagattggtctatatcaaaaaagaaggatcttttaaatggttttaaaaataggtgtcgatattttgttggtaattattcgtcttcagaaagttttgaaaattttaataaatatttaacaactattgaagaagaagaagcaaaaaaaaaatattatgcaacatgttataaaatgaatggttcagattataatatatcaaataatgttgcagaggataatattagtatagatgatgaaaataagacaaatgaatattttcaaatgtgtactccaaaaaattgccctgataatgtattttcatcaaattataattttccatatgttataaatagtatattatatttagcattacctccacatatatttattagtactttaaaaaaaattataaaaaaaaattgtttaaatagtaaaggcactgataaaatattactagaaaaaccatttggaaatgatttagattcatttaaaatgttatcaaaacaaatattagagaattttaatgaacaacaaatatatagaatagatcattatttgggtaaggatatggtttcaggattgttgaaattaaaatttacaaatacatttttattatctttaatgaatagacattttataaaatgtattaaaattactcttaaagaaactaaaggtgtatatggtagaggacaatattttgatccctatggtattattagagatgttatgcaaaatcatatgttacaattattaacattaataactatggaagatcctatagatttaaatgatgaatctgtaaaaaatgagaaaataaaaattcttaaatcaattccttcgatcaaattagaagatactattattggacaatatgaaaaagctgaaaattttaaagaagatgaaaataatgatgatgaatcgaaaaaaaatcatagttatcatgatgatccacatatagataaaaattcgattactccaacattttgtacatgtatcttatatattaattcaattaattggtatggtgtaccaatcatttttaaatctggaaaaggtctgaataaagatatatgtgaaatacgtatacaattccataatattatggggtcgtctgatgaaaatatgaataataatgaatttgttattatattacaacctgttgaagctatatacctaaaaatgatgattaaaaaaacgggttgtgaagaaatggaagaagtacaattaaacctaacagtgaatgagaaaaataaaaaaattaatgtaccagaagcatatgaaacattactcttagaatgttttaaaggacataaaaaaaaattcatctcagacgaggaattgtatgaatcatggagaatatttactcctttacttaaggaactccaggaaaaacaagtcaagcctcttaaatattcttttggatcatcaggccctaaagaggtatttggacttgtcaaaaaatattacaattatggtaaaaattatacgcacagacctgagtttgttagaaaatcctctttttatgaagacgatttgttagatattaattattaattgatatatgtatatatttaaattaaccaaattaacacccaatgaatatgaaaataatatatatatatatatatatattatatgattgtttagtatattattacctatcttttataagataacataaatgtatatattatgacatatatatatatatatatatattatttcacttatctgcccacgaactttatttttgttttaaaattctagtataattaaataaaagaaaatatttggaacaatttgcattttttatgtataaataaaatttatataataatatactttcatacttactttttattttattttattttatttattttttaaatgtctattatatatacatataaatgcgttttcaaataaataataaaaacccatgtttaactaataatattacaaatagaactcaaaaaaaaaaaaaataattatacaatgaattaaagctttttaatatatttttaatggtatctccagactttagag

SEQ ID NO: 2650 - protein, 736 aa, Plasmodium falciparum
MNNYQNNYIYNEKTLDFINNDQDNDNLKYLKEYVYFTTTNQFDVRKRITVSLNLLANASSKIFLLNSKDKLDLWKNMLIKSYIEVNYNLYPATYLIDTSCTNENVNINNNNNNNNKNKNNYCYSNTTVISCGYENYTKYIEEIYDSKYALSLYSNSLNKEELLTIIIFGCSGDLAKKKIYPALFKLFCNNSLPKDLLIIGFARTVQDFDTFFDKIVIYLKRCLLCYEDWSISKKKDLLNGFKNRCRYFVGNYSSSESFENFNKYLTTIEEEEAKKKYYATCYKMNGSDYNISNNVAEDNISIDDENKTNEYFQMCTPKNCPDNVFSSNYNFPYVINSILYLALPPHIFISTLKKIIKKNCLNSKGTDKILLEKPFGNDLDSFKMLSKQILENFNEQQIYRIDHYLGKDMVSGLLKLKFTNTFLLSLMNRHFIKCIKITLKETKGVYGRGQYFDPYGIIRDVMQNHMLQLLTLITMEDPIDLNDESVKNEKIKILKSIPSIKLEDTIIGQYEKAENFKEDENNDDESKKNHSYHDDPHIDKNSITPTFCTCILYINSINWYGVPIIFKSGKGLNKDICEIRIQFHNIMGSSDENMNNNEFVIILQPVEAIYLKMMIKKTGCEEMEEVQLNLTVNEKNKKINVPEAYETLLLECFKGHKKKFISDEELYESWRIFTPLLKELQEKQVKPLKYSFGSSGPKEVFGLVKKYYNYGKNYTHRPEFVRKSSFYEDDLLDINY

SEQ ID NO: 2651 - DNA, 1509 bp, Debaryomyces hansenii
  CDS (1)..(1509)
atgtcagtagaaccatttggtaaacacgttaccattgtcgtctttggggcctctggtgatttagctaagaagaagacgttcccagcattatttggattattccgtgaaggagaattgccatcaacgatcaaggtgattgggtatgcaagatcagaattatcagatgctgactttaaggaaagaatatcagccaatttcaagggcgttaatgatagtaacaagcataaggtcgacgaattcttgaacttgtgttcttatactcaaggtcaatacgattccgcagaaggttttaaaaagttgaatgaggagatggaaaagtatgaaaaagattccggtgttgacaaacctgaaagattgttctacttggctttacctccatcggtattcgtcactgttgcaagtcatataaaggaaaatgcctacaccaaaactggtgaggttagattaattgtcgaaaagccgtttggtaatgacttggaatcttctaggaagttgcaaaagagcttggccccattgttcacagaagaagaattgtatagaattgaccactacttaggaaaggaaatggttaagaacttggtatttttaagatttagtaatgaatttcttaacgcttcatggaacaaaaaccacatcaagtcgatccagatatctttcaaggaagcttttggtactgaaggtagaggtggttatttcgatgatattggaattgttagagatgtcatgcaaaaccatttgttgcaagttttgactttgttaactatggaaagaccagtctctattgaccctgaagctatcagagatgaaaaggtcaaggtcttgaaagcatttggtgaactcgaaactgatgacatcttattgggacaatatactaagtccgaagatggaaccaaaccaggttacttagatgatgacactgttaaaggtgactccaagtgtgttacatatgctgcacttggtatgcaaatccacaatgaaagatgggaaggtgttccaattgttatgagagctggtaaggctttgaaagaatctaaggttgaaattagaattcaattcaaggaagtggctaagggtatgttcaatgacattcaaagaaatgaattagttatgagaattcaaccaaatgaagccgtctatatgaaaatcaattctaagatcccaggtatttctgctgttccttctgttaccgacttggatttaacatactcatctagatactctaaggaattttggatcccagaggcttacgaatcattaattagagactgttacttaggtaaccatgctaatttcgtcagagacgatgaattggatctttcatggaagttgttcactccattgttacagcacatcgaatcaaaggatggcccaacacctgaaccttatccttatggttctaacggtccaaagaatttgagacctttcttatctgatcacggttataacttctacgatgaaggcacttatgaatggcctttaaccaccccaaatgttaagggtaaaatgtaa

SEQ ID NO: 2652 - protein, 502 aa, Debaryomyces hansenii
MSVEPFGKHVTIVVFGASGDLAKKKTFPALFGLFREGELPSTIKVIGYARSELSDADFKERISANFKGVNDSNKHKVDEFLNLCSYTQGQYDSAEGFKKLNEEMEKYEKDSGVDKPERLFYLALPPSVFVTVASHIKENAYTKTGEVRLIVEKPFGNDLESSRKLQKSLAPLFTEEELYRIDHYLGKEMVKNLVFLRFSNEFLNASWNKNHIKSIQISFKEAFGTEGRGGYFDDIGIVRDVMQNHLLQVLTLLTMERPVSIDPEAIRDEKVKVLKAFGELETDDILLGQYTKSEDGTKPGYLDDDTVKGDSKCVTYAALGMQIHNERWEGVPIVMRAGKALKESKVEIRIQFKEVAKGMFNDIQRNELVMRIQPNEAVYMKINSKIPGISAVPSVTDLDLTYSSRYSKEFWIPEAYESLIRDCYLGNHANFVRDDELDLSWKLFTPLLQHIESKDGPTPEPYPYGSNGPKNLRPFLSDHGYNFYDEGTYEWPLTTPNVKGKM

SEQ ID NO: 2653 - DNA, 1503 bp, Candida glabrata
  CDS (1)..(1503)
atgtcagaacctgttaagtttgagaagaataccgttgttgtggtgtttggtgcttctggtgatttggccaagaagaagactttcccagctttgtttggtttgttcagagaaggatacctgcacgaatccaccaagattatcggttatgcgcgttccagtcttaccgttgaggaattgactgagcgtatcaagcctcacttgaagactccaaggggtaaggaggacgaggccaagattccacagttcttcaagctgctgacctatgtctccggtccttacgaccaggacgacggtttcatccgcttgcgtgagcagattgagaccttcgaaggtgccaagtgctccaccgtgccacacagactgttctacttcgctttgccaccaagcgtgttcttgccagtcgccaccaacattaagcgtctggtgtacgccgaaaacggtgtcactagactgatcgtggagaagccatttggtagagatctagagaccgctagaaagctacaagccgacttgagtccattgttcaaagaagaagaaatctacagaattgaccattacttgggtaaggaattggtcaagaacttgctagtcatgagattcggtaaccagttcttgaacagtgcttggaacagagacaacatccaatccattcagatctccttcaaagaacctttcggtaccgagggccgtggtggttacttcgataacatcggtatcataagagacgtcatgcaaaaccacttgttgcaagtgttgactttgttgaccatggagagacctgtctccttcgacccagaagccatccgtgacgagaaggttaaggtcctaaaagctatggctccattcgaccctaaggacatcttgatcggtcaatacggtaagtccgaagatggctctaagccagcttacttggatgacgaaaccgttaagccaggctccaagtgtgtcaccttcgccgccatcgccttccaaatcgaaaacgaacgttgggaaggtgttccaatcgttatgagagctggtaaagctcttaacgagggtaaagtagaaatcagactgcaatacaaggctgtcgcttccggtgtattcaagaacatcccacacaacgaattggttatcagaattcaaccaaatgaagccgtttacatgaaattcaacgccaagacaccaggtctgtcaaacgctactcaagtcactgacctagacttgacttactcttccagatacaaggacttctggatcccagaagcttacgaagctttgatcagagatgctctattgggtgaccactctaatttcgttagagatgatgagcttgatgtcagttggagtttattcacacctctattgaactacctagaaggaccagatgctcctcaaccagaaatatatccatacggttcaagaggtccaagcggtctaagggactacttgaagaagcacaattacatgatcgaggaaaagcacccatacacttggccagtcaccactccagatgaggattaa

SEQ ID NO: 2654 - protein, 500 aa, Candida glabrata
MSEPVKFEKNTVVVVFGASGDLAKKKTFPALFGLFREGYLHESTKIIGYARSSLTVEELTERIKPHLKTPRGKEDEAKIPQFFKLLTYVSGPYDQDDGFIRLREQIETFEGAKCSTVPHRLFYFALPPSVFLPVATNIKRLVYAENGVTRLIVEKPFGRDLETARKLQADLSPLFKEEEIYRIDHYLGKELVKNLLVMRFGNQFLNSAWNRDNIQSIQISFKEPFGTEGRGGYFDNIGIIRDVMQNHLLQVLTLLTMERPVSFDPEAIRDEKVKVLKAMAPFDPKDILIGQYGKSEDGSKPAYLDDETVKPGSKCVTFAAIAFQIENERWEGVPIVMRAGKALNEGKVEIRLQYKAVASGVFKNIPHNELVIRIQPNEAVYMKFNAKTPGLSNATQVTDLDLTYSSRYKDFWIPEAYEALIRDALLGDHSNFVRDDELDVSWSLFTPLLNYLEGPDAPQPEIYPYGSRGPSGLRDYLKKHNYMIEEKHPYTWPVTTPDED

SEQ ID NO: 2655 - DNA, 1485 bp, Bacillus thuringiensis serovar konkukian str
  CDS (1)..(1485)
atggaatcaatgacctttgttttatttggagcgacaggggacttagcgaaacgcaaaatttaccccgcactatataacttatatagagatcaaaagcttccaaagcaaatatccgttatcgggcttgggagacgtgaagtatctcatgtagatttccaaaaaagaataaaagaatcaatagagacgttttctcgtcatagagaagaaggtactccagaactcgaagattttttagataattttcgctattgtccattagatgtgagtaagccggaagactatgagagattattacaagtcgttcgtgaaagggaagaagagctacatataaaagggaatagaatgttctatctttctgttgctcctgaattttttgagacaatcgctttaaatattaaggaaagcggacttgataaaacggatggatggaaacgcctaatgattgagaaaccgttcgggcacgatcttacatctgctcgtgagctgaatgataagcttagtcgcacgtttgaagaagacgagatataccgtattgatcattatttaggtaagccgatgattcaaaaccttgaagcactagagtttgcaaatcctgttttacaatcgatttggaataaagaacatatagcgaatgtacaaatcacagcgagtgaaacagttggggttgaagaaagggcaggatattatgatcaggcaggagccattcgagatatggttcaaaatcatatgttacaaatattaatgatgactgctatgaatttgccggaaaaggttaatgcatgtgaaattcgagaggaaaagcgaaaggtaatggaggcgcttcgtaaagtgaaaaaagaagacgttcaaaaccatatcattcgcggacaatatggtgcaggtgagataaatggcgggcaagttgtagcatataaagaggagccaggagtaaatccttcttctaatatagacacatttgttgctgctcgcttgtggatcgataatccattttggactggcgttcccttttatatacgaacaggcaaacgaatgaaagaaaagtctactcgtattgtaatcgaatttaaaaatacgttaaaacagcaatatcaagatagtaatccaaatgcagcacctaacttgttaataattgaaattagcccaggtgagaacgtttcattacagttaaatagtaaaaatccattgaaaaatggagaaattgaaccgatccgtattaactttacttgtgagcaagcggatgtgggagtacctgaagcgtatgaaagactcattcatgatgctgtgagtggagacgctacattctttgcacattggagagaagttgaattgtcatgggaatgggtacaaccaattcttgaagcattcgaggaaaacttattaccacttcatgaatatgagtctggttcacatggtccagaggcatctaatgaattattgcaagaaagtggatttaaatggtggttagatcaagaaacgaaaaaataa

SEQ ID NO: 2656 - protein, 494 aa, Bacillus thuringiensis serovar konkukian str
MESMTFVLFGATGDLAKRKIYPALYNLYRDQKLPKQISVIGLGRREVSHVDFQKRIKESIETFSRHREEGTPELEDFLDNFRYCPLDVSKPEDYERLLQVVREREEELHIKGNRMFYLSVAPEFFETIALNIKESGLDKTDGWKRLMIEKPFGHDLTSARELNDKLSRTFEEDEIYRIDHYLGKPMIQNLEALEFANPVLQSIWNKEHIANVQITASETVGVEERAGYYDQAGAIRDMVQNHMLQILMMTAMNLPEKVNACEIREEKRKVMEALRKVKKEDVQNHIIRGQYGAGEINGGQVVAYKEEPGVNPSSNIDTFVAARLWIDNPFWTGVPFYIRTGKRMKEKSTRIVIEFKNTLKQQYQDSNPNAAPNLLIIEISPGENVSLQLNSKNPLKNGEIEPIRINFTCEQADVGVPEAYERLIHDAVSGDATFFAHWREVELSWEWVQPILEAFEENLLPLHEYESGSHGPEASNELLQESGFKWWLDQETKK

SEQ ID NO: 2657 - DNA, 1554 bp, Oryza sativa
  CDS (1)..(1554)
atgtcaggaggatctggtgattcttccccttcatcagggcgggctagcttcagttctttgtcaggtttgaaggacctagaactgtcttcagagtctggttgcttgtccattgtggtcctaggtgcttctggagaccttgctaagaagaaaacattcccagcgctgtttcacctctttcagcagggatttctacaatctggagaagtccatatatttgggtatgcaagatcaaatatttcggatgatggattaagagaacgcattcgtggatacctcaaaggagcttcagatgaacatatttcacaatttttgcaattaattaaatatgttagtggttcctacaatagcggggaaggatttgcatcattaaataacgccatttcagagaatgaaacttcgaagaacaacaaaccaggaagctcacgtagactattttatttggcattgcctccatcagtctacccctcagtatgcaaaatgataagatcatactgcatgaatccatcttctcattctggctggacaagggttattgttgaaaagccctttgggaaggacttggagtctgcagaggaactcagtgcccagcttggagagctgtttaatgaacaacagctgtacagaattgaccactatttaggaaaagaattggtccaaaatctgcttgtgcttcgctttgcaaaccgtttgttcctacctctttggaatcgtgataacattgctaatgtacagattgtattcagagaggactttgggactgaaggacgtggagggtactttgatcaatatggcatcattcgtgatatcattcagaaccatttgttgcaggtcttctgtttggtggctatggaaaagcctgtctctcttaagcctgagcacataagagatgaaaaagtcaaggttcttcagtcagtgacacctataaagcatgatgaggtggtccttgggcaatatgatggctacaaggatgactctacggtaccagatgactccaacacacctacttttgcatctcttgtattgagggtaaacaatgaaagatgggaaggagttcctttcattctcaaggctggcaaagcactgaacaataggaaagcagagatacgtgtgcagttcaaggatgctcctggtgacatttttaaatgcaagaagcaaggaaggaatgaattcgttatacggttgcagccatcggaagccatgtatatgaaattaactgtcaagaaacccggactagaaatggcaaccgaacaaagcgagctggatctgtcatatgggctacgctaccaagacgtgaagatcccagaagcgtatgaacgcctcatcctggatacgataagaggggatcagcagcactttgttcgccgagacgaactgaaggctgcgtgggagatcttcactccgctgctgcacgacatcgacgacggcaaggtgaaggccctgccgtacaagccgggaacccggggacccccagaggccgacgagctgagcaagaggatgggctacgtgcagacccatggctacgtttggatacctccaaccctttcaaaattctag

SEQ ID NO: 2658 - protein, 517 aa, Oryza sativa
MSGGSGDSSPSSGRASFSSLSGLKDLELSSESGCLSIVVLGASGDLAKKKTFPALFHLFQQGFLQSGEVHIFGYARSNISDDGLRERIRGYLKGASDEHISQFLQLIKYVSGSYNSGEGFASLNNAISENETSKNNKPGSSRRLFYLALPPSVYPSVCKMIRSYCMNPSSHSGWTRVIVEKPFGKDLESAEELSAQLGELFNEQQLYRIDHYLGKELVQNLLVLRFANRLFLPLWNRDNIANVQIVFREDFGTEGRGGYFDQYGIIRDIIQNHLLQVFCLVAMEKPVSLKPEHIRDEKVKVLQSVTPIKHDEVVLGQYDGYKDDSTVPDDSNTPTFASLVLRVNNERWEGVPFILKAGKALNNRKAEIRVQFKDAPGDIFKCKKQGRNEFVIRLQPSEAMYMKLTVKKPGLEMATEQSELDLSYGLRYQDVKIPEAYERLILDTIRGDQQHFVRRDELKAAWEIFTPLLHDIDDGKVKALPYKPGTRGPPEADELSKRMGYVQTHGYVWIPPTLSKF

SEQ ID NO: 2659 - DNA, 1500 bp, Photobacterium profundum
  CDS (1)..(1500)
atggttcagccagaaaataacgcgattgttatttttggtgcgtcaggcgatttgactcaccgaaaattgattccagcattttatcatctctatgctaatgggttattaccagaagattttgcaattttaggcgtaagtcgtactgaatatagtgaccaagattttcgtgaaaaactaaaaatttcactcacagaaacagaaaaggtaaacgaagaaacgctaattaaattttgtgagcatttatattaccaagcattgaatacgtcagaagtggctgaatatgcgctgttaaaacagcgtttgggtgatttgaatgataagcatcatacccaaggtaatactatttattacttggcaaccccaccaagcttgtatggtgttattcctgaatgtttgggtgcgcatggcttaaacgacgaaacgcacggttggaaaaaccttattgttgaaaagccatttggttacgatttagcatcagccaacgagcttgatgaacgtattcatgcgcatttcaaagagcaacaaatttaccgcattgaccactacttaggcaaagaaacagtacagaatctacttgtatttcgttttgctaatgggatgtttgaaccattatggaaccgtaatttcatcgaatacgttgagatcacggcagctgaatctttaggtgtcgaagagcgcggtggctattacgatggagccggtgctgtacgtgatatgttccaaaatcacttacttcaagtacttgctatggttggaatggaatcgccagcagcaatcaatgcagattctattcgtgatgaagttgtgaaggttatgcaaagctttcagcctttgtcagacaaagatttagaaaaaaatcttgtgctagggcaatacaccgattccacagtaagaggcgatcatctaccaggataccgagaagaacatggcgtagcagatgattctcgcacagaaacgtatgttggtatgaagatgtttatccagaactggcgttggaatggcgtgccattttacgttcgtactggtaagcgtttacccactcgcgtgacggaagtggtcattcactttaagaaaacaccacacccagtgttcggtaccaatgcaccagagaataagctgatcattcgtattcaacccgatgaaggtattctaatgagtttcggtttgaaaaagccaggggctggctttgaagctgaagaagtttctatggatttccattacggcgatttagaagaaacgaatatgcttaccgcttacgagcgattattgcttgactgtatgaagggtgatgccacgttgtttgcccgaactgatgcggtaaaagcgtgctggaaattcgtacaacccattcttgaatataaagaaaatcctgaccatttatttggttatgcggcaggtacttggggaccaaaagaagcggatgagttattacaaggcgacgaacgtaattggcgctttccgtgtaaaaacctgactaatactgactattgtgagttatag

SEQ ID NO: 2660 - protein, 499 aa, Photobacterium profundum
MVQPENNAIVIFGASGDLTHRKLIPAFYHLYANGLLPEDFAILGVSRTEYSDQDFREKLKISLTETEKVNEETLIKFCEHLYYQALNTSEVAEYALLKQRLGDLNDKHHTQGNTIYYLATPPSLYGVIPECLGAHGLNDETHGWKNLIVEKPFGYDLASANELDERIHAHFKEQQIYRIDHYLGKETVQNLLVFRFANGMFEPLWNRNFIEYVEITAAESLGVEERGGYYDGAGAVRDMFQNHLLQVLAMVGMESPAAINADSIRDEVVKVMQSFQPLSDKDLEKNLVLGQYTDSTVRGDHLPGYREEHGVADDSRTETYVGMKMFIQNWRWNGVPFYVRTGKRLPTRVTEVVIHFKKTPHPVFGTNAPENKLIIRIQPDEGILMSFGLKKPGAGFEAEEVSMDFHYGDLEETNMLTAYERLLLDCMKGDATLFARTDAVKACWKFVQPILEYKENPDHLFGYAAGTWGPKEADELLQGDERNWRFPCKNLTNTDYCEL

SEQ ID NO: 2661 - DNA, 1551 bp, Parachlamydia sp
  CDS (1)..(1551)
atgcataactcgcattattttgttaatcctttgaacgaaccgaatcggcccataaaaattccagaatcttgtattttagtcatttttggagcgaccggtgatttaacagctcgtaaactaattccagctttgtataacttagcgagagacggccaacttcctggtcattttgcctgtgtaggctttgctagaagggcaaaaacacatgatgagtttcgggaagaaatgttagaagcagttaacaaattttcaagatcgaaaccagttgaacaaggactctggaaacgctttcgtgaacaattgttttatcatcaatcagaatttgatgatgatgaagggtataaaagcttaaaccaatttttagaaaaactcgacacacaaatgggaactaaaggtaaccgagttttttatttatctatccagcctagctattttcctctcgttgttgaaaagcttagccaacaccaattgacatatccagttaaacaagtcaaagacaaatggagtcgtgtcattatagaaaagccttttggaagagatattgaatcagcaaaacaacttcaacaagatcttgtgcaacacctagatgaaagtcaaatttatcgaattgatcattatttgggaaaagaaactgtacaaaatttattagtttttagatttggtaatcccatctttgaatcagtttggaataaccatcatattgataatattcaaattactgttggtgaagaaattggaattggttctcgcggtcgattttgggaagaagcaggaatgttgcgagatattgtccaaaatcatgtgatgcaactcctttctcttgttgcgatggaacccccgacgagtctccaagccaactcagtccgcggcgaaaaagttaaagtcattgaagctattagacctatccccttcgattcaatggaacaatgcgttatccggggccaatatggatctggattcattaacggggaacccgttaaaggatatcgagacgaggaaaatgtagactctaaatcttttgttgaaacctacgttgccttgcaactttctatcgataactggcgttgggctggagttcccttctatttacgtgctggtaaacgcctacccaaacgagctactgaaattgcgattactttcaaaaaagcccccggatatctatttgaaggaacttcagctttgattgactcaaacgttttagtgattcgtattcaaccggatgaaggaatttcattgagaattaattgcaaagtccctgcattaaacacagtcattcaaccggtgaaaatggattttcgttacggatcttactttggtgccattcctcccgaagcttatgaaagattaatttgtgattgcatggccggggataatactttatttgctagagatgacgaagtcattatgtcttggaagttgctcacacctattttagaacattggcaagaaacatccccgacagattttccaaattatgccgcgggaacttgggggccagaccgagccgaagaaatgctaaaacgccaaggacgtcattggagacttatttaa

SEQ ID NO: 2662 - protein, 516 aa, Parachlamydia sp
MHNSHYFVNPLNEPNRPIKIPESCILVIFGATGDLTARKLIPALYNLARDGQLPGHFACVGFARRAKTHDEFREEMLEAVNKFSRSKPVEQGLWKRFREQLFYHQSEFDDDEGYKSLNQFLEKLDTQMGTKGNRVFYLSIQPSYFPLVVEKLSQHQLTYPVKQVKDKWSRVIIEKPFGRDIESAKQLQQDLVQHLDESQIYRIDHYLGKETVQNLLVFRFGNPIFESVWNNHHIDNIQITVGEEIGIGSRGRFWEEAGMLRDIVQNHVMQLLSLVAMEPPTSLQANSVRGEKVKVIEAIRPIPFDSMEQCVIRGQYGSGFINGEPVKGYRDEENVDSKSFVETYVALQLSIDNWRWAGVPFYLRAGKRLPKRATEIAITFKKAPGYLFEGTSALIDSNVLVIRIQPDEGISLRINCKVPALNTVIQPVKMDFRYGSYFGAIPPEAYERLICDCMAGDNTLFARDDEVIMSWKLLTPILEHWQETSPTDFPNYAAGTWGPDRAEEMLKRQGRHWRLI

SEQ ID NO: 2663 - DNA, 1515 bp, Rhodopseudomonas palustris
  CDS (1)..(1515)
atgaccacgcaagccaacagcaatcaggtccccgaaggctgcgcgttcgtcatcttcggcgccaccggcgacctcacccatcggctggtgattccggcgctctacaacctcgccgaagccaacctgctgcctgaaaaattctgcgtcgtcggcgtcacccgcaaggagatgtccagcgacgatctgcgcgacagcctgatgcagggcctgcgcaaatacgcgacccgcccggtcgacgacaaggtcgctgatcagcttctgtactgcgtcaccgcggtcagcgccgatcccagcgagccggcctcgttcgagcggttgcgcgagcggctggagaagctcgaggccaatcgcaacaccggcggcaaccggctgttctatctcgccacgccgcctgatgcgttcgcgccgatcgccaccgagctcggccgcgccgggctgcttaaggagaccagcggcgcctggcgccggctggtggtggagaagccgttcggcaccgacctcgcctcggccaaggcgctgaacgatcatctgctcagcatcatctccgagcacgagctgtaccggatcgatcactacctcggcaaagagacggtgcagaacatcctggtgctgcggttctccaacggcatgttcgagccgatctggaacagagagcacatcgaccacatccagatcaccgtcgaggaaaagctcggcgtcggccatcgcggcagcttctacgacaagaccggcgcgctgcgcgacatggtgccgaaccatctgtttcaactgctgtcgctggtggcgatggagccgccggcgcatttcaacgcccacgcggtgcgttcggccaaggccgacgtgctcgcggcgatccagatccaaaccgaagaggaagcgctgcgcaattcggtgcgcggccaatacacttcgggcaagatcggcgacaccgacatcccggactatcgcagcgccaaggacgtcgcggccgacagcaccaccgagaccttcgcggcgctgacactgtcgatcgacaattggcgctgggccggcgtgccgttctatctgcgcaccggcaaggcgctgtcgggcaagcgcaccgaggtggcgatcaaattcaaggaggcgccattctcgatgtttcgctgcaccccggtgcaggaactgtcgcagaactttctggtcattgggatcgaaccggtcgaaggcatctcgctgcagttcaacaccaaggtgccgggaccgatgatcgccatcgacggcgtcgagatgaccttccgctacaaggactacttcaaggtggcgccgagcaacggctacgagacgctgctgcacgactgcatgatcggcgacaacatcctgttccaacgcgccgacggtgtcgaagccggctggcgcgcggtacaacccttcctcgacgcctggaagaaggccggcgcgcacggccttcagatctatcgcgccggcagcgatggcccggaagacgccgacgaactgctggggcgcgacggtcgcaattggcggaagccgacctga

SEQ ID NO: 2664 - protein, 504 aa, Rhodopseudomonas palustris
MTTQANSNQVPEGCAFVIFGATGDLTHRLVIPALYNLAEANLLPEKFCVVGVTRKEMSSDDLRDSLMQGLRKYATRPVDDKVADQLLYCVTAVSADPSEPASFERLRERLEKLEANRNTGGNRLFYLATPPDAFAPIATELGRAGLLKETSGAWRRLVVEKPFGTDLASAKALNDHLLSIISEHELYRIDHYLGKETVQNILVLRFSNGMFEPIWNREHIDHIQITVEEKLGVGHRGSFYDKTGALRDMVPNHLFQLLSLVAMEPPAHFNAHAVRSAKADVLAAIQIQTEEEALRNSVRGQYTSGKIGDTDIPDYRSAKDVAADSTTETFAALTLSIDNWRWAGVPFYLRTGKALSGKRTEVAIKFKEAPFSMFRCTPVQELSQNFLVIGIEPVEGISLQFNTKVPGPMIAIDGVEMTFRYKDYFKVAPSNGYETLLHDCMIGDNILFQRADGVEAGWRAVQPFLDAWKKAGAHGLQIYRAGSDGPEDADELLGRDGRNWRKPT

SEQ ID NO: 2665 - DNA, 1650 bp, Corynebacterium diphtheriae
  CDS (1)..(1650)
atgcccaacgtgagtaaaccagtggctaacggaaacaccgtagaaagtaacaatgctgaacttgctttcggcggtgttgatttttcctattctgatacacatgagaattcgtgtagtagaacgtcaagcaaatgggtcaatcccctaagggatgctgaggacaagcgcctcccccgcatcgcgggcccgtgcggaatggttatttttggtgtaactggtgatctcgctcggaaaaagctcctgccagcgatctatgatcttgcacacaggggcctattgcctgcaggtttcagtcttgtcggctacggtcgacgaggctggtctaaggccgactttgaaaattacgtcaagcaagcagttgttgccggtgcccgtaccgatttccgcgaaaatgtttgggcacgacttgccgaaggtatgcacttcgttcaaggcaatttcgatgatgatgcagcatttgatagtttggcatcgcttttggcggatcttgatcagacccgtggaactgccggtaactgggccttttatctctctgttccaccagattatttttcggatgtttgccatcaacttcagcgctcaggcatggctacagccgagggcaattcatggcgtcgcgtcattgtggaaaagccttttgggcatgatcaagaatcagcacgtcagctaaacaacttgatcaattcagtattccctgaaaagtcagtatttcgtatcgaccactacttgggtaaagagacagtgcaaaatattatggcactgcgctttgcaaaccagctatttgatccgctctggaattctcactatgttgaccatgtccaaatcaccatggctgaggatatcggtctaggcggtcgcgctggttactatgatggaatcggcgccgctagagacgttatccaaaaccaccttattcagctgttggcgctggtagctatggaggaacccgtagcttttaccccacaagagcttcaggctgaaaaaatcaaggttcttcgtgccactcgcccagtagaaccttttgctaaaacaacagcccgagggcaatattcgcgcggttggcagggatctgagctcgtccaaggtctacgagaagaagacggatttgatcctaattccggaactgaaacttatgctgcctgcacactcgagataaattcgcgtcgttgggccggtgtgcccttttatcttcggactggaaagcgtttaggacgccgggtgactgagatcgcccttgtattcaaggatgcgcctcatcagccatttagcgaaggtagccgtcattcccaaggccgcaacgtcgtagtgatccgagtccagcctgatgagggtatgctgatgcgttttggttccaaggttcctggtaacacgatggaagtacgcgacgtcaacatggacttctcgtactcagaggcatttaccgaagaatcaccggaagcctacgaacgactcattctcgatgcacttctcgacgaagcaagtctcttcccaacaaatgaagaagttgagcttagctggcagatcctagatccgatattgaacttctggtctgatcgtgggcaaccggaagaataccccgctggcacctggggcccagctggtgcagacaagatgctggagcgcgaaggtcgcgcttggcgtcgaccttaa

SEQ ID NO: 2666 - protein, 549 aa, Corynebacterium diphtheriae
MPNVSKPVANGNTVESNNAELAFGGVDFSYSDTHENSCSRTSSKWVNPLRDAEDKRLPRIAGPCGMVIFGVTGDLARKKLLPAIYDLAHRGLLPAGFSLVGYGRRGWSKADFENYVKQAVVAGARTDFRENVWARLAEGMHFVQGNFDDDAAFDSLASLLADLDQTRGTAGNWAFYLSVPPDYFSDVCHQLQRSGMATAEGNSWRRVIVEKPFGHDQESARQLNNLINSVFPEKSVFRIDHYLGKETVQNIMALRFANQLFDPLWNSHYVDHVQITMAEDIGLGGRAGYYDGIGAARDVIQNHLIQLLALVAMEEPVAFTPQELQAEKIKVLRATRPVEPFAKTTARGQYSRGWQGSELVQGLREEDGFDPNSGTETYAACTLEINSRRWAGVPFYLRTGKRLGRRVTEIALVFKDAPHQPFSEGSRHSQGRNVVVIRVQPDEGMLMRFGSKVPGNTMEVRDVNMDFSYSEAFTEESPEAYERLILDALLDEASLFPTNEEVELSWQILDPILNFWSDRGQPEEYPAGTWGPAGADKMLEREGRAWRRP

SEQ ID NO: 2667 - DNA, 1446 bp, uncultured bacterium 581
  CDS (1)..(1446)
atgaccggagtcgacctaattatttttggcgcttccggagacctttcagcaagaaagctctttcccgcactgtttcaactcgaccgcgccgaattactgcccagcgacctgcgcatcacagcaattgctagagatcaggtcgacgtaaatacttttttggaaggcctaagacagcgaatgcatgcctacatgggctctgagtcgccttccgatgccgagtggcagcactactcacgacattttcaatatgtgggcgccgacttcgccaacgctgacagctattccagtatcagggcaactctagatgatacccgtatcagcttattttacttggctacaccacccagcatcttcgccctaatttgcaacaatctggccactaataattgcctcaccggcgactgccgaatcgtactcgaaaaacccattggcgaatgtctagcctcgtcaaaggaagtcaatgaaacgctggctcgctactttgacgaaggatctatttatcgcatagatcactacctgggaaaggagaccgttcagaacttactcgcgctgcgctttgcaaaccgatttattaatagtcagtgggatgccaactgtatcgaccatgttcaaatcaccgtcggcgaaatcgtcggtattgagggtcgctggtcttactatgaccgcgttggccagctccgcgacatggttcaaaaccaccttatgcagttactctgtctcgtcgctatggagccccccaatagcctagaagccgatagcatccgcgacgagaaagtcaaaatcgtcaaggccttgagacgcatcgactctgatcaggtctctgagcacgtgattaaagggcaatacagccagggttggtcttcaggtgcggccgtgcctgggtaccttgaggagcccggttgtgagcgccctgacagcgataccgagacgtttatcgcgatcaaagctcatgtagacaactggcgctgggctggcgttccattttacctgcgaacaggaaaacgcgttcctgaaaaattaactgaaatcatcattcagtacaaagaccttccccacaacatttttagcggcggcaccagcgcgaacaagttaatcattcggttacagcccagggaaggcatagagctaacaatggcatcgaaacgccagacgctgcgagaaaaactgtccttacagaaccataccttggatttagattttcgggaaaccaccggcatgaatcgaattcccgacgcctacgaacgattatttcttgatgcaattaatggcgatcagtcgctgtttgtaggtcgagaggagatcgaagaaagctggcgctggtgtgatgaactgattgacgcctgcaaccaaaagaacatagagaccaagccctatcacgctggatcttggggcccacccaaagccgagcttttaattgaaaaggatgggcgtagctggcatgtctga

SEQ ID NO: 2668 - protein, 481 aa, uncultured bacterium 581
MTGVDLIIFGASGDLSARKLFPALFQLDRAELLPSDLRITAIARDQVDVNTFLEGLRQRMHAYMGSESPSDAEWQHYSRHFQYVGADFANADSYSSIRATLDDTRISLFYLATPPSIFALICNNLATNNCLTGDCRIVLEKPIGECLASSKEVNETLARYFDEGSIYRIDHYLGKETVQNLLALRFANRFINSQWDANCIDHVQITVGEIVGIEGRWSYYDRVGQLRDMVQNHLMQLLCLVAMEPPNSLEADSIRDEKVKIVKALRRIDSDQVSEHVIKGQYSQGWSSGAAVPGYLEEPGCERPDSDTETFIAIKAHVDNWRWAGVPFYLRTGKRVPEKLTEIIIQYKDLPHNIFSGGTSANKLIIRLQPREGIELTMASKRQTLREKLSLQNHTLDLDFRETTGMNRIPDAYERLFLDAINGDQSLFVGREEIEESWRWCDELIDACNQKNIETKPYHAGSWGPPKAELLIEKDGRSWHV

SEQ ID NO: 2669 - DNA, 1602 bp, Nonomuraea sp
  CDS (1)..(1602)
atgacagacccggcagcacccgcggaggaggccgtcaccgtggcggcggccgtcgcgggcaccgccaccaccgaggctgtggcagccgccaacccgctgcgcgacccgcgtgacaagcggttgccccgggtggcgggaccgtgcgtgatggtgttgttcggcgtgacgggtgacctggccaagcgcaagctgctaccggcgatttacgacctgggcaaccgggggctgctgccgcccggcttctcgctggtcggcttcgcccggcgcgattggaaagaccaggatttcgcccagttgacgcacgacgccgtcaaggcgcatgcccggacacccttccgtgaggaggtctggaagcagatccgcgagggcatccatttcgttcccggcgagttctcggacgacggggcgttcgacgcgctggccatggcgttggcagagatcgacgagacccgcggcacgggcggaaactacgctttctacctgtcggtgccgccgaagttcttccccgtggtggtggagcagctcaagcgcaccgggctgtccgacgcgcccgacggctcgtggcggcgggtggtgatcgagaagccgttcgggcacgacctgcagtcggcccacgagctgaacgagatcaccacctcggccttcccggagagctcgatcttccggatcgaccactacctgggcaaggagaccgtccagaacatcatggcgctgaggttcgccaacaacctctacgagccgatctggaaccgcagcttcgtcgaccacgtacagatcacgatggccgaggacatcggcatcggcggccgggccggctactacgacggcatcggcgccgcccgcgacgtgatccagaaccacctgctccagctcctcgcgctcgtcgcgatggaggacccgacctccttcgaggccaactcgctgcggcgggagaaggagaaggtgctcaaggccgtgcggctgcccgcgaacctgggcctgaacaccgcgcgcggccagtactccgcgggctggcagggcggcgagaaggtcgtcggctacctccaggaggagggcatctcgcaggagtccaccaccgagacctacgccgccatcaagctggagatcgccaaccggcgctgggccggcgtgccgttctacctgcgcaccggcaagcgcctgggccgccgcgtcaccgaggtggccgtggtgttccagcgggcgccgcacctgccgttcagcaaggacgacaccgagatcctcggccagaacgcgctggtcgtccgggtccagccggacgagggcatcaccgtgcggttcggctcgaaggtgccggggacggcgatggaggtgcgtgacgtctccatggacttcgcctacggcgagtcgttcctggagtcgtcgccggaggcgtacgagcggctgctgctcgacgtgatgatcggcgatccgccgctcttcccgcaccagcgggaggtggagctgtcgtggaacatcctcgacccgatcgaggagttctgggccacgcaggggcagccggagccgtacgagtccggttcgtgggggcccgagtcggccgacgcgatgatggcccgcgacggccgcgtgtggaggaggctctag

SEQ ID NO: 2670 - protein, 533 aa, Nonomuraea sp
MTDPAAPAEEAVTVAAAVAGTATTEAVAAANPLRDPRDKRLPRVAGPCVMVLFGVTGDLAKRKLLPAIYDLGNRGLLPPGFSLVGFARRDWKDQDFAQLTHDAVKAHARTPFREEVWKQIREGIHFVPGEFSDDGAFDALAMALAEIDETRGTGGNYAFYLSVPPKFFPVVVEQLKRTGLSDAPDGSWRRVVIEKPFGHDLQSAHELNEITTSAFPESSIFRIDHYLGKETVQNIMALRFANNLYEPIWNRSFVDHVQITMAEDIGIGGRAGYYDGIGAARDVIQNHLLQLLALVAMEDPTSFEANSLRREKEKVLKAVRLPANLGLNTARGQYSAGWQGGEKVVGYLQEEGISQESTTETYAAIKLEIANRRWAGVPFYLRTGKRLGRRVTEVAVVFQRAPHLPFSKDDTEILGQNALVVRVQPDEGITVRFGSKVPGTAMEVRDVSMDFAYGESFLESSPEAYERLLLDVMIGDPPLFPHQREVELSWNILDPIEEFWATQGQPEPYESGSWGPESADAMMARDGRVWRRL

SEQ ID NO: 2671 - DNA, 1476 bp, Listeria monocytogenes
  CDS (1)..(1476)
atgacagatgagttagaacaaaaagcactgattactatttttggcggtacgggagatttggcaaatcgcaaactttacccttcgctatatcatttgtacagtaagggatctcttggcgacaattttgctgttattggaacggctcgtcgtgaatggagtaacgatttcttccgtgataaagtaaaagagtctatcaaagacattgacggttccgaaaaagacgcggatgcatttgcttctcacttctactatcaatctcatgatgtgacaaataaagaatcttatgtaactttaaaagatttgtctgatgaattagatgcaaaatacgaattaggtggcaatcgcctcttctatcttgcaatggcgccgaatttctttggaactatcgcaagtcgcattaaatctgaaggatttgtagatacagatggctttcatcgtttaattatcgaaaaaccatttggtcacgatttagctagtgcagaagaattaaataattcgcttcgtcaagcatttaaagaagatgaaatttatcgtattgaccattatttaggaaaagaaatgatccaaaatatctcggttattcgttttgcaaattctatcattgaatcgctttggaataatcgttacatcgataacatccaagttactttaactgaggtgcttggggttgaagatcgtgggcgctattacgatgaaagtggcgcgcttcgagacatggttcaaaaccatattctccaaatcgtttctctacttgcgatggagccaccaattaacttaacgacacgcgagattcgtcatgaaaaagttcgcgcgcttcgttccttacgcgtttttgaaggtaaagaagttcaccaaaactttattcgtggtcagtacggtcctggtgaagtaggtggcaaagaactcaaaggctatcgtcaagaagataatgtggatcctcattccaatacggaaacgtttgttgcagccaaactagaaatcgataacttccgctgggctggcgttccattttatattcgcacgggtaaacgtcttgcgaagaaaacgacccaaattgcgattcagttcaaagatgtaccgctgaatttatttggtcaacaacaatcgcttggtggtaatgtgcttgttattcatatccaaccggacgaaggtattacacttcatttgaacgtcaaagaacctggtcaaggtatggttacaatgccagtcaacttaaattatattcattcctctccagacggcatgaacacacctgaggcttacgaaaaattgattctagactgtcttcgcggtgatgcgacttacttctctcactgggatgaagtatcactatcatggaactttattgaccatatagcagatgtttggacaaatacgaaagatcatttcccgaactacaaatccggttcgatggggcctaaagaagcagacgacctcattcaacgcgacggattccagtggttcccaatcgattaa

SEQ ID NO: 2672 - protein, 491 aa, Listeria monocytogenes
MTDELEQKALITIFGGTGDLANRKLYPSLYHLYSKGSLGDNFAVIGTARREWSNDFFRDKVKESIKDIDGSEKDADAFASHFYYQSHDVTNKESYVTLKDLSDELDAKYELGGNRLFYLAMAPNFFGTIASRIKSEGFVDTDGFHRLIIEKPFGHDLASAEELNNSLRQAFKEDEIYRIDHYLGKEMIQNISVIRFANSIIESLWNNRYIDNIQVTLTEVLGVEDRGRYYDESGALRDMVQNHILQIVSLLAMEPPINLTTREIRHEKVRALRSLRVFEGKEVHQNFIRGQYGPGEVGGKELKGYRQEDNVDPHSNTETFVAAKLEIDNFRWAGVPFYIRTGKRLAKKTTQIAIQFKDVPLNLFGQQQSLGGNVLVIHIQPDEGITLHLNVKEPGQGMVTMPVNLNYIHSSPDGMNTPEAYEKLILDCLRGDATYFSHWDEVSLSWNFIDHIADVWTNTKDHFPNYKSGSMGPKEADDLIQRDGFQWFPID

SEQ ID NO: 2673 - DNA, 1485 bp, Bacillus cereus
  CDS (1)..(1485)
atggaatcaatgacctttgttttatttggagcgacaggggacttagcgaaacgaaaaatttaccccgcactatataacttatatagagatcaaaagcttccaaagcaaatatccgttatcgggcttggaagacgccaagtatctcatgtagattttcaaggaagaataaaagaatcaatagagacattttcccgtcatagagaagaaggtactctagaacttgaaggttttttagataattttcgctattgtccattagatgtgagtaagccggaagactatgagagattattgcaagtcgttcgtgaaagggaagaagaactacatataaaagggaatagaatgttctatctttccgttgctcctgaatttttcgagaccattgctttaaatattaaggaaagcggacttgataaaacggatggatggaaacgcctaatgattgagaaaccgtttgggcacgatcttcaatctgctcgtgagttgaatgataagcttagtcgcacgtttgaagaagatgagatataccgtattgatcattatttaggtaagccgatgattcaaaaccttgaagcactagagtttgcaaatcctgttctccaatcgatttggaataaagaacatatagcgaatgtacaaattacagcgagtgaaacagttggggttgaagaaagagcaggatattatgatcaggcaggagccattcgagatatggttcaaaatcatatgttacaaatattaatgatgactgctatgaatctgccggaaaaggttaatgcatgtgaaattcgagaggaaaagcgaaaggtaatggagacgcttcgtaaagtgaaaaaagaagacgttcaaaaccatatcattcgcggacaatacgcttcaggagagataaaaggcgagcaagttgtagcatataaagaggagccaggagtaaatccttcttctaatatagacacatttgttgctgctcgtttatggatcgataatccgttttggactgacgttcccttctatatacgaacaggcaaacgaatgaaagaaaaatctactcgtattgtaatcgaatttaaaaatacgctaaaacagcaatatcaagataataatccaaatgcagcacctaacttattaataattgaaattagcccaggtgagaatgtttcattacagttaaatagtaaaaatccattgaaaaatggagaaattgaaccgatgcgtattaactttacttgcgagcaagcagatgtgggagtgcctgaagcgtatgaaagacttattcatgatgctgtaagtggagacgctacattctttgcacattggagagaagttgaattgtcatgggaatgggtacaaccaattcttgaagcattcgaggaaaacttattaccacttcatgaatatgagtctggttcatatggtccagatgcgtctcatgaattattgcaagaaagtggatttaaatggtggttagatcaagaaacggaaaaataa

SEQ ID NO: 2674 - protein, 494 aa, Bacillus cereus
MESMTFVLFGATGDLAKRKIYPALYNLYRDQKLPKQISVIGLGRRQVSHVDFQGRIKESIETFSRHREEGTLELEGFLDNFRYCPLDVSKPEDYERLLQVVREREEELHIKGNRMFYLSVAPEFFETIALNIKESGLDKTDGWKRLMIEKPFGHDLQSARELNDKLSRTFEEDEIYRIDHYLGKPMIQNLEALEFANPVLQSIWNKEHIANVQITASETVGVEERAGYYDQAGAIRDMVQNHMLQILMMTAMNLPEKVNACEIREEKRKVMETLRKVKKEDVQNHIIRGQYASGEIKGEQVVAYKEEPGVNPSSNIDTFVAARLWIDNPFWTDVPFYIRTGKRMKEKSTRIVIEFKNTLKQQYQDNNPNAAPNLLIIEISPGENVSLQLNSKNPLKNGEIEPMRINFTCEQADVGVPEAYERLIHDAVSGDATFFAHWREVELSWEWVQPILEAFEENLLPLHEYESGSYGPDASHELLQESGFKWWLDQETEK

SEQ ID NO: 2675 - DNA, 1410 bp, Mycobacterium paratuberculosis
  CDS (1)..(1410)
atggccgacgatgacagccatccatccgacctgctggtgatcttcggaatcaccggggacttggcgcgcaagatgacgttccgcgcgctctaccggctggagcgccgcgaggagctcgagcacccgatcatcggcgtggccagcgacgacatcaccctcgaccagctgctggaccgcgcccgggaggcgatcaaggccaccggtgagacgttcgacgacgcggtgttcgaccgcttggcgggccggctgtcctacctgtcgggcgacgtcaccgacgccgggctctacagcgagctcgccaagaagatcggtggcgattcgcgtccgctgtactacctggagatgccgccgtcgttgttcgcgccgatcgtggagaacctggccaaggccgacctactggaacgcgccagggtggcggtggaaaagccgttcggccacgacctggaatctgcgcgcgacctcaacgcccggctgcgcgcggtgctcgacgaagaccaaatcctgcgcgtagaccactttttgggcaaacagccggtcgaagaactgcaatacctgcggttcgccaacaacgccctggccaagctgtgggaccgcgacagcatctccgaaatccacatcaccatggccgaggacttcggcatcgaggaccgcggcaagttctatgacgccgtgggggcggtgcgcgacgtcgtgcaaaaccatctgctgcaggtgctcgcgctggtcgccatggaacccccggtgggggcgggcgccgacgacctcaacgacaagaaggccgaggtgttccgggccatgccgtcgctggacccggagcactgcgtgcgtggccagtatcgcggctacaccgaagtccccggtgtggcaaaggattccaccaccgagacctacgtcgcgctgagggccgagatcgacaactggcgctgggccggggtgccgatcttcctgcgcgccggcaaggcgttgccgcacaaggtcaccgaggtccggatgttcctgcatcacgtgcccggcttctccttcctgcccaaccgccgcccgcccgagcccaaccagatcgtgctgcgcatcgaccccgatcccgggatgcgcctgcagctgtccgctcaggtcggcgactcgtggcacgacgtgcacctggactcctcgttcgcggtggacctcggcgaaccggtgcggccctacgaacggctgctctacgccgcgttcaacggcgaccgccagctgtttgcccgcgaggacgccatcgaagagacctggcggatcgtgcagccggtgctggacaagccgagccgcatccaccaatacgagcaaggctcctggggacccgaggccgcgcaggcgctggtgcacggtcgccacgcctggcagcaaccgtggctgccgcagagcacgtccacgaaacgataa

SEQ ID NO: 2676 - protein, 469 aa, Mycobacterium paratuberculosis
MADDDSHPSDLLVIFGITGDLARKMTFRALYRLERREELEHPIIGVASDDITLDQLLDRAREAIKATGETFDDAVFDRLAGRLSYLSGDVTDAGLYSELAKKIGGDSRPLYYLEMPPSLFAPIVENLAKADLLERARVAVEKPFGHDLESARDLNARLRAVLDEDQILRVDHFLGKQPVEELQYLRFANNALAKLWDRDSISEIHITMAEDFGIEDRGKFYDAVGAVRDVVQNHLLQVLALVAMEPPVGAGADDLNDKKAEVFRAMPSLDPEHCVRGQYRGYTEVPGVAKDSTTETYVALRAEIDNWRWAGVPIFLRAGKALPHKVTEVRMFLHHVPGFSFLPNRRPPEPNQIVLRIDPDPGMRLQLSAQVGDSWHDVHLDSSFAVDLGEPVRPYERLLYAAFNGDRQLFAREDAIEETWRIVQPVLDKPSRIHQYEQGSWGPEAAQALVHGRHAWQQPWLPQSTSTKR

SEQ ID NO: 2677 - DNA, 2454 bp, Mycobacterium paratuberculosis
  CDS (1)..(2454)
atggctacccagaaaccgcagaccatctcctacccggctcccgaggcccggccgcgtcgtcaccacaccgacccgctcgaccctcatgtgatcgtcctgttcggcgccaccggggatttggcgaaacgcaagctgatccccggtttggcgtatctggaccagtccgagctggcacccgacatccagatcgtcgccacgtcgctggaggacctgagcaacgacgaattccgcgagctggccaagaacgcgatcgactcgttcggcacgcacaagctgacgcccgaccagtggcgcaacttcgccgacatcatcacctacatcccgcagagcgccggctccgacgcgctggccgccgcggtggccgaggccgaggccaagctggggccgaacgtgcggcggctgcattacctgtcggtgccgccgaaggcggcgcgcgcggtgatcaccatgctgcgcgacgccaaactggtcgagcggtcgcgggtggtgatggagaaaccgttcggcaccgatctggccagcgcggtggcgctcaacgacttcgtgcaccaaaccttcgaggaatcccagattttccgcatcgaccacttcctgggtaaggaggccgcccagaacattctggcgttccgcttcgccaacgggttgttcgagccgatctggaaccgcaacttcatcgaccacatccaaatcgacatccccgaggccctcggcctggatcagcgggcgagtttctacgaggagaccggcgcctacaaggacatggtggtcacccatctgtttcaggtgatggccttcgtggtgatggagccgccgacggcgctcgaaccgttcgccatcagcgaagaaaagaacaaggtgttccggtcgatgcttccggtcaagccctcgaacgtggttcgcggtcagtacatcggctatcgcgaggaagacggagtggcaaaggattccgacaccgagacattcatcgccctcaaggtcggcatcgacaactggcggtgggccggggtgcccgtctaccttcgcaccggtaagaggatggccgagggcatccggcatcatctcgatcgcgttcaaggaggcaccgcggaccatgttcccgcccgggtcgggggtgggcacgcaggggcccgaccacctgacgttcgatcttgcggacaattcgcgggtgtcgctgtcgttctacggcaagcggcccggccccggcatgaaactggacaagctgtccatgcaattctccacccaggagatcgaaaccgcggtggacgtgctggaggtctacgaacggctcatcctggacgcgatgcgcggcgaccacaccctgttcaccaccgccgaaggcatcgaatcactgtgggagcgttccgaagagctgctcaacgacccgccaccggccaagctgtaccagccggggacgtggggccccaacgcaattcaccagttgatcgcgcccaacgcgtggcggctgccgttcgagcgcgagtggcgcgatccccagaccctaccccggagtgggcagctgagaagtgctgcggttcagcccaattcggcgctgagataactgatggcctggcggaattccctgaggatttcgttgtcgggcaactcgaagccgtagtcggtgtacacccgctcggtgggcaggcgggtgacgctccagccggtggcctccaggtggtcgccggccgggcggcgctcgccgagccagaccagttcggccacgtcgatgtccagtccgtgctggcgccaggtgctgcgcatcgcccgggcgcgttcgtcggtgaacacccgcatgtcggtgatgttctcggtggccagcctgctgcccggcgcgctgagcgcggtgatgttgtccagcagccggtcctgggcgtgcggcggcaggtagggcagcagcccctcggcgatccaggcggtacgggcgctgctgtcaaagccgttgtcgcgcaacgctgttggccagtcatcgcgcaaatcgacggcgacggtgcggcgctcggcggtcggttgcgcgcccagccgggccagggtgtcggtcttgaaggagatgacctcgggctggtcgacctcgaacaccacggtgcccgccggccaggacaaccggtaggcccgcgcgtcgagcccggcggccaggatgacggcctggcgaatgccggcagcggtcgcggagcggaagaaatcgtcgaaaaaccgcgtccgcaccgtgatttgctcgcgccgctgctgcagcgtcatcggcatgtcgtcggtgtcgagcgggatctggccgtccagcatccggacgaagaagggatgcccgaccgcgcgcaccaacggttcggcgaaccggtcgtcgagcagcgggtccggaccgcgagaggccagcgcccgggaggccgcgaccatggtcgcggtcgcccccacgctggaggccagatcccagctgtcgccctcggtacgtgccgaaccggtcgatga

SEQ ID NO: 2678 - protein, 817 aa, Mycobacterium paratuberculosis
MATQKPQTISYPAPEARPRRHHTDPLDPHVIVLFGATGDLAKRKLIPGLAYLDQSELAPDIQIVATSLEDLSNDEFRELAKNAIDSFGTHKLTPDQWRNFADIITYIPQSAGSDALAAAVAEAEAKLGPNVRRLHYLSVPPKAARAVITMLRDAKLVERSRVVMEKPFGTDLASAVALNDFVHQTFEESQIFRIDHFLGKEAAQNILAFRFANGLFEPIWNRNFIDHIQIDIPEALGLDQRASFYEETGAYKDMVVTHLFQVMAFVVMEPPTALEPFAISEEKNKVFRSMLPVKPSNVVRGQYIGYREEDGVAKDSDTETFIALKVGIDNWRWAGVPVYLRTGKRMAEGIRHHLDRVQGGTADHVPARVGGGHAGARPPDVRSCGQFAGVAVVLRQAARPRHETGQAVHAILHPGDRNRGGRAGGLRTAHPGRDARRPHPVHHRRRHRITVGAFRRAAQRPATGQAVPAGDVGPQRNSPVDRAQRVAAAVRARVARSPDPTPEWAAEKCCGSAQFGAEITDGLAEFPEDFVVGQLEAVVGVHPLGGQAGDAPAGGLQVVAGRAALAEPDQFGHVDVQSVLAPGAAHRPGAFVGEHPHVGDVLGGQPAARRAERGDVVQQPVLGVRRQVGQQPLGDPGGTGAAVKAVVAQRCWPVIAQIDGDGAALGGRLRAQPGQGVGLEGDDLGLVDLEHHGARRPGQPVGPRVEPGGQDDGLANAGSGRGAEEIVEKPRPHRDLLAPLLQRHRHVVGVERDLAVQHPDEEGMPDRAHQRFGEPVVEQRVRTARGQRPGGRDHGRGRPHAGGQIPAVALGTCRTGR

SEQ ID NO: 2679 - DNA, 1545 bp, Mycobacterium paratuberculosis
  CDS (1)..(1545)
atgagcccggctcgcaccgcgcagcaatggcataacccgttacgcgacaagcgcgacaagcggctcccgcgcatcgccgggccgtgcggaatggtgatcttcggcgtcaccggcgatctggcccgcaagaaggtcatgcccgccatctacgacctggccaaccgcgggctgctgccgcccagcttctcgctggtcggcttcgcccgaagggattggagcacccaggatttcggcaaggtggtatatgaggccgtcaaggagcactgccgcaccccgttccggcaggagaactgggatcggctggccgagggattccgtttcgtgccaggcgctttcgacgacgacgaggcgttcggccggctcgccgagacgctggacaaactcgacgccgagcggggcaccggcggtaatcacgccttctacctggccatcccgcccaagtccttccccgtcgtgtgcgaacaactgcacaagtccgggctggcccgcccgcagggcgaccgctggagccgagttgtcatcgagaagccgttcggccacgacctggagagcgcgcagagcctgaacaaggccgtcaacgccgtctttcccgaggagtcggtcttccgcatcgaccactacctgggcaaggagacggtccgcaacatcctggcgctgcggttcgccaaccagttgttcgacccgatctggaactcgcactacgtcgaccacgtgcagatcaccatggccgaggacatcggcctgggcgggcgggccggctactacgacggcatcggcgccgcgcgcgacgtcatccagaaccacctgatgcagctgctggcgctgaccgcgatggaagagccggtcagcttcagcccgttggcgctccaggccgagaagatcaaggtactctcggccacccacctcgcccacccgctcgacgagaccaccagccgcggccagtacaccgcgggctggcagggcggcgagaaggtggtcgggctgctcgacgaggagggcttcgccaaggactcgatcaccgagacgttcgccgccatcaccctcgaggtggacacccgccgctgggcgggggtgccgttctacctgcggaccggaaaacgcttgggccgcagggtgaccgagatagccctggtgttcaagcgcgcgccgcatctgccgttcgacgcgacgatgaccgatgagctgggcgccaacgccatggtgatccgggtgcagcccgacgagggtgtcacgctgcggttcggttccaaggtgccgggcaccgcgatggaggtccgcgacgtcaacatggacttctcctacgggtcggcgttcgccgaggaatcaccggaggcctacgagcagttgatcctcgacgtgctgctgggtgagccgtccctgttcccggtcaacgccgaagtcgaattggcttggcacatcctcgatcccgtgctcgacaactgggcgagcggcggcaggcccgagccctacgaggccggcacctggggcccggattcggcgttcgagatgctgcaccggacgggccgcgaatggcggcggccatga

SEQ ID NO: 2680 - protein, 514 aa, Mycobacterium paratuberculosis
MSPARTAQQWHNPLRDKRDKRLPRIAGPCGMVIFGVTGDLARKKVMPAIYDLANRGLLPPSFSLVGFARRDWSTQDFGKVVYEAVKEHCRTPFRQENWDRLAEGFRFVPGAFDDDEAFGRLAETLDKLDAERGTGGNHAFYLAIPPKSFPVVCEQLHKSGLARPQGDRWSRVVIEKPFGHDLESAQSLNKAVNAVFPEESVFRIDHYLGKETVRNILALRFANQLFDPIWNSHYVDHVQITMAEDIGLGGRAGYYDGIGAARDVIQNHLMQLLALTAMEEPVSFSPLALQAEKIKVLSATHLAHPLDETTSRGQYTAGWQGGEKVVGLLDEEGFAKDSITETFAAITLEVDTRRWAGVPFYLRTGKRLGRRVTEIALVFKRAPHLPFDATMTDELGANAMVIRVQPDEGVTLRFGSKVPGTAMEVRDVNMDFSYGSAFAEESPEAYEQLILDVLLGEPSLFPVNAEVELAWHILDPVLDNWASGGRPEPYEAGTWGPDSAFEMLHRTGREWRRP

SEQ ID NO: 2681 - DNA, 1449 bp, Lactobacillus johnsonii
  CDS (1)..(1449)
atgaaaaatattccagttgttatgattatttttggtggctccggagatttagctcatagaaagctttatccagccttatttaatttgtatcaaaaaggtttaattcatgatcattttgctgtaattggtacagcgagaagaccttggagccatgaatatttgcaagaacaagtagttgaagcagttaaagaaagctgtgacaactttgatgaaaaagaagcaaaagaattcgcttcacatttttattaccagtctcacgatgtaactgatattggccactacattgccttgaaggaattagcagctaaacttgatgaaaaatatcaagcagaaggaaatcgaattttctacatggctatggcaccaagattttttggtacaattgctactcacattaatgatcaaaaattgcttggtagcggctttaaccgtttagtaattgaaaagccatttggtcatgatttagcttcagcagaaaagttaaaccgagaaattggcgaaagttttgatgaagagtcggtatatcgaattgaccactatcttggaaaagaaatggttcaaaatattatgcctctaagaatgactaatccaattgttaagaatatctggaataatgactatatcgcaaatatgcaagtaactttagcagaaagtctaggagtaggaactcgtggtggttactacgaaacatctggtgctttacgtgatatggttcaaaaccatatttttcaaattattacacttttagctatgcctgagcctaaaggacttgattcagaccatattcaccaagctaaacaagaattattagatagtctagtaattccaactccagaaatggttaaaaagcatttctcacgaggacaatatttagctgatgataatgaagtagagtatttaaaggcagatcaagttgcactagactctaaagtagaaacatttgtagctggagaagttaaattcaaaaagggtccagtagctgatgtgccaatttactttagaactggtaagaaaatgaaggataaggtttctcgcattgatattgttcttcaccatatgaataatttatacggtagcgcacattcaaataatatctcaattattattgatccaattagtgaaatttatttcacaattaatggaaagaagattacagctgaaggtttaagaagagaaaaccttagttataagttttctaaggaagaaatggagcaagttccagatggctacgaacgattgcttcacgatgtgtttgtagcagatagaactaactttactcactggtcagaattgaagcaatattggaagttcgttgatgcagttgaagatgtttggcaagatgaaaataaagatgttaagcagcttgaacaatatccaagtggtaagttcggtacggaatcaagtaatcatatttttgaaaaagatagcgagcactggatttaccgttaa

SEQ ID NO: 2682 - protein, 482 aa, Lactobacillus johnsonii
MKNIPVVMIIFGGSGDLAHRKLYPALFNLYQKGLIHDHFAVIGTARRPWSHEYLQEQVVEAVKESCDNFDEKEAKEFASHFYYQSHDVTDIGHYIALKELAAKLDEKYQAEGNRIFYMAMAPRFFGTIATHINDQKLLGSGFNRLVIEKPFGHDLASAEKLNREIGESFDEESVYRIDHYLGKEMVQNIMPLRMTNPIVKNIWNNDYIANMQVTLAESLGVGTRGGYYETSGALRDMVQNHIFQIITLLAMPEPKGLDSDHIHQAKQELLDSLVIPTPEMVKKHFSRGQYLADDNEVEYLKADQVALDSKVETFVAGEVKFKKGPVADVPIYFRTGKKMKDKVSRIDIVLHHMNNLYGSAHSNNISIIIDPISEIYFTINGKKITAEGLRRENLSYKFSKEEMEQVPDGYERLLHDVFVADRTNFTHWSELKQYWKFVDAVEDVWQDENKDVKQLEQYPSGKFGTESSNHIFEKDSEHWIYR

SEQ ID NO: 2683 - DNA, 1539 bp, Ashbya gossypii
  CDS (1)..(1539)
atgatgtgtggagaagtgacgaggacagacgcttttgaaaaggatgtgataattacagtgtttggagcctcaggggatcttgccaagaagaagacgttcccagcactgtatggattgtatcgcgaggggtacctggacgacagcacgaagattattgggtatgctcggtcggagctatctgatgcggagctgcgggagcgcgtcaagccgtacttgagcaaaccagacgacgcagcgagtgaggccaagcaagccgagttcctggagaggatgagctacgtagctgggccttacgacaaggaggaggggtacgtgcagttgcgggagcagattgaggcttacgagcgcgaacggggcgttgagaaacctcacaggttgttctacttggcgcttcctcccagtgcgtttgtcagtgttgctgagaaaatcaagcagttcctctatgcggagggcggcgttacaaggttaattgtggaaaagccctttggccatgacctggagtcgtctcggaagttgcaaaagcagctggagcctctgttccgtgaggaggagatattccggattgaccactacttaggaaaggagatggtcaagaacctgctacctctgcggtttggtaatgcgttcttcaatgcctcctggaataaggaaaatatccagatgatccagatctcgttgaaggaaccatttgggacggaaggccgtggaggttactttgactccactggtattataagggacgtcatgcagaaccacttgctccaagtactaactttgctaaccatggagaggccagtatcttttgatccggagagcatacgtgacgagaaagtcaaggtgctgaaggccatcgttcctcttgaccacgaagacattttgattggacagtacggccgatctgaagatggtacaaagcctgcttacttagatgacgagactgtcagcaaggactctaagtgcgtgacatttgccgcgttgacctttaatatccagaatgagcggtgggatggagttcctattgtcatgcgtgcagggaaggcattgaacgaaggtaaggttgagatccgtattctatacaagcgcgtggcgcggggtatttttaacgatattccaaacaatgagctagttgtccgtgtccagccagatgaggccatatacttgaaattcaacgctaaaacaccggggttggattcgaattcccaaattacggagcttgatttgacttactcgaagaggtatagggactactggattccggaggcttacgaatctctgttgcgggatgctttgctgggcgatcattcgaattttgtgagagacgatgagttggatatcagctggaagctgttcacccctctcttaaattaccttgagggcccagacagccctcggcctgaaatttataagtatggttctcgtgggcctgatggtctaaccaagtacttggagaagcatcagtatgtcttcgaaaagagcgggctttaccagtggcctgtctcgtccccaaaagaaaaagcaagtttggagccacggttatga

SEQ ID NO: 2684 - protein, 512 aa, Ashbya gossypii
MMCGEVTRTDAFEKDVIITVFGASGDLAKKKTFPALYGLYREGYLDDSTKIIGYARSELSDAELRERVKPYLSKPDDAASEAKQAEFLERMSYVAGPYDKEEGYVQLREQIEAYERERGVEKPHRLFYLALPPSAFVSVAEKIKQFLYAEGGVTRLIVEKPFGHDLESSRKLQKQLEPLFREEEIFRIDHYLGKEMVKNLLPLRFGNAFFNASWNKENIQMIQISLKEPFGTEGRGGYFDSTGIIRDVMQNHLLQVLTLLTMERPVSFDPESIRDEKVKVLKAIVPLDHEDILIGQYGRSEDGTKPAYLDDETVSKDSKCVTFAALTFNIQNERWDGVPIVMRAGKALNEGKVEIRILYKRVARGIFNDIPNNELVVRVQPDEAIYLKFNAKTPGLDSNSQITELDLTYSKRYRDYWIPEAYESLLRDALLGDHSNFVRDDELDISWKLFTPLLNYLEGPDSPRPEIYKYGSRGPDGLTKYLEKHQYVFEKSGLYQWPVSSPKEKASLEPRL

SEQ ID NO: 2685 - DNA, 1734 bp, Oryza sativa
  CDS (1)..(1734)
atggccggcaccggcttacgattccggcagggcgccatcttcttctcaggagctcatgctgctgctcatccaagaacaaggactcctcaccaccattgctcacctcagaggacgcacgatgcgagaggaaggtgccgcctcacggctaagtccgcaaatggacgcccacagatcagtgcctccttcagagatgtggcgatagatggggcacagtctgaagatggggcgccagagcagggaggatccaccgtcagcatcaccgtcgtcggcgcctccggcgatctcgccaagaagaagatctttcccgcgcttttcgccctgtactacgaggactgcctcccggagcattttacagtttttggttatgctcgtagcaagatgagcgatgaagagctcaggaacatgattagcttgactctgacatgccggattgatcagagggagaactgcagtgacaagatggaacagtttctgaagagatgcttttatcaatctgggcagtacaattcagaggaagggttttctgaactggacagaaagctaaaagaaaaggaggctggcaaggtaccaaacaggctcttttacctgtcgattccaccgaacatatttgtcgatgtggtgagatctgctagtcgcacagcatcatctcaagacggatggacaaggttcatagtggagaagccattcggccgcgattccgagtcgtcaggggagctcactcgaaacttgaagaagtacttggccgaggagcagatattcaggattgaccattatttggggaaggagctggttgagaacctctcggtgctccgtttctccaatctcgtcttcgagccactgtggtcgaggaactacatcaggaatgtgcagctcatattttctgaagatttcggcacggagggtcgaggcggctacttcgacaactacgggatcatcagggacataatgcagaaccacctgctgcagatcctggccctgttcgccatggagactccggtcagcctcgacgccgaggacatccgcaacgagaaggtgaaagtgctgaggtcgatgaggcagctgaggctggaggacgtggtggtgggtcagtacaaggggcacagcaagggcgggaagacgtacccggcgtacgtggacgacccgacggtgccgagcggcagcatcacgccgacgttcgccgccgccgccctcttcatcgacaacgcccgctgggacggcgtccccttcctcatgaaggccggcaaggccctgcacacgcgacgggcggagatcagggtgcagttccggcgggtgccggggaacctgtacgggcggcggagccggagcgtgggcggcggcgggacgacagcgacgagggagctggagaaggcgacgaacgagctggtgctgcgggtgcagcccgacgaggcgatctacctcaagatcaacagcaaggtgcccgggctggggatgaggctggacagcagcgacctcaacctgctctactccgagcgctaccccgccgagatccccgacgcctacgagcgcctgctgctcgacgccatcgagggcgagcgccgcctcttcatccgcagcgacgagctcgacgccgcctgggccatcttcacccccgtcctcgccgacctcgaggccaacaaggtggcacccgagctctacccgtacggcagccggggacccgtcggagcgcactacctcgccgccaaccacaacgtccgctggggtgacattagctag

SEQ ID NO: 2686 - protein, 577 aa, Oryza sativa
MAGTGLRFRQGAIFFSGAHAAAHPRTRTPHHHCSPQRTHDARGRCRLTAKSANGRPQISASFRDVAIDGAQSEDGAPEQGGSTVSITVVGASGDLAKKKIFPALFALYYEDCLPEHFTVFGYARSKMSDEELRNMISLTLTCRIDQRENCSDKMEQFLKRCFYQSGQYNSEEGFSELDRKLKEKEAGKVPNRLFYLSIPPNIFVDVVRSASRTASSQDGWTRFIVEKPFGRDSESSGELTRNLKKYLAEEQIFRIDHYLGKELVENLSVLRFSNLVFEPLWSRNYIRNVQLIFSEDFGTEGRGGYFDNYGIIRDIMQNHLLQILALFAMETPVSLDAEDIRNEKVKVLRSMRQLRLEDVVVGQYKGHSKGGKTYPAYVDDPTVPSGSITPTFAAAALFIDNARWDGVPFLMKAGKALHTRRAEIRVQFRRVPGNLYGRRSRSVGGGGTTATRELEKATNELVLRVQPDEAIYLKINSKVPGLGMRLDSSDLNLLYSERYPAEIPDAYERLLLDAIEGERRLFIRSDELDAAWAIFTPVLADLEANKVAPELYPYGSRGPVGAHYLAANHNVRWGDIS

SEQ ID NO: 2687 - DNA, 1467 bp, Gluconobacter oxydans
  CDS (1)..(1467)
atggaacatttccagcaggtcgagcctttcgactatgtcatcttcggtgccactggcgatctcacgatgcgcaagctgctgcccgcgctctacaaccgccttcggatgggccagattccggatgatgcgtgcatcatcggagccgcccgtacggagctggaccgggaggcctatgtcgcgcgggcccgagacgcccttgagcggtttcttccctcagacatcctgggcccggggctggtcgagcgtttcctcgcccgtctcgattacgtgacgctggacagcagccgcgagggcccgcagtgggacgccctgaagtccctgctggccaaggcacagcctgaccgggtgcgcgtctatatttcgcaaccgcaccgcagcttacggcagcatctgcgagacctgaaccgctacgagctgatcacccccacgtcgcgggttgttctcgaaaagccgatcggtacgaacatggccaccgccaccgccatcaatgacggggtcggccagtattttccggaaaagcagatctaccggatcgatcattatctcgggaaagagacggtccagaacgttctcgccctgcgttttgcaaacccgctcatgaacgctgcctggtccggcgagcatatcgagagcgtgcagatcacggcggtcgagaccgtgggcgtcgaaggtcgtgcggcctattacgacacgtctggcgcgcttcgcgacatgatccagaaccacctgctccaggtactgtgtctggttgcgatggaagcccccgattcccttgaggccgatgccgtccgcaacgccaaactggccgtcctgaacgccctgcgccccatcacggatgccacagccgccaccgagacggtgcgcgcgcagtacacggcaggcgtggtcgatggcgagaatgttccgggttatcttgaagagctcggcaagcccagcgcgacggaaacctatgccgcaatccgcgcctgggtggacacgccgcgctggaagaacgtgccgttctacatccgcacggccaagcggtccggcaagaaggtcagcgagatcgtcgtgacgttccgcccggctgcgaccaccatgttcggcgccaccccggccagcaacaggctggtcctgcgcatccagcccaacgaaggcgtggacctgcgtctgaacgtcaagaaccctgcgctggatgtcttcaacctgcggacggcggatcttgatacctccatccgcatggaaggcggcctgcccttcccggattcctatgagcggcttcttctggatgccgtgcggggtgatccggtactgttcatccgccgcgacgaggtcgaggccgcatggcgctgggtcgagcccatccttgaggcctggaaacatgacaaggcgcccatgcagacctacagtgcgggttcctatgggccggaacaggcaacacaactgctcgccagccatggcgacacctggcatgaagcgtcggagtaa

SEQ ID NO: 2688 - protein, 488 aa, Gluconobacter oxydans
MEHFQQVEPFDYVIFGATGDLTMRKLLPALYNRLRMGQIPDDACIIGAARTELDREAYVARARDALERFLPSDILGPGLVERFLARLDYVTLDSSREGPQWDALKSLLAKAQPDRVRVYISQPHRSLRQHLRDLNRYELITPTSRVVLEKPIGTNMATATAINDGVGQYFPEKQIYRIDHYLGKETVQNVLALRFANPLMNAAWSGEHIESVQITAVETVGVEGRAAYYDTSGALRDMIQNHLLQVLCLVAMEAPDSLEADAVRNAKLAVLNALRPITDATAATETVRAQYTAGVVDGENVPGYLEELGKPSATETYAAIRAWVDTPRWKNVPFYIRTAKRSGKKVSEIVVTFRPAATTMFGATPASNRLVLRIQPNEGVDLRLNVKNPALDVFNLRTADLDTSIRMEGGLPFPDSYERLLLDAVRGDPVLFIRRDEVEAAWRWVEPILEAWKHDKAPMQTYSAGSYGPEQATQLLASHGDTWHEASE

SEQ ID NO: 2689 - DNA, 1581 bp, Vibrio vulnificus
  CDS (1)..(1581)
atgtcactgatagggtgggctcatcctttaagccgtatccaggcacacaacaagtacctcgtttttaagggaaagatgatggtaataccagaaaacagcagcatcgtaatttttggtgcttcaggtgatttaacatatcgcaagttgatccctgctttataccacctctacgcaagtaagcagctaccagaaaactttgctattttaggtgtcagccgcactgaatacagcgatgaatcttatcgcgaaaagttaaagcgctctcttcaggaaatggagaaaacggaaccagctattctggattcatttatcgaccatcttcactatcaagccatcaacacgtcagacacacaagactacgcgaagttggttgtacgtttagacgaattggccgctcaataccagttcgaacaacgtaatacactgttttatcttgccacaccgccaagcctttacagtgtcattccttcaagccttgctcatcacggtcttaacagtgaagaggatggttggaaacggctgatcattgaaaaaccgtttggttatgatttggcttcggcacgtcagctcgacaaagaaatacacgattgcttccaagagcatcagatctatcgcatcgaccactaccttggaaaagagaccgtgcaaaacttacttgttttccgtttctctaacgccatgtttgaacctctgtggaaccgcaacttcattgattatgtggaaatcacaggtgccgaattccttggcgtggaagagcgtggcggttattacgacggctccggcgctgtgcgcgatatgttccaaaaccatctactgcaagtattggcaatggtgggcatggaaccgcctgcacaaattaatgccgattccatgcgtgatgaagtagtgaaagttctgcagtgtttaaaaccgcttgaggaagatgatctgcgtaacaacctagttttgggtcaatacacagcatcagacgtgcgcggacaacatctgcttggctaccgtgaagaaaacggcgtagcggacgattctcgtactgagacttacattggtcttaaagcgtacatcaataactggcgttggaatggcgtgccattctacgtgcgcacgggtaagcgtcttccaactcgcgtaacagaagtggttatccacttcaaacaaacaccgcatccggtatttggccaaaacgccccagaaaacaaactgatcattcgtattcagcctgatgaaggcattcaaatgagcttcggtttgaaagaacctggtgcaggctttaaagcgaaagaagtgaagatgaacttccattatgcttcgttgcaagagacgcaaatgctgaccgcctatgagcgtctgcttcttgatgcgttaaacggcgatgcaacgctgtttgctcgcagcgatgcggtcgaagcgtgttggaaatacgttcaacctatcctcgatttcaaacaagatccacaagcactctttggttatgcctgcggcacttgggggccaaaagagtcagacgatttgctgcagcgtgacgatcgcgcgtggcgtttcccatgcaaaaacctaacagatacggactactgcgaactatga

SEQ ID NO: 2690 - protein, 526 aa, Vibrio vulnificus
MSLIGWAHPLSRIQAHNKYLVFKGKMMVIPENSSIVIFGASGDLTYRKLIPALYHLYASKQLPENFAILGVSRTEYSDESYREKLKRSLQEMEKTEPAILDSFIDHLHYQAINTSDTQDYAKLVVRLDELAAQYQFEQRNTLFYLATPPSLYSVIPSSLAHHGLNSEEDGWKRLIIEKPFGYDLASARQLDKEIHDCFQEHQIYRIDHYLGKETVQNLLVFRFSNAMFEPLWNRNFIDYVEITGAEFLGVEERGGYYDGSGAVRDMFQNHLLQVLAMVGMEPPAQINADSMRDEVVKVLQCLKPLEEDDLRNNLVLGQYTASDVRGQHLLGYREENGVADDSRTETYIGLKAYINNWRWNGVPFYVRTGKRLPTRVTEVVIHFKQTPHPVFGQNAPENKLIIRIQPDEGIQMSFGLKEPGAGFKAKEVKMNFHYASLQETQMLTAYERLLLDALNGDATLFARSDAVEACWKYVQPILDFKQDPQALFGYACGTWGPKESDDLLQRDDRAWRFPCKNLTDTDYCEL

SEQ ID NO: 2691 - DNA, 1476 bp, Photorhabdus luminescens
  CDS (1)..(1476)
atggcggttacttctacagctcaggcttgtgatttagtcatttttggcgctaaaggggatttggcacgccggaaattattgccttccctttatcagcttgagaaagcgggttatatccacccagaaacccggattatcggtgttggccgggctgattgggataaaaaagcttataccaaggttgttgaagaagctttaaatacattcttgccagaaaaattagattcagaattatggaagatattgagtgagcgtttggcgttctgcaatctggatgttaatcaaaaagaagactttgccaaattgaaggcaattcttaagcaggataatcggcctgcaatccattattttgcgatgccacccagtacttttggttcggtttgtcacggattgggccttgcagggctaaataaagagccaaatcgagttgtgatggaaaagcctttagggaccgatcttgaatcatccaaagccatcaatgatgaagtagctaaatatttcaatgagcgtcaggtttatcgcatcgatcattatctgggtaaagaaaccgtattgaatctgttggcgctgcggtttgccaattccttgtttgtgaataattgggataaccggacaattgatcatgtacaaattacagtagctgaagaagtcggtattgaaggccgttggggttattttgaccaagctgggcagatgcgcgatatgattcagaatcacctgttgcaaatattgaccatgattgctatgtctcctccggcagatctgacgacagaccgtatccgtgatgaaaaagtaaaagtattgcgttctctgcgctgtattgatcatacgaatgtgcgggagaagacggtacgaggtcaatacactgctggttttgttcaggggcataaggtaccggggtatctggaagaagagggggcaaaccagtccagccggacggaaacttttgtctctatccgtgtcgatattgatgactggcgttgggccggggttcctttctacctgagaaccggtaaacgtctgccaacgaaatgttccgaggtggtagtttatttcaaaaagcctgcactgaacttgttttctgagtcttatcaacaactaccgcagaataagctaacgattcgtttgcagccggatgaaggtattgatattgaagtgctgaacaaagctccggggctggaacacaagcatcgtctgcaaaccactaagctagatctgagtttctctgaaacgtttaaccatattccgttggcggatgcttatgagaggttactgctggaggctatgcggggtattcaggcgctatttgttcgtcgtgatgaagtggaagaagcgtggaaatgggttgattctattatgaatgcatgggcggcggataatgatgcgcctaagccttatcaggcggggacgtgggggccggtcgcttctgttgcgatgatcactcgcgatggtcgttcgtggaatgagtttgagtaa

SEQ ID NO: 2692 - protein, 491 aa, Photorhabdus luminescens
MAVTSTAQACDLVIFGAKGDLARRKLLPSLYQLEKAGYIHPETRIIGVGRADWDKKAYTKVVEEALNTFLPEKLDSELWKILSERLAFCNLDVNQKEDFAKLKAILKQDNRPAIHYFAMPPSTFGSVCHGLGLAGLNKEPNRVVMEKPLGTDLESSKAINDEVAKYFNERQVYRIDHYLGKETVLNLLALRFANSLFVNNWDNRTIDHVQITVAEEVGIEGRWGYFDQAGQMRDMIQNHLLQILTMIAMSPPADLTTDRIRDEKVKVLRSLRCIDHTNVREKTVRGQYTAGFVQGHKVPGYLEEEGANQSSRTETFVSIRVDIDDWRWAGVPFYLRTGKRLPTKCSEVVVYFKKPALNLFSESYQQLPQNKLTIRLQPDEGIDIEVLNKAPGLEHKHRLQTTKLDLSFSETFNHIPLADAYERLLLEAMRGIQALFVRRDEVEEAWKWVDSIMNAWAADNDAPKPYQAGTWGPVASVAMITRDGRSWNEFE

SEQ ID NO: 2693 - DNA, 1539 bp, Gloeobacter violaceus
  CDS (1)..(1539)
atgaccgcatcgttgactggaggattgagcgccaatccgttgcgccaggggctgcgcctggagcgcacgcccaagcctgccattttgactatcttcggggcctccggagatttgaccgtccgcaagctgatcccagccctttacgacctggcccgcgaccggcgattgccccctgaattcacggtcgtgggctatgcccgtcgcccctacagccacgaagaatttcgcgaaatgatgaaggaaggggtagccaagtattcgcgcagcaagctgggcaacctctgggaaagtttctccaagggcatctattacttccagggggacctcgacaatctccagaattttaaggacctcggcgaatttttgcagactctagatagcgagcgcggcaccctcggcaaccgggccttctacatggctaccgccccgagtttctttgcgcccatcatcgagaatctgggcggagcgggcctggcgggcgacgtgcgcaacacgcgcctggtgatcgaaaaacccttcggccacgacctggagtcggctcaaaatctcaacaaagtcgtccagcaagtctttcacgaaaagcaggtctaccgcatcgatcactacctgggcaaagagaccgttcagaatatcctggtcttccgctttgccaattcgatctgggaaccgctctggaacaaccgctacgtcgatcacgtgcagatcacggtagcagagacggtgggggtcgaaaaccgcgggccgtactacgacgaagccggcggcgcgctgcgcgacatgatccagaatcacctggtacagctgttggctctcaccgccatggagccgccctccgccttcgaggccgacaccgtgcgcgacgaaaaagtgaaagtcctgcgcgccacccaggtcggccaggggccgaacggccttgcggcagtccgcgcccagtacgccaacggctggatttcaggcgaaccggtgcacgcctaccgcgacgaaccccgggtcaaccccgacgttcagactgcgagctatattgccgccaaattcatgatcaacaattggcgctggaagggcgtgccgtttttgctgcgcaccggcaaacgcctcgccaagcgcgtcaccgaaattgccctgcaatttcgggaagtgccgcacctgctctttccgtcgagcagcgcgggccagctcagcccgaacatgctggtgctgcgcatccaaccggacgaaggcatttcgctgcgcttcgaggccaagcggccggtggccgacatcgccatgcgctcggtgaacatggactttcactacggcggcaccttcgaggtcgcctcgcccgaagcctacgagcggttgctgctcgattttctgctcggggatcagacgctgtttacccgcgcggacgaagtcgaggcggcctggaagatcgtcacaccgctcatcgagcgctgggaaatccagaaagccggcgatctcaattactacgacgccggttcctgggggccgagtgccgcgagtaagctgatggacaacggccgccgctggcggcgcctatag

SEQ ID NO: 2694 - protein, 512 aa, Gloeobacter violaceus
MTASLTGGLSANPLRQGLRLERTPKPAILTIFGASGDLTVRKLIPALYDLARDRRLPPEFTVVGYARRPYSHEEFREMMKEGVAKYSRSKLGNLWESFSKGIYYFQGDLDNLQNFKDLGEFLQTLDSERGTLGNRAFYMATAPSFFAPIIENLGGAGLAGDVRNTRLVIEKPFGHDLESAQNLNKVVQQVFHEKQVYRIDHYLGKETVQNILVFRFANSIWEPLWNNRYVDHVQITVAETVGVENRGPYYDEAGGALRDMIQNHLVQLLALTAMEPPSAFEADTVRDEKVKVLRATQVGQGPNGLAAVRAQYANGWISGEPVHAYRDEPRVNPDVQTASYIAAKFMINNWRWKGVPFLLRTGKRLAKRVTEIALQFREVPHLLFPSSSAGQLSPNMLVLRIQPDEGISLRFEAKRPVADIAMRSVNMDFHYGGTFEVASPEAYERLLLDFLLGDQTLFTRADEVEAAWKIVTPLIERWEIQKAGDLNYYDAGSWGPSAASKLMDNGRRWRRL

SEQ ID NO: 2695 - DNA, 1539 bp, Gloeobacter violaceus
  CDS (1)..(1539)
atggcaaccgattcgacgacgcccttcccaatcgccccaccggctggaccctgcgcgatggtcgtcttcggggcggctggagatcttaccggtcggctactggtgccggcgctctataacctggccgcgggcgggctattaggtgaaaaatttgtcttgatcgggctggcccgcgccccgctcaccgacacgaattttcggacacaactgggcgaggcgctgcagcgccatggcactgctgcagtcaatccggccgtctgggatgcccttgcgcagcgatttttttatctggaagccaacttcgaagctcccgatacctacgcccgcctgcggcagcggctggccgaggcggaagccgaattcaacacggacggcaacacgctattttatctggcgaccgcccctgagcacttcggcggcattgtcgagcagttgggctgggctgggctgtcccgcgaggagaccggtcactggcgacgcgtcgtcctcgaaaaacccttcggtcaggatctcgcctccgcccaagccctcaacgcccgcctccggcgcgacctctccgaaagccaggtctaccgcatcgatcactacctgggcaaagaaaccgtccagaacatcctggtcctgcgcttcgccaacggcctgttcgagcccctctggaaccgcaaccacatcgaccacgtgcagatcaccgtcgccgagagcgtcggggtcgaaaagcggggcggttactacgagcgggccggggcgctcagggacatggtgcccaaccatcttttccagttgctggccctcaccgcgatggagccgcccacctgcttcggggccgacgccgtgcgcaccgaaaagaccaagctgctggaagccgtccagaccctcaagcccgcccagatctccacccacgtcgtgcgcgctcagtacgccgcgggtacggtcggggagcgggcactgccggactaccgcgccgagccgcgggtggcgccggattcgaccaccgagacgttcgtcgccctcaaactcgccgtcgacaactggcggtgggcgggggtgcccttttatctgcgcaccggcaaggccctggccaggcgcagcaccgagatcgccatccgcttcaagcaggcgccctacgcgatgtttcgcgacacgccggtggagcgcctcacacccaactatctggtgctccacatccagccggaggagcgcatcagcctcgaattcggcgccaaagtgccgggaccggcggtgcgcatggccggcgtcggcatggacttttgctacaatcgccacttcggcggcgagcgggcgatcggctatgaaacgttgctctacgactgcatgatgggcgatgctaccctgtttcagcgctcggatacggtggaggcggcctggcaggtcgtcgaaccgatctttgctgcctggaacgattcaactgccgacctggtcacctatccggccggcagttggggtccgcagcaggcggaggagttgctcgggcgcgacggtcggcagtggcggagagcggaccatgattcttgcgggtga

SEQ ID NO: 2696 - protein, 512 aa, Gloeobacter violaceus
MATDSTTPFPIAPPAGPCAMVVFGAAGDLTGRLLVPALYNLAAGGLLGEKFVLIGLARAPLTDTNFRTQLGEALQRHGTAAVNPAVWDALAQRFFYLEANFEAPDTYARLRQRLAEAEAEFNTDGNTLFYLATAPEHFGGIVEQLGWAGLSREETGHWRRVVLEKPFGQDLASAQALNARLRRDLSESQVYRIDHYLGKETVQNILVLRFANGLFEPLWNRNHIDHVQITVAESVGVEKRGGYYERAGALRDMVPNHLFQLLALTAMEPPTCFGADAVRTEKTKLLEAVQTLKPAQISTHVVRAQYAAGTVGERALPDYRAEPRVAPDSTTETFVALKLAVDNWRWAGVPFYLRTGKALARRSTEIAIRFKQAPYAMFRDTPVERLTPNYLVLHIQPEERISLEFGAKVPGPAVRMAGVGMDFCYNRHFGGERAIGYETLLYDCMMGDATLFQRSDTVEAAWQVVEPIFAAWNDSTADLVTYPAGSWGPQQAEELLGRDGRQWRRADHDSCG

SEQ ID NO: 2697 - DNA, 1479 bp, Chromobacterium violaceum
  CDS (1)..(1479)
atggagactcgttctacccctaccccggccttcgacatggtgctgttcggcggcgccggcgacctggtgatgcgcaagctgctgccttcattgtaccaggcgcataacgccggcctgctcaacgaacagggccgcatcctggcgctgggccgcaaggacctgagccgcgacgactacctggcttccgtcgaaaagcagtcccgcatccatatcaagtcccacttcgacgatgccgcctggcagagcttctgtagccgcatcgactacctgcgcgtcgacgcctcccaggccgccgactacccggcgctggccgagaaggtcggcgacgacgccggcaaggtggtggtgtgctaccttgccaccgcgcccaatctgttcgccggcatctgcgaaaacctggccgcggtcggcctgaaccgccccaatgtgcgggtggtgctggaaaagccgctgggcaccgacctcgactcgtccaacgagatcaacgacgacgtcgcccgcttcttcaaggaagagcagctgtaccggatcgaccactacctgggcaaggagtcggtgcagaacctgatggccatccgcttcgccaacgcgctgttcgagccgctgtggcgccgcgaatggatacacgacgtgcagatcaccatttcggaagaactgggcgtcggcagccgcggcgatttctacgacggcaccggcgcgctcagggacatggtgcagaaccacctgctgcagctgctgtgcatcgtggcgatggagccgccggccaacctggaagccgacgccgtccgcgacgagaagctgaaggtgctgaaggcgctgcgcccgttcaccgagcacgatgtcgccgccaagaccgtgcgcggccagtacaaggccggcgccagcggcggccagccggtggtcggctaccaggacgaggccggcattcccgccggcagccagaccgagaccttcgtcgccatcaaggccgagatcgacaactggcgctgggccggcgtgcccttcttcctgcgcaccggcaagcggatgcaggaacgcctggccgagatcgtcatcaacttccgcgatgtgccgcaccaggtgttcaccggcccgctgggcggcagccaccacgccaaccggctggtgatccgcctgcagcccgaggaaagcatccgcctgtacttcctggccaaggagccgggcgacaccatgcgcctgcagccggcctacctggacctggacttctacaaggcgttcaaggtgcgccgcgccgacgcctacgagcgcctgctcttggacgtgatccgcggcaagctggcgctgttcatgcgccgcgacgagctgatcgaggcctggcgctgggtcgagcccatcatggacacctgggccgccagcaccaacaacccgcccaagcaatacaccgccggcagctggggcccggccgcgtccagcgcgctgctgtcgcgcgacggcatcagctggcacgaggagtgttaa

SEQ ID NO: 2698 - protein, 492 aa, Chromobacterium violaceum
METRSTPTPAFDMVLFGGAGDLVMRKLLPSLYQAHNAGLLNEQGRILALGRKDLSRDDYLASVEKQSRIHIKSHFDDAAWQSFCSRIDYLRVDASQAADYPALAEKVGDDAGKVVVCYLATAPNLFAGICENLAAVGLNRPNVRVVLEKPLGTDLDSSNEINDDVARFFKEEQLYRIDHYLGKESVQNLMAIRFANALFEPLWRREWIHDVQITISEELGVGSRGDFYDGTGALRDMVQNHLLQLLCIVAMEPPANLEADAVRDEKLKVLKALRPFTEHDVAAKTVRGQYKAGASGGQPVVGYQDEAGIPAGSQTETFVAIKAEIDNWRWAGVPFFLRTGKRMQERLAEIVINFRDVPHQVFTGPLGGSHHANRLVIRLQPEESIRLYFLAKEPGDTMRLQPAYLDLDFYKAFKVRRADAYERLLLDVIRGKLALFMRRDELIEAWRWVEPIMDTWAASTNNPPKQYTAGSWGPAASSALLSRDGISWHEEC

SEQ ID NO: 2699 - DNA, 2229 bp, Giardia lamblia ATCC 50803
  CDS (1)..(2229)
atgttcaagccttcctgcgtcttcgtcatcatgggggcatcaggggatcttacttataagaagcttatccctgccatctacagccttgcctcggacggctaccttcacaaggacacttgcatccttggcgttgcacgctcagacattaagctggacgcctttcatagtcgtattaaggacggtatagataagtattcacgccatgggacaggccctgggtctgctacaaatcgagaaccctggagcacctttgtgaagagactcaactaccatcgcataaacaacatggaggcactgagtgactataaggcgctagcggagattgtactctgtaaggagccgtataaggaccttgagcgcgttgtcatttatcttgccctcccgcctggcgctttctatgccgcagtcaccaacttgggggagtcgggtctcaataacaggaagtgtacaatagtagtggagaagcccctcgggtcagatctccacacagccatggaactcgaaaagttgctccacagccagttcaaagaagaccagatagcccgcattgaccattatctggggaagatgcaagcactcaatatgatgggcttccgattctccaacgcgtttgttgagccaatctggaatgacaagtacatagatcgcatcatcatcactgcctctgaggagatagatgttaatgggcggatcagctactacgacgccaacggcatcattattgatatggttcaatcccaccttcttcagcttcttgcccttacgaccatggaagcccccatagacatgaccgcagatggcatacgcaacgaaaaggtgaagcttctgaagtccgttgaccccattcgtgtcgagaatgtcctgacagcccagtacgacgggtacctcaaacacgagggcgttccggagggctctcttgctccaacagctgtctgtcttagggtgtccatcaacaatgcacgctggaaaaggacgcagttcatcatccagacatgcaagtgtggggctacgcgcgagacccgaattgatgctgtcatgcgtccttcggggtcgcgcattctcaatactgttagcatggttccggatcctaacattttctcgttcctcgtgcaccccaccgaagggattcagatcagtttcgaaaccatggtgccatcaatatcttcttccactcttgcgtgcgacaacagtggatgcatcgaacgggagccgggtccgtttttgaccaagcccgtgacgctggactttgactaccagaagtcgcatatcatcacccaatcagcatatgagcgtctgctacaagaggcggttgcaggggatctatccaactttacacgtactgatgaggtagttgcccagtggaagatcgtagcaaacatattggataacagcaggaacaagcccatcatatacgctaagggccttcgtcttcttcatcccatctgcctcgacacttggaactacggaaaggagtacatacgtcgcttagcatacggccattgcaggttgcgtgttgcttgggaaatcactgccacggcaatactcgcgtgcgagaccgtcagtaataaggtcattcactccgtcgcactgtgggctgagacccacacgctgaataatagctttgacataattctcgccggtggcaccacccccaagcattgctatgaacacatgagccgccatctgatcaagcacttaccactggaggtgcggaagcgcatattcatctggctttcagatgagcgtgaggatacgtgtgccaggaacaacgggaaaatgatcaaggagtgctttaaggacagcggagttgttatcaatgaaatctatgatggaagcaagagctttgagaccagcatccgagagtactcaaagaaactcgaaggagtagaggtctttagggcagcaattctggggataggcacagatggccacatatgctcactcttcccaggttgtcttcccactctcaccagcagagaagatcagtgcatcatggttgaagtccctcagctgggagagcggcgagcaaccatcactcctctggtcatacaaagaattgcagacgttatcatccttgccactggagaagataagaccacagcattgactcgacttgcctacgcgcctttccagccggccttcattcctgcacagttggccactgcacagtctagcacaactgtggtctgtgatcacaccgcgcgttcatctaggccagtgttcaattaa

SEQ ID NO: 2700 - protein, 742 aa, Giardia lamblia ATCC 50803
MFKPSCVFVIMGASGDLTYKKLIPAIYSLASDGYLHKDTCILGVARSDIKLDAFHSRIKDGIDKYSRHGTGPGSATNREPWSTFVKRLNYHRINNMEALSDYKALAEIVLCKEPYKDLERVVIYLALPPGAFYAAVTNLGESGLNNRKCTIVVEKPLGSDLHTAMELEKLLHSQFKEDQIARIDHYLGKMQALNMMGFRFSNAFVEPIWNDKYIDRIIITASEEIDVNGRISYYDANGIIIDMVQSHLLQLLALTTMEAPIDMTADGIRNEKVKLLKSVDPIRVENVLTAQYDGYLKHEGVPEGSLAPTAVCLRVSINNARWKRTQFIIQTCKCGATRETRIDAVMRPSGSRILNTVSMVPDPNIFSFLVHPTEGIQISFETMVPSISSSTLACDNSGCIEREPGPFLTKPVTLDFDYQKSHIITQSAYERLLQEAVAGDLSNFTRTDEVVAQWKIVANILDNSRNKPIIYAKGLRLLHPICLDTWNYGKEYIRRLAYGHCRLRVAWEITATAILACETVSNKVIHSVALWAETHTLNNSFDIILAGGTTPKHCYEHMSRHLIKHLPLEVRKRIFIWLSDEREDTCARNNGKMIKECFKDSGVVINEIYDGSKSFETSIREYSKKLEGVEVFRAAILGIGTDGHICSLFPGCLPTLTSREDQCIMVEVPQLGERRATITPLVIQRIADVIILATGEDKTTALTRLAYAPFQPAFIPAQLATAQSSTTVVCDHTARSSRPVFN

SEQ ID NO: 2701 - DNA, 2850 bp, Plasmodium yoelii yoelii
  CDS (1)..(2850)
atggagtacgagacatttttaaaatgcttagatgaaataaggtgtgtgaacaatgtgaaatatatggagaccgaagatttaacagactttaataaaaaatcggcatattatatttgtaaagaaatatatgagaaacaattaagtaatgaaaatgggtatgtagttataggtttatcaggtggaaaaacacctatagatgtttataaaaatatgtgtgcaataaaagatataaaaattgataaaaataagttaattttttttataattgatgaaaggtataaaaatgatgatcataaattcagtaattataataatataaaatttttatttgatgaattaaatattaataaagaaacccaattatataagcccgatacaaaaaaagatcttgttagttgtataagagattataatgaacaaattaaaagcatgctagaaaaatataaaaaaatagatattgcaatattaggtatggggagtgatttccatatagctagtttatttccaaatgtgtattataatatatacatgaataattatcaaaataattatatatatgaagacaatgaaacaataaggtcattaaatgccgacaataatgttaatttaagtttactaaatgagcatgtatattttacaacaacaaataattttgatgtgagaaaaagaattacagtatcacttaacctattgtcaaattcaacaagtaaaatatttttattaaatacagcagataaattaaatttatggaaaaatatgctcttaaatttttatgttaatcctaactataatttatatccagcatttaaggtgatcgactctagaaatacaacagtcatagcatgtggtcataaaaattattcaaaaatgttagaagatttatatgttcaaaaagattgtgcactttctccggtcagcaataataatgtagagaataaaaatgagttactaacaatagttatatttggttgctctggtgatttagcaaaaaaaaaaatatacccagccttgtttaaattattttgtaataatttattaccaaaaaatataataataatcggttttgcaagaacagaacaagattttgaatcattttttaacaaaatatctatatatttaaaaatatctttaaacagttataaaaatttatcagtttttgaaaaagccgaacgcttaaattcttttaaaagcaaatgtagatattttattggaaactatttatctacggaaagttttgaaaattttgatgtatatataactcaggaagagaggatagcattaggctgttttggtcagaaaggtaatgaaaaacataaacaagttaattccacttcacaattccctaataatcatactaacacaaatgttaccaacaatatagataacggatgtgagccaccaatgcctaatgattctcccaaaagatgcccctacagttcaagttattccaatacatctggtaacgctacatgtcctcacagttcacaccattctgttaagcctagtaatactggatgcccatacctttcgagccaagctaatacatctgataattctggctgtccatacatttcacaccatattaataaatctggtaattcgggttgtccttatactatcactagaatgctttacttagccttaccaccccatatctttgtaagtacattacaaaattataaaaagtattgcttaaataaaaacagaatcaccaagatattacttgaaaagccatttggaaaagatttggaatcatttaaaatattatcgaaacaaatattagaagcttttcctgaaaaaaacatatatagaattgatcattatttaggaaaagatatggtttcaggattattaaaactaaaatttacaaatacatttttgttatctttaatgaacagacattttataaaatgcataaaaataacattaaaagaaacaaagggagtatatggaagaggacagtatttcgatccatatggaattataagagatgttatgcaaaatcacatgctacaattactgacattaataactatggaacatccaactgatttagatgataaatccatacaaaatgaaaaaataaaaatattaaaatctatagcttcaataaaattagaagacaccgttataggacaatatattaaatcaaataatgatgatacaaataataataattcaaatatttctgaaaatgccaatatagataaatctaaaataaatcatagttatcatgatgatccacatgtagatccaaattcaataacccctacattttgtacatgtgttttatatattaattcaataaattggcatggtgtcccaataatacttaaagcaggaaagggactaaataatgatatatgtgaaattaaaattcaatttcataatattatgggctcatctgacgaaagtatgtataataatgaatttgtaattattttacaacctgtagaaggaatatatctaaaacttatgataaaaaaaatgggttctgaagaaatggaagaagtacaattgaatttaagccttaatgaaaataataataaagcatatgttccagaagcttatgaaactttattatcagaatgctataaaggatataagagaaaatttatctcagatgaagaattatatgaatcttggagaatattcacccctctattaaatgagttacaagaaaagcatgtcaagcctctatcttacccatttgggtcatcagggccccaagaagcttatgaccttgtaagaaaatattacaattatggaaaaaactatgacacaactgctaaattttgcagaaaatcttcctactatgatgatagcttgtttgataatatgagagaataa

SEQ ID NO: 2702 - protein, 949 aa, Plasmodium yoelii yoelii
MEYETFLKCLDEIRCVNNVKYMETEDLTDFNKKSAYYICKEIYEKQLSNENGYVVIGLSGGKTPIDVYKNMCAIKDIKIDKNKLIFFIIDERYKNDDHKFSNYNNIKFLFDELNINKETQLYKPDTKKDLVSCIRDYNEQIKSMLEKYKKIDIAILGMGSDFHIASLFPNVYYNIYMNNYQNNYIYEDNETIRSLNADNNVNLSLLNEHVYFTTTNNFDVRKRITVSLNLLSNSTSKIFLLNTADKLNLWKNMLLNFYVNPNYNLYPAFKVIDSRNTTVIACGHKNYSKMLEDLYVQKDCALSPVSNNNVENKNELLTIVIFGCSGDLAKKKIYPALFKLFCNNLLPKNIIIIGFARTEQDFESFFNKISIYLKISLNSYKNLSVFEKAERLNSFKSKCRYFIGNYLSTESFENFDVYITQEERIALGCFGQKGNEKHKQVNSTSQFPNNHTNTNVTNNIDNGCEPPMPNDSPKRCPYSSSYSNTSGNATCPHSSHHSVKPSNTGCPYLSSQANTSDNSGCPYISHHINKSGNSGCPYTITRMLYLALPPHIFVSTLQNYKKYCLNKNRITKILLEKPFGKDLESFKILSKQILEAFPEKNIYRIDHYLGKDMVSGLLKLKFTNTFLLSLMNRHFIKCIKITLKETKGVYGRGQYFDPYGIIRDVMQNHMLQLLTLITMEHPTDLDDKSIQNEKIKILKSIASIKLEDTVIGQYIKSNNDDTNNNNSNISENANIDKSKINHSYHDDPHVDPNSITPTFCTCVLYINSINWHGVPIILKAGKGLNNDICEIKIQFHNIMGSSDESMYNNEFVIILQPVEGIYLKLMIKKMGSEEMEEVQLNLSLNENNNKAYVPEAYETLLSECYKGYKRKFISDEELYESWRIFTPLLNELQEKHVKPLSYPFGSSGPQEAYDLVRKYYNYGKNYDTTAKFCRKSSYYDDSLFDNMRE

SEQ ID NO: 2703 - DNA, 1476 bp, Neurospora crassa
  CDS (1)..(1476)
atggagcagctcaaggacaacaccgtcatcgttgtccttggcgcctctggcgatctcgctaagaagaagacctaccgcaaccaatttttgcccaaggacatccggattgtgggctatgccagaactaaaatggaccacgacgagtacatccgccgcatcaagtcgtacatcaagactcccacgaaggagagcgagcagcagcttgaggagttctgctccatctgcacatacgtttccggccagtacgatcgcgacgactccttcctgcagctcaacaagcatttggaggaactggagcaaggaaggaaagagaacaaccgactcttctacatggctctgcctcccagcgttttcaccattgtttcacagcatctcaagaagtgttgctacccctccaggggcgttgcccgtgttattgtcgagaaaccctttggcaaggacttggcaagctctcgagaactgcagaagtctcttgagcccgactggaaggaagaggagatcttccgtatcgaccattatctaggcaaggagatggtgaagaacattctcattctgcgtttcggcaactccttccttggcgctacctggaacaggcatcacatcgacaacgtccaaattacattcaaggaacccttcggcaccgagggccgtggtggctacttcgacgagttcggcatcatccgcgatgtgatgcagaaccatctgttgcaggtccttacgttgcttgccatggaacgccccatctctttctccgctgaagatatccgtgatgagaaggtgcgggtcctccgcgccattccggcaatcgagcccaagaatgtcatcattggacagtacggcaagtcgcttgacggaagcaagcctgcttacaaggaagacgatacggtccccaaggattcccgctgccccactttctgtgcgctagttgcgtacatcaagaacgagcgttgggatggtgtacctttcatcatgaaggcaggcaaggccttgaacgagcagaagaccgagatccgcgtgcagttcaaggacgtcacatcgggcattttcaaggacattcctcgcaacgaactcgttatgcgcattcagcccaacgaaagtgtctacatcaagatgaactctaagcttcccggcctgagcatgcagactgttgtcaccgagcttgacctcacctacaggagacgcttctccgacctcaagatccccgaagcttacgagtcccttattctcgactgcttgaagggtgaccattccaactttgtccgtgacgatgagctcgatgccagctggagaatctttacccctttgctccactatctcgatgataataaggaaatcatcccgatggagtatccttatggttctcgcggcccggctgttttggatgactttacggcttcgtacgggtacaaattcagcgatgctgcgggctaccagtggcccacaacctccgccatggggtcgggcatgaagttgtag

SEQ ID NO: 2704 - protein, 491 aa, Neurospora crassa
MEQLKDNTVIVVLGASGDLAKKKTYRNQFLPKDIRIVGYARTKMDHDEYIRRIKSYIKTPTKESEQQLEEFCSICTYVSGQYDRDDSFLQLNKHLEELEQGRKENNRLFYMALPPSVFTIVSQHLKKCCYPSRGVARVIVEKPFGKDLASSRELQKSLEPDWKEEEIFRIDHYLGKEMVKNILILRFGNSFLGATWNRHHIDNVQITFKEPFGTEGRGGYFDEFGIIRDVMQNHLLQVLTLLAMERPISFSAEDIRDEKVRVLRAIPAIEPKNVIIGQYGKSLDGSKPAYKEDDTVPKDSRCPTFCALVAYIKNERWDGVPFIMKAGKALNEQKTEIRVQFKDVTSGIFKDIPRNELVMRIQPNESVYIKMNSKLPGLSMQTVVTELDLTYRRRFSDLKIPEAYESLILDCLKGDHSNFVRDDELDASWRIFTPLLHYLDDNKEIIPMEYPYGSRGPAVLDDFTASYGYKFSDAAGYQWPTTSAMGSGMKL

SEQ ID NO: 2705 - DNA, 1524 bp, Synechococcus sp
  CDS (1)..(1524)
atggtcgccaccgccaccaatcccctgcgggtcggtctccgacaggaacgggtcatcgcaccgcaatgtctggtaattttcggcgccagtggtgacctgacccaccgcaagctggtccccgcgctgttcgaactgttcaagcagaggcgacttcccagtgaattcgcccttctcggctgcgcccgccggccctggagcgacgacgagtttcgcggaaaaatggccgaggccctggccagcaagatcgccgagaaccaggaagcctgggatcagttcgtctcgaagttgttctacgaacccgtcgatctgcagcaaccggaggatgtggttcgcctggggaaacgcctggaaaccgttgatcaacagtgcgccacccgcggcaaccgcaccttctatctctcggtgtcaccgaagttctacggcagtggctgtcgcgcgctagcggatgccggtctgctgaaggatcctcaacgcagccgcgtggtgatcgagaagcctttcggtcgtgactacggcagcgctcaagccctgaaccgtgttgtaaaaagctgcgggcaagagaatcagatcttcaggatcgaccattacctaggcaaggaaacggtccagaacatcatggtgctgcgctttgccaacaccattttcgaaccgatctggaaccggaactacatctccagtgttcagatcactgccgccgagaccgttggagtcgaggagcgggccgggtattacgagacctccggtgccctgcgggacatggtgcagaaccacctgacccagatgctggccatcacagccatggaaccgccaggtcgctttgacccggaggcgatccgcaacgaaaaggccaaggtgttgcaagcggcacgactggctgacgagcaggagccatggaactgctgcatccgcggtcagtacggccccggcggcagccatgacgctcccctggccggataccgccaggaacccggcgtcgatcccaacagcaccacggagacctacgtcgccatgaagctgttcgtcgacaactggcgttggcagggggtccccttctacgtccgcacaggcaagcggctggccaaacgcctcagcgaggtggtgctcaccttccgcgaagcaccagtgcatctcttcgatgcagccaccggcggccccacggccaaccagttgattctgcgcatccagcccgacgaaggggcggaattccgcttcgaagtgaaatcccccgggtccggcatgcgcagccgtccgatcgacatggagttctcctacgacgagtccttcggggagccctccgatgagggctatgtccgcctgctggcggacgccatgctcagcgatccgaccctgttcacccgcagtgacgaggtggaagcggcctggcgtctgtacaccccgctgctggagctgatcgaagacagcccttggcagctgccgatccatccctacgaatcccgcacctggggacctgccgccgctgatgccctgctggcccgtgacggactgctctggcgtcgtccctga

SEQ ID NO: 2706 - protein, 507 aa, Synechococcus sp
MVATATNPLRVGLRQERVIAPQCLVIFGASGDLTHRKLVPALFELFKQRRLPSEFALLGCARRPWSDDEFRGKMAEALASKIAENQEAWDQFVSKLFYEPVDLQQPEDVVRLGKRLETVDQQCATRGNRTFYLSVSPKFYGSGCRALADAGLLKDPQRSRVVIEKPFGRDYGSAQALNRVVKSCGQENQIFRIDHYLGKETVQNIMVLRFANTIFEPIWNRNYISSVQITAAETVGVEERAGYYETSGALRDMVQNHLTQMLAITAMEPPGRFDPEAIRNEKAKVLQAARLADEQEPWNCCIRGQYGPGGSHDAPLAGYRQEPGVDPNSTTETYVAMKLFVDNWRWQGVPFYVRTGKRLAKRLSEVVLTFREAPVHLFDAATGGPTANQLILRIQPDEGAEFRFEVKSPGSGMRSRPIDMEFSYDESFGEPSDEGYVRLLADAMLSDPTLFTRSDEVEAAWRLYTPLLELIEDSPWQLPIHPYESRTWGPAAADALLARDGLLWRRP

SEQ ID NO: 2707 - DNA, 1455 bp, Rhodopirellula baltica
  CDS (1)..(1455)
atgtcacatacaattgtcatctttggtgccagcggcgacctgaccagccgcaaactggtcccggcactcttccgactcttctcacgcggacgcctgcccgactcgactcgcattgtcggtgtttcgcgaagtccctacgaacattccgagtggcgaaaatcgcttcgcgaaaccaccgccaaatttgtcggcaagtctttcagcgaagaagcctgggaatcattcgcaccgaacatctactaccagcccggcgacatcaaagacgcagagtcgtttcaatcgctggcgacgtttttggatgaaatcgaagaaggcaaatcgaccggtcgagtctactacctgtcgaccatgccacagttgtacgaagaagcgatccagcaactcggggccgcgggactcgcctgcgacaaaaccggaccgcgacgggtgatcatcgagaaaccgttcggcacggatctgaaaacggcccagcgtctgaacgaatcgatccacaacgtttttcgcgaagatcagatctaccggatcgatcattacctcggcaaagaaaccgtacagaacattttcgcgttgcgttttgccaacagtatcttcgaaccgctgtggaaccggaactacatcgaccacgtgcaaatcaccgtggccgaagaagtcgtcatcggccggcgagctggctactacgacaacagcggaatcctccgcgacatgttccagaatcatattctgcaactgatgatgatcacggcgatggaaccgccggcgaaatttgacgccgctttggttcgcgatgagaaagtcaaagtgttgcacagtgttcgcaagatgacgggtggcgacttcgcatctcaaaccgttcgcggccagtacgacggctacctgcaagaggaaggcgtcccggcgaacagccaaacggaaacctttgccgcgttgaaactgtactgcgacaactggcgatggcagggcgtgccgttcttcttgcgaagcggcaaaggcatgtcatgccgaacgacccagatcgtgatccagttcaaaaacgttccgcaccaattgtttggcggatcgaagaaggagaacaaacttggcaaccgattggtcattcaagtccaaccggccgaaggcatccaattgcacttcgaaaccaaggttgccgacgccggaatgaagacgcgaaccaaccacttggacttcaacttccaagattcgatcggcggccaagaaatgcccgacgcctatcagcgactgctgctggacgcggtgcaaggcgacgccagcctctttgctcgcggcgacgaagtcgaactggcctggagcatcatcgatccaatcatcgaagcgtggcgaagcccggccgctccgccactgcacacgtaccaaaccggcctttggggccccgaagaatgctcgcagtggctgttcgaccaaaaacgcgaatggttcgacgtctgcccagttatttaa

SEQ ID NO: 2708 - protein, 484 aa, Rhodopirellula baltica
MSHTIVIFGASGDLTSRKLVPALFRLFSRGRLPDSTRIVGVSRSPYEHSEWRKSLRETTAKFVGKSFSEEAWESFAPNIYYQPGDIKDAESFQSLATFLDEIEEGKSTGRVYYLSTMPQLYEEAIQQLGAAGLACDKTGPRRVIIEKPFGTDLKTAQRLNESIHNVFREDQIYRIDHYLGKETVQNIFALRFANSIFEPLWNRNYIDHVQITVAEEVVIGRRAGYYDNSGILRDMFQNHILQLMMITAMEPPAKFDAALVRDEKVKVLHSVRKMTGGDFASQTVRGQYDGYLQEEGVPANSQTETFAALKLYCDNWRWQGVPFFLRSGKGMSCRTTQIVIQFKNVPHQLFGGSKKENKLGNRLVIQVQPAEGIQLHFETKVADAGMKTRTNHLDFNFQDSIGGQEMPDAYQRLLLDAVQGDASLFARGDEVELAWSIIDPIIEAWRSPAAPPLHTYQTGLWGPEECSQWLFDQKREWFDVCPVI

SEQ ID NO: 2709 - DNA, 1524 bp, Prochlorococcus marinus subsp
  CDS (1)..(1524)
atgtcctcaaccttaagtaatcctcttagattaggtttgcgacaagaaagagtgatatctccacaatgcctaataatatttggagctagtggagatcttactcataggaaacttatacctgccttatttgaactttatctgcaaagaaggatcccaagtgaattcgccatagttggatgtgcaagaaggccttggagtgatcaagattttaaggaaaaaatgaagggtaagttagctgatcaaatatctgacaatgaaaaggaatgggaacagttttcaaattatctattctacgaaccagttgatttgcagcaaagtgatcatgtagtaagactttccaaaagattaaatgagattgataaattacaggctacacatggaaataacaccttttacttatcagtatctccaaacttttatggaagtggatgtaaggctctaaaggctgctggattactagatgatccgaagaaaagtcgaatcgttattgaaaaaccctttggaagagattattcaagtgcgaagaaattaaataagatcgttcaaagttgtgcagatgaaagtcagatatatcgaatagatcattatttggggaaagagactgttcaaaacatacttgttatgaggtttgctaatactatttttgaacctatatggaataggaattatatttcaagtgttcaaataacatcatcggaaactgttggggttgaagatagagctggttattatgaaagctctggggctttaagagatatgctccaaaatcatttaactcaaatgcttgctgtaacagcgatggagcctcctggtaaatttgaacctgaggcaataagaaatgaaaaagcaaaagttcttcaagcttcaaaacttgccgatgagaatgaaccctggaattgctgtgtcagaggtcagtatgcacaaggaggtaatagtcttaaaagacttaaaggttatagggatgaagatggagtaaatttgaacagtacaacagaaacttatattgcaacaaaagtatttattgataattggcgatggcaaggagttcctttcttcttaagaacaggtaaaagactaccgaaaagacttggggaaattgtattaacatttaaagatgtcccagtacatttatttgaatcaacaataattaatcctgcgccaaatcagcttattcttaggattcagcctaatgaaggagctacttttaaatttgaagtcaaatcacctggatctgggatgaaagcaagaccagttgaaatggaattttcttacgatgaatcttttggagagccttctgacgaaggttatgtaaggttgttggctgatgccatgctctcagatcctaccttgtttacaaggagtgatgaggtagaagctgcttggaaactttatacaccattaatagaattaatggaagacgctccttggaagttacctattcataaatacgaatcaatgacttggggacctcctgaatcagatcaattactttccaaagataatattttttggcgcagaccctaa

SEQ ID NO: 2710 - protein, 507 aa, Prochlorococcus marinus subsp
MSSTLSNPLRLGLRQERVISPQCLIIFGASGDLTHRKLIPALFELYLQRRIPSEFAIVGCARRPWSDQDFKEKMKGKLADQISDNEKEWEQFSNYLFYEPVDLQQSDHVVRLSKRLNEIDKLQATHGNNTFYLSVSPNFYGSGCKALKAAGLLDDPKKSRIVIEKPFGRDYSSAKKLNKIVQSCADESQIYRIDHYLGKETVQNILVMRFANTIFEPIWNRNYISSVQITSSETVGVEDRAGYYESSGALRDMLQNHLTQMLAVTAMEPPGKFEPEAIRNEKAKVLQASKLADENEPWNCCVRGQYAQGGNSLKRLKGYRDEDGVNLNSTTETYIATKVFIDNWRWQGVPFFLRTGKRLPKRLGEIVLTFKDVPVHLFESTIINPAPNQLILRIQPNEGATFKFEVKSPGSGMKARPVEMEFSYDESFGEPSDEGYVRLLADAMLSDPTLFTRSDEVEAAWKLYTPLIELMEDAPWKLPIHKYESMTWGPPESDQLLSKDNIFWRRP

SEQ ID NO: 2711 - DNA, 1524 bp, Prochlorococcus marinus
  CDS (1)..(1524)
atgagcaccacgatcaccaaccctttacgggttggactacgtcaagagcgggttatcgctccgcagtgcctagtcatctttggtgcaagtggcgacctgacccaccgaaaattggttccagcccttttcgagctatacaaacaacggcggctaccgagtgaattcgccctacttggctgcgcgcgacgtccttggagcaacgaaatatttcgccaaaaaatggctgaagccctcggcgagactatcaacgaaaaccatcttgcttgggatcaattcgccgctggtcttttttacgaacctgtcgatctacagaagccagaagacctcatcaaactcagccatcggctggaagagattgatcgactccgcgccacccgcagcaatcgcaccttctatctttcggtgtcaccaaagttctacggcagtggctgcaaagctcttgctaatgccggtcttctaagtgatcccaaacgcagtcgagtggttatcgaaaaaccattcgggcgtgattacgccagtgctcagtctttaaatcaaatcgtccaaagctgtggccaagagaatcaaatcttccgcatcgaccactacctcggcaaagaaacagtccagaacatccttgtgctgcgattcgcaaataccatctttgaaccaatctggaaccggaattacatctccagcgttcaaatcacagccgctgaaaccgtaggggttgaagaacgagccaactactacgaatcgtcaggggccctgcgcgacatggtgcaaaaccatctcacccagatgctggccatcaccacgatggaaccgccagggcgctttgaccctgaggcaatccgcaatgaaaaagccaaggttttgctagcggctcgcctagcggatgagttggaaccttggaactgctgcatccgtggccagtacgcacctggcggcaccaaggaagctccgatagcaggctaccgacaggagccgggtgtcgatcccagcagcaccaccgagacctatgtagcgatgaaacttttcatcgacaactggcgctggcagggagtgcccttttacgttcgcactggcaaacgactggcaaagcgtcttagtgaagtggttctcacctttcgagaagcacccgtgcatcttttcgatgccgctgggggcagccctacagcgaaccaactcatcctgcgaatccaaccggatgaaggagccgagtggcgctttgaggtgaagtcacctggttcaggcatgcgcagccgaccagtagagatggaattctcctatgacgaatccttcggtgagccatccgatgagggatacgtccgacttttagccgatgccatgctcagtgacccaactttattcacccgcagtgatgaggttgaagcagcgtggcgcctttacacccctctcctggaactgattgaagacagcccatggcaattgcccattcatccctatgaatcacgtacctgggggcccgctgctgccgataccctgcttgccaatgacggattgctctggcgccgaccctga

SEQ ID NO: 2712 - protein, 507 aa, Prochlorococcus marinus
MSTTITNPLRVGLRQERVIAPQCLVIFGASGDLTHRKLVPALFELYKQRRLPSEFALLGCARRPWSNEIFRQKMAEALGETINENHLAWDQFAAGLFYEPVDLQKPEDLIKLSHRLEEIDRLRATRSNRTFYLSVSPKFYGSGCKALANAGLLSDPKRSRVVIEKPFGRDYASAQSLNQIVQSCGQENQIFRIDHYLGKETVQNILVLRFANTIFEPIWNRNYISSVQITAAETVGVEERANYYESSGALRDMVQNHLTQMLAITTMEPPGRFDPEAIRNEKAKVLLAARLADELEPWNCCIRGQYAPGGTKEAPIAGYRQEPGVDPSSTTETYVAMKLFIDNWRWQGVPFYVRTGKRLAKRLSEVVLTFREAPVHLFDAAGGSPTANQLILRIQPDEGAEWRFEVKSPGSGMRSRPVEMEFSYDESFGEPSDEGYVRLLADAMLSDPTLFTRSDEVEAAWRLYTPLLELIEDSPWQLPIHPYESRTWGPAAADTLLANDGLLWRRP

SEQ ID NO: 2713 - DNA, 1521 bp, Prochlorococcus marinus
  CDS (1)..(1521)
atgataccgactacaaacccattgagagttggtcttagacaagagagggtaatttcacctcagtgtttaattatttttggggccagtggagatttaactcataggaaacttgtccctgcccttttcaagctattcaaacaaagacgcttgcccagtgaatttgcattactaggttgcgctagaagaccttggagtgacattgagttccgaaaaaaaatgtcagtttctcttaaagatgaaatcaaattaaatccaaatgaatgggaagaattcataactcgtcttttctatgaaccagtcaatcttgaacgaccagaagatcttgtaaaactaggtacaaggctcgaagaaatagaccggataaaagctacccatgcaaatagaaccttttatttatctgttgcaccaaaattctatgcaagtggttgcaaagctttagcagatgcaggccttctcaaagacccacgaagaagcagagtggttatcgagaaacctttcgggagggattacagaagcgctcaaagtttaaatcgtattgttcagaattgtgctcttgaaagtcaaatctttcgcatcgatcattatctagggaaagagactgttcagaacattctggttctaagatttgcaaacacaatttttgaaccaatttggaacagaaattatatatctaatgttcaaataacttcagctgaaacagtaggagtcgaagatcgagcaggctattacgaaagttcaggagcattaagggatatggtgcagaatcatttaacgcaaatgcttgcaattactgcaatggaaccacctggtcattttgatccagaagccattaggaatgaaaaagccaaagtactgcaagctgctcatttagctaatgaacttgagccttgggaatgttgtgtaagaggccaatattcaaaaggtggctctaagaaaagaccattgattggttaccgagatgaacctggtgttaatccaaatagcacaactgaaacctatgttgctatgaagcttttcattaataattggcgatggcaaggagtccctttttatattcgtactgggaaaagattggcaaaaagaactagtgaagtagttttaacctttagagaggcacctgttcaccttttcgatgcggcaggggggacaccaacatctaatcaactagtcctaagaatccaacctgatgaaggagctgagttcaagtttgatgtgaagtctccaggttctggaatgaggagcaggcctgttgaaatggaattctcttatgatgaatcatttggagaaccttcagacgaaggatatgtaaggcttttagctgatgcaatgcttggagatcctactcttttcacgagaagcgatgaggtagaagccgcttggcgtttatatactcctcttttagaaataattgaagatagtccttggcaacttccaacttatccttatgaatccagaacttggggcccttcagaagctgatgcattactagctaaagatcaattactttggagaagaccctaa

SEQ ID NO: 2714 - protein, 506 aa, Prochlorococcus marinus
MIPTTNPLRVGLRQERVISPQCLIIFGASGDLTHRKLVPALFKLFKQRRLPSEFALLGCARRPWSDIEFRKKMSVSLKDEIKLNPNEWEEFITRLFYEPVNLERPEDLVKLGTRLEEIDRIKATHANRTFYLSVAPKFYASGCKALADAGLLKDPRRSRVVIEKPFGRDYRSAQSLNRIVQNCALESQIFRIDHYLGKETVQNILVLRFANTIFEPIWNRNYISNVQITSAETVGVEDRAGYYESSGALRDMVQNHLTQMLAITAMEPPGHFDPEAIRNEKAKVLQAAHLANELEPWECCVRGQYSKGGSKKRPLIGYRDEPGVNPNSTTETYVAMKLFINNWRWQGVPFYIRTGKRLAKRTSEVVLTFREAPVHLFDAAGGTPTSNQLVLRIQPDEGAEFKFDVKSPGSGMRSRPVEMEFSYDESFGEPSDEGYVRLLADAMLGDPTLFTRSDEVEAAWRLYTPLLEIIEDSPWQLPTYPYESRTWGPSEADALLAKDQLLWRRP

SEQ ID NO: 2715 - DNA, 1488 bp, Haemophilus ducreyi
  CDS (1)..(1488)
atgaatatagaaaatagttgtatcgtaatttttggtgcatcaggggacttaacattccgtaaacttatcccagcactatataatctttttaaagtaggtcggttaggcgaacatttttctgttttaggtgtttcacgatcagacctaactcacgattcttttagacaaaaaatgcgtgaagcattaatcaaatatgagcaagcaagcgggcagtttttagatgatttttgcaatcacttgtattatcaagcaatcaacaccgctgatccggacgattatgccaaactattaccttgtttagatgaattacacaataaatacggtagctgtggtaacactttatattacctttcaacaccgcctagtttatacggcattatccctgaatgcttggcggctcacggcttaaccactgaagaatatggttggaaacggattatcatcgaaaaaccatttggttacgatattaaaacagccaaacaactcgatgagaaaatacatcattattttgaagaacatcaaatttaccggatcgatcattatcttggtaaagaaaccgtgcaaaatttattagtactccgtttctcaaacggtttatttgaaccactttggaatcgtaattttattgaatatgtagaaattaccggtgcagaatcattaggtgttgaagatcgtggtggttattatgatggatctggtgcaatgcgtgatatgttccaaaaccatttactacaagtattagcaatggttgccatggaacctccggccattattaatgctaactcaatgcgtaatgaagtagcaaaagtcttatatagcttacgtccattaagcactgaagacgtcaaaaataatgtggtacttggtcaatatacctccggtgaaattgatgacttagttgtacccggttatactgaagaaaatggcgttcccaacgattcaaatacagaaacttatttagccgtaaaatgcgaaattgataactggcgttgggccggcgtgccattttatgtgcgaacaggtaagcgtttgcctactcgggtaactgaaatcgtaatccacttcaaaacgactccacatccagtctttagccaaaatgcgcctgaaaataaattaattatccgggtacaacctgatgaaggtatttctatgcggtttggtttgaaaaaacccggtgctggttttgaggcgaaagaagtctctatggattttcgctattctgatttaagctctgcttcaagtttattaaccgcttatgaacggttactattagatgcattaaaaggagatgcgaccctatttgcccgaaccgatgccgtacatgcctgttggcatttcgtacagccgattctagactataaggcagaacgtggccgagtgtatgaatatgaagcaagcagttgggggcctaaagaagctgataaactgattgcacgcaatggcaaagtatggcgtaaaccgtctggaatgatgaagaaaaaaatatag

SEQ ID NO: 2716 - protein, 495 aa, Haemophilus ducreyi
MNIENSCIVIFGASGDLTFRKLIPALYNLFKVGRLGEHFSVLGVSRSDLTHDSFRQKMREALIKYEQASGQFLDDFCNHLYYQAINTADPDDYAKLLPCLDELHNKYGSCGNTLYYLSTPPSLYGIIPECLAAHGLTTEEYGWKRIIIEKPFGYDIKTAKQLDEKIHHYFEEHQIYRIDHYLGKETVQNLLVLRFSNGLFEPLWNRNFIEYVEITGAESLGVEDRGGYYDGSGAMRDMFQNHLLQVLAMVAMEPPAIINANSMRNEVAKVLYSLRPLSTEDVKNNVVLGQYTSGEIDDLVVPGYTEENGVPNDSNTETYLAVKCEIDNWRWAGVPFYVRTGKRLPTRVTEIVIHFKTTPHPVFSQNAPENKLIIRVQPDEGISMRFGLKKPGAGFEAKEVSMDFRYSDLSSASSLLTAYERLLLDALKGDATLFARTDAVHACWHFVQPILDYKAERGRVYEYEASSWGPKEADKLIARNGKVWRKPSGMMKKKI

SEQ ID NO: 2717 - DNA, 1497 bp, Candidatus Blochmannia floridanus
  CDS (1)..(1497)
atgcggtcaaaaacaactaccactcaagcttgtaatttcattatttttggagctaaaggagatttagctcgtaggaaattaattcctgcgctatatcaattagagaaaatcggttctatacatcctagaacttttatattaggagtaggtagagcggaatgggatttattaacatatattaaaattgtgcgttcttctttagagagatttatgaaagaatctattaatgaaaatatatggtgtcgtttttctaaaagatttgatttttgtaatttagatgttaatcaaacggaacaatttgtacatgtgctgaataaattaaaaaatttagatttattgacaataaattattttgcaatgcctcctcatacatttggatctatttgtaaaggattaagtttagtgggtttaaataaagaaagaaatagaatagtgatagaaaagccattaggaatgaactttgattctgctcgtgttattaattctcaagtatctaaatattttcatgaaactcaaatttatcgggtagatcattatttaggaaaagaagctattttaaatttgttggtattacgttttgcaaattctgtatttttttcaaattgggataacaataccattgatcatgtacaaattactgtttcagaagaggttggaattgaaggtcgttggggttattttgatgctatggggcaaatgcgtgatatggtacaaagtcatttattacaaattcttactatcattgctatgtctcctccttttgatttaagtgctgattgtattcgggacgaaaaagttaaagtgttacgttcattgcgtatgattaatactaatacgatacatgaaattgcggtacgaggtcaatatactgctggttttattaatggtcaaccagtaccaggatatttagaggaaataggttctaacaaggatagtaaaacggaaacatttgtatcgattaaagtgaatatagataattggaggtggtttggagtgcctttttatttacgtactggaaaaagattagcaatgaaatattctgaagttgttatatattttaaaaaaccaatattgaatttatttaaagattcttattcaattttacctaataataaattaattattcgattacaaccatatgaaggaatagatatgcagattctaagtaaaataccgggattaggtaataagaatcgtttaaaaattactaatttgaatttaaatttgaggaaaatattttccggagaatacatattagatgcttatgaacgattattattagaggtaatgcgtgggattcaagtattatttgtacgttatgacgaaatagaggattcatggaggtgggttgattctgttatagaggcatggtctttagttgatggtgttccaaaattatataaagctggtacatggggtccgagtgaatctacagaaatgattcgtaaaggaaatcatcattggaataaatgtacgttgaaatatacgaatatttga

SEQ ID NO: 2718 - protein, 498 aa, Candidatus Blochmannia floridanus
MRSKTTTTQACNFIIFGAKGDLARRKLIPALYQLEKIGSIHPRTFILGVGRAEWDLLTYIKIVRSSLERFMKESINENIWCRFSKRFDFCNLDVNQTEQFVHVLNKLKNLDLLTINYFAMPPHTFGSICKGLSLVGLNKERNRIVIEKPLGMNFDSARVINSQVSKYFHETQIYRVDHYLGKEAILNLLVLRFANSVFFSNWDNNTIDHVQITVSEEVGIEGRWGYFDAMGQMRDMVQSHLLQILTIIAMSPPFDLSADCIRDEKVKVLRSLRMINTNTIHEIAVRGQYTAGFINGQPVPGYLEEIGSNKDSKTETFVSIKVNIDNWRWFGVPFYLRTGKRLAMKYSEVVIYFKKPILNLFKDSYSILPNNKLIIRLQPYEGIDMQILSKIPGLGNKNRLKITNLNLNLRKIFSGEYILDAYERLLLEVMRGIQVLFVRYDEIEDSWRWVDSVIEAWSLVDGVPKLYKAGTWGPSESTEMIRKGNHHWNKCTLKYTNI

SEQ ID NO: 2719 - DNA, 1768 bp, Oryza sativa
  CDS (2)..(1768)
catggcgctctcctgcatgaggtgctccccggccgccggcgccgtacgacgaggattggcatcggcggctccgccggcggcgctctcctttgccagatgcggcctccgtagagcggccgcgctcgggtggcgcgtcgccgccgtcgccactacgggagtgcaaggtgccaaggatgctggtctggagaaagctgccagaagtgcttcccaatcaaaggtggaaaatggctcaccttcagaaatcattttagatgattttgaagacttgagccctctatcagaaaatgatgactccactgttagtatcactgtagtcggagcatctggtgaccttgccaagaagaagatatttcctgcactttttgctctatactatgaagattgtcttccaaagcatttcactatcttcggatatgcacgcagcaagatgacagatgctgaattgagaaacatggtcagcaaaacactgacatgcagaatagataaaagggaaaactgtaatgagaagatggaagagtttttaaagagatgcttctatcattcaggccaatatgattcagaggagcatttcatggaccttgacaagaagctgaaacaacatgagggttccagagtttctaaccgtcttttctacttgtcaataccaccaaatatattccttgatgttgtaaaatgtgcaagcaaatcagcatcatctgggaatggttggacaagggtaattgttgagaaaccttttggtcgtgactcagattcatcttctgcattaacaaggggtctgaagcagtacctggtagaggaccaaatcttcaggattgaccactacttgggaaaggaactagtggagaacctgtctgtccttcgcttctcaaatcttgtttttgaacctctatggtcaaggcagtatataaggaatgtgcagctgatattctcagaggatttcggcactgaaggacgaggagggtactttgataggtatggtattatccgtgacataatgcagaatcatcttcttcagatactagccctatttgcaatggaaactcctgttagcttggaggcagaggacataagaaacgaaaaggttaaagttttgcgttccatgaagcccctgcaactggaagatgtggtgataggacagtacaaaagtcatacaaagggtggtaccacataccctggatacactgaagataagacggtgcccaaggatagtgtcaccccaacatttgctgcagctgcacttttcataaataatgctagatgggatggagttccttttcttatgaaagctgggaaggctttacatacaaaaggggctgagattagagtacagttccgacatgttcctggtaatctttataagaggagttttgggactgatcttgatacagccactaatgaacttgtcatacgtgtgcaacctgatgaagctatctacttgaagattaacaacaaaattcctggtcttggtatgagactagatagaagtaatttgaatcttcactatgcagcaaggtactccaaggagataccagatgcttatgagaggctcttacttgatgccattgaaggagagcgaaggctttttatccgttctgatgagttggatgccgcatgggagctcttcactcccttactcaaggagctggaagagaagcggatagcccctgagctatacccttatggaagccgcggtcctgtaggggctcactaccttgcagcaaagtacaacgtcagatggggtgatttgaccacagaacagaaggcatga

SEQ ID NO: 2720 - protein, 588 aa, Oryza sativa
MALSCMRCSPAAGAVRRGLASAAPPAALSFARCGLRRAAALGWRVAAVATTGVQGAKDAGLEKAARSASQSKVENGSPSEIILDDFEDLSPLSENDDSTVSITVVGASGDLAKKKIFPALFALYYEDCLPKHFTIFGYARSKMTDAELRNMVSKTLTCRIDKRENCNEKMEEFLKRCFYHSGQYDSEEHFMDLDKKLKQHEGSRVSNRLFYLSIPPNIFLDVVKCASKSASSGNGWTRVIVEKPFGRDSDSSSALTRGLKQYLVEDQIFRIDHYLGKELVENLSVLRFSNLVFEPLWSRQYIRNVQLIFSEDFGTEGRGGYFDRYGIIRDIMQNHLLQILALFAMETPVSLEAEDIRNEKVKVLRSMKPLQLEDVVIGQYKSHTKGGTTYPGYTEDKTVPKDSVTPTFAAAALFINNARWDGVPFLMKAGKALHTKGAEIRVQFRHVPGNLYKRSFGTDLDTATNELVIRVQPDEAIYLKINNKIPGLGMRLDRSNLNLHYAARYSKEIPDAYERLLLDAIEGERRLFIRSDELDAAWELFTPLLKELEEKRIAPELYPYGSRGPVGAHYLAAKYNVRWGDLTTEQKA

SEQ ID NO: 2721 - DNA, 1548 bp, Bos indicus
  CDS (1)..(1548)
atggcagagcaggtggctctgagccagacacagacgtgtgggatactgtgggaagagctgtgccaaagctattctttccatcagtcggatacacacatattcatcatcatgggtgcatcgggtgacctggccaagaggaatatctaccccaccatctggtggctgttccaggatggccttctgccaaaagataccttcattgtgggctacaccgactcccacttcacagtggccaacatccgcaagcagagtgagcccttcttcaagtccaccccagaggaggagcccaagctggaggagttctttgcccacagctcctacatggccagccagtatgatgacgtggcttcctacgagcacctcaacagtggcatgaacgctctccaccagggtccgcaggccaactgcctcttctacctggccttgctccccagcggctacaggactgtcaccaagaacatctgtgacacctgcacgagccagacaggctggaaccgcatcatcgtggagaagccgtttgggagggacctgcagagctccaaccagctgtccaaccacatcgcctccctgttccacgaggaccagatctaccgcatcgaccactacctgggtaaggaggtagtccagaacctcatggtgctgaggtttgtcaacaggatcttaggccccatctggaaccgggacaacattgcttgcatgagcttcaccttcaaggagccatttggcactgagggccggtggagctacctcagtgaatctgggatcatctgggaggtgatgcaaaatcccctcctccagatcctgtgtctggtggccatggagaagcccatctccaccaactcagataacatccgtgatgataaggtcagggtgttgaaatgtatatcaaaggtgcaggtgagcaatgtggtcctgagccaatatatggagaaccccactgaagaaggtgaggccaccagagggtacccagaggaccccagggtgccccatgggtccaccactgacacctttgcagcagctgtcctctatgtggaaaatgagcgctgggacggggtgcccttcatcctgcgctgcggcaaagccctgaatgagcgcaaggccgaggtgcgcctgcagtttcgtgacgtggccggggacatcttccggcagcagtgcaagcgcaacgagctggtaatccgtgtgcagcccaacgaggccgtgtacaccaagatgatgaccaagaagcctggcatgttcttcaaccccgaggagtcggagcttgacctgacctatggcaaccgatacaagaacgtgaagttccctgacgcctacgagcgcctcatcctggacgtcttttgcgggagccagatgcacttcgtgcgtagtgatgaactgcgggaggcctggcggatcttcactccactgctccaccacattgaacgcgagaaggcccggcccatcccgtacgtgtacggcagccggggccctgtggaggcagacgagctgatgaagcgtgtgggcttccagtacgagggcacctacaagtgggtgaaccctcacaagctctga

SEQ ID NO: 2722 - protein, 515 aa, Bos indicus
MAEQVALSQTQTCGILWEELCQSYSFHQSDTHIFIIMGASGDLAKRNIYPTIWWLFQDGLLPKDTFIVGYTDSHFTVANIRKQSEPFFKSTPEEEPKLEEFFAHSSYMASQYDDVASYEHLNSGMNALHQGPQANCLFYLALLPSGYRTVTKNICDTCTSQTGWNRIIVEKPFGRDLQSSNQLSNHIASLFHEDQIYRIDHYLGKEVVQNLMVLRFVNRILGPIWNRDNIACMSFTFKEPFGTEGRWSYLSESGIIWEVMQNPLLQILCLVAMEKPISTNSDNIRDDKVRVLKCISKVQVSNVVLSQYMENPTEEGEATRGYPEDPRVPHGSTTDTFAAAVLYVENERWDGVPFILRCGKALNERKAEVRLQFRDVAGDIFRQQCKRNELVIRVQPNEAVYTKMMTKKPGMFFNPEESELDLTYGNRYKNVKFPDAYERLILDVFCGSQMHFVRSDELREAWRIFTPLLHHIEREKARPIPYVYGSRGPVEADELMKRVGFQYEGTYKWVNPHKL

SEQ ID NO: 2723 - DNA, 1536 bp, Chlamydophila caviae
  CDS (1)..(1536)
atgacaagtaatgaaaataaagatggcgggaaaaccttgctcccatgtcctccctgtgtgatggtaatcttcggagctaccggagatcttacagcgcgcaagttattcccagcattgtatcatcttattaaagagggtaggctgtctgaaaactttgtctgcgtaggttttgctagaagaaagaaaagccatgaggaatttcgtgaagaaatgaaacaggcaatacaaaacttttcacgtgctcaagagcttgatatccgcatttgggaagagtttgaatcacgtatattttatcacgaatccaacttctcttctcccgagggctacgcctcattaaaagagagacttgaggatattgataagaaatataagacacaagggaatcggctattttacttatcaacgcctccagagtatttccccgagattatcgaaaatattaataagcataagcttttttatcatgatcaaagcgaaggcaagccatggtctcgagtgattatagaaaaaccctttggtgtggatctacaaagcgctaaagaactacaaaagtacatagatgataatctagatgaagattctgtctatcgtatcgatcattatctggggaaagaaactgtacagaatattcttacgatacgttttgcaaatactctatttgagtcttgttggaattctcaatacattgatcatgtgcaaattagcgtgagtgaatctataggcataggcacacgagggaacttctttgaaaaatctggaatgcttcgtgatatggtgcaaaaccatatgatgcagcttttatgtctattaactatggaacctccttcagtattcaattctgaagaaattaaaaaagaaaagatcaatattcttaagaaaatccgtccatttgctaaagaagatattattcgtggacaatatggtccgggagaagtacaagatgtgtctgttcttggctatcgtgaagaagacaatgtagctccagattctaatgtggagacttatgtagcgttaaagatgtttattgataacccacgttggttgggagtgcctttttatcttcgagccggtaaacgtctttctaaacgctctacagatatctctatcattttcaaaaagtctttgcccagcttatttacagcggaatcttgtcccgtatgtcctttagaaaatgatctgctaattatccgtatacaaccggatgaaggcgtggccttgaaatttaactgtaaagttcctggaatgaataatatcgtacgtcctgtgaaaatggattttcgctacgatacgtatttcaagacaacggcgccggaagcttacgagagattgctttgtgactgtattctaggcgataggattctatttacctgtagtgatgaagttatggattcttgggagctctttacaccgattttaaagcgatgggagcaagattcctcagatgcgcatttccctaattatgttgctggatcttcaggtcctaaggaagcagaggaattactacaagctgatggaagaagttggcgtcccctgtaa

SEQ ID NO: 2724 - protein, 511 aa, Chlamydophila caviae
MTSNENKDGGKTLLPCPPCVMVIFGATGDLTARKLFPALYHLIKEGRLSENFVCVGFARRKKSHEEFREEMKQAIQNFSRAQELDIRIWEEFESRIFYHESNFSSPEGYASLKERLEDIDKKYKTQGNRLFYLSTPPEYFPEIIENINKHKLFYHDQSEGKPWSRVIIEKPFGVDLQSAKELQKYIDDNLDEDSVYRIDHYLGKETVQNILTIRFANTLFESCWNSQYIDHVQISVSESIGIGTRGNFFEKSGMLRDMVQNHMMQLLCLLTMEPPSVFNSEEIKKEKINILKKIRPFAKEDIIRGQYGPGEVQDVSVLGYREEDNVAPDSNVETYVALKMFIDNPRWLGVPFYLRAGKRLSKRSTDISIIFKKSLPSLFTAESCPVCPLENDLLIIRIQPDEGVALKFNCKVPGMNNIVRPVKMDFRYDTYFKTTAPEAYERLLCDCILGDRILFTCSDEVMDSWELFTPILKRWEQDSSDAHFPNYVAGSSGPKEAEELLQADGRSWRPL

SEQ ID NO: 2725 - DNA, 1524 bp, Streptomyces avermitilis
  CDS (1)..(1524)
atgtcgagcagcaacccgctgcgtgaccccgcagaccgacggctcccgcgtatcgcggggccgtcgggcctggtcatcttcggcgtcacgggcgatttgtcacgtaaaaagctgatgccagccgtgtacgatctcgccaaccgcgggctgctgccgccgggcttctcgctcgtcggcttcgcccgccgcgactgggagcacgaggacttcgcccaggtcgtccacgacgccgtcaaggaacacgcccgtacggagttccgcgaggaggtctggcagcagctcatccaggggatgcgcttcgtccagggcaccttcgacgacgacgacgccttcgagcggctgcgcgacaccatcggggaactggacaaggcacagggcacgggcggcaacttcgccttctacctgtccgtgccgccgtccgccttcccggtggtcatccagcagctcaagaagcacggcctggccgaccagtcggacggctcctggcgccgcgcggtcatcgagaagcccttcggacacgacctcaagtcggccgaggagctcaacgcgatcgtccacgaggtcttcggctcggaccaggtcttccgcatcgaccactacctgggcaaggagaccgtccagaacatcctggcgctgcgcttcgccaacacgatgttcgagccgatctggaaccggtccttcgtggaccatgtgcagatcaccatggccgaggacatcggtatcggcggccgcgccggctactacgacggcatcggcgccgcccgtgacgtcatccagaaccacctgctccagctgatggcactgaccgccatggaggagcccgcctccttcgacgcggacgcgctcgccgccgagaagaccaaggtgctcggcgccgccaagctgccgaaggacctgagcaagaacaccgtccgcggacagtacgcggccggctggcagggcggcgagaaggtcgtcggctatctccaggaagacggcatcgaccccaagtcgaagaccgacacctacgcggccgtcaagctcgaggtggacaaccgccgctgggcgggcgtccccttctatctccgtaccggcaagcgcctgggccgccgcgtcaccgagatcgcggtcgtcttccagcgcgccccgcactcccccttcgaccacacggcgacggaggagctcggccagaacgcgatcgtcatccgcgtccagcccgacgagggcatcaccgtccgcttcggctccaaggtgcccggcacctcgatggagatccgggacgtctcgatggacttcgcgtacggcgagtcgttcaccgagtccagcccggaggcgtacgagcggctgattctggacgtgctgctcggcgactcgaacctcttcccgcgcaccgaggaggtcgagctgtcctggaagatcctcgacccgatcgaggagcactgggacaagcacggcaagcccgcgcagtaccccgcgggcacgtggggtcccgtcgaggcggacgaaatgctcgaacgagacggacggagctggcgtcgcccatga

SEQ ID NO: 2726 - protein, 507 aa, Streptomyces avermitilis
MSSSNPLRDPADRRLPRIAGPSGLVIFGVTGDLSRKKLMPAVYDLANRGLLPPGFSLVGFARRDWEHEDFAQVVHDAVKEHARTEFREEVWQQLIQGMRFVQGTFDDDDAFERLRDTIGELDKAQGTGGNFAFYLSVPPSAFPVVIQQLKKHGLADQSDGSWRRAVIEKPFGHDLKSAEELNAIVHEVFGSDQVFRIDHYLGKETVQNILALRFANTMFEPIWNRSFVDHVQITMAEDIGIGGRAGYYDGIGAARDVIQNHLLQLMALTAMEEPASFDADALAAEKTKVLGAAKLPKDLSKNTVRGQYAAGWQGGEKVVGYLQEDGIDPKSKTDTYAAVKLEVDNRRWAGVPFYLRTGKRLGRRVTEIAVVFQRAPHSPFDHTATEELGQNAIVIRVQPDEGITVRFGSKVPGTSMEIRDVSMDFAYGESFTESSPEAYERLILDVLLGDSNLFPRTEEVELSWKILDPIEEHWDKHGKPAQYPAGTWGPVEADEMLERDGRSWRRP

SEQ ID NO: 2727 - DNA, 1647 bp, Streptomyces avermitilis
  CDS (1)..(1647)
atgagcaagactccttcgaccgggacgccgggcaccgagaagcctgtcaccgggacgccggccaccgagacgcctgtcacggaggctccggtcaccgaggctccggtcaccgaggcgtcggccgtcgactgggccaaccccctgcgcgacccccgggaccgccgtctcccccgtatcgcgggcccctcgggcctcgtcatcttcggggtcaccggcgacctgtcccgcaagaagctgatgccggccatctacgacctggccaaccgcggtctgctcccgccgggcttctcgctcctcgggttcgcccgccgggactgggaggaccaggacttcgcgcaggtggtgcacgactcggtgcgcgagcacgcccgcacggagttccgcgaggaggtctggcagcagctcgccgagggcatgcggttcatcccgggcgacttcgacgacgacatggcgttcaagcaactgcgcgcgtccgtcgacgagctggacgcctcccgcggcaccagcggcaactacgccttctatctctcggtaccgccgaagttcttcccgaaggtcgtccagcagctcaagaagcacgggctcgcggacgcgccggagggctcctggcggcgtgcggtcatcgagaagccgttcggccacgacctggccagcgcgcgtgagctgaacgcgatcgtgcacgaggtgttcgacccggaccaggtgttccgcatcgaccactacctgggtaaggagaccgtccagaacatcctggcgctccgcttcgccaaccagatgtacgagccggtctggaaccggtcgtacgtcgaccacgtacagatcaccatggccgaggacatcggcatcggcggccgtgcggggtactacgacggcatcggttcggcccgtgacgtcatccagaaccacctcctccagctgatggcgctgaccgccatggaggagccggccgccttcgacgccgagtcgctgctcgccgagaagctgaaggtcctcaagtccgtgaagctgccggggaacctgggcgagcacaccgtgcgcggtcagtacacggcgagctggcagggcggcgagcgggtgcgcggctacctccaggaggacggcatcgaccccaggtcgacgacggacacctacgcggccgtgaagctggaggtcgacaaccgccgctgggcgggcgtccccttctatctgcgcaccggcaagcgtctgggccgccgggtgaccgagatcgcggtggtcttccagcgcgcgccccactcccccttcgactcgaccgccaccgaggagttgggcgccaacgcgatcgtcgtccgtgtccagcccgacgagggcatgaccgtgcgcttcggttcgaaggtgccgggtacgtcgatggagatccgggacgtctcgatggacttcgcgtacggcgagtcgttcaccgagtccagcccggaggcgtacgaacggctgatcctggatgtcctgctcggcgacgccaatctcttcccccgccatcaggaggtggaagagtcctggaagatcctcgacccgatcgaggggtactgggacacgcacggcaagcccgcgcagtacccctcgggatcctggggtcccgaggaagccgacgagatgctcgcacgagacggacggagctggcgcaggccatga

SEQ ID NO: 2728 - protein, 548 aa, Streptomyces avermitilis
MSKTPSTGTPGTEKPVTGTPATETPVTEAPVTEAPVTEASAVDWANPLRDPRDRRLPRIAGPSGLVIFGVTGDLSRKKLMPAIYDLANRGLLPPGFSLLGFARRDWEDQDFAQVVHDSVREHARTEFREEVWQQLAEGMRFIPGDFDDDMAFKQLRASVDELDASRGTSGNYAFYLSVPPKFFPKVVQQLKKHGLADAPEGSWRRAVIEKPFGHDLASARELNAIVHEVFDPDQVFRIDHYLGKETVQNILALRFANQMYEPVWNRSYVDHVQITMAEDIGIGGRAGYYDGIGSARDVIQNHLLQLMALTAMEEPAAFDAESLLAEKLKVLKSVKLPGNLGEHTVRGQYTASWQGGERVRGYLQEDGIDPRSTTDTYAAVKLEVDNRRWAGVPFYLRTGKRLGRRVTEIAVVFQRAPHSPFDSTATEELGANAIVVRVQPDEGMTVRFGSKVPGTSMEIRDVSMDFAYGESFTESSPEAYERLILDVLLGDANLFPRHQEVEESWKILDPIEGYWDTHGKPAQYPSGSWGPEEADEMLARDGRSWRRP

SEQ ID NO: 2729 - DNA, 1491 bp, Nitrosomonas europaea
  CDS (1)..(1491)
atgaatgatgcaaaaatgagccagactgaaaagctgccctgcctgtttgtcatttttggtgcaactggagatctcgcctcaaacaagttgctgcccgcgttatttgagttggaaaatgctggccgcctggcagataatttttccatcgttgctttctcgcgccgcgagtggacaactgacgattggctcgaacatctgcgtgaaatactgaagaataggattgatcaatcttttccggaaggagtgctggagcgtttttttgcacgtttccgttatcagcagggagatctcaacgatatcgaatcctatcgtgtgttagctgccggtctggcgcccggatcggcttgttctcgtacggtattttatcttgcgatcaggcctgctgatttcgttgcggtgatcaggaatctcaaagctgctggcctcaatgagccgcgaggaatgaaccgtgtagtgattgaaaaaccgtttggagaggatcttgaatcggcacaggtactgaatcgcttattgcatcagcattttgatgaagagcagatttatcgtatcgatcatttccttggtaaggaaaccgtacagaatctgcttgttttccggtttgccaatacgttgatcgagccactgtggaatcgtaattttattgatcatgtacaaattacggtggcggaatcgggtggtattgaaaaacgtgcagggtattatgatcgtgctggtgcgttgcgtgatatgttgcagaatcatttgatgcaattattgaccgtagttgccatggaaccgccacctgctcttgaggcagatgctttacgtgacgaaaaggtcaaagtactacgttcgattcgtcccattgccaagcgcgcgatacatgcccatgctgtgcgcgctcaatatactcacggtaatatcgatgggcaggtggtggcaggttatcagcaggaagataatgttgaacgggattcgattaccgaaacttttgtggcagccaagttctacattgataattggcgctggcggggagtgccgttttatctgcgtacaggtaagcgtatgccgaaacagaattcgatgatcgcaattcgtttcaagcatcctccccagcaacttttccgtgaaacaccattggaatggattgcaccaaactgggtgttgctttcgattcagcctgaagaatcgatgcacatggaaattcatgttaaacaacccggtctcgatatgaatacccgggtgatgcagatgaacgcaagttttctcaaaaccgatgaacaggcgctggatgcttatgaagcgctactgctcgacgtcattgaaggcgatcgctcacttttcattcgttttgatgaagttgaatgggcgtggcaagtgattgatcctattctgaaacattgggtggtagagcgcgaatatatcccgacttaccctgctggcagttgggggccggcagaggctaatcgcttgtttgacaacgatgatcagacctggcgcaacgagctttag

SEQ ID NO: 2730 - protein, 496 aa, Nitrosomonas europaea
MNDAKMSQTEKLPCLFVIFGATGDLASNKLLPALFELENAGRLADNFSIVAFSRREWTTDDWLEHLREILKNRIDQSFPEGVLERFFARFRYQQGDLNDIESYRVLAAGLAPGSACSRTVFYLAIRPADFVAVIRNLKAAGLNEPRGMNRVVIEKPFGEDLESAQVLNRLLHQHFDEEQIYRIDHFLGKETVQNLLVFRFANTLIEPLWNRNFIDHVQITVAESGGIEKRAGYYDRAGALRDMLQNHLMQLLTVVAMEPPPALEADALRDEKVKVLRSIRPIAKRAIHAHAVRAQYTHGNIDGQVVAGYQQEDNVERDSITETFVAAKFYIDNWRWRGVPFYLRTGKRMPKQNSMIAIRFKHPPQQLFRETPLEWIAPNWVLLSIQPEESMHMEIHVKQPGLDMNTRVMQMNASFLKTDEQALDAYEALLLDVIEGDRSLFIRFDEVEWAWQVIDPILKHWVVEREYIPTYPAGSWGPAEANRLFDNDDQTWRNEL

SEQ ID NO: 2731 - DNA, 1524 bp, Enterococcus faecalis
  CDS (1)..(1524)
atgaatgaaaaagtagcattatttactattttcggggggacaggtgatcttgccaaacgtaaattgtatccttccctgttccgcttatataaaaaaggattattagctgagcgttttgcggtgattggtaccgcacgtcgggaatggacagacgaatactatcgtgaaatcgtccgtgaaaccattcaagacttaaatcccacggccgaagaggcaactgaattttctagtcatttctattaccaatcacataatgtgaatgatacggaacattataataccttaaaagaattatctgatcgcctaaatgaacaataccacttagaaggcaatcatgtttactatttagctatggcccctcaattctttggaaccattgttaatcacttgaaatcacaacatattatttcggaagaaggctttgatcgtctaattatcgaaaagccatttggttctgattatgaatctgcctacgaattaaatgaagaaattcgtgctgcatttcctgaacaagatattttccgaattgaccattacttaggcaaagaaatgatccaaaatatttcagccattcgttttgccaataatatttttgaatcacaatggaacaatcgttacattgataatgtccaaatcaccttcgctgaaagcttaggtgtcgaggatcgtggcggctattatgaccacagtggcgcactaaaagatatggttcaaaatcatattttacaagtcgttgcattgctttctatggagcctcctgttgccttttctgaaaaagaaattcggactgaaaaagtaaaagctttacgtgccatccgcctttattctgaagaagaagcccttcaaaatttcgtgcgtggacaatacggcgaaggtcagctagctgatcaaacatttgcagcctatcgtgatgaaccaaatgtggcagaaacttcatccactgaaacttttgttgctggtaaatttttaattgataatttccgttggtctggcgtccctttctatgttcgcacaggtaaacgattaactgaaaaaggcacacgcattaacatcgtctttaaacaagtacctattaatgtcttcaaagatgatacgtgtgaagaatgcgataaaaccgatttaccaccgaatgttttaactatctatatccaaccaactgaaggattttcattaaccttaaatggaaaagaaatcggtcaagggttcaatacaactccagtgaaacttgatttccgtcaaagtgctgaaatgactgaaaatagtccagaagcatacgaaaaacttctattagactgcctaaatggcgatagtacaaacttctctcattgggacgaagttgcccaatcttggcgcattgttgacattattcgacatgcttgggataaaacagacgtttctttccctaattatgccgctggcacaatgggcccgcaagctgccttcgacttattagaaaaagatggctttacttgggaatggcaaccagataactggtaccgtgaccgcggtcaacttgatcaataa

SEQ ID NO: 2732 - protein, 507 aa, Enterococcus faecalis
MNEKVALFTIFGGTGDLAKRKLYPSLFRLYKKGLLAERFAVIGTARREWTDEYYREIVRETIQDLNPTAEEATEFSSHFYYQSHNVNDTEHYNTLKELSDRLNEQYHLEGNHVYYLAMAPQFFGTIVNHLKSQHIISEEGFDRLIIEKPFGSDYESAYELNEEIRAAFPEQDIFRIDHYLGKEMIQNISAIRFANNIFESQWNNRYIDNVQITFAESLGVEDRGGYYDHSGALKDMVQNHILQVVALLSMEPPVAFSEKEIRTEKVKALRAIRLYSEEEALQNFVRGQYGEGQLADQTFAAYRDEPNVAETSSTETFVAGKFLIDNFRWSGVPFYVRTGKRLTEKGTRINIVFKQVPINVFKDDTCEECDKTDLPPNVLTIYIQPTEGFSLTLNGKEIGQGFNTTPVKLDFRQSAEMTENSPEAYEKLLLDCLNGDSTNFSHWDEVAQSWRIVDIIRHAWDKTDVSFPNYAAGTMGPQAAFDLLEKDGFTWEWQPDNWYRDRGQLDQ

SEQ ID NO: 2733 - DNA, 1464 bp, Tropheryma whipplei
  CDS (1)..(1464)
atgccaaaggtgaattgcgcaacacagcagattgccctgcctggggcgcttgctatattcggggcaacgggtgacctgagctccaaaaaactattgccagcggtgtacgacttgtttcataactctcttctatcaaatgggttcgttttaattgctctgaatagagacttctcggcgcaagattttatctgtcacttccgccattgcgttaagtctttctctaggacgggatggtcagagtctgtttttcttgatctccaaaaaagggtacatcatgtaagtggcgacttttccgaccccgagacatatattgagctctctgagaaattagaaaccaccaaagaggaaactgggggtaattgtgttttttatctctcagttccgccaaatgtatttactcccatcatgaaaaacttgtctgctagtgggctgtctagaggatgtttgcataaaattgctgttgaaaaaccctttggtaatgaccttaaaagtgcaatacagcttaattcagtgcttaggtcagctttccctgagcgtgctatctttcgggttgatcactatcttggtaaagagaccattcaaaatattcttacttttcgttttggaaaccaaatctttgaccctatttggaataggaaacatgttgatcatgtgcagattacgatgtctgaagatataggggttgagggtcgcagtaagtactatgacggaatcggtgctgcacgtgatgtattacaaaatcatcttttgcagcttatggctctaattacgatggagagaccctcgaatttgaataacgcgagtgatataaggcacgagaagcagagagttttggaatgtgtgagtcttccgaaaaatatagctcaaaatgctgttcgtggccaatactcatccggctatctacgggatgagagggttgtatcttttttgcaagaagatggggttaatccatcttcaagaactgaaacattcgcggcgataaagctaaatgccgataatgaacgttggtatggtgtacctttctacgttagaactgggaaacggatggcaaaacgtagtgcatatataagtcttgtattcaagccaactgatatgagtattttgcaaaatgtgattgttataaggttgcaaccagacgagggtgtgtctatttggtttgcgtcgaaagtgcccggttatcgttctgatattcgacaggtgaattttgatttttcgtataaaagctcatttactgaatcaagtccagaggcttatgaacgcttaattctggatgcaatgaggggtgaggcctccttgtttccgcagcaaagagaagtggagttgtgttggggcataatagacccccttgaggaggtttgggaaaacgacaataccctgataccccaatacactccaggaagttgggggccagatacttcaaacgaccttttgctcagaacgtccaggcactggagaaattactga

SEQ ID NO: 2734 - protein, 487 aa, Tropheryma whipplei
MPKVNCATQQIALPGALAIFGATGDLSSKKLLPAVYDLFHNSLLSNGFVLIALNRDFSAQDFICHFRHCVKSFSRTGWSESVFLDLQKRVHHVSGDFSDPETYIELSEKLETTKEETGGNCVFYLSVPPNVFTPIMKNLSASGLSRGCLHKIAVEKPFGNDLKSAIQLNSVLRSAFPERAIFRVDHYLGKETIQNILTFRFGNQIFDPIWNRKHVDHVQITMSEDIGVEGRSKYYDGIGAARDVLQNHLLQLMALITMERPSNLNNASDIRHEKQRVLECVSLPKNIAQNAVRGQYSSGYLRDERVVSFLQEDGVNPSSRTETFAAIKLNADNERWYGVPFYVRTGKRMAKRSAYISLVFKPTDMSILQNVIVIRLQPDEGVSIWFASKVPGYRSDIRQVNFDFSYKSSFTESSPEAYERLILDAMRGEASLFPQQREVELCWGIIDPLEEVWENDNTLIPQYTPGSWGPDTSNDLLLRTSRHWRNY

SEQ ID NO: 2735 - DNA, 2145 bp, Leishmania mexicana
  CDS (298)..(1986)
aggcggagcgcgagcgcggcatcacgatcgacattgcgctgtggaagttcgagtcgcccaagtcggtgttcacgatcatcgatgcgcccggccaccgcgacttcatcaagaacatgatctaaaataaagcgaagaacaccaaggagaaatcgaaaaggacaggcgactcgtcgagaaagagaatttggtgtccttattgaacccccttcctattacttgtttagagctctcgatcgcattttattttgcctttggctaccatatagtgatcagtggcaggtacatcaattaagcaccatgtcggaagagcagtttgctgcttctcaagaggcctatgtggccgacgtcgacagcattctggacgtgctccgcgcgcaagtgctggagcggaagccggataacgttctccagtttatctccaagtcggcgcttagtctacagaaggacagcagctcggaatcctgcgatctcatcagctgtaaggtgaaggatgagcagaagagtcgttcgttgaccatcatcgtgttcggtgccagcggagatctggccaagaagaagacatttcctgccctcttcagcctgtactgcggtggccttctccccccggatgtcaatattatcggctatgcgcgcaccaaggtggacgatgccgagaagtggaagcatgagacgctcatgaagcatttttcgaacttgtcggagcgtgaatgccacgccgaggatttcttgaaacatatcagctatttttgtggatcatacgacaaggtggaagacttcaagcgtcttgacattatgattcgcgaaaaggagaatgcttttaagggccctgaaaagggtggaaaccgtctcttctacctcgctcttccgccatccgttttcgcgactgtctgtgaaagcatttacaagggcgtgatgccgcaagaagtagggggatgggttcgggtgatcatcgagaagccctttggccgcgatactgagagctccgcggagctgtcacgagcgctggagccgttcttcaacgagtcacagatctaccgcattgatcactacctcgggaaggagatggtgcagaacatcattacaacacgcttcgccaaccgtattttcagcgctgtgtggaactcgagcaacatcgcgtgcgtgcagatcaccttcaaggagaccataggcactgagggccgtggtggctacttcgacagcatcggcattattcgcgacgtcatgcaaaaccatctcacacaaattcttgcattgctggcgatggagaagccgcggacgcttgacgccgagtgtatccgtgacgagaaagtgtcagtactgaaacacattgaaccagtaaccaaggagaattgtgttctggggcagtacactgcctccgccgatggctccattcctggctacctggaagacgagaccgtacccaagggcagcacttgccctacatttgctgtgatgcggcttaacatcaacaacgaccgctgggccggcgttccttttattctcaaggccggcaaggctgtggagcagaagtacgtagcaattcgcattcagttcaaggacgaggtacacccctacggtgaggcgacacagcgcaacgagctcgtcatccgtgcccagccgtccgaggccatgtatgtcaagatcaccacaaaggttcctggcctgagcggtgacttgcgacaaacgcaccagacagagctggacctcacatatcacacccggtacgatgtgcgccttccagatgcctacgaaagccttctcaatgacgcacttctggggagctcgacaaattttgtgcgcaaggacgagcttgacgtggcatggcgcatcttcacaccgcttctgcaccagatcgaccgtggagagatcaaacccattcagtaccaggccggtacgcgtgggcccaaggaagcggatgagttcatcatcagcaacggctttaagcaccagaaaggctatcactggcttcccttcaacaaactgtgaaaggaggcgaatcagtctgttttacagtcgcctgctgatgacagcgagagacgcagagcgtctcacgctgatgagtgtcatatgcggtcaggaatcactgatggcgctctgccatatgcacacacgggcaacacacgagagtgaagacagacatcacgc

SEQ ID NO: 2736 - protein, 562 aa, Leishmania mexicana
MSEEQFAASQEAYVADVDSILDVLRAQVLERKPDNVLQFISKSALSLQKDSSSESCDLISCKVKDEQKSRSLTIIVFGASGDLAKKKTFPALFSLYCGGLLPPDVNIIGYARTKVDDAEKWKHETLMKHFSNLSERECHAEDFLKHISYFCGSYDKVEDFKRLDIMIREKENAFKGPEKGGNRLFYLALPPSVFATVCESIYKGVMPQEVGGWVRVIIEKPFGRDTESSAELSRALEPFFNESQIYRIDHYLGKEMVQNIITTRFANRIFSAVWNSSNIACVQITFKETIGTEGRGGYFDSIGIIRDVMQNHLTQILALLAMEKPRTLDAECIRDEKVSVLKHIEPVTKENCVLGQYTASADGSIPGYLEDETVPKGSTCPTFAVMRLNINNDRWAGVPFILKAGKAVEQKYVAIRIQFKDEVHPYGEATQRNELVIRAQPSEAMYVKITTKVPGLSGDLRQTHQTELDLTYHTRYDVRLPDAYESLLNDALLGSSTNFVRKDELDVAWRIFTPLLHQIDRGEIKPIQYQAGTRGPKEADEFIISNGFKHQKGYHWLPFNKL

SEQ ID NO: 2737 - DNA, 1494 bp, Dictyostelium discoideum
  CDS (1)..(1494)
atgacatcaacaccagactctcgttcagttttaacagtaattattttaggtgcatcaggtgatcttgcaaagaaaaagacctatccagcactctttggtttatatcttagagatttgttaccaagcaacacaatcatttatggttatgctagatcacatattgaaattggtgatttcaaagctagaatctcaaaaggattaaaaggtgatgaagaaaagaaaaaacaatttttaaatttattacattatcattcaggtaaatatgatgaaaaagcatcctatgatgaatttgaaaaattaattttagcagaagaaaagaaacaacaaggtgttgataaattcaatcgtttattctatatggcaattccaccatcaattttcattgaagttagtattggtattcatggttcattgatctcaaagaatggttggtcaagagttatcgttgagaaaccatttggacgtgatttagcatcctcaagagagttggttagtgaattgggtaaacttttcaaagagaaagatttattccgtatcgatcattatttgggtaaagagatggtacaaaatttaatggtattaagattcgccaatgcagtattcgagccattatggtcaaaatcacatatctcttcaatcaccatcacattcaaagaagacattggtaccgagggtagaggtggttatttcgatcaatttggtatcattagagatgtaatgcaaaatcatttgcttcaagtactctctttggttgcaatggagccaccagtgtcattgaatgccgatgatatcaccaatgaaaaggttaaattacttcgttgtattcaaccaattaaaatgagtgaagttgtactcggtcaatatacttccgatcctgaaggtaaaattccagcctatttagatgatgaaggtgttccaaaggattcaaccactccaacctatgctgccgctgttttccatatcaataatccaagatggagaggtatgccattcatcttaaaatgtggtaaagctttagatgaaagaaaaactgaagttagaattcaattcaaacgtccagataactttttattctctgatgatgatatctcaagaaatgaattagttatgagaattcaaccaggtgaagctgtttacttaaaattattatcaaagaaaccaggtttagaaaataaaattgaacaaactgaattagatttatcatatcgtcatagatttgaaaatcttgatttaccagatgcatatgaacgtttaattcttgattcaattaaaggtgatcataaccttttcgtcagagatgatgaattagatgttgcatggcaaatatttacaccattactcgatcaaattgaaaaagaaaagattaaacctgaaccatattcctttggttcacgtggtccaaaatctgctgatgaattatcaaagaaatttggtttcattagatccttaggttataattggccaggtaattctccacaaggtagtaaaaaataa

SEQ ID NO: 2738 - protein, 497 aa, Dictyostelium discoideum
MTSTPDSRSVLTVIILGASGDLAKKKTYPALFGLYLRDLLPSNTIIYGYARSHIEIGDFKARISKGLKGDEEKKKQFLNLLHYHSGKYDEKASYDEFEKLILAEEKKQQGVDKFNRLFYMAIPPSIFIEVSIGIHGSLISKNGWSRVIVEKPFGRDLASSRELVSELGKLFKEKDLFRIDHYLGKEMVQNLMVLRFANAVFEPLWSKSHISSITITFKEDIGTEGRGGYFDQFGIIRDVMQNHLLQVLSLVAMEPPVSLNADDITNEKVKLLRCIQPIKMSEVVLGQYTSDPEGKIPAYLDDEGVPKDSTTPTYAAAVFHINNPRWRGMPFILKCGKALDERKTEVRIQFKRPDNFLFSDDDISRNELVMRIQPGEAVYLKLLSKKPGLENKIEQTELDLSYRHRFENLDLPDAYERLILDSIKGDHNLFVRDDELDVAWQIFTPLLDQIEKEKIKPEPYSFGSRGPKSADELSKKFGFIRSLGYNWPGNSPQGSKK

SEQ ID NO: 2739 - DNA, 1503 bp, Xylella fastidiosa
  CDS (1)..(1503)
atgctgctcacgcaaacaaaaacacccccacaccaacaaacgttaacatccaaatccgagaccaggtccatgcacaacaccctcttattgtttggcgccaccggcgacctcgcccaacgctatctcttcccctccttactgcaactgtttactgatggcttattgccacaagacttccgcattcgtgctctggccttgtcaccccataacaccacacaattccgcgacatcctgcgcacgcgcttggaacaagcactacccatcgccaacaccgcgcacatccaagccctactacaacgtgtcgactacctttccgtagacttgaacgacccaacatcaatcgccgaagcagtccgagatctgacggaacatccctgcatcagctacttggcaatcccaccaggcctgtataccaacaccgccctaggattggcacaaggaggggcactgcagacaccacaccgattgatgctggaaaaaccgatcggacgcgactcaataaacgcacgcgaaatcctaaacaccatcggcacactgattgacgaagatcgcatcttccgcgtagaccactatctaggcaaagcagcagtgcagaacctcgtcgcactgcggttcggaaacaccctgctagaagcggtatggaaccgaaaccacattgagtccgtacacatcctcatcgccgaaaccgaaggcgtcgatggccgcaatgcttactacgcacgtgctggcgcactacgtgacatgatgcaaagccacatcctgcaactcctatgcctggtcgctatggaacccccggtctctatggaagccgaccgcatacgcgacgaaaaagtcaaagtcctgcgcgcactacgcccactgaacgcccaaaacgccgcaatgcacagcgtgcgcggacgctacagcgcgggcaccattaacagccaaccagtgccagcctatcaaccaccagaaggcagcaatgtagagacctttgtcggtgtcaccgcatacatcgacaactggcgctgggcgggcgtaccgttccatctatgcacaggaaaacgcttggccgaacgctcaacccaaatcgtcgtcaccctcaaacccgtcacacactggctatttgaacgtccaaaccggaacaatgcagcaccaaaccgcctgtgcttcaaactacagccccaggaaaatatcgaactaaacctgatgagcagcctggccggccccgaatggggaaccctagaactgcaaccgctggaattggagttatccgtcccaaccgggaaacatcgccacatcgcctatgagcgccttttcctcgacgcattcaacggcaaccctgcgctatttgtacgtcacgacgaagtcacagaagcctgggcttggatcgacagcatcagcaatgcctgggaactgtccgacttaccactgcaaccctaccccgccggcggctggggcccacctcaagcccaccaatttctgccgccattggggattgatggccatggaaacaacgcatga

SEQ ID NO: 2740 - protein, 500 aa, Xylella fastidiosa
MLLTQTKTPPHQQTLTSKSETRSMHNTLLLFGATGDLAQRYLFPSLLQLFTDGLLPQDFRIRALALSPHNTTQFRDILRTRLEQALPIANTAHIQALLQRVDYLSVDLNDPTSIAEAVRDLTEHPCISYLAIPPGLYTNTALGLAQGGALQTPHRLMLEKPIGRDSINAREILNTIGTLIDEDRIFRVDHYLGKAAVQNLVALRFGNTLLEAVWNRNHIESVHILIAETEGVDGRNAYYARAGALRDMMQSHILQLLCLVAMEPPVSMEADRIRDEKVKVLRALRPLNAQNAAMHSVRGRYSAGTINSQPVPAYQPPEGSNVETFVGVTAYIDNWRWAGVPFHLCTGKRLAERSTQIVVTLKPVTHWLFERPNRNNAAPNRLCFKLQPQENIELNLMSSLAGPEWGTLELQPLELELSVPTGKHRHIAYERLFLDAFNGNPALFVRHDEVTEAWAWIDSISNAWELSDLPLQPYPAGGWGPPQAHQFLPPLGIDGHGNNA

SEQ ID NO: 2741 - DNA, 1506 bp, Vibrio parahaemolyticus
  CDS (1)..(1506)
atgatggtaataccagaaaacagcagcatcgttatttttggtgcttcaggtgaccttacatatcgtaagctcattcctgctttataccacctttatgcgaacaagcagcttccagagagttttgccattcttggcgtaagtcgtactgaatacagtgacgagtcctaccgcgagaagctgaaaaaatcgcttcaagaaatggaaaaaaccgagccagaaacgcttgatgcatttatcaaccatctgcattaccaagcaattaacacttctgacacgcaagattacagcaagctggcaacacgtttagaccaacttgccgacgaatatcaattcgaacaacgtaatacgcttttctacctagctacacctccaagcctatacagtgtgatccctgcaagccttgcagcacatggtttgaacaatgaggaagatggctggaaacgtctgatcatcgagaaaccgttcggttacgaccttgagtcagcacgcacgttggataaagaaattcacgagcacttccaagaacatcaaatctaccgtatagaccattatttaggtaaagagacggttcaaaacctgcttgttttccgtttctctaacgcgatgtttgaaccgctttggaaccgtaacttcattgattacgtggaaatcacaggcgctgaattccttggcgtagaagagcgtggtggttactacgacaactctggcgctgtgcgcgatatgttccaaaaccacttgctacaagtattggcaatggtcggtatggaaccaccagcacaaatcaacgcagattcaatgcgtgatgaagtggtgaaagtgcttcaatgcctaaaaccactggatgaaacagcattacgtaacgatcttgtccttggtcagtacactgcatcagacgtacgcggccaacaccttccgggttaccgtgaagaaaacggcgtagcggacgattctcgtactgagacgtacattggtctaaaagcttacatcaacaactggcgttggaatggtgtacctttctatgtacgtacaggtaagcgtcttccgactcgcgttactgaagtggttattcactttaaacaaacaccgcacccagtgtttggccaaaatgcgccagaaaacaaactgatcattcgtattcagccagacgaaggcattcagatgagctttggtttgaaagaaccaggtgcaggctttaatgcgaaggaagtgaaaatgaacttccactacgcagacctgcaagagactcaaatgctaactgcgtacgagcgtcttctacttgatgctctaaatggcgatgcgacgctatttgcacgtagcgatgcagttgaagcatgttggcagtacgttcagccaattttagacttcaaacaagatcctcaatcactcttcggatacgcatgtggtacatggggtcctaaagagtctgatgacttgcttcagcgtgacaaccgcgcttggcgtttcccatgtaaaaacctaacagatacggactactgtgaactatga

SEQ ID NO: 2742 - protein, 501 aa, Vibrio parahaemolyticus
MMVIPENSSIVIFGASGDLTYRKLIPALYHLYANKQLPESFAILGVSRTEYSDESYREKLKKSLQEMEKTEPETLDAFINHLHYQAINTSDTQDYSKLATRLDQLADEYQFEQRNTLFYLATPPSLYSVIPASLAAHGLNNEEDGWKRLIIEKPFGYDLESARTLDKEIHEHFQEHQIYRIDHYLGKETVQNLLVFRFSNAMFEPLWNRNFIDYVEITGAEFLGVEERGGYYDNSGAVRDMFQNHLLQVLAMVGMEPPAQINADSMRDEVVKVLQCLKPLDETALRNDLVLGQYTASDVRGQHLPGYREENGVADDSRTETYIGLKAYINNWRWNGVPFYVRTGKRLPTRVTEVVIHFKQTPHPVFGQNAPENKLIIRIQPDEGIQMSFGLKEPGAGFNAKEVKMNFHYADLQETQMLTAYERLLLDALNGDATLFARSDAVEACWQYVQPILDFKQDPQSLFGYACGTWGPKESDDLLQRDNRAWRFPCKNLTDTDYCEL

SEQ ID NO: 2743 - DNA, 1533 bp, Pseudomonas syringae
  CDS (1)..(1533)
atgggtctgtcgcgcggcagtgccgagcaaaaagccgaagttgcgcccccaaccaccctgtttctgttcggtgcacatggtgacctggtcaagcgtctgctgatgccggcgctttacaacctgtcgcgcgacggtctggtggatgaagggctgcacatcgtcggcgtcgatcacaacgcgatcagcgatgcggacttcgccaaaaaactcgaaaatttcattcgcgacgaggccgccggcaaaattgccggcggtggcaaggaccctctcgatcctgcgttgtggggcacgctggccgagcgtatcagctatgtgcagggtgactttctggatgattcgacctatcaggacatcgccagcaagattgagagcaccggtgcgaaaaacgcggtgttttatctggccaccgcgccgcggttcttcagcgaagtggcccagcgcctggggtcgtccggtttgctgcaggaaaccgatgacgggttccgccgggtaatcatcgaaaagccgttcggctccgatctggccagtgcagtggcgctcaatggctgcctgctcaaggtcatgagcgaaaaacagatctaccggatcgaccattacctgggcaaggagacggtgcagaacattctggtcagccgtttctccaatggcctgttcgagtcgttctggaacaaccactacatcgaccacgtgcagatcaccgccgcggaaaccgtgggtgtcgagacccgtggcagtttttacgagcacaccggtgcactgcgcgacatggtgcccaatcacctgttccagttgctggcgatggtcgcgatggagccccccgcggccttcggtgccgacgcggtccgtggcgaaaaagccaaggtggtgggcgcgatcaggccgtggaacaaagaggaagcactggccaattcggtacgcggtcagtatgcgcagggcacgatgggcgacaaggaggttgtcggttatcgccaggaagatcgggtcgagcctgacagtacgacggaaacctatgtggcgctcaaggtcatggtcgacaactggcgctgggtgggcgtgcctttttatctgcgcacaggcaagcgcatgagtgcccgcagcactgaaatcgccatctgcttcaaacctgcgccctatgcgcaatttcgtgacaccgaagtcgatcgtttgaagcccaactacctgcgcatccagattcagcccaacgaaggcatgtggttcgatctgttcgccaaacggcccggcccgacgctggacatggaggacatcgcgctgggttttgcctataaggacttcttcgagatgcagccttcgaccggctacgaaacccttatatacgactgtctgaccggcgaccagaccctgtttcagcgtgccgacaacatcgaaaacggctggcgtgctctgcagccgtttcttgatgcctgggccagccagcctgaagttcagccgtatgaggctggcaagaacggacctgatgcgggtgacgagttgctgagccgtgatggtcgcgagtggagagatctgaatgtctga

SEQ ID NO: 2744 - protein, 510 aa, Pseudomonas syringae
MGLSRGSAEQKAEVAPPTTLFLFGAHGDLVKRLLMPALYNLSRDGLVDEGLHIVGVDHNAISDADFAKKLENFIRDEAAGKIAGGGKDPLDPALWGTLAERISYVQGDFLDDSTYQDIASKIESTGAKNAVFYLATAPRFFSEVAQRLGSSGLLQETDDGFRRVIIEKPFGSDLASAVALNGCLLKVMSEKQIYRIDHYLGKETVQNILVSRFSNGLFESFWNNHYIDHVQITAAETVGVETRGSFYEHTGALRDMVPNHLFQLLAMVAMEPPAAFGADAVRGEKAKVVGAIRPWNKEEALANSVRGQYAQGTMGDKEVVGYRQEDRVEPDSTTETYVALKVMVDNWRWVGVPFYLRTGKRMSARSTEIAICFKPAPYAQFRDTEVDRLKPNYLRIQIQPNEGMWFDLFAKRPGPTLDMEDIALGFAYKDFFEMQPSTGYETLIYDCLTGDQTLFQRADNIENGWRALQPFLDAWASQPEVQPYEAGKNGPDAGDELLSRDGREWRDLNV

SEQ ID NO: 2745 - DNA, 1470 bp, Pseudomonas syringae
  CDS (1)..(1470)
atgcccttgattacggttgaaccgtgcacatttgccctgtttggtgccctgggggacctggcggtacgcaagctgttcccggctctttatcagcttgatcgcgctggactgctgcatgaagacacaaaaattcttgccctggcgcgtgaaccaggcgacgaacagtcgcatctggcctacatcgaaaaatccatgcgccgcttcattcccgaggcggagcttgaggccgacaacgcagcgcgcttcctggcgcgcctcagctacctgcatgtcgattttctcaaggccgaggactatgttgcgctggccgagcgcgttggcaatgccgagacgctgatagcctacttcgccacgccggcctcggtgtacggcgcgatctgcgagaacctcgcgtcggtgaacctggccgagcgcacacgcgccgtcctggaaaagcccatcggccatgacctggcctcgtcgcgacgggtcaacgacgccgttgcgcagttcttcccggaaaaccgcgtctaccgaatcgaccattacctgggcaaggacacggtccagaacctcattgccctgcggttcgccaacagcctgttcgagacccagtggaaccagaaccatatttcccacgtggaaatcacggttgccgagaaagtcggcattgagggccgctggggctacttcgatcaggccggccagctgcgcgacatgattcagaaccacctgctgcagttgctctgcctgatcgccatggacccgcccagcgacctgtcggccgacagtattcgtgacgagaaggtaaaagtgctcaaggcactggccccgttcacccccgagcgtctggccacccaggtggtgcgcggtcagtacaccgctggctacagcgaaggcaaggcagtgccgggttatctggaagaagagaactcaaacacccagagcgacaccgaaacctttgttgcgttgcgtgccgatatccgcaactggcgctggtcgggtacgccgttttatctgcgtaccggcaagcgcatgccgcagaaaatgtcgcagatcgtgatccacttcaaagagccgccgcactacatctttgcccctgagcagcgtttgcagatcagcaaccgcctgatcattcgtctgcagcctgacgaaggtatttccctgcaggtgatgaccaaggatcaggggctggacaaaggcatgcagctgcgcagcggccccttgcaactgaatttttccgacacctaccgcagcgctcgtgtccccgacgcttatgagcggttgttgctggaagtcatgcgtggcaatcagaacctgtttgtccgcaaagatgaaatcgagtacgcctggcaatggtgcgatcagctgattgccggctggaagaaggcgggcgatgcgcccaagccttacccggccggaacctgggggccaatgagctccattgccctgattactcgcgacgggagatcctggtatggcgatatgtga

SEQ ID NO: 2746 - protein, 489 aa, Pseudomonas syringae
MPLITVEPCTFALFGALGDLAVRKLFPALYQLDRAGLLHEDTKILALAREPGDEQSHLAYIEKSMRRFIPEAELEADNAARFLARLSYLHVDFLKAEDYVALAERVGNAETLIAYFATPASVYGAICENLASVNLAERTRAVLEKPIGHDLASSRRVNDAVAQFFPENRVYRIDHYLGKDTVQNLIALRFANSLFETQWNQNHISHVEITVAEKVGIEGRWGYFDQAGQLRDMIQNHLLQLLCLIAMDPPSDLSADSIRDEKVKVLKALAPFTPERLATQVVRGQYTAGYSEGKAVPGYLEEENSNTQSDTETFVALRADIRNWRWSGTPFYLRTGKRMPQKMSQIVIHFKEPPHYIFAPEQRLQISNRLIIRLQPDEGISLQVMTKDQGLDKGMQLRSGPLQLNFSDTYRSARVPDAYERLLLEVMRGNQNLFVRKDEIEYAWQWCDQLIAGWKKAGDAPKPYPAGTWGPMSSIALITRDGRSWYGDM

SEQ ID NO: 2747 - DNA, 1458 bp, Pseudomonas putida
  CDS (1)..(1458)
atggagagtggtggtttgactattccttgcgacattctggtcttcggcggcaccggtgatctggccctgcacaaattgcttccggcgctctaccacctgtttcgcgaggcccgtctgaaccctgccgtgcgggtcatcgcactggccaggcgcaacctgccacgcatcgactatctgaagctcgccgaacgccattgtcgggcgcagattgcccgcagcgacttcgacgaagaggtgtggcagcggttttccgcacgggtcgactacttcccgatggatgcttcacagagcgccgacttcggccgcctggcacgctacctgggcgaacccggtggactgacacgcatcttctacctggccaccgctcccaacctgttcgtgccgattgccaaccacctgcgcattgccggactggccgacaccgaagcgcgcatcgtgctggaaaaaccgatcggccattcgctggaatcggccactgccatcaatgaagcgattggcacggtgttcgaagaaagacaggtgttccgcatcgaccactacctgggcaaggaaaccgtgcagaacctgatggccctgcgttttgccaatgccctgctggagccggtgtggcgcaacaaccaggtcgaccatgtccagatcagcgtttgcgagacactgggcgtagaaaaccgcggtgcctactacgatcgcgccggggctattcgcgacatgctgcagaaccacctgctgcagctgctgtgcctggtggccatggagccacccgcgcaattcgaggcagaggcggtacgcgacgaaaaggtgaaaatcctgcgcgccctcaagccgatcaccggccaggatgtgcaggacaagacggtacgcggccaatatggggccgggcgtatcggcggccaggaagtgccggcctactactttgaaaaggacgtcgacaacgacagcgataccgaaactttcgtggccatcgaggcgcatatcgacaactggcgctgggcgggcgtgcctttctatctgcgcaccggcaaacgcatggcgcggcgcgcttcgcagatcgtcatccagttcaagccagtgcctcacgaactgttcagcggcggccaggtcaaccagttgctgatacagctgcaaccggacgaacgcatcagcctgcgcatgatgaccaagagcccaggcaagggcatgcgcctggaacccgtggacctggaccttaatctggcccaggtgttcagccagactcgccgctgggaagcctacgagcgtctgctgctggatgtgctcgaaggtgattcgacactgttcatgcgccgcgatgaagtggaagcagcctgggcttgggtagatccaatcatcaagggctgtgaagagcacttccaggcgccccgcccctacccggctggcagtttcgggcccgaacaagccaacagcctgctcgccaggcatggcaggcactggcatggctga

SEQ ID NO: 2748 - protein, 485 aa, Pseudomonas putida
MESGGLTIPCDILVFGGTGDLALHKLLPALYHLFREARLNPAVRVIALARRNLPRIDYLKLAERHCRAQIARSDFDEEVWQRFSARVDYFPMDASQSADFGRLARYLGEPGGLTRIFYLATAPNLFVPIANHLRIAGLADTEARIVLEKPIGHSLESATAINEAIGTVFEERQVFRIDHYLGKETVQNLMALRFANALLEPVWRNNQVDHVQISVCETLGVENRGAYYDRAGAIRDMLQNHLLQLLCLVAMEPPAQFEAEAVRDEKVKILRALKPITGQDVQDKTVRGQYGAGRIGGQEVPAYYFEKDVDNDSDTETFVAIEAHIDNWRWAGVPFYLRTGKRMARRASQIVIQFKPVPHELFSGGQVNQLLIQLQPDERISLRMMTKSPGKGMRLEPVDLDLNLAQVFSQTRRWEAYERLLLDVLEGDSTLFMRRDEVEAAWAWVDPIIKGCEEHFQAPRPYPAGSFGPEQANSLLARHGRHWHG

SEQ ID NO: 2749 - DNA, 1506 bp, Pseudomonas putida
  CDS (1)..(1506)
atgactaaacagacccttgcggccgcccccccttgtaccctgttcctgttcggcgccaatggcgacctggtcaagcgcctgctgatgcccgcgctgtacaacctcagccgtgacggtttgctggaccgtaacctgcgcatcgtcggcgttgaccataacccggccagcgccgaggatttcgccgcgcgcctgcacgcgttcatggtcgagcgtgacaaaggcggcgagggcagcgccaagtgcctggacgagaagctatgggcccgcctggccaagcgcctcgattaccagacgggcgactttctcgatccggccacctaccaggccctggccaggcgcatcgacaagacccgccacggcaatgccattttctatctggccacgtcgccgcgcttcttccccgaggtggcgcagcgcctggggcaggccggcttgctggacgagtctgccggcggctttcgccgggtggtggttgaaaaaccgttcggcaccgacctggccagcgccgaggcgctcaacgcctgcctgctgaaggtgatgggcgagcggcagatctaccgcatcgaccattacctgggcaaagagacggttcagaatattctggtcagccgcttttccaacggcttgttcgaatcgttctggaacaatcactacatcgaccacgtgcagatcaccgcagcggaaaccgtcggtgtcgagacccgtggtgcgttctatgacagcaccggcgccctgcgcgacatggtgcccaaccacctgttccagttgctggcgatggtggccatggagccgccggccgcgttcggcgccgatgcggtgcgcggtgaaaaggccaaggtggtcggcgctattcgcccatggtcggcaaaaatggcccagaagaattccgtacgaggccagtacagagccggcaagcaggggcgcaagccgttgccaggctaccggcaggagcccaacgtcgcgccggatagccagaccgagacctacgtggcgctgaaggtgatgatcgacaactggcgctgggccggcgtgccgttctacctgcgcaccggcaagcgcatgagcgtgcgtgacaccgagattgccatctgcttcaagcccgcaccgtatgcgcagtttcgcgagtcggagctggaacggcccaaacccaactacctgaaaatccagatccagcccaatgaaggcatgtggttcgacctgcaagccaaacggcccgggccagagctggtgatggagaatgtcgagttgggttttgcctacaaggacttcttcaagatgaccccggccactggctacgagacgctgatctatgactgcctgaccggtgaccagaccctgttccagcgggctgacaacatcgaaaacggttggcgagcggtgcagccgtttctcgatgcctgggcccagggcggcgaagtgcatgagtactcggctggcgaagatgggcctgaggccggcaatgaattgctgacccgcgacaagcgggagtggcaccggttggggtga

SEQ ID NO: 2750 - protein, 501 aa, Pseudomonas putida
MTKQTLAAAPPCTLFLFGANGDLVKRLLMPALYNLSRDGLLDRNLRIVGVDHNPASAEDFAARLHAFMVERDKGGEGSAKCLDEKLWARLAKRLDYQTGDFLDPATYQALARRIDKTRHGNAIFYLATSPRFFPEVAQRLGQAGLLDESAGGFRRVVVEKPFGTDLASAEALNACLLKVMGERQIYRIDHYLGKETVQNILVSRFSNGLFESFWNNHYIDHVQITAAETVGVETRGAFYDSTGALRDMVPNHLFQLLAMVAMEPPAAFGADAVRGEKAKVVGAIRPWSAKMAQKNSVRGQYRAGKQGRKPLPGYRQEPNVAPDSQTETYVALKVMIDNWRWAGVPFYLRTGKRMSVRDTEIAICFKPAPYAQFRESELERPKPNYLKIQIQPNEGMWFDLQAKRPGPELVMENVELGFAYKDFFKMTPATGYETLIYDCLTGDQTLFQRADNIENGWRAVQPFLDAWAQGGEVHEYSAGEDGPEAGNELLTRDKREWHRLG

SEQ ID NO: 2751 - DNA, 1470 bp, Pseudomonas putida
  CDS (1)..(1470)
atggccgcaatcagtgtcgaaccttgcacctttgccctgtttggcgccctcggcgacctggcattgcgcaagctgtttcctgcgctctaccagctcgaccgggccaacctgttgcacccggacacccgcctgctggccctcgcccgtgaggtcggcagtgcgcaggagcacctggacagcatcgaagcccacctgcgccggcacgtgcccgaggcagatatcgagcctgctgcgctggggcgcttccttgcccgcctgaattaccagcacctggacttccttcagcccgagggctatcaggccctggccgagcagctgccgggcgagctgccgctgatcgcctacttcgccacggcggcggcggtgtatggggccatctgcgaaaacctcgacaaggtcgggctggctgcgcgcacccgggtagtgctcgagaaacctattggccacgacctggagtcgtcgcgccgggtcaacgacgccgtggcgcggttcttccctgaaagccgggtttaccgcattgaccattacctgggcaaagagacggtgcagaacctgattgccctgcgcttcgccaatagcctgttcgaaacccagtggaaccagaattccatctcccatgtggagattaccgtcgcggaaaaggtcggtatcgagggccgttggggttatttcgacaaggccggccaactgcgcgacatgatccagaatcacctgctgcagttgctgtgcctgatcgccatggacccgcccagcgaactgtccgccgatgccatccgcgacgagaaggtgaaagtgctcaaagccctggcaccgatcactggcgacggcctgagcaccagcgtggtgcgcggccagtacattgccggctacagcgaaggcaagccggtgccgggttacctggaagaagacaacgccaacgcccagagcgacaccgaaaccttcgtcgccctgcgcgccgacatccgtaactggcgctggtcgggcgtgccgttctacctgcgaaccggcaagcgcatgccgcaaaaactgtcgcagatcgtcattcacttcaaggaaacgccgcactacatcttcgccccggaacagcgtttgcagatcggtaacaagctgatcatccgcctgcaaccggacgaaggcatttctttacgggtgatgaccaaggagcagggcctggacaagggcatgcaactgcgcagtggcccattgcagctgaatttttccgatgcctggcgcagtgcacgaattccggatgcctacgagcggctgttgctcgaagtgatgcgcggcaaccagaacctgttcgtgcgcaaggacgaaatcgagtatgcctggaagtggtgcgaccagttgatcgccggctggcgtaatgcgggcgatgcgcccaagccatacgcggcgggctcctgggggccgatgagctcgattgcactgatcacacgcgatgggagggcgtggtatggggatatctga

SEQ ID NO: 2752 - protein, 489 aa, Pseudomonas putida
MAAISVEPCTFALFGALGDLALRKLFPALYQLDRANLLHPDTRLLALAREVGSAQEHLDSIEAHLRRHVPEADIEPAALGRFLARLNYQHLDFLQPEGYQALAEQLPGELPLIAYFATAAAVYGAICENLDKVGLAARTRVVLEKPIGHDLESSRRVNDAVARFFPESRVYRIDHYLGKETVQNLIALRFANSLFETQWNQNSISHVEITVAEKVGIEGRWGYFDKAGQLRDMIQNHLLQLLCLIAMDPPSELSADAIRDEKVKVLKALAPITGDGLSTSVVRGQYIAGYSEGKPVPGYLEEDNANAQSDTETFVALRADIRNWRWSGVPFYLRTGKRMPQKLSQIVIHFKETPHYIFAPEQRLQIGNKLIIRLQPDEGISLRVMTKEQGLDKGMQLRSGPLQLNFSDAWRSARIPDAYERLLLEVMRGNQNLFVRKDEIEYAWKWCDQLIAGWRNAGDAPKPYAAGSWGPMSSIALITRDGRAWYGDI

SEQ ID NO: 2753 - DNA, 1485 bp, Lactobacillus plantarum
  CDS (1)..(1485)
atgagtaacgaaaaaattgccttattcaccatctttggcggtactggtgacctcgcacagcgtaaactgtacccgtcactatttaagctctatcaaaagggctatctcaaggaccactttgccgttattgggacggctcggcgtccttggactgatgatcactatcatgaagttattagtgactccctagctgatctgaatgctgatcaggaaacggtgacgcaatttgcgagccatttttattatcaatcgcatgacgttactgatgctgaacattaccgaactttgaaaaaattatcagaaaagctggacgcccaatatggtttacaaggcaaccggatcttctacttagcaatggcaccaaacttcttcggtacgattgcccaacacttacgttccgaaaatattctgacagataacggttttaaccgcgtcattatcgaaaagccttttggtcatgattatgaaagtgccaaggaacttaacgaccaattaacggctacttttaacgaaaatcagatttatcgaattgaccactaccttggtaaagaaatgattcaaaatatcacggccattcgttttggcaataatatttgggaatcattatggaacaaccgttacatcgacaatgtccaaattacgttaagtgaaaaactgggtgtcgaagaacgggccgtttactatgataacagcggtgccttgcgggatatggtccaaaatcacattttgcaaattttgagtctgttaacaatggatcaaccagttgaattcactgaaaatgatatcgacgtggaaaaggtcaaggctttacggagcttacgaccacttaaaccagaagaagtcgcaaccaactttgtccgtggtcaatacggtgccggcgatgatgctaaagcttaccgcgacgaagataagatttcatcagattctaacaccgatactttcgtcgctggtaaagtcatgatcgataattatcggtggtccggagtgccgttttacatccggactgggaaacgcttagccgataagttcacgcgaatcgacgtggtgttcaaacggccagtcgtcaatatcttcaatcatgaagacgtccgagctaatgacgacgcagcaaccagtctcgatccaaacatcttgacaatcaacgttgaaccgactgaaggcttcgagctccgcatgaatgctaaagcaatcggccaaggcttcgcaaccaccccggtcaagttgaattattctcacgatgctgaagccacggctggtagcccagaagcttacgaacgtttgcttcacgatgccttaaatggcgacgcaaccaactttacccactggcaagaggttgccgattcgtggaaattcgttgacgtcattcaaaaatactgggatgaacatcaacccgaatttccaaactaccgccctggtacaatgggaccagatgcggccgatgaattattacgtcaagatggtcaccgctgggtctaccgcaactag

SEQ ID NO: 2754 - protein, 494 aa, Lactobacillus plantarum
MSNEKIALFTIFGGTGDLAQRKLYPSLFKLYQKGYLKDHFAVIGTARRPWTDDHYHEVISDSLADLNADQETVTQFASHFYYQSHDVTDAEHYRTLKKLSEKLDAQYGLQGNRIFYLAMAPNFFGTIAQHLRSENILTDNGFNRVIIEKPFGHDYESAKELNDQLTATFNENQIYRIDHYLGKEMIQNITAIRFGNNIWESLWNNRYIDNVQITLSEKLGVEERAVYYDNSGALRDMVQNHILQILSLLTMDQPVEFTENDIDVEKVKALRSLRPLKPEEVATNFVRGQYGAGDDAKAYRDEDKISSDSNTDTFVAGKVMIDNYRWSGVPFYIRTGKRLADKFTRIDVVFKRPVVNIFNHEDVRANDDAATSLDPNILTINVEPTEGFELRMNAKAIGQGFATTPVKLNYSHDAEATAGSPEAYERLLHDALNGDATNFTHWQEVADSWKFVDVIQKYWDEHQPEFPNYRPGTMGPDAADELLRQDGHRWVYRN

SEQ ID NO: 2755 - DNA, 1440 bp, Clostridium tetani
  CDS (1)..(1440)
atgaaaaataaagccattaccatatttgggggaacaggagatttagcctatcgaaaattattcccttctctatataatttatatatgttagggagtattaatgatgaatattctattataggaattggtaggagagattatacaaaagaggattatttaacttatattcaagcaggagttaaaaagtttgccagaataaattatagtgatgataagtttgataagttttctaaaattataacctattataaaatggatattcaaaaggaagaagaatataagggtttaattaaatattataaagataaagatattattaaaaatcatatttactattatgcagttgcaccaagattttttattccaataactaaaggattaaaaaataataaatgttaccttaaagatgcaaaagttattattgaaaagccttttggagaagatttagaatcagctacttacctaaatgaacagctttcttttgtatttaaggacaagaatatttatcatattgatcattatttaggcaaagaaatgatacaaaatattataaatataagatttgccaacgcaatatttaaaggaatttggaacaaagattttattgagaatatacaaattaatgcttttgaaagcataggtgttaacaatagaggtggctattatgaccaaagtggtgcattaaaagatatggttcaaaatcatctatttcaattattgtccatagtagctatggaagaacccaaagaatttaatagtgattttattcatgaagctcaactcaaggtattaactgaaatgaagccaatagaggatagggatattgataattacttagttatgggtcaatatgaaggatatagggaagaaaaagatgttaatctaaaatcaaaaacagaaacttatgttgctatgaaaataataattgataatgaaagatggcaaggtgtacctttctatattcgtacaggtaaaaagctaaataagagagaaacggaaattataattaaatttaaatcaacaaataaaaatatagaaggaaatttattaattataaaaattcaaccagatgagggaatttatttaaaatttaatataaagaaacctggtactgtggatgagattcaaaaagtaagtatggatttttgtcaaagctgtattttagagaatagaattaatacgccagaagcctatgaaagattattaaaagcatgtatggattcagatagaagtttattttcaaaatgggagcaaattgtagtaagttggaaatatatcaacaaagttttagaaagttatagatcttattcaaataaactttataggtataagccggagacaattggaccaaaggaggcagaagagttagttaaaaaggataatcattattggataaatgatgaaagtaatagttgcttaaaacaaggagaggatagttaa

SEQ ID NO: 2756 - protein, 479 aa, Clostridium tetani
MKNKAITIFGGTGDLAYRKLFPSLYNLYMLGSINDEYSIIGIGRRDYTKEDYLTYIQAGVKKFARINYSDDKFDKFSKIITYYKMDIQKEEEYKGLIKYYKDKDIIKNHIYYYAVAPRFFIPITKGLKNNKCYLKDAKVIIEKPFGEDLESATYLNEQLSFVFKDKNIYHIDHYLGKEMIQNIINIRFANAIFKGIWNKDFIENIQINAFESIGVNNRGGYYDQSGALKDMVQNHLFQLLSIVAMEEPKEFNSDFIHEAQLKVLTEMKPIEDRDIDNYLVMGQYEGYREEKDVNLKSKTETYVAMKIIIDNERWQGVPFYIRTGKKLNKRETEIIIKFKSTNKNIEGNLLIIKIQPDEGIYLKFNIKKPGTVDEIQKVSMDFCQSCILENRINTPEAYERLLKACMDSDRSLFSKWEQIVVSWKYINKVLESYRSYSNKLYRYKPETIGPKEAEELVKKDNHYWINDESNSCLKQGEDS

SEQ ID NO: 2757 - DNA, 1512 bp, Bradyrhizobium japonicum
  CDS (1)..(1512)
atgacaaaagacccgcaagccaagcgcaagccggaaaattgcgccttcgtcatctttggcgtgaccggagaccttactcatcgccttgtgatgccctcgctctacaatctcgcggccgagcacctgttaccggaaaagttctgtgtcgtcggcgtggcccgcaagggccaatcggatgacgagctgcgcagcagcctgttgaagggcctgcgccagttcgcgacgcgacccgtggacgacgatatcgcccagaagctgctgcaatgcctgaccttcgtcgaggccgacccgaaggactcgccgtccttcgaccgcttgcgcgagcatctggattcgctggaatgcgcgcaggacaccggcggcaaccggctgttctatctggcaacgccgcccgccgcgttcgcgccgaccgcgcgcgagctcggccgcaccggcatgatggaggagaacggcgcctggcgacgcctcgtgatcgaaaagccgttcggcaccgatctcgcctcggcacgcgcgctgaacgccgagctcctgaagatcatggacgagcaccagatctaccggatcgatcactatctcggcaaggagacggtgcagaacattttggtgctgcgctttgccaacggcatgttcgagccgatctggaatcgcaaccacatcgaccacatccagatcacggtggaagagaagctcggcgtcggccatcgcggcggcttctacgacgccaccggcgcgctgcgcgacatggtaccgaaccatctgttccagctgatgtcgctggtcgcgatggagccccccgcccgcttcgacgcgcattccgtgcgctccgagaaggccgacgtgctcacctcgatccagcagcccagccgggaagaggcgctgaagaattcagtgcgcgcgcaatatctcgccggccgcatcggcgacgaggagatcacggactatcgcaagaccgaggacgtcaagcccggcagcaccaccgagacctttgtcgcgctcaagctgatgatcgacaattggcgctgggccggcgtccccttctacttgcgcaccggcaaggcgctgggtcacaagcgcaccgaagtcgcgatcaagttcaagcaggcgccgctgtcgatgttttcgggcacggacgtcgaccgcctgtcgcagaacttccttaccatcggcatcgcgccgaccgagaccatcgagcttcagttcaacgccaagattccgggcccgagcatcaccatcgacggcgtcgagatgaagttccgctatggcgactatttccgcgtcgatccctcgaccggctacgagacgctgatctacgactgcatgatcggcgacaacatactgttccagcgcgccgacggcatcgaggccggatggcaggcggtgcagccgttcctggacgcctggaagagcgagggcaccaacggcatcgagacctatgaagccggcagcgacggccccgcctgcgcggacgagctgctccggcgcgacggacgaagctggcggaagttttcgtga

SEQ ID NO: 2758 - protein, 503 aa, Bradyrhizobium japonicum
MTKDPQAKRKPENCAFVIFGVTGDLTHRLVMPSLYNLAAEHLLPEKFCVVGVARKGQSDDELRSSLLKGLRQFATRPVDDDIAQKLLQCLTFVEADPKDSPSFDRLREHLDSLECAQDTGGNRLFYLATPPAAFAPTARELGRTGMMEENGAWRRLVIEKPFGTDLASARALNAELLKIMDEHQIYRIDHYLGKETVQNILVLRFANGMFEPIWNRNHIDHIQITVEEKLGVGHRGGFYDATGALRDMVPNHLFQLMSLVAMEPPARFDAHSVRSEKADVLTSIQQPSREEALKNSVRAQYLAGRIGDEEITDYRKTEDVKPGSTTETFVALKLMIDNWRWAGVPFYLRTGKALGHKRTEVAIKFKQAPLSMFSGTDVDRLSQNFLTIGIAPTETIELQFNAKIPGPSITIDGVEMKFRYGDYFRVDPSTGYETLIYDCMIGDNILFQRADGIEAGWQAVQPFLDAWKSEGTNGIETYEAGSDGPACADELLRRDGRSWRKFS

SEQ ID NO: 2759 - DNA, 1497 bp, Bacteroides thetaiotaomicron
  CDS (1)..(1497)
atggataaatttgcaatgattatttttggtgcttcgggcgacttgactaaacgcaagttgatgcccgcattgtactctctgtatcgggataaacggctgacggggagttttactgttctgggaattgggcgtactgtctattctgatgaagattaccgttcatatatacttggggagttgcagcagtttgtaaaggctgaagagcagaatttggagctgatgtcttcttttgtgtctcatttgtattatttgccgatggatcctgcgaaagtggagggatattcgcagttgcgggagcgtttggtagagcttacgaaggaggtcgatccggataatttgttgttctatctggctactccgccttcgctgtatggggtggtgcctttgcatttgaaggcggccgggctgaatactcctcattctcgtattattgttgagaagccgttcgggtatgatctggagtcggcgcttgagttgaataagatttactcttctgtgtttgatgagcatcagatttatcgtatcgatcattttctgggcaaggagacggcgcagaatgtgcttgctttccgtttcgccaatggtatttttgagccgttatggaatcgtaattatattgattatgtggagattactgctgtagagaatctgggtattgagcagcgcggaggtttttacgagacggcgggggctttgcgggatatggtgcagaatcacctgattcagctcgtagctcttacggctatggagccgccggcggtattcaatgcggataatttccggaatgaggtagtgaaggtttatgagtcgctgactccgcttacggagacggacttgaatgaacatatcgttcgcggacaatatacggcttcgggcaataagaaggggtatcgtgaggaaaagggagtggctcccgactcgcgtacggagacttatattgcgatgaagctgggcatcagtaactggcgttggagcggggtaccgttctacatccgcaccggtaagcagatgccgacgaaggtgacggaaattgtcgttcacttccgcgagacgccccatcagatgttccgctgttccggcggtaactgtccgagggctaataagttgatccttcgtttgcaaccaaacgagggtattgtgttgaagatcggaatgaaggttccgggtgcaggtttcgaagtccgtcaggtgacgatggatttcagttacgcacagttgggcggcgtgccgagcggtgacgcttatgcccgtctgattgacgactgcattcagggagatccgaccttatttactcgaagtgatgctgtagaggcttcctggaacttctttgatccggtcttacgttattggaaagataatccggacgcacctttgtacggctatccggcaggtacgtggggacctctcgaaagtgaagctatgatgcacgagcatggggcagactggaccaatccgtgtaagaatttaacaaatacagaccaatattgcgaactatga

SEQ ID NO: 2760 - protein, 498 aa, Bacteroides thetaiotaomicron
MDKFAMIIFGASGDLTKRKLMPALYSLYRDKRLTGSFTVLGIGRTVYSDEDYRSYILGELQQFVKAEEQNLELMSSFVSHLYYLPMDPAKVEGYSQLRERLVELTKEVDPDNLLFYLATPPSLYGVVPLHLKAAGLNTPHSRIIVEKPFGYDLESALELNKIYSSVFDEHQIYRIDHFLGKETAQNVLAFRFANGIFEPLWNRNYIDYVEITAVENLGIEQRGGFYETAGALRDMVQNHLIQLVALTAMEPPAVFNADNFRNEVVKVYESLTPLTETDLNEHIVRGQYTASGNKKGYREEKGVAPDSRTETYIAMKLGISNWRWSGVPFYIRTGKQMPTKVTEIVVHFRETPHQMFRCSGGNCPRANKLILRLQPNEGIVLKIGMKVPGAGFEVRQVTMDFSYAQLGGVPSGDAYARLIDDCIQGDPTLFTRSDAVEASWNFFDPVLRYWKDNPDAPLYGYPAGTWGPLESEAMMHEHGADWTNPCKNLTNTDQYCEL

SEQ ID NO: 2761 - DNA, 4583 bp, Mus musculus
  CDS (119)..(2488)
agagcttcatctggaagtgctggtccccagattggccatgaggggaccaaatgcagaccagggttgactgacaccaggttgtgttctttgcctgcactggcacacaggcatttggaagatgctcctagcggcaatgtgcttggcccttctgggctgcctacaggcgcaggaactcaagggtcatgtttccataatcctgctgggagcaaccggggacctagctaaaaagtacctgtggcagggactgtttcagctatacctggatgaggctgggaagggccacagtttcagcttccacggtgctgccctgacagccccccagcaaggccagaagctcatggacaaggccttggaatccctctcctgtcccaaggacttggtacccagtcgctgtgatgaactcaagggtcagtttctacagctgagccaataccaccagctgaagacagtggaggactatcagaccctcaacaaggatattgagacccaggtccagcaggatgggctctgggaggcaggcaggatcttctacttcagtgtgccgccctttgcctacgcagacattgcccgtaacatcaacagcagctgccgaccacacccaggtgcctggctacgggttgtttttgaaaaaccctttggccatgaccacctctcagcccagcagctggcttcagaacttggaagctttttccaggaggaggagatgtaccgtgtggatcattacctcggcaagcaggcggtggctcagatcctgcccttccgagatcagaaccgcaaggccttggatggcctctggaacaggcaccatgtggagcgggtggagatcattttgaaggagaccatagatgcggaaggtcgggccagtttctatgaggagtatggcgtcatccgtgacacgctgcagaaccacctgactgagatcctcacgctggtggccatggaactgcctctcaacatcagcagctcagccaccgtgctccagcataagctctgggccttccaggccctgcgggggctgcagaagagcagtgccatcctgggccagtaccaggcctacagcggacaggtgcgccgagagctgcagaagccagacggcttccagagcctgacaccaaccttcgcaggtgtccttgtccacatcgacaacctgcgttgggagggtgtccctttcatcctgatgtctggcaaggccttggatgagagagtgggctatgttcggattgtgtttaagaatcgggcgtactgcacccagagcgagagacactgggtgccggagcagagccggtgcctgccccagcagattatcttctacattggacacggtgagctgggccaccctgccattctggtcagccggaacctgttcaaaccctcactacccactcagaagtggaaggaggtgcaggaccagcctgggctccgcctgttcggccgtcctctgtctgattactacgcctacaggcctgtgcgggagcaagacgcctactccaccctcctgtcgcacatcttccactgccgaaaggagtccttcatcaccaccgagaacctcttggcctcctgggtcttctggaccccgttactggacagcctggcctttgaagttccacgcccgtacccagggggagccgagaatggccagctgctggacttcgagtttagcggtggtcagctgaccttctcccagcagcagctggaggtgctgataccagatctaggctcagtcccaaagcccagtgacttccaggtcctcggggcccggtatagacagagcccactgattaccgcctggccagaggagctgatctctaagctggccagtgacattgaagccgccgcggtgcaggcggtacggcacttcggcaagttccacctggcactgtcaggtggttcgagccccatagctctcttccagcagctggccacagggcattacagcttcccctgggcccacacacacctctggctggttgatgagcgctgtgtccctctctcagatccagactccaacttccagggcctgcaggctcacctgctacagcacgtcagggtaccctactacaacatccacccaatgccagtgcacctgcaccagcggctctgtgccgaggaggaccagggagctcagacctatgccagtgagatctcagccctggtggccaacagcagcttcgacctggtgctcctgggcatgggcaccgacgggcacacggcttctctgttcccacagtcccccacaggcctggatggtgatcagctggtggtgctgacggagagcccgttcaggccacaccaacgcatgagcctcagcctgcccctcatcaaccgagccaagaaggtagctgtcctggtcatgggcaggacaaaacgtgagatcacaacgttggtgagccgcgtgggccatgaacccaagaagtggcccatctcaggtgtggtgcctctttctgggcagctggtttggtacatggattacgaggcctttctgggatgacagtaccatcctggtcttagtcactctcagccttcctctttagctgcccactgtgcctcagctgtgtggagcctggtaccagagtcaggccccagagaagggaggacaaaactctgtgccgacttcctggacccactggttctcgggaatttcggtgcctgcacatggaaacaaggtagagctctggcctcaaaacccaggtaggagagggactaaggcctccagcagttacacaccagtagctacaacacacagtaagactgggcgaaggctccacgctaaagaaccaaagtggcctgccaagactggcctgcaatcttcaaactggtttctgtggaaagaggggccagtgttgatggggagcagggtgcagagactcctggtgaatgtcttgctctgagccaggccagcagagtagacacaatcctgagcctgcaccgggcgccttgcctcttctggtatcccatcatccctctgtgcacctagctgagatccagcgctcctccgggcagcttctgtctactctgggaggacacccactgtcctcagtattccccattacccctcagcctctccctctctacagacacagacactgccacgtcagaagttcccccagatctagagaccggggctccctttcccactaagaactgttatgctgtcattgggctgtcgggcatctctgatctaactagacgggagggctctgtctgctcctgggtcgggggtgactccagatcacagcctctttctagggcttatgtggccaattgccagcatcagggcagactgcagctagccctcctcacactacctctctctggcttcaagtctggcagcagcccctcctctgccgggcatctccaccattcttactgacgaacctggtaccactgggaacactacaggcagctcctaacttcagtcccctccagggccaacaacataaacatttcagggcacatacagttttcatttaggcctcctgctgagtcatgtgaacaagggaaggcccagaagggttaggatggcccgtcctcacagttacctatgtgtcagtcacagagtctccgtgtctttcagaattttcccatagagaggtttcctgtgatgaggagcgtcaggaaatctgtttctctccttttatttgattgtactttctcccagacagcacatggaaaagaattcttgctttcactagagatgtgtgcatagagtgtagcctgagctgagggctctgtatgaaaggcactcttgttgaaattctgcttactctgacctccagtgacccagactgacagaacacctctattccttggcagaaaagaggaacgccctggggtcctttcctggcctgctttgctcaggcttggatgcaggtagtcgcaggtgaagttccacctttagccatgtgggggagcccacgtgccaccactcacattccacccaggaggcgggttttagtgccaaacgtcttttcttcgcttttcttgctcactgcctctcaggcgtcttagcccagtgcgttttcatcagttcttagggactcggccttctgcagttgcaacatcagagagcaaggggccttgcatgcctcaggagagagggtgcccaggctctgtgtcaccattctgaataacggtgagtcactgcccagcctgagcctagaatgtcccgttcttatccagatgaatgactcgcctctgtctgtggggagtctctgcacaggggaggccagtgtgggggaaataccaaagatctcctttccggaagcaagcacaaataaaatttcattggaaaggttggtgggggacattgtctgtgttctctggcatgcacctgtgcgtgccctttccctttctgccccgggttaggaaggagtgatgttcagagccaggaccacggaagatgctgctcttcagactttctgaaccatcatccacagccagcagggctttaccaatcagtcacatctgtgtacgaatctgtctcaggaaggagctctcagccttaagacctgggataccctctattttttaaaaattttcattaaaaaattgttgcttgcaaaccacttaaaaaaaaaaaaaaa

SEQ ID NO: 2762 - protein, 789 aa, Mus musculus
MLLAAMCLALLGCLQAQELKGHVSIILLGATGDLAKKYLWQGLFQLYLDEAGKGHSFSFHGAALTAPQQGQKLMDKALESLSCPKDLVPSRCDELKGQFLQLSQYHQLKTVEDYQTLNKDIETQVQQDGLWEAGRIFYFSVPPFAYADIARNINSSCRPHPGAWLRVVFEKPFGHDHLSAQQLASELGSFFQEEEMYRVDHYLGKQAVAQILPFRDQNRKALDGLWNRHHVERVEIILKETIDAEGRASFYEEYGVIRDTLQNHLTEILTLVAMELPLNISSSATVLQHKLWAFQALRGLQKSSAILGQYQAYSGQVRRELQKPDGFQSLTPTFAGVLVHIDNLRWEGVPFILMSGKALDERVGYVRIVFKNRAYCTQSERHWVPEQSRCLPQQIIFYIGHGELGHPAILVSRNLFKPSLPTQKWKEVQDQPGLRLFGRPLSDYYAYRPVREQDAYSTLLSHIFHCRKESFITTENLLASWVFWTPLLDSLAFEVPRPYPGGAENGQLLDFEFSGGQLTFSQQQLEVLIPDLGSVPKPSDFQVLGARYRQSPLITAWPEELISKLASDIEAAAVQAVRHFGKFHLALSGGSSPIALFQQLATGHYSFPWAHTHLWLVDERCVPLSDPDSNFQGLQAHLLQHVRVPYYNIHPMPVHLHQRLCAEEDQGAQTYASEISALVANSSFDLVLLGMGTDGHTASLFPQSPTGLDGDQLVVLTESPFRPHQRMSLSLPLINRAKKVAVLVMGRTKREITTLVSRVGHEPKKWPISGVVPLSGQLVWYMDYEAFLG

SEQ ID NO: 2763 - DNA, 1485 bp, Staphylococcus epidermidis
  CDS (1)..(1485)
atgagtactaaacaaaaacacattccctgtttgattacaatattcggtgccacaggagatttgagtcatagaaagctatttccttctatattccatttatatcaacaagacaatttagatgaacatattgctattattggtataggacgtcgcgattataataacgaacaatttcgcgaccaagttaaaacgtcaattcaaacttatgttaaagatacagatagaattgatgagtttatgacgcatgttttttatcataaaactgacgtgagtgataaagaaagttatcagtcattacttcaatttagtgagcgactagattcagaatttgctttaggtgggaatcgtctgttttacttagcgatggcaccacaattttttggagtgatctcagattaccttaaatcttctggtcttactcaaactacaggatttaaacgcttagttatagagaaaccatttggcagtgatcttaaatctgctgaatcattaaataatcaaataagacgttcgtttaaagaagaagaaatttatcggatagatcactatcttggcaaagatatggtgcaaaatatagaagttttgcgattcgcaaacgcgatgtttgaacctttatggaataataaatacatttcaaatattcaagttacatcatcagaagtattaggtgtcgaagatcgtggtggctactatgaatctagtggtgcacttaaagacatggtacaaaatcacatgctacagatggttgctttacttgcaatggaagcaccgataagtttgaatagtgaagatatacgtgcagaaaaagtcaaagtacttaaatctcttagacaattaaaaccagaagaagttaaaaagaatttcgtgcgtggtcaatatgatcaaggcaatatagatggtaaacaggttaagtcatatcgagaagaagatcgcgtagcaaaggattcggttacaccgacatttgtatcgggtaaattaacaattgataactttagatgggctggagttcctttctacattagaacgggtaaacgtatgaaatcaaaaacgatacaagtcgtagtagaatttaaagaagtacctatgaatttatattatgaaactgacaatttactagattctaatttgctagtcattaatattcaaccaaatgaaggaatttcattgcatttaaatgctaaaaagaacattcaaggaattgatactgagccagtgcaattatcatacgcaatgagtgctcaagataaaatgaatacagttgatgcatatgaaaacttattgtttgattgtcttaaaggtgatgcgactaattttacacattgggaagaattaaaatctacttggaaatttgtagatgcaatccaagatcaatggacaatggttgaaccatgtttccctaactatgaagcgggtacaaatggacctcttgaaagtgatcttttattaagtcgtgatggaaatcattggtgggatgatatccactaa

SEQ ID NO: 2764 - protein, 494 aa, Staphylococcus epidermidis
MSTKQKHIPCLITIFGATGDLSHRKLFPSIFHLYQQDNLDEHIAIIGIGRRDYNNEQFRDQVKTSIQTYVKDTDRIDEFMTHVFYHKTDVSDKESYQSLLQFSERLDSEFALGGNRLFYLAMAPQFFGVISDYLKSSGLTQTTGFKRLVIEKPFGSDLKSAESLNNQIRRSFKEEEIYRIDHYLGKDMVQNIEVLRFANAMFEPLWNNKYISNIQVTSSEVLGVEDRGGYYESSGALKDMVQNHMLQMVALLAMEAPISLNSEDIRAEKVKVLKSLRQLKPEEVKKNFVRGQYDQGNIDGKQVKSYREEDRVAKDSVTPTFVSGKLTIDNFRWAGVPFYIRTGKRMKSKTIQVVVEFKEVPMNLYYETDNLLDSNLLVINIQPNEGISLHLNAKKNIQGIDTEPVQLSYAMSAQDKMNTVDAYENLLFDCLKGDATNFTHWEELKSTWKFVDAIQDQWTMVEPCFPNYEAGTNGPLESDLLLSRDGNHWWDDIH

SEQ ID NO: 2765 - DNA, 1590 bp, Yersinia pestis
  CDS (1)..(1590)
atgaccttttttgacgcatttttatctgggtttactggctatagtcaaagagagtacattagtaatgtaagaaaattacaaatatcctgcaacgaggagaatagcatggcagtaatgaatacagtccaggtagcccaggcgtgtgacctggtgattttcggcgctaaaggtgatttggctcgccggaaactgctgccttctctttaccaattagaaaaagcgggtcatatccacccagatactcggataatcggtgttggccgtgctgagtgggataaagatgcgtacaccgctgtggtaaaggaagccctcgatacctttatgaaagagccgctggatgacgagctatggcaaaaactcagctcgcgcctcgacttctgcaatctggatgtgaatgacagtaagcatttcaccaaattaggtaaaatgctcgatcaaaaacatcgcaccacgattaactactttgctatgccgccgagtacatttggtgcgatttgtaaaggcctgggagaagccgggttaaacaaagagcctagccgagtggtaatggaaaaaccattgggaaccgatttagcgccctcaagggtaattaacgatcaggtagccgagtatttcaacgaatgtcaggtttaccgtattgaccactatttagggaaagaaacggtattaaacctgttggcgcttcgcttcgctaactcgttgttcgcctcaaactgggacaaccgcactatcgatcatgtgcaaattaccgtcgcagaagaggtcggaattgaagggcgttggggctattttgatcaggccggtcagatgcgtgacatgatccaaaaccatctgttgcaaatcctgacgatgatcgccatgtcaccccccgcagatctcagtacggatcgcatccgtgatgaaaaagtaaaagtactgcgttcgctgcgccgtattgatcacaccaatgtgcgcgaaactacagttcgtgggcaatatactgccggctttgtacagggcaataaagtgccgggttatctggaagaggaaggcgcgaataagaatagcaataccgaaacatttgtgtctattcgggtggatatcgatgactggcgttgggctggggtacctttctacctgagaaccggtaagcgcctacccagcaaatgctctgaagttgtggtttactttaagaaccccgcactgaatctcttccgcgaatcttatcaacaactgccacaaaacaaactgacaattcgtttgcaaccggacgaagggatcgaaattgaagtgctgaataaagtccccggattggaacataagcatcgtttacaaaccactaagcttgatctcagtttctccaaaaccttcaatgagcagcatattgctgatgcctatgaacgtctgctactggagaccatgcggggtattcaagcgctgtttgtgcgccgtgatgaggtcgaagaggcgtggaaatgggtcgattctattatgaatgcgtgggcggcagataatgaagcaccaaaaccataccagtccggtacatgggggcctgtggcatccgttgctatgatcacccgtgatggccggtcatggaatgagttcgagtaa

SEQ ID NO: 2766 - protein, 529 aa, Yersinia pestis
MTFFDAFLSGFTGYSQREYISNVRKLQISCNEENSMAVMNTVQVAQACDLVIFGAKGDLARRKLLPSLYQLEKAGHIHPDTRIIGVGRAEWDKDAYTAVVKEALDTFMKEPLDDELWQKLSSRLDFCNLDVNDSKHFTKLGKMLDQKHRTTINYFAMPPSTFGAICKGLGEAGLNKEPSRVVMEKPLGTDLAPSRVINDQVAEYFNECQVYRIDHYLGKETVLNLLALRFANSLFASNWDNRTIDHVQITVAEEVGIEGRWGYFDQAGQMRDMIQNHLLQILTMIAMSPPADLSTDRIRDEKVKVLRSLRRIDHTNVRETTVRGQYTAGFVQGNKVPGYLEEEGANKNSNTETFVSIRVDIDDWRWAGVPFYLRTGKRLPSKCSEVVVYFKNPALNLFRESYQQLPQNKLTIRLQPDEGIEIEVLNKVPGLEHKHRLQTTKLDLSFSKTFNEQHIADAYERLLLETMRGIQALFVRRDEVEEAWKWVDSIMNAWAADNEAPKPYQSGTWGPVASVAMITRDGRSWNEFE

SEQ ID NO: 2767 - DNA, 1530 bp, Synechococcus elongatus
  CDS (1)..(1530)
atggtaaccctatttgaaaatcccctgcgggttggactacgccaagagcgaaccccagagccgctgattttagtcatttttggtgccagtggcgaccttactcagcgcaagctgattccctcgatttatcaactgagactcgaacgccgtctgccccccgaactgaccattgttggcgtggcgcggcgcaactggagtcatgactattttcgcaagcacctccgtcaaggggtcgaggagtttggtggcggcattcaggcggaacccctgtggcaggaatttgcccaaggtttgttttattgctctggcaatatcgatgatcccgccgcctacacccagctgaaaacactgctagctgagctagatgaaaaacgccaaactcgcagcaatcgcgtcttttaccttgcggtctcaccgagctttttcgttgaggccattcagcaactgggggcagcggggctattgagtgatccccaaaaacatcgtcttgtgattgaaaagccctttggccgtgatctcacctctgcccaagccctcaatgaggtggtgcagtcggtgtgcaaggaggagcaagtttaccgcattgaccactacctcggtaaagagacggtgcaaaacctgatggtgtttcgctttgccaatgccatttttgaacccctctggaaccgccagtacgtggatcatgtgcagattactgttgctgaaaccgtcggggtggaagatcgcgcgggctactatgaaactgcgggtgccctgcgggacatggtgcaaaaccacattctccagttgctggctctgaccgcgatggaaccccccaatgccctcgatgccgatagtctgcgtagcgaaaaggtgaaagtcctccaagctacccgtttagcggatcttgataatctcgatgcctgtgctgtccgcggccaataccgagccggctggatgaagggcaaacctgttgtgggctatcgtcaggagccgggggtgagtcctacctccaccactcccacctatgcggccctaaaactagggattgataactggcggtggcagggggtgcccttctatgtgcgcacgggtaaacgcttggcaaaaaaggtcacagaaatctcaattcagtttcgtggggtgcctttactgattttccagtcggccgcccgccaaaccaatcccaatatcctgacgatgcgcattcaacccaatgaagggattgctctgcgctttgaggcaaaaatgccgggtgcagatctgcgcacacgcacggtggaaatggactttagctacggctcctcctttggaatggccacagcggatgcctatgcgcggttattactggactgcatgttgggggaccaaaccctgtttacgcgcgcagatgaggtagaggcggcttggcgggtggtgatgccggttttaacggcttgggacgcccccacagatccagaggccatacccacctatgacgcggggacttgggggcccgatgcggcagaagtgatgattaatgccgatggccggcgctggcggcgactttga

SEQ ID NO: 2768 - protein, 509 aa, Synechococcus elongatus
MVTLFENPLRVGLRQERTPEPLILVIFGASGDLTQRKLIPSIYQLRLERRLPPELTIVGVARRNWSHDYFRKHLRQGVEEFGGGIQAEPLWQEFAQGLFYCSGNIDDPAAYTQLKTLLAELDEKRQTRSNRVFYLAVSPSFFVEAIQQLGAAGLLSDPQKHRLVIEKPFGRDLTSAQALNEVVQSVCKEEQVYRIDHYLGKETVQNLMVFRFANAIFEPLWNRQYVDHVQITVAETVGVEDRAGYYETAGALRDMVQNHILQLLALTAMEPPNALDADSLRSEKVKVLQATRLADLDNLDACAVRGQYRAGWMKGKPVVGYRQEPGVSPTSTTPTYAALKLGIDNWRWQGVPFYVRTGKRLAKKVTEISIQFRGVPLLIFQSAARQTNPNILTMRIQPNEGIALRFEAKMPGADLRTRTVEMDFSYGSSFGMATADAYARLLLDCMLGDQTLFTRADEVEAAWRVVMPVLTAWDAPTDPEAIPTYDAGTWGPDAAEVMINADGRRWRRL

SEQ ID NO: 2769 - DNA, 1473 bp, Shewanella oneidensis
  CDS (1)..(1473)
atgggcaaaacaacatcaggcgccaaagcttgtgacttcgtactctttggtactaaaggtgacttagcaagacgtaagttattaccttctttataccagttagataaggctgagcttctcgataaagatactaaggtgataggtgtcgcaaaagatgaattcagtcaggatgaatacagagacttagtcatccttgcgttaaaaaccttcgtcaaagaacccctctgcgaagacactctcaaccgattcgtgtcccgttgttattatgtaggcactaattttaccgaatcagcaggctacggtgccttccatgaattgctcaaaccagaagagcgtgtcatggtcagttactttgccacccctccatcgatttttggtgatatctgccgctgtttacatgaacaaaacctgatccacagtgactctcgcgtagtactcgaaaaacccattggctctgatctcgcatcttcccgtattattaacgatcaagtgtctgcctactttaaagaaagccaagtctaccgtatcgaccattatcttggtaaagagaccgttcaaaacttgattgcgctgcgttttgctaactccttatttgcctctaaatgggataaccggaccattgaccatgtccagatcacggttgcggaagaagtcggtattgaaggccgttggggttacttcgataaagccggtcaaatgcgcgatatgatccaaaaccacttgctacaggtgctgacgctcgtcgcaatggatccgccagtgaacttagatgctgatagtattcgcgatgaaaaggtgaaagtgcttaagtcgctgcggccgattaatgctgacaatgtgtatgaaaacactgtccgtggtcagtacagtgcgggcttcctgaaaggtagtccggtgccaggctatttagaggaagagggcgcgaacgtacagtcacacaccgaaacttttgtggcgttgcgggtcgatatcgataactggcgttgggctggggtgccgttttatctgcgcagcggtaagcgcatgccgtttaagagttctgaaattgtggtgtattttaaaaatcctccgcacaacctttaccgctctagctaccgtaacttgccacctaacaagttaaccatccgtctgcaaccacacgaaggggttgagatccagatgatgaacaaggtgccaggattagagcaaaaacaacgtttgcaaaccactaagctcgacttgagtttctcggatacctttaaaaacgagcgcattgccgatgcctacgagcgtttgttgcttgaagccatgctcggtaatcaagctttgttcgtgcgccgagatgaagtggagcaagcctggacatgggtggatggcatcatccaagcatgggaacagagcaatgagaaaccgaaaccttatcctgcgggcacttggggccctgtggcttcggtcgcgctgatcaccaaagatggtcgctcgtgggatgaatag

SEQ ID NO: 2770 - protein, 490 aa, Shewanella oneidensis
MGKTTSGAKACDFVLFGTKGDLARRKLLPSLYQLDKAELLDKDTKVIGVAKDEFSQDEYRDLVILALKTFVKEPLCEDTLNRFVSRCYYVGTNFTESAGYGAFHELLKPEERVMVSYFATPPSIFGDICRCLHEQNLIHSDSRVVLEKPIGSDLASSRIINDQVSAYFKESQVYRIDHYLGKETVQNLIALRFANSLFASKWDNRTIDHVQITVAEEVGIEGRWGYFDKAGQMRDMIQNHLLQVLTLVAMDPPVNLDADSIRDEKVKVLKSLRPINADNVYENTVRGQYSAGFLKGSPVPGYLEEEGANVQSHTETFVALRVDIDNWRWAGVPFYLRSGKRMPFKSSEIVVYFKNPPHNLYRSSYRNLPPNKLTIRLQPHEGVEIQMMNKVPGLEQKQRLQTTKLDLSFSDTFKNERIADAYERLLLEAMLGNQALFVRRDEVEQAWTWVDGIIQAWEQSNEKPKPYPAGTWGPVASVALITKDGRSWDE

SEQ ID NO: 2771 - DNA, 1476 bp, Oceanobacillus iheyensis
  CDS (1)..(1476)
atggaacaaactatacagccaagagccgttattgtaatcttcggagcaactggagatttagcaaagcgtaaattattcccttccatttatcgtttgtaccgaagcggaaaattagatgagcattttgcagtaattggtttagcacgtcgtccttggacagatgaagtacttagagaaaatgtggaaaattccatacaagatgctctttctccggatgaggatttatccgaatttatttcccatttctattataaatcttttgatgtgacggaaaaagaatcgtatcaaggacttaatgaaatcattcaaaaccttgaaggtcaataccaaacagaaggaaatagactattttatctggcaatggctccagatttctttggtgctattgcaaatcaactcaatgattatggattaaagaacacgagtggttggactagacttgtgatcgaaaaaccatttggacatgatttaccttctgctaaaaagttaaaccatgaattacaagccgcatttcgtgaagatcaaatttatcgtatcgaccactatctaggtaaagagatggtgcaaaatattgaagtaatccgttttgccaacggtatttttgaacatttgtggaataatcgctttatctcaaacatccaaattacgagtagcgaaacgcttggagtagaggaacgagcacgttattatgacacttctggtgctacgcgggatatggttcaaaatcatatgttacaaatggttgctctactggcgatggaacctccgattagtttaacaacagaggaagtacgctctgaaaaaattaaagtattgcgtgccttaagaatgatggagacaaatgaaatagatgattatttcattcgcggtcaatacggtgctggtacagttaaaggtaattctgttattggttatcaagacgaagatgaacaactagaaaattctcgtactgaaacatttgtagctggaaaacttctcattgacaattaccgatgggcaggcgttcctttctatattcgtacaggaaagcgcatgacagaaaaatccacaaaaattgtaattgagttcaaagacattccaatgaatctttattaccaaaaagatgatcaaaggaatccaaatttattggttattaatattcaaccaaatgaaggaattacgctttgcttgaatgcacgtaaatcaggtgaaggtgcactagcagagccaattcaattagcataccaccaaaatgctgtatctggaatcaatacaccagaagcatatgaaaaactaatttacgatagtatgcttggtgatgcgactaactttacccattgggatgaagttgctttatcttggcaatttgtcgataagattttggaaaactggtcagaaaatcaaccagcattccctaattatcgttctggatcgatgggaccagaagcatctgatgaactgttgaaaaaagatggtttccattggtggccaatctaa

SEQ ID NO: 2772 - protein, 491 aa, Oceanobacillus iheyensis
MEQTIQPRAVIVIFGATGDLAKRKLFPSIYRLYRSGKLDEHFAVIGLARRPWTDEVLRENVENSIQDALSPDEDLSEFISHFYYKSFDVTEKESYQGLNEIIQNLEGQYQTEGNRLFYLAMAPDFFGAIANQLNDYGLKNTSGWTRLVIEKPFGHDLPSAKKLNHELQAAFREDQIYRIDHYLGKEMVQNIEVIRFANGIFEHLWNNRFISNIQITSSETLGVEERARYYDTSGATRDMVQNHMLQMVALLAMEPPISLTTEEVRSEKIKVLRALRMMETNEIDDYFIRGQYGAGTVKGNSVIGYQDEDEQLENSRTETFVAGKLLIDNYRWAGVPFYIRTGKRMTEKSTKIVIEFKDIPMNLYYQKDDQRNPNLLVINIQPNEGITLCLNARKSGEGALAEPIQLAYHQNAVSGINTPEAYEKLIYDSMLGDATNFTHWDEVALSWQFVDKILENWSENQPAFPNYRSGSMGPEASDELLKKDGFHWWPI

SEQ ID NO: 2773 - DNA, 1344 bp, Corynebacterium efficiens
  CDS (1)..(1344)
atgactcccacaggacacgaccaccggcagaccgtgacgttctacatcctcggcggcgcgggagatctcgtgcgtcgtctgctcatccccggtatggcggggtacctccgggagtatgagggcacccggatcaacatcgtcgccacggggcgttcggagatcgacgactacccgcagctggtgcgcgattccctcgccgcagccggcacagacatcgatgaccgggtggtcgacagcctggccgggcatgcctctttcctggcgtcggatgccactgatccggccgagctgcaggagctgctcgattcccgggaacccggtgaccgcccggtgctctacttcgcgctctcgccttccgtgaccgcgcaggccgtcgatgccctggcgggggtcaccctgcccgagggcatcgtgcttgccctggaaaaacccttcggcgaggacgcggacaccgcccgcgagctcaacgagaaattgtggaaaatcaccgatgaggagcacatcttccgcgtcgaccacttcaactgcgagaccgccctgtcgaacctggtcggactgatgggcgcgaatgcgatcctctccgccgggtggaataacagggcagtcgagagcattgagatcgtctatgacgaatccctcggcctggagggacgcgccgagttctacgacagcaatggggctgtgcgcgacatgctccaatcccacctgctgcaggtcatggcacacgccctggctgccgacaccgatgacacggtcaccgacattctcgccgccacggacatcgatccgggttccgtccgtcgcgcccggtacaccgcaggcgaggcgggtggcgaacagctgccggactacgcacaggaggagggcgtggatccggagcgggggaccgagacgctcttccagctcaccgcgcacgtggacaccgaccgctggcgtggcgtgcccatcaccctgcgttccggcaaggcactggggaaaccgcgcagggagatcgccatctcctaccggcgcgagggctaccccgaggaggtcgagctgcagccgggcagccgtctggtcttccccttcaccgatgaggtggtgctcgaggcgaatgtctccgaccatggttacagccacaacctgcagcgcgttgaactgcgcaccgaactggtgccctcgaagctgtcggcctacggccgggtggtgcgtgccatcctcgacatgagcgacaccgccgaggtgcccgccgacgccccggcccgggcctgggagatcgtggagcccgtgctcaccgcgttcgccaacgacgaggtcccgctggaggagtacccggcggggtcagcgggacctgcgggctggtag

SEQ ID NO: 2774 - protein, 447 aa, Corynebacterium efficiens
MTPTGHDHRQTVTFYILGGAGDLVRRLLIPGMAGYLREYEGTRINIVATGRSEIDDYPQLVRDSLAAAGTDIDDRVVDSLAGHASFLASDATDPAELQELLDSREPGDRPVLYFALSPSVTAQAVDALAGVTLPEGIVLALEKPFGEDADTARELNEKLWKITDEEHIFRVDHFNCETALSNLVGLMGANAILSAGWNNRAVESIEIVYDESLGLEGRAEFYDSNGAVRDMLQSHLLQVMAHALAADTDDTVTDILAATDIDPGSVRRARYTAGEAGGEQLPDYAQEEGVDPERGTETLFQLTAHVDTDRWRGVPITLRSGKALGKPRREIAISYRREGYPEEVELQPGSRLVFPFTDEVVLEANVSDHGYSHNLQRVELRTELVPSKLSAYGRVVRAILDMSDTAEVPADAPARAWEIVEPVLTAFANDEVPLEEYPAGSAGPAGW

SEQ ID NO: 2775 - DNA, 1545 bp, Corynebacterium efficiens
  CDS (1)..(1545)
atgagctcccacacgaatcccaccacctggattaatcccctgcgtgatccccaggacaaacgactgccccgcatcgcgggaccgtccggcctggtcatcttcggtgtcaccggtgacctcgcccgcaagaagctcctccccgcgatctatgatctggccaaccgtggtctgctccccccgggtttcgccctggtgggttacggacgccgtgactggagcaaggaggacttcgagaactacgtgcgcgaggccgtggaggccggcgcccgtaccgaattccgcggaaacgtgtgggaacgcctcgccgagggcatggaatttgtcaagggcaacttcgacgacgattccgccttcgacaatctcgcggacacgcttaagcgtctcgacgagaccaggggcaccgccggcaactgggccttctacctatccatcccgccggattccttcgcggcggtctgccaccagttggagcgctcaggtatggcggcatccacagacgaatcctggcgacgggtgatcatcgagaagcccttcggcaatgatctcaagaccgcgcatgaactcaatgagacggtcaacgctgtcttccccgaggaatcggtcttccgcatcgaccattacctgggcaaggaaaccgtccagaacattctggccctgcgtttcgccaaccagctgttcgagccgttgtggaactccaattatgtcgatcatgtgcagatcaccatggcggaggacatcggattggggggacgcgccggttattatgacggcatcggtgccgcccgtgatgtcatccagaaccacctgatccagctgctggccctggtggccatggaggagcccatctccttcacccccacccagctgcaggcagagaagatcaaggtgcttcgtgccaccaagccgagcctgccgatcgcggagaactccgcgcgtggccagtattccgccggctggcaggggtctgaatatgtcaagggtctgcgggaggaggatggtttcgatccggaatccaccaccgagacctatgccgcctgcaccctggagatcacctcccgcaggtgggcgggtgtgccgttctacctgcgcaccggcaaacgcctgggtcgtcgtgtcaccgagatcgccgtggtgttcaaggatgccccccaccagcccttcgatcccggcatgaccgcggcactcggtaacaacgccatcgtgatccgtgtgcagcccgacgagggtgtgctcatccgtttcggatccaaggtgcccggatctgccatggaggtccgtgatgtgaatatggacttctcctattccgagtccttcaccgaggaatcccccgaggcgtatgagcgtctcatcctggatgcgcttctcgatgagtccagcctcttccccaccaatgaggaagtggaactgagctggaagatcctggatccgatcctggagatctgggaggagaatggccaaccggaggagtatcccgccggcacatggggaccgaagagcgccgatgagatgctggcacgcaacggccaccagtggcgcaggccgtag

SEQ ID NO: 2776 - protein, 514 aa, Corynebacterium efficiens
MSSHTNPTTWINPLRDPQDKRLPRIAGPSGLVIFGVTGDLARKKLLPAIYDLANRGLLPPGFALVGYGRRDWSKEDFENYVREAVEAGARTEFRGNVWERLAEGMEFVKGNFDDDSAFDNLADTLKRLDETRGTAGNWAFYLSIPPDSFAAVCHQLERSGMAASTDESWRRVIIEKPFGNDLKTAHELNETVNAVFPEESVFRIDHYLGKETVQNILALRFANQLFEPLWNSNYVDHVQITMAEDIGLGGRAGYYDGIGAARDVIQNHLIQLLALVAMEEPISFTPTQLQAEKIKVLRATKPSLPIAENSARGQYSAGWQGSEYVKGLREEDGFDPESTTETYAACTLEITSRRWAGVPFYLRTGKRLGRRVTEIAVVFKDAPHQPFDPGMTAALGNNAIVIRVQPDEGVLIRFGSKVPGSAMEVRDVNMDFSYSESFTEESPEAYERLILDALLDESSLFPTNEEVELSWKILDPILEIWEENGQPEEYPAGTWGPKSADEMLARNGHQWRRP

SEQ ID NO: 2777 - DNA, 1668 bp, Bifidobacterium longum
  CDS (1)..(1668)
atgcgtacacgtttgcgtacgcgattggcccaacgcacggcacagcacacgcaatgtggcccaaatcgcagcccaaatcgcatatcgcctctagcgatagatagccgccggcgactacccttgtacattatgagtgaatcccccaattggagcaatcccctgcgcgactcgcgcgacctcagactgccccgtatcgccggcccatgcagcctcgtcattttcggtgtcacgggcgatctggcacaaaagaaactgctgccagccgtctacgacctggcgaaccgtggcctactgccgccgagcttcggtctgaccggcttcgcccgccgcgactggacacaggaacggttcatcgaattcgtcaaggccgccgtccaggcgcattgccgtacgccgttcaaggagtcgacttggcgcaatctggccgccggcatccgcttcgtgcagggtacgttcgacgacccggaggccttcgagcgcctgagcgccaccgtgcaggagcttgaccgcgaccgcggcacgcagggtaaccatgccttctacatgtcggtgccgccgcgcgcattcccacaggtcgccaagcagctggccgcctccggcctgtcgcgctcgtccgagggcgcatggcgccgcgtgatcatcgagaagccgttcggccatgatctggccagcgccaaggaactcgacagcgtggtatccgaagtgttcgacccgagctccgtgttccgcatcgaccactacctcggcaaggaaaccgtgcagaacctgctggccctgcgtttcgccaacgccatgtacgagccgatctggaacgccaactatgtggaccacgtgcagatcacgatggccgaggacatcggcatcggcggccgcgccggctattacgacggcatcggcgccgcacgcgacgtcatccagaaccacctgcttcagctcatggctctgaccgccatggaggagccggtgagcttcaccgccaaggacctgaccgccgaaaagaccaaggtgctttccgccgtgcgcctgcccaaggacctcgccgccaacaccgcgcgcggccagtacgccaagggctggcagggctcgcacgaagtggtcggctacttggaggaaaaaggcatcgaccccaagagcaccactgaaacgtacgccgccatccgcctcgatatcgacacccgccgctgggctggcgtgccgttctacctgcgttgcggcaagcgcctcggcaagcgtgtaaccgaaatcgccgtggtgttcaagcgcgccccgcatctgccgttcgagcagaccgccgtgcgcgaactcggcaagaacgccatcgtgattcgcgtgcagcccgacgagggcgtcaccatgcgcttcggagccaaggtgccgggcggctccaccatggaggtccgtgacgtgaacatggacttcagctacggccgctccttcaccgagaactcgccggaagcctatgagcgactgattctggacgtgctgctcggtgatccgccgttgttcccgaccaccgaagaggtgaacctcagctgggagatcctcgatccgattgaacaattctggtccacgcttggccagccgcaggcctaccgcgccggtacgtggggtccggcacaggccgacgaaatgctggcgcgcgacggccgccactggaggatgccatga

SEQ ID NO: 2778 - protein, 555 aa, Bifidobacterium longum
MRTRLRTRLAQRTAQHTQCGPNRSPNRISPLAIDSRRRLPLYIMSESPNWSNPLRDSRDLRLPRIAGPCSLVIFGVTGDLAQKKLLPAVYDLANRGLLPPSFGLTGFARRDWTQERFIEFVKAAVQAHCRTPFKESTWRNLAAGIRFVQGTFDDPEAFERLSATVQELDRDRGTQGNHAFYMSVPPRAFPQVAKQLAASGLSRSSEGAWRRVIIEKPFGHDLASAKELDSVVSEVFDPSSVFRIDHYLGKETVQNLLALRFANAMYEPIWNANYVDHVQITMAEDIGIGGRAGYYDGIGAARDVIQNHLLQLMALTAMEEPVSFTAKDLTAEKTKVLSAVRLPKDLAANTARGQYAKGWQGSHEVVGYLEEKGIDPKSTTETYAAIRLDIDTRRWAGVPFYLRCGKRLGKRVTEIAVVFKRAPHLPFEQTAVRELGKNAIVIRVQPDEGVTMRFGAKVPGGSTMEVRDVNMDFSYGRSFTENSPEAYERLILDVLLGDPPLFPTTEEVNLSWEILDPIEQFWSTLGQPQAYRAGTWGPAQADEMLARDGRHWRMP

SEQ ID NO: 2779 - DNA, 1284 bp, Rhodococcus opacus
  CDS (1)..(1284)
atgattgccggcgcacgcacttccttccggatcgacacatggaaccagctggcacgcaacttccgctatatacgaggcacatttgacgaccaatcggcctttgaggacctgaaacgcgtactagcacaattggatacgattcactccgccataggtcacgccttctacatgtcgatctccccggcgcacttttccctggtgtgcgctcagctgaactccgtgggtctcaaccaggatcgccacggataccggcgcatcgtgctggagaagccattcggcaacgacctggccagttcacgggagttgggcgccacggtggacgaggtgttcggggccggatcggtgttccgggtcgaccactatctcggcaaagagacggtccagaacatcctggcgctgcgattcgccaacgggctgttcgagccgctgtggaaccaccgccacatcgacaacatacagatcaccatggccgaggacatcggcgtcgaggggcgagccggctactacgacggtgtcggcgctgcccgagacgtcatacagaatcatttgctgcagttgttggccctcattgccatggaggagccagttggtgtcgacgcagcaagtctgtcggcggagaaggtgaaagttctctctgccacatcagcagtgagtccgctggccgacaccaccgcgcgtggtcagtactcggctaccgtccggggtgagacctacctgccggggctgctcgaggaggacggattcgatccttgctcgaccaccgagacgtacgcggccatcaccgtgcagatagcgaatcgccgctgggccggggttccgttctatctccgcgcgggtaagcgtctggccagaaggaccacggaagttgctgtgactttctcctcgccgcaccatttgaccggttccgccgaggccggcccacctccccagaatgtcttggtggtgcgagtgcagcccgacgacggaatctcgttgaggatcggagcgaagacacccggggaggggatgcgaatccaggatgtggatctgaacatgtcgttcgctgactcgttcggcgggtcctcacccgaggcctacgagcgcctgatcctcgatgtccttcgcggcgacgcctcactgttcccatcgcaggccgaggtcgacgcgtcgtgggcgattgtcgatccggtcatcgctttctgggccgagcagggccgccccgacacataccaatccggcagcgccggaccgagttcggccattcccgtcgtcactcgtacaggacgggcatggcggccgttgtga

SEQ ID NO: 2780 - protein, 427 aa, Rhodococcus opacus
MIAGARTSFRIDTWNQLARNFRYIRGTFDDQSAFEDLKRVLAQLDTIHSAIGHAFYMSISPAHFSLVCAQLNSVGLNQDRHGYRRIVLEKPFGNDLASSRELGATVDEVFGAGSVFRVDHYLGKETVQNILALRFANGLFEPLWNHRHIDNIQITMAEDIGVEGRAGYYDGVGAARDVIQNHLLQLLALIAMEEPVGVDAASLSAEKVKVLSATSAVSPLADTTARGQYSATVRGETYLPGLLEEDGFDPCSTTETYAAITVQIANRRWAGVPFYLRAGKRLARRTTEVAVTFSSPHHLTGSAEAGPPPQNVLVVRVQPDDGISLRIGAKTPGEGMRIQDVDLNMSFADSFGGSSPEAYERLILDVLRGDASLFPSQAEVDASWAIVDPVIAFWAEQGRPDTYQSGSAGPSSAIPVVTRTGRAWRPL

SEQ ID NO: 2781 - DNA, 2879 bp, Leishmania guyanensis
  CDS (205)..(1893): n means a or g or c or t/u
cgctatataagtatcagtttctgtactttattgcaacgcagcagaaagcgaataacaacagcaagaacacacaaaaacgcacgacttgagagataaaagtcggttatcctattcgggtcctcctatacaaccgtcttaatggtgttttaggtttgactctgggcaccctacattgatcactggtacatgcattaagtactcgccatgtcgtcggagcattccagtgctgatcagaattcctatgaggctgacgtgtgctgcattctggacgagctccgcgcacaggtgctggcgcagaagccggacaacgtgttgcagttcatctccaagtcagcgcttaatcttcagaaacagcgccagatggaagcgtgtgatcaaatcaccttcaaggtgaaggatgagcagaagaaccgtgcgttgaccatcattgtgatcggcgccagcggcgatctggccaagaagaagacattcccggccctctttcagctctactgcgacggattcctccccccggaagtcaacattgtcggctatgctcgcaccaaggtggatgatgtcgagaagtggaagcgtgagacgctcatgaagtactttttgaacctgtcggcgcttcgatgtcacgccgaagacttcttgaaacacattagctacttctcgggagcgtacgacaacgtggacgacttcaagcgtctcgacaagatgatccgcgagaaggaggatgctttcaagggccctgagaagggtggcgaccgtctcttttaccttgctctccccccatcagtgtttgcatgcgtctgtgggagcattcgcaagggtgccatgccgcaggaggtaggaggatgggtgcggctgatcatagagaagccctttggccacgacaccaacagttccgccgagctgtcccacgcgctggagccgttcttcgacgagtcgcagctgtaccgcattgaccactatctcgggaaggagatggtacagaacatcatcacgacacgcttcgccaaccgcatcttcagctctttgtggaactcgagcaatatcgcttgcgtgcagatcacgttcaaggagacgatcggcaccgagggccgtggcggctacttcgatagcattggcattattcgtgacgtcatgcaaaaccatctcacccagattcttgccctgctagccatggagaagccraagtcactcgaagccgagtgcatccgcgacgagaaggtgtcgttgctgaagtgtgttgagcccgtcaccaaggagaattgcgtgctgggccagtacactgcctccgccgacggttccatcccaggttacctggaggacgagaccgtacccaagggcagtacttgccccacgtttgccgtggtgcggctcaacatcaacaacgaccgctggtcgggagtcccttttattctcaaggctggcaaggccgtggagcagaagtacgtggcgattcgcgttcagttccacgatgaggttcacccgtacggcgatgcaacaaagcgtaacgagcttgtcattcgtgcccagccgtccgaggccatgtatgtcaagattaccacaaaagttcccggtcatagtgaggacttgcggcacacgcaccagacagaattggatctcacctaccactcccggtacagtgtgcgtctcccagacgcttacgagagcctcatcaacgacgcactgctgggcaactccacaaactttgtgcgaagggacgaactcgatgtggcgtggcgcatcttcacaccgctcttgcaccagatcgatcgtggcgaagtcgctccgattccgtaccaagccggcactcgcggacccaaggaagcggatgactttatcatcaacaacggcttcaagaaggaagaggactatcactgggctccctcgaacaagctgtaagaaaggtcaacattgcagtttgtttcacaagccccctttcgacgacagcgaagagaggcaagtggcttatatactgggaagcttgcctatccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggatgagagagtttgctgtaggcagagtgcgcggatcctcaacacgaaggcacgcgcatagagtcgatacgttaccgaattttctttcgtttcttccactccccctttgctgtttgctatgatcagcctggctttcttctctcttgcgtccgcatttgtgtgccgcttttgctgttttttcgtttcggagtctcttcttgccgccgcaccccacacgcgccactgtggcgttccgctccttcctcctccaccttcccagatgactctccctctatctctccgtctataaaccagacctttttcctcttcccttttttctattattgccacttggatatatacacttacacgtaccgtgcgcgcgatgtagcgatgngttcagtcgtctgacagcgatcgagaccagaatacatgaaacacgagatagataggcttccttttaagcagcagggatacatacgctgatcggagttacatgcaagccccgacgacaattcgaaaatgatgtgctcttgnaacagaaagaaaccaaaaaaaaaaaaaaaaaaaaaaaaa

SEQ ID NO: 2782 - protein, 562 aa, Leishmania guyanensis
MSSEHSSADQNSYEADVCCILDELRAQVLAQKPDNVLQFISKSALNLQKQRQMEACDQITFKVKDEQKNRALTIIVIGASGDLAKKKTFPALFQLYCDGFLPPEVNIVGYARTKVDDVEKWKRETLMKYFLNLSALRCHAEDFLKHISYFSGAYDNVDDFKRLDKMIREKEDAFKGPEKGGDRLFYLALPPSVFACVCGSIRKGAMPQEVGGWVRLIIEKPFGHDTNSSAELSHALEPFFDESQLYRIDHYLGKEMVQNIITTRFANRIFSSLWNSSNIACVQITFKETIGTEGRGGYFDSIGIIRDVMQNHLTQILALLAMEKPKSLEAECIRDEKVSLLKCVEPVTKENCVLGQYTASADGSIPGYLEDETVPKGSTCPTFAVVRLNINNDRWSGVPFILKAGKAVEQKYVAIRVQFHDEVHPYGDATKRNELVIRAQPSEAMYVKITTKVPGHSEDLRHTHQTELDLTYHSRYSVRLPDAYESLINDALLGNSTNFVRRDELDVAWRIFTPLLHQIDRGEVAPIPYQAGTRGPKEADDFIINNGFKKEEDYHWAPSNKL

SEQ ID NO: 2783 - DNA, 1689 bp, Leishmania mexicana
  CDS (1)..(1689): n means a or g or c or t/u, Xaa is unknown
atgtcggaagcgcaggctcgtgctgatgaggatgcttacatggccgacgtcgacagcattctggacgtgctccggacgcatgtgctggaacggaagccagatgacgttttccagttcctctccaagtcggcgctacgtctgcagaaggacagcggcgccgaattgtgcgatcgcatcaactgtaaggtaaaggatgaacagaagagccgtgcattgtctatcatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttttgtggagcgtacgacaaggtggacgacttcaagcgtcttgacgcggtgattcgagagaaggagaatgcctttaagggccctgagaagggtggaaaccgtctcttctatcytgctcttccgccctcagtgttcgcaattrtctgcgagcacattcacaagggggcgatgccgcaggaagtggggggatgggtgcgggtgatcatcgagaagccctttggcygcgataccaagagctccgccgagctttcccaagcgctggagccgttcttcgacgagtygcagctgtaccggattgacyactacctcgggaaggagatggtgcagaacatcatcacgacacgcttcgccaaccgtatcttcagcgctgtgtggaactcgagcaacattgcgtgcgtgcagatcacgttcaaggagaccatcggtaccgagggccgcggcggctacttcgacaacattggcattattcgcgatgtcatgcaaaatcacctcacccagattcttgccctgctggccatggagaagccgcggtcgctggacgctgagtgcatccgcgacgagaaggtgtcggtgctgaagtgcattgagccagtaactaaggagaattgtgttctgggccagtacactgcctccgccgatggctccatgcctggttacctacaggatgagaccgtaccccggggcagcacttgccccacatttgccgtgatgcggctcaacatcaacaacgaccgctgggccggcgtcccttttattctcaaggctggcaaggctgtggagcagaagtacgtggcgattcgcattcagttcaaggacgaggtccacccctacggcgatgcgacacagcgcaacgagctcgtcatccgcgctcagccgtccgaggccatgtatgtcaagatcaccacaaaagttcctggccttagtggggacttacggcagacgcaccagacagagctggaccttacctaccacacccggtacgatgtgcgccttccagacgcctacgagagcctcatcaacgacgcacnnnnnnnnnnnnnnnnnnnnnnnnnnnnnnnnnnnnnnnnnnnnnnnnnnnnnngcatcttcacaccgctcctgcaccagatcgacaatggagaaatccaaccgattccgtaccaggctggcacgcgcgggcccaaggaagcggatgaattcatcatcaacaacggcttcaagcaccagaaagactaccagtggactccctcgaacaagctgtga

SEQ ID NO: 2784 - protein, 562 aa, Leishmania mexicana
  Xaa is unknown
MSEAQARADEDAYMADVDSILDVLRTHVLERKPDDVFQFLSKSALRLQKDSGAELCDRINCKVKDEQKSRALSIIXXXXXXXXXXXXXXXXXXXXXXXXXXXXXXXXXXXXXXXXXXXXXXXXXXXXXXXXXXXXXXXXXXXXXXXXXYFCGAYDKVDDFKRLDAVIREKENAFKGPEKGGNRLFYXALPPSVFAIXCEHIHKGAMPQEVGGWVRVIIEKPFGXDTKSSAELSQALEPFFDEXQLYRIDXYLGKEMVQNIITTRFANRIFSAVWNSSNIACVQITFKETIGTEGRGGYFDNIGIIRDVMQNHLTQILALLAMEKPRSLDAECIRDEKVSVLKCIEPVTKENCVLGQYTASADGSMPGYLQDETVPRGSTCPTFAVMRLNINNDRWAGVPFILKAGKAVEQKYVAIRIQFKDEVHPYGDATQRNELVIRAQPSEAMYVKITTKVPGLSGDLRQTHQTELDLTYHTRYDVRLPDAYESLINDAXXXXXXXXXXXXXXXXXXXIFTPLLHQIDNGEIQPIPYQAGTRGPKEADEFIINNGFKHQKDYQWTPSNKL

SEQ ID NO: 2785 - DNA, 2916 bp, Leishmania amazonensis
  CDS (207)..(1895): n means a or g or c or t/u, Xaa is unknown
cgctatataagtatcagtttctgtactttattgcgacgtaggataaagcgaagagcagcaaaacgtactgaaaagagcggaggactctccgagcaatagaatttgctcatcttattcacccacccttatacaaccgttttgatcttatttcttgttgcctccggctaccatatattgatcggtgttatacaaattaagtaagcaccatgtcggaagcgcaggctcgtgctgatgaggatgcttacatggccgacgtcgacagcattctggacgtgctccggacgcatgtgctggaacggaagccagatgacgttttccagttcctttccaagtcggcgctaagtctgcagaaggacagcggcgccgaattgtgcgatcgcatcaactgtaaggtaaaggatgaacagaagagccgtgcattgtctatcatcgtattcggtgccagcggggatctggctaagaagaagacatttcctgccctcttcgatctgtactgtggcgggctccttcccccggaggtcaacattatcggctatgctcgcaccaaggtggacgatgtcgagaagtggaagcatgagacgctcatgaagtatttttcgaaagtgtcggagcgggaatgccacgccgaggacttcttgaaacacatcagctacttttgtggagcgtacgacaaggtggacgacttcaagcgtcttgacgcggtgattcgagagaaggaaaatgcctttaagggccctgaggagggtggaaaccgtctcttctatcttgctcttccgccctcagtgttcgcaattgtctgcgagcacattcacaagggggcgatgccgcaggaagtggggggatgggtgcgggtgatcatcgagaagccctttggccgcgataccaagagctccgccgagctgtcccaagcgctggagccgttcttcgacgagtcgcagctgtaccgcattgaccaytacctcgggaaggagatggtgcagaacatcatcacgacacgcttcgccaaccgtatcttcagcgctgtgtggaactcgagcaacattgcgtgcgtgcaaatcacgttcaaggagaccatcggyaccgagggccgcggcggctacttcgacaacattggcattattcgcgacgtcatgcaaaaccacctcacccagattcttgccctgctggccatggagaagccgcggtcgctggacgctgagtgcatccgcgacgagaaggtgtcggtgctgaagtgcattgagccagtaactaaggagaattgtgttctgggccagtacactgcctccgccgatggctccatgcctggttacctacaggatgagaccgtaccccggggcagcacttgccccacatttgccgtgatgcggctcaacatcaacaacgaccgctgggccggcgtcccttttattctcaaggctggcaaggctgtggagcagaagtacgtggcgattcgcattcagttcaaggacgaggtccacccctacggcgatgcgacacagcgcaacgagctcgtcatccgcgctcagccgtccgaggccatgtatgtcaagatcaccacaaaagttcctggccttagyggagacttacggcagaygcaccagacagagctggaccttacctaccacacccggtacgatgtgcgccttycagacgcctacgagagcctcatcaacgacgcactgctgggtaactcgacaaactttgtgcgtaaggacgagctcgatgtggcatggcgcatcttcacaccgctcctgcaccagatcgacaatggagagatccaaccgattccgtaccaggcaggcacgcgcgggcccaaggaagcggatgaattcatcatcaacaacggcttcaagcaccagaaagactaccagtggactccctcgaacaagctgtgatgaaggcagacattgcaatctatttcacagctccctgtcgacggcagcgagagaggcagggtattatacactggatgcgtgcctatccgcccctaagaaagcacgtggtcgcgctctgcggtacccaccgaccaacgctgcagatacaacacgtgccaattggcatcccgtacctctactgtctacaatccttttttttcgttctcccttgctatcgccattccccatgcgtgtgcactgcggcccagacagctagaggatgtgtgagcccgtgccgccgtacagacagtgccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgagggatagatctctggaatcttaggagaacgcgcggcacccaacacggaggcgcgcacttgatgcaaatgctgctctcgcgtttgttttccctttgccttatttttgttgtttgctttggtcggcctgttgttttcctctctcgcgcagctacctttgtatgcagatttttcattgcttgtgtcgttgctggagttgccttttgccgccgttcccccaccaccttttcagaacacacacacacacaccgcccctcgggcatttcgctcccttttcctacccccttttggccgttttcctttccaatttccgggcataaattacattcttgggttccttttttgttgtcatagtcccttgagggtgcattcccatgttccgcgagcgtggggcaacgacgtgccccagcgtccggaaaggatcgagaaaaggcccccgaaagggtcaaaaacgaagggtggccttcattcaagcagcagcgattcagatgtgtgtgggagtggcagccctttccgagtggcttcccaaacatggcatgtgctcgaaagggagccaacgagaaaaaaaaaaaaaaaaaaaaaaaaaaaaaaaaaaaaaaaaaaa

SEQ ID NO: 2786 - protein, 562 aa, Leishmania amazonensis
  Xaa is unknown
MSEAQARADEDAYMADVDSILDVLRTHVLERKPDDVFQFLSKSALSLQKDSGAELCDRINCKVKDEQKSRALSIIVFGASGDLAKKKTFPALFDLYCGGLLPPEVNIIGYARTKVDDVEKWKHETLMKYFSKVSERECHAEDFLKHISYFCGAYDKVDDFKRLDAVIREKENAFKGPEEGGNRLFYLALPPSVFAIVCEHIHKGAMPQEVGGWVRVIIEKPFGRDTKSSAELSQALEPFFDESQLYRIDHYLGKEMVQNIITTRFANRIFSAVWNSSNIACVQITFKETIGTEGRGGYFDNIGIIRDVMQNHLTQILALLAMEKPRSLDAECIRDEKVSVLKCIEPVTKENCVLGQYTASADGSMPGYLQDETVPRGSTCPTFAVMRLNINNDRWAGVPFILKAGKAVEQKYVAIRIQFKDEVHPYGDATQRNELVIRAQPSEAMYVKITTKVPGLSGDLRQXHQTELDLTYHTRYDVRLXDAYESLINDALLGNSTNFVRKDELDVAWRIFTPLLHQIDNGEIQPIPYQAGTRGPKEADEFIINNGFKHQKDYQWTPSNKL

SEQ ID NO: 2787 - DNA, 1440 bp, Chlorobium tepidum
  CDS (1)..(1440)
atgagcggcactctcgacaacttcaccatcgtcatcttcggcgcgagcagcgacctggcttcgcgcaagctttttccgtcgattttccagctcgcgcggtgggggcacatgcctgagagcttccggctgattggcgtcgggcggcaggagcaaagccacgaggagttccgcgcgttcgtccgcagtcgcctgctggagcactcgcccgaagccgccggtgacgccgcgcggctcgacgccttctgcctccgcctcttttatgcccgcgtcgatctggacgatccggcgagctacgaagtgctgcgcgacgagatcatgcgcgaggaaaaagtgggagggagcacttgccgcaacctgatgttctatctgtcgataccgccgagccttgcgcctgccgtggtgcgcaatctcggcaaggccgggctgggtggacgtgaacagtcgtgcaccgggtggcgcaagctcatcgccgaaaagccctacggccacgatctcgaaagcgcccgcgagctgaaccgcgttatcaacgaggtgttcgaggagaaccaggtctatcgcatcgaccactacctcggcaaggagccggtgcagaacatcatggtgttccgcttctcgaacggtattttcgagccgctctggaaccggcagtatatcgcgcaggtgcagatcaccatcgccgaggatttcggcatccgggatcgcggcgcgtactacgaggagtcgggacttttgcgtgacatcatccagaaccacggcttgcagttgctcacggccatcgcgatggagccgccggtcgatctcagcgccgattcgatccgcgacgagaaagcgaaagttctgcgttcggtgcggcacttcactcctgattcggttcgggagtcggtggtgatcggccaatacgaggggtaccgcaacgagaaaaatgtcgcgccggactcgaaagtcgagaccttcgctgccgtgaagtttcacgtggataactggcgttggtcgggtgtgccgttctacatgaaagcgggcaagaatctcgccaagcgcgtgaccgaaatcgtcatcaccttccgctgcccgccgcagaattattacggcccatccggcggggcggcgtgctgtacgccgaaccaggtggtactcggcatccagcccgacgaaacggttgccatccgctttggcgccaagcgccccggcgagcagatgattaccgatccggtgttcatgaagttcgactaccgcgatacttttcagggcgaaggtcttacgccgtaccaccgcctcctgctcgatgccatcgagggcaaccagatgaacttcatccgcaaagacagcgtggagtactcgtgggaaattatcgacagcctgaaaaattcaatcgacggccaggttccggagcaatatccagttcatagctgggggccggaatcgtcgaggatttacgggtga

SEQ ID NO: 2788 - protein, 479 aa, Chlorobium tepidum
MSGTLDNFTIVIFGASSDLASRKLFPSIFQLARWGHMPESFRLIGVGRQEQSHEEFRAFVRSRLLEHSPEAAGDAARLDAFCLRLFYARVDLDDPASYEVLRDEIMREEKVGGSTCRNLMFYLSIPPSLAPAVVRNLGKAGLGGREQSCTGWRKLIAEKPYGHDLESARELNRVINEVFEENQVYRIDHYLGKEPVQNIMVFRFSNGIFEPLWNRQYIAQVQITIAEDFGIRDRGAYYEESGLLRDIIQNHGLQLLTAIAMEPPVDLSADSIRDEKAKVLRSVRHFTPDSVRESVVIGQYEGYRNEKNVAPDSKVETFAAVKFHVDNWRWSGVPFYMKAGKNLAKRVTEIVITFRCPPQNYYGPSGGAACCTPNQVVLGIQPDETVAIRFGAKRPGEQMITDPVFMKFDYRDTFQGEGLTPYHRLLLDAIEGNQMNFIRKDSVEYSWEIIDSLKNSIDGQVPEQYPVHSWGPESSRIYG

SEQ ID NO: 2789 - DNA, 2187 bp, Methylobacterium extorquens
  CDS (640)..(2187)
gtgggggctggagcgcggctactgcatgatgatcggcggcgagaaggccgtggtggatcgcctcgatcccatcttcgcggccctcgcgccgggccgcggcgagattccccccacccccggccgagcggggcgggacccgcgggccgagcagggctatatccacgccggcccgagcggggcgggccacttcgtcaagatggtccacaacggcatcgagtacggcctcatgcaggcctacgccgaaggtttcgagatcctgaagcacgcggactcggccgagctgccgcaggagcagcggttcgacctcgacctcgcggacgtggccgaggtctggcggcggggcagcgtcgtgtcgtcctggctcctcgacctcaccgcgatggcgctggccaacgatccgaagctcgactcgttcgcaggctacgtcgaggattcgggcgagggccgctggaccatcaatgcggccgtcgaggaggcggtgccggcgatcgttctctcggcggcgctctacgcccggttccgctcgcgccaggaggcgagcttcgccgacaagatgctgtcagcgatgcgcaagggcttcggcggccaccaggagcccaagaagagctgaacgtgacgttcgccacgcgggagccgcgcatgatccacccgaacaccgcccccaaggcgggcgccgcgaaaccggcgccggactgcacgcttgtcatcttcggcgtcaccggcgacctgacgcaccggctcttgatgccggcgctctacaacctcgcgcggtggaagctcctgcccgaacggttcgccatcgtcggcgttggccgcagcgagatgggcaccgacgggctgcgccacgacctcaccaggaccatgcagggcttcgtcgccgagaggggcggcgagttctcagccgacagcctcgaccgggaggcctggaaccgggtcgtcggccggctggactatctcgccggcgatgtcgaagacccggcgacttacgaagagctgtcgcggcgcatcggggtctcgcgagatgcccaggccgccggcggcaacgtgctgttctaccttgcggtcgcggcccgcctcttcggtccggtggtgacgcgactcggcgaagcggggctcacccgagaaggggagggcgcctggcggcgggtgatcatcgaaaaacccttcggccacgatctcgcctcggccaaggcgctcaaccgggaggtcctcgcggccctaagcgaggaccagatcttccggatcgaccacttcctcggcaaggagaccgtccagaacatcatggtcttccggttcggcaacggcctgttcgagccgttgtggaaccgcgaccgcatcgaccacgtccagatcacggtcgctgagacggttggggtcgagaagcgcggctcgttctacgacgcgaccggcgccctccgcgacatggtgccgaaccacctcttccagctcttcaccatgacggccatggagccgccgatctccttcgacgcccacgccgtgcgcgacaagaaggaggaggtgctcatggccgtgcaccagctctccgaggacgcggccgtgcgcgaggcggtgcgcgggcgatacacggcaggcgcggtgcgcggccagcccgtccgcagctaccgcgacgagccggacgtggacccggcctcgcagaccgagacctacgtcgcgctgcgcctcatggtcgacaactggcgctgggccggcgtgccgttctacctccgcacgggcaaggcgatgacgaggcgcgacacggagatcgccatccagttcaagcaggcgccgctggcgctgttccgcggcaccgccgtcgaggcctgcatcccgaactggctcgtgctgcagatccagccggacgagggcatctccctgcagttcggcgccaaggtgccgggcaccgaggtgcggctcggcgccgtcaacatggacttcctctacaaggactacttccagacccagccgagcaccggctacgagacgctcatctacgacgccatgatcggcgacgcgacgctgttccagcgcgccgacaatatcgaggccggctggcgggccgtgcagcccgtgctcgacgcctggtcgagcgggcgcgccccgatggccgcctacccggccggcagcgcaggcccgaaggaggcggacgacctcctcgcccgcgacggtcgcgcctggcgccctctgtga

SEQ ID NO: 2790 - protein, 515 aa, Methylobacterium extorquens
MIHPNTAPKAGAAKPAPDCTLVIFGVTGDLTHRLLMPALYNLARWKLLPERFAIVGVGRSEMGTDGLRHDLTRTMQGFVAERGGEFSADSLDREAWNRVVGRLDYLAGDVEDPATYEELSRRIGVSRDAQAAGGNVLFYLAVAARLFGPVVTRLGEAGLTREGEGAWRRVIIEKPFGHDLASAKALNREVLAALSEDQIFRIDHFLGKETVQNIMVFRFGNGLFEPLWNRDRIDHVQITVAETVGVEKRGSFYDATGALRDMVPNHLFQLFTMTAMEPPISFDAHAVRDKKEEVLMAVHQLSEDAAVREAVRGRYTAGAVRGQPVRSYRDEPDVDPASQTETYVALRLMVDNWRWAGVPFYLRTGKAMTRRDTEIAIQFKQAPLALFRGTAVEACIPNWLVLQIQPDEGISLQFGAKVPGTEVRLGAVNMDFLYKDYFQTQPSTGYETLIYDAMIGDATLFQRADNIEAGWRAVQPVLDAWSSGRAPMAAYPAGSAGPKEADDLLARDGRAWRPL

SEQ ID NO: 2791 - DNA, 1476 bp, Bartonella henselae
  CDS (1)..(1476)
atggtgagtaaaattattccagtctctccctttgactgtattgtgtttggtggcaatggtgatttagcagcacgcaaacttatacctgctttataccattgtcagtgtgttgggcaattgagcgagccaacacgtattattggagtttcgcgctcttctttgagtggtgaagagtatcaaaattttgttcgtgcttctttagaaaaatatgttcatccaaaagatctcaatcgaattgaactcaatcgttttcttgcgcgtttaacctatatttctgttgatattacatcaaatcgagggtggagagatctcgctttaccgctctcagaagatccatctgatattcgagttttttatttagcagttggttcatccctttttggtgatattgcgatgagattgggacaaaatggtttagtaacgcaaaaaacacgaattattattgaaaaacctattggttgtaatgtaaaaacagcggttcagctcaatgatacatttgcaagcgtatttgatgaagatcagatttttcgcattgaccattatctgggcaaggagaccgttcaaaatttgatggcattgcggtttgttaatacactttatgagccgttatggaactccaattatattgatcatgtacagataacggtggctgaatctttaggattggaagggcgtatagaatattatgagagtgcaggtgcactgcgtgatatggtacaaaatcatatgctgcaattgctctgtttggttgctatggaagtaccatttaccaatagtgcgaatgctgtgcgtgatgaaaaactgaaagttttgcattctttaatgcctctcgatgttcgtaatgtagagcaatatactgtacgtgggcagtatctttctggtatattggatgatgtttgtgtaaaatcttatcttgatgatttggggaaagaagttagtaggagcgaaacatttgtggcgcttaaaattaaggttgataattggcggtgggcagatacgcctttttatttgcgaacaggtaaacgcatgtccacgcggatgtctgaaattgttatcgttttcaaacccattccccataatatttttgagacggattcaaatgaaattttttctaatcggctcgtcattcgtctccagcctgatgaaggcgtaaaacaatggttgatgattaaggatccaggtcctggtggtatacgatttcgtcatattccattggatatgagttttgcgtctacattttctcagcgtaatcctgatgcttatgaacgcttattaatggatgttattcgcggagatcaaacactctttatgcgtcgtgatgaagttgaagctgcttggcgttggattgatccaattctagagggatgggaagccataaagcagcctgttcatggttatagcgctggctcatggggaccatctgcttcgaaacttttgatggaacgtgatgggcgtatatggaacaatttggtttag

SEQ ID NO: 2792 - protein, 491 aa, Bartonella henselae
MVSKIIPVSPFDCIVFGGNGDLAARKLIPALYHCQCVGQLSEPTRIIGVSRSSLSGEEYQNFVRASLEKYVHPKDLNRIELNRFLARLTYISVDITSNRGWRDLALPLSEDPSDIRVFYLAVGSSLFGDIAMRLGQNGLVTQKTRIIIEKPIGCNVKTAVQLNDTFASVFDEDQIFRIDHYLGKETVQNLMALRFVNTLYEPLWNSNYIDHVQITVAESLGLEGRIEYYESAGALRDMVQNHMLQLLCLVAMEVPFTNSANAVRDEKLKVLHSLMPLDVRNVEQYTVRGQYLSGILDDVCVKSYLDDLGKEVSRSETFVALKIKVDNWRWADTPFYLRTGKRMSTRMSEIVIVFKPIPHNIFETDSNEIFSNRLVIRLQPDEGVKQWLMIKDPGPGGIRFRHIPLDMSFASTFSQRNPDAYERLLMDVIRGDQTLFMRRDEVEAAWRWIDPILEGWEAIKQPVHGYSAGSWGPSASKLLMERDGRIWNNLV

SEQ ID NO: 2793 - DNA, 2266 bp, Toxoplasma gondii
  CDS (169)..(1851)
ccccctcctggcatcttgcgtcgcatagcagacatacatcgtggggttttggcccgctaggttaccatcacgctcaacggcttccagttgaggaaccgtgttttccccacattttcatgattttgtccaaaagttgcagagtcgacttccatctctggataaggcaacatggcaccggaaaatggtagaagcagttattctgcatatatcagactgttgtggcttctgacggcggtaactgctgcgtcggccctcgtcacgaacgtctcgggggggacggcaggcgaagatcaaacttatggatatgtgaatgtcggaaacaactctgatggtgtcacgttcattttttacggcgcaaccggagatctctgcaggaggaaaatttacccgacggtcttccaactatatttggagaaaaagctgccggagtcgtttctcattgtaggcatgagcaatcaagccatgagcttggtcgacttccgtaagatgcatcgtcctcagctcgagaatgtcttgcgttcttataagcggctacgtgatcctgcgaggctactgaatcagtttgagcagcggatgagctacaccacgggatcgatcgacgatgataatattttaagtcatttctgccacaatatatcgagaatggaacaggcacaatcccctaacgcttcttggggccgagtactgtacttggcgctgcctcctcatattttcgctccggcggcggccggcttcaagcggaattgctcgacacataacgggtggacgcgagtagtagttgaaaaaccatttggacgtgattatgagagctcagagcttctttcggagcagctgaggagcgtgctgcttgaagaggaaacataccgaatagatcactatctcggcaaggagatgttacaggcactgccaccgctgcgattcacgaacttcttcctcgagccgctcatgaaccgaaatttcgtgaaagcactcacgatttctttcaacgaggatattggtatcagcggccgcggcgagttctttaatgcatacgggatcattcgggacgtcatgcagaatcacctcctccaacttctaactctcgtggtgatggaaagaccagccactttgagtgatgaggatatcagagacgagaaggttaaggttctgaaacagatcgctcccattaaactagaggagaccattgtcggtcagtactcaaagtcggaggatggaagcgctggatcgtatctggagaccgatggagtgccctcgcactctcgaacgcccacttacgccgcggtatgtatgcacatacgaagtcctcggtgggaaggagttcccatttacatggaggctggtaaaggcatgggcaagaggatcgtctacgtccgcatagactttgctggcgtcccgggattcagagagagtaactatgacttcccaggaaatagtttgattttagaagtccagccgcacccgtctgtgcgctttgaagtcaatgccagggcacctggactcggagcgactttgggaaggaacgtcttgaaaatggatgtcaatccggacggcgtgcggatccccgatgcatacgaaaatcttctcctcaacgtgctcagcggcgacaaaagccattttgttagaacggatgagctccgcgaatcatggagaattttcacgccgatgttacatgcattagaagatttacaggtccagccacgactgtatcctttcgggacacctggtcctagtggcgctgttgatgagctgcgcgcagctgtcgctgcctcagtgaacggtacgcaaggcaaatctacgatagatagcagagtctctctgcgtttttctgccagcacagggaaacagaggtaatgctcgtcgtattcgcttaagcacaaagcaggcgccaggggatcacttgtgctatagcgtgaggagtttctgttttggtagggcgtgtgattttggtaaattatagtaacgttggtaactagtggagctatcagtgaaagcgtagacttgcatctcttgacgcttcatgcatgtgttgtaagaagtcgacgtccgaaatagccgcaggtttccctttgtcagacagcgacggttaggccgtaactgcggctgaagatgctctttaattcagtaatgcagacagggacagtaacatacacattcgtttcacccgtggaggcggaaagctcctggcacgtgtttcgtaactggatgaacgttttttataccacagcagtcataagacattggccgctaaaaaaaaaaaaaaaaaaaa

SEQ ID NO: 2794 - protein, 560 aa, Toxoplasma gondii
MAPENGRSSYSAYIRLLWLLTAVTAASALVTNVSGGTAGEDQTYGYVNVGNNSDGVTFIFYGATGDLCRRKIYPTVFQLYLEKKLPESFLIVGMSNQAMSLVDFRKMHRPQLENVLRSYKRLRDPARLLNQFEQRMSYTTGSIDDDNILSHFCHNISRMEQAQSPNASWGRVLYLALPPHIFAPAAAGFKRNCSTHNGWTRVVVEKPFGRDYESSELLSEQLRSVLLEEETYRIDHYLGKEMLQALPPLRFTNFFLEPLMNRNFVKALTISFNEDIGISGRGEFFNAYGIIRDVMQNHLLQLLTLVVMERPATLSDEDIRDEKVKVLKQIAPIKLEETIVGQYSKSEDGSAGSYLETDGVPSHSRTPTYAAVCMHIRSPRWEGVPIYMEAGKGMGKRIVYVRIDFAGVPGFRESNYDFPGNSLILEVQPHPSVRFEVNARAPGLGATLGRNVLKMDVNPDGVRIPDAYENLLLNVLSGDKSHFVRTDELRESWRIFTPMLHALEDLQVQPRLYPFGTPGPSGAVDELRAAVAASVNGTQGKSTIDSRVSLRFSASTGKQR

SEQ ID NO: 2795 - DNA, 1923 bp, Xanthomonas campestris
  CDS (1)..(1923)
atgcaacgacgtgggcctgctcgccgaagagtacgacccgcgcagcaaacgcatgcttggcaacttcccgcaagggtattcccacgtggccctggtcaatgcggcattgcgcctgcatggacgcatgggcgagaaggagacgcatccatgagtgagcaagtgaccaccccgccgtgcatcatcgtggtgttcggtgcgcgcggtgacctgacccggcgcctggtgatgccggcgctgtacaacctgcgccgcgccggtgcacttggcgaggaattcgccattgtcggcatggaccacggcgacatcaccgagcgtgcctggcgcaccaacatgggcaaggcgatgaccgagctgctgagcagccgcgatgccgagttccaggccgatggattcgataccgacacctgggactggttgcgcgagcgcatgcattacgtgcgcggcgacttcaccgacctgcgtgcctatcagtcgctggacggcgtgctggaaaaactgcacaagcgctatggcacccgcggtaatgtgctgttctatctggccaccgccgcgcgcttcttcgagccggtgctgctgaatctgggcgaggccgggctggtcaagcagcgcgagggcgccggctggcgccgggtgatcgtggaaaagccgttcggccacgacctgcccagcgccaagcatctcaatgccacggttgcgcgcgtgctgcacgaagaccaggtgttccgcatcgaccatttcctgggcaaggaaaccgtgcagaacatcctggcgttccgcttcgccaatggcctgttcgagccggtgtggaaccgcgaccggatcgaccacgtgcagatcactgccgccgaaaccatcggtgtggaagggcgcgggcgtttctacgatcccaccggctgcctgcgcgacatggtgcccaaccatctgttccagctgctggcgatgattgcgatggagccgccggccgcgttcaccaccgaggcgatgcatcgccgccgcgccgaagtgatcgaagcggtgcgcccgatcaaacctgaagacgtggtgcgtgggcagtacgcgtccggtgcggtcaatcgcagcgccgtgccgggataccgcgaagaagacacggtaccggacgagtcggaaaccgaaaccttcgtggcgatgaagttgcaggtcgacacctggcgctgggccggcgtgccgttctatctgcgcaccggcaagcgcctgcgcgaacgcaccaccgagattgcgatccgcttcaagcctgcaccgttggcgccattccgcagcaccgaagtgggcggctacggccccgactggctggtgctgcatatccagcccgacgaaggcatctcgctgcagttcgacgtcaagcgcccgggcgcgcaagtggcgttggcgccggtgcggatggacttccgctaccgcgactggttcccgaaggaatacaccgttggctacgagcgcttgctgcaggactgcatgaatggcgaggccggtctgttccaggatgcagcgatggtggaaggcgcgtggcgcatcgtgcagccgatcctggatgcgtggaagcaaccgcccagtgactttcccaattacgcggctggcagtgccggcccgtcggcggccgatgcgttgctggcgatgaacggcgggcacgcctggcgtgcgctcactccgggccgcaaaccgccgccgcgtcgcccgcctgaagcgcgtgcgggtgcggcggcaccggcgaagaagagcgccaagaaggcggtcaaaaaggctgcgaaaaaagtcgccaaggcgcctgccaagcgcagcgctgcggttgccgggaaatctgcagcggcggcgtcgccgagcaaggcggcaagcaaggcggtcaccaagcgcgccaccaaaaaggcgacgaagccggcaaccaaagtcgtcaagaagagcgcttcgtag

SEQ ID NO: 2796 - protein, 640 aa, Xanthomonas campestris
MQRRGPARRRVRPAQQTHAWQLPARVFPRGPGQCGIAPAWTHGREGDASMSEQVTTPPCIIVVFGARGDLTRRLVMPALYNLRRAGALGEEFAIVGMDHGDITERAWRTNMGKAMTELLSSRDAEFQADGFDTDTWDWLRERMHYVRGDFTDLRAYQSLDGVLEKLHKRYGTRGNVLFYLATAARFFEPVLLNLGEAGLVKQREGAGWRRVIVEKPFGHDLPSAKHLNATVARVLHEDQVFRIDHFLGKETVQNILAFRFANGLFEPVWNRDRIDHVQITAAETIGVEGRGRFYDPTGCLRDMVPNHLFQLLAMIAMEPPAAFTTEAMHRRRAEVIEAVRPIKPEDVVRGQYASGAVNRSAVPGYREEDTVPDESETETFVAMKLQVDTWRWAGVPFYLRTGKRLRERTTEIAIRFKPAPLAPFRSTEVGGYGPDWLVLHIQPDEGISLQFDVKRPGAQVALAPVRMDFRYRDWFPKEYTVGYERLLQDCMNGEAGLFQDAAMVEGAWRIVQPILDAWKQPPSDFPNYAAGSAGPSAADALLAMNGGHAWRALTPGRKPPPRRPPEARAGAAAPAKKSAKKAVKKAAKKVAKAPAKRSAAVAGKSAAAASPSKAASKAVTKRATKKATKPATKVVKKSAS

SEQ ID NO: 2797 - DNA, 1431 bp, Xanthomonas campestris
  CDS (1)..(1431)
atgcacaacaccctgatcctgttcggcgccaccggcgatctcgcccagcgctatctctttccatccctgctgcgcctgtttgtcgacggcctgttgccggaggacttccgcatccgtgcgttggccctgtcgcagcacgacaccgacgccttccgcgaggtactgcgcccgcgcctggcccaggcgctgccgattgccaccgccgcgcagatcgatgcgctgctgcagcgcatcgactaccgctcggcggacctgcgcaatgccgaatcggtggccgaggccgtgcgcgaactggccagccgccagtgcgtaagctatctggcgattccaccgggcctgtacatcagtacctgccagggcctggccctgggcggcgcgctggctgcaccgcaccggttgatgctggaaaaaccgatcggccacgattcggacagcgcccgcgagatcctgcagtcgatcggcgcactgatcgacgaagaccgcgtgttccgtctcgaccactacctgggcaaggccgcggtgcagaacctggtggcgctgcgcttcggcaacaccttgctggaagcggtgtggaaccggacctacatcgaatcggtacagatcctggtggccgagagcgaaggcgtggacggccgcgatgcctactacgcccgctccggcgcgctgcgcgacatggtgcagagccatatcctgcagttgctgtgcctggtggccatggagccgccggcctcgctggaagccgaccgcatccgcgacgagaaggtcaaggtgctgcgcgccttgcgcccgatgaccgccgagcacgccgcgcaagacagcgtgcgtggccgctacaccgccggcagcatcaacggcgagccggcgcaggcctaccacccgccggaaggcagcgatgtggaaaccttcgtcgcggtcaccgcgcacatcgacaactggcgctgggctggcgtgccgttccacctgtgcaccggcaagcgcctggctgagcgctccacgcgcatcgtggtcacgctcaagccggtgacgcattggttgttcgagcgtccggaccgccagaacgcggtgcccaaccgcctgaccttccagctgcagccgctggaaaacatcgagctgggcctgatgagcagcctggccggcccggaatggggtgcgatcgaactgcagccgctggaactggagctgtccgtgcccaccggcctgcaccgccgtatcgcgtatgaacgcttgttcgtggatgccttcaacggcaacccggcgctgttcgtgcgcgatgacgaggtcaaggccgcctgggcctggatcgacagcgtcagcgatgcctggtcggacgcacagctgccgctgcagccgtatccggccggtagctggggccccgagaccgccgcaccgttcctgcccccggccaccgacgcacagggaaacaacgcatga

SEQ ID NO: 2798 - protein, 476 aa, Xanthomonas campestris
MHNTLILFGATGDLAQRYLFPSLLRLFVDGLLPEDFRIRALALSQHDTDAFREVLRPRLAQALPIATAAQIDALLQRIDYRSADLRNAESVAEAVRELASRQCVSYLAIPPGLYISTCQGLALGGALAAPHRLMLEKPIGHDSDSAREILQSIGALIDEDRVFRLDHYLGKAAVQNLVALRFGNTLLEAVWNRTYIESVQILVAESEGVDGRDAYYARSGALRDMVQSHILQLLCLVAMEPPASLEADRIRDEKVKVLRALRPMTAEHAAQDSVRGRYTAGSINGEPAQAYHPPEGSDVETFVAVTAHIDNWRWAGVPFHLCTGKRLAERSTRIVVTLKPVTHWLFERPDRQNAVPNRLTFQLQPLENIELGLMSSLAGPEWGAIELQPLELELSVPTGLHRRIAYERLFVDAFNGNPALFVRDDEVKAAWAWIDSVSDAWSDAQLPLQPYPAGSWGPETAAPFLPPATDAQGNNA

SEQ ID NO: 2799 - DNA, 1839 bp, Xanthomonas axonopodis
  CDS (1)..(1839)
atgagtgagcaagcaaccacaccgccgtgcatcatcgtggtgttcggcgcacgcggcgatctgaccaagcgcctggtcatgccggcgctgtacaacctgcgccgttccggtgcgctgggcgatgatttcgccattgtcggcatggaccatggcgacatcagcgagcgcgcctggcggaccaacatggggcagtcgatgacgcagctgctcagcagccgcgatgccgaattccagaccgacgaattcgacaccgccacctgggactggctgcgcgaacgcatgcattacctgcgcggcgacttcaccgatcagggagcctatcgatcgctgggcggcgtgctggacaagctgcacaagcgctacggcacgcagggcaatgtgctgttctatctggccaccgccgcgcgcttcttcgagccggtattgctcaacctgggcgaggctggcctggtcaagcagcgcgaaggcgaaggctggcgccgggtcatcgtggaaaaacccttcggctacgatctgcccagcgcccagcacctcaatgccacggtcgccaaggtgctgcacgaggatcaggtgttccgcatcgatcatttcctgggcaaggaaaccgtgcagaacattctcgcgttccgcttcgccaatggcttgttcgaaccggtgtggaaccgcgaccgcatcgaccatgtgcagatcaccgcggccgaaaccatcggagtggaagggcgcggacggttctacgaccccaccggctgcctgcgcgacatggtgccgaaccatctgttccagctgctggcgatgattgcgatggagccgccagcggccttcaccaccgaggcgatgcatcgccgtcgcgccgaagtgatcgaagcggtgcgcccgatcaaacccgaagacgtggtgcgcgggcaatacgcctccggtgcggtcaatcgcaatgcggtgccgggttatcgcgaagaagacaccgtgcccgacgattcggacaccgaaacctatgtggcgatgaagctacaggtggacacctggcgctgggccggcgtgccgttctacctgcgcaccggtaagcgcctgcgcgaacgcacgaccgagatcgccattcgcttcaagccggcaccgctggcgcccttccgcagtaccgaggtgggcggctacggccccgactggctggtgctgcatatccagccggacgagggcatctcgctgcagttcgacgtcaagcgtccgggcgcgcaggtggcactggcaccggtgcgcatggacttccgttaccgcgactggttccccaaggaatacacggtgggctacgagcgcctgctgcaggactgcatgaacggcgaagccggcttgttccaggatgcggccatggtggaaggcgcatggcgcatcgtgcaaccgatcctggatgcatggaaacaacccccaagcgacttccccaattacgccgccggcagcgccggcccttcggctgccgatgcactactggcaatgaatggcggacacgcctggcgcgcactcaccccagggcgcaagccgccaccgcgccggccgccggaagcgcgtgctggcgctgccgcgccgattaagaaaaccaccggcaaatctgccaagaaggccgccaaggcgccggccgagaaggtcaccaaggcgccagccagacgcgcatctgcggcttcagcaagaccatcgcaggatgcggctacgtcgcctagcagcgcggccaggaaggccgtgagcaaacgcgtaaccggcaaggtcgcaaaggccgccggcaaaaccgcggcaggcaagggcgcagcgaagaagtcggccagcaagaccgtggcgcgcacgccacgccgctga

SEQ ID NO: 2800 - protein, 612 aa, Xanthomonas axonopodis
MSEQATTPPCIIVVFGARGDLTKRLVMPALYNLRRSGALGDDFAIVGMDHGDISERAWRTNMGQSMTQLLSSRDAEFQTDEFDTATWDWLRERMHYLRGDFTDQGAYRSLGGVLDKLHKRYGTQGNVLFYLATAARFFEPVLLNLGEAGLVKQREGEGWRRVIVEKPFGYDLPSAQHLNATVAKVLHEDQVFRIDHFLGKETVQNILAFRFANGLFEPVWNRDRIDHVQITAAETIGVEGRGRFYDPTGCLRDMVPNHLFQLLAMIAMEPPAAFTTEAMHRRRAEVIEAVRPIKPEDVVRGQYASGAVNRNAVPGYREEDTVPDDSDTETYVAMKLQVDTWRWAGVPFYLRTGKRLRERTTEIAIRFKPAPLAPFRSTEVGGYGPDWLVLHIQPDEGISLQFDVKRPGAQVALAPVRMDFRYRDWFPKEYTVGYERLLQDCMNGEAGLFQDAAMVEGAWRIVQPILDAWKQPPSDFPNYAAGSAGPSAADALLAMNGGHAWRALTPGRKPPPRRPPEARAGAAAPIKKTTGKSAKKAAKAPAEKVTKAPARRASAASARPSQDAATSPSSAARKAVSKRVTGKVAKAAGKTAAGKGAAKKSASKTVARTPRR

SEQ ID NO: 2801 - DNA, 1431 bp, Xanthomonas axonopodis
  CDS (1)..(1431)
atgcacaacaccctgatcctgttcggcgccaccggcgatcttgcccagcgctatctctttccttccctgctgcgtctgttcatcgacggtctgttgccggaggacttccgcatccgtgcgctggcgctgtcgccgcacgacaccgatgcatttcgcgacgtgctgcggccgcgcctgaccgaagcgctgccgatcgcgaccgccgaacagatcgacacgctgctacaacgggtcgactatcgctcggtggatctgcgcaatgccgattcggtggccgacgcggtccgcgaactggccagccgtcggtgtgtgagctatctggcgatcccgccgggcctgtacatcagcacctgccagggcctggcgctgggtggcgccctggcggcaccgcatcgcttgatgctggaaaaaccgatcggccacgactcggacagcgcccgcgacatcctgcagtcgatcggcgcgctgatcgacgaagaccgcgtgttccgcctggaccattacttgggcaaggcagcggtgcagaacctgatcgcgctgcgcttcggcaacacgctgctggaggcggtctggaaccggacctacatcgagtcggtgcagatcctggtcgccgaaagcgaaggcgtcgacgggcgcgatgcctactacgcccgctccggcgccctgcgcgacatggtgcagagccatatcctgcagctgttgtgcctggtggcaatggagccgccggcctcgctggaagccgaccgcatccgcgatgagaaggtcaaggtgctgcgcgccctgcgcccgatgaccgccgagcacgccgcgcacgactgcgtgcgcggccgctacaccgccggcagcatcaacggccagccggcgcaggcctaccacccgccggaaggcagcgacgtggaaacctttgtcgccgtcaccgcgcatatcgataactggcgctgggccggcgtgccgttccacctgtgcaccggcaagcgtctggccgagcgctccacccgcatcgtggtgacgctcaagccggtgacgcactggctgttcgaacgccccgaccgccagaacgcggtgccgaaccgcctgaccttccagttgcagccgcaggaaaacatcgagctcggcctgatgagcagcctggctggcccggaatggggtgcgatcgaactgcagccgctggaactggaactgtcggtgccgaccggcctgcaccgtcgtatcgcctacgaacgtctgttcgtcgacgccttcaacggtaaccccgcgctgttcgtgcgcgacgacgaggtcaaggcggcgtggtcgtggatcgacagcgtgagcgacgcctggaaagacgccgcgctgccgctgcagccctacccggccggcagctggggtcccgaatcggccgcccacttcctgcccccggccaccgacgcacagggaaacaacgcatga

SEQ ID NO: 2802 - protein, 476 aa, Xanthomonas axonopodis
MHNTLILFGATGDLAQRYLFPSLLRLFIDGLLPEDFRIRALALSPHDTDAFRDVLRPRLTEALPIATAEQIDTLLQRVDYRSVDLRNADSVADAVRELASRRCVSYLAIPPGLYISTCQGLALGGALAAPHRLMLEKPIGHDSDSARDILQSIGALIDEDRVFRLDHYLGKAAVQNLIALRFGNTLLEAVWNRTYIESVQILVAESEGVDGRDAYYARSGALRDMVQSHILQLLCLVAMEPPASLEADRIRDEKVKVLRALRPMTAEHAAHDCVRGRYTAGSINGQPAQAYHPPEGSDVETFVAVTAHIDNWRWAGVPFHLCTGKRLAERSTRIVVTLKPVTHWLFERPDRQNAVPNRLTFQLQPQENIELGLMSSLAGPEWGAIELQPLELELSVPTGLHRRIAYERLFVDAFNGNPALFVRDDEVKAAWSWIDSVSDAWKDAALPLQPYPAGSWGPESAAHFLPPATDAQGNNA

SEQ ID NO: 2803 - DNA, 1458 bp, Thermoanaerobacter tengcongensis
  CDS (1)..(1458)
atgaaagataaagacctttcaaacgtgatggtcatattcggtggaacaggagatttaacccataaaaaattgatgccggccctttacaacttaagatatcaaaatatcctgcctgaaaattttgctgtagttgctatagggagaagagacaagactgaagaggaatatagaaatgagatgctggagtctgttaaaacttattctagatttgacattgacgaaaaaatctggcaagatttaagtagcaggatattctacaaaagatttgattttaactatgacaacggatatatggaacttagttactttttagatgaactggataggaaatacaatacacagggcaacagggtatattatcttgcagttgcaccggaatattttggcatcattgtggaaaagttatacagacacggaatggtaagtaatgaaacttcatggcagagagtagttatagaaaagccttttggagaaaatttagaatctgcccggaaactaaataaaatgataacagatgtctttacagaaagaaatacttatagaattgatcactatttaggaaaagagatgctacagaatataatggtcatcagatttgccaatgtgttttttgagccagtttggaacagaagatatatagacaatgtgcaaatttcttctaatgagacggtagggatagaaaatagaggaggatactacgagaaagcaggagctttgagggacatggttcaaaaccacatgatgcagcttctgaccttgacggcgatggaaccacctgtaaatttggatacagaatctataagggatgagaaggtgaaggttttaaaatccttagagattatgactcctgagcttgtagagaaaaatgtggtgagagggcagtatgtgggatataggcaggaggaaaaagtatctccaacttccaatacagagacttttgtggcattaaaagtgcacatagaaaatttcagatgggcaggagttcctttttacatcaggactggaaaaaggatgccggaaaaatccacacagattgtcatccaatttaagcctctgccaggtattttgtatttcaaagagtataaaaatttgcttcccaatttgcttgtaataaaaattcagccggaggaaggagtaaaacttcagtttaatgccaaagtgccgggagcaggagatataactatagagcctgtaaatatggatttttgtcagaactgccagatatccaataattctccagaggcatatgaaagacttctttttgatgtgatgagaggagattctactttatttactcgctgggatgaggtagaatattcttggaggtttgtagatgctattgctaaagcatgggcagaaaaaacacccgattttcctaattactatccagggacctggggtcctagtgaggcagaagagcttttgagaagagatggaagaatgtggtggaatgtatag

SEQ ID NO: 2804 - protein, 485 aa, Thermoanaerobacter tengcongensis
MKDKDLSNVMVIFGGTGDLTHKKLMPALYNLRYQNILPENFAVVAIGRRDKTEEEYRNEMLESVKTYSRFDIDEKIWQDLSSRIFYKRFDFNYDNGYMELSYFLDELDRKYNTQGNRVYYLAVAPEYFGIIVEKLYRHGMVSNETSWQRVVIEKPFGENLESARKLNKMITDVFTERNTYRIDHYLGKEMLQNIMVIRFANVFFEPVWNRRYIDNVQISSNETVGIENRGGYYEKAGALRDMVQNHMMQLLTLTAMEPPVNLDTESIRDEKVKVLKSLEIMTPELVEKNVVRGQYVGYRQEEKVSPTSNTETFVALKVHIENFRWAGVPFYIRTGKRMPEKSTQIVIQFKPLPGILYFKEYKNLLPNLLVIKIQPEEGVKLQFNAKVPGAGDITIEPVNMDFCQNCQISNNSPEAYERLLFDVMRGDSTLFTRWDEVEYSWRFVDAIAKAWAEKTPDFPNYYPGTWGPSEAEELLRRDGRMWWNV

SEQ ID NO: 2805 - DNA, 1762 bp, Oryza sativa
  CDS (41)..(1558)
ggtatattgctgaaggaagaagagcaccaacctatttatcatgtcaggaggatcttcaccaaggtcaagacgaagcagctttaattctttatcaagagatctcgaactcccttcagagcaaggttgtctctctgttattgtcctcggggcttctggagacctagccaagaagaaaactttcccggcactcttccatctttttgcacagggatttatacaatcaggtgaagtgcatatatttgggtatgcgagatcaaacctttctgatgatgggttaagggaacgcattcgtggatacctcaaaggagcctcagaagaacatctctcagactttttgcaacatataaaatatgtcagtggttcctatgacagcggagaaggatttgagaaattgaacaaggaaatttcagagtatgagaagtcaaacaaatcagaaagccctcgcaggctcttctatttggcattgcctccatctgtctacccttcagtctgcaaaatgatcagaacatattgcatgaatccatctggatggactagagtcattgttgagaagccatttggaaaggacttggactcttcagaagaattaagtgcccaacttggggagctatttgacgaaaaccaactctacagaattgatcactacttgggaaaagagttggtccaaaacctgcttgtgcttcgttttgccaaccgcttgttcttgcctctttggaaccgcgacaatattgataatatacagattgtattcagggaggactttgggactgacgggcgtggtggatattttgatcaatatggaatcattcgtgacatcatccagaaccatttgttacaggttttctgtttggttgcaatggaaaagcctgtctctcttaagcctgagcacattagagatgagaaagtcaaggttctgcagtccgtgaaccctataaagcatgatgaggttgtccttggacaatacgaggggtacaaggatgaccctacagtgccagatgactcaaacaccccaacttttgcatctgtcgtgtttcgggtacacaatgaaagatgggagggtgttcctttcattcttaaagctggtaaagcactaagctcaaggaaagcagaagtccgtgtgcagttcaaagatgttcctggtgacatctttaaatgtaaaaggcaaggaagaaatgagtttgtcatacgccttcagccatcagaagccatgtacatgaaacttactgtcaaaaaacctggattggagatggccaccgagcagagtgaacttgatctgtcatacgggatgcggtaccaaaacgtcaaaattccagaggcatgcgagcgtctcatattggatacgatacgaggagaccaacagcacttcgttcgccgagatgagctgaaggctgcttggcagatcttcactcccctgctgcacgacatcgacgaaggcaaggtgaagtctattccataccagcctggcagccgaggccccaaggaagccgatgaactgagcgagagggttgggtatatgcagacccacggttacatatggataccacccacccttgcatagacagacagacagacagacagtagtattgtttagctaggaagagtgcctctaaactgttattattgcggatatattcgtttcatattttcacgataacgcctgactagtgactacctggcgttgtaataatgtgttgcttcgtaagtataactgctattgtgaaataaaagtgcatgtttcgatcaaaaaaaaaaaaaaaaaaaa

SEQ ID NO: 2806 - protein, 505 aa, Oryza sativa
MSGGSSPRSRRSSFNSLSRDLELPSEQGCLSVIVLGASGDLAKKKTFPALFHLFAQGFIQSGEVHIFGYARSNLSDDGLRERIRGYLKGASEEHLSDFLQHIKYVSGSYDSGEGFEKLNKEISEYEKSNKSESPRRLFYLALPPSVYPSVCKMIRTYCMNPSGWTRVIVEKPFGKDLDSSEELSAQLGELFDENQLYRIDHYLGKELVQNLLVLRFANRLFLPLWNRDNIDNIQIVFREDFGTDGRGGYFDQYGIIRDIIQNHLLQVFCLVAMEKPVSLKPEHIRDEKVKVLQSVNPIKHDEVVLGQYEGYKDDPTVPDDSNTPTFASVVFRVHNERWEGVPFILKAGKALSSRKAEVRVQFKDVPGDIFKCKRQGRNEFVIRLQPSEAMYMKLTVKKPGLEMATEQSELDLSYGMRYQNVKIPEACERLILDTIRGDQQHFVRRDELKAAWQIFTPLLHDIDEGKVKSIPYQPGSRGPKEADELSERVGYMQTHGYIWIPPTLA

SEQ ID NO: 2807 - DNA, 1305 bp, Encephalitozoon cuniculi
  CDS (1)..(1305)
atgaaggtcgttatcttcgggtccagtggcgatcttgcaaaaagaaagctttttcctgcactctctcggattgacttggagggtgtcggggtggttggctatgcaaggaccaagtacaacatcgagttttcggaagttcttcaggaggtcgggaactactcgccggaatttctttcgaaggtcacctacattccagggccctacgatgacctttcgaagcttaaagaggtctcagactcggagactgtgctgtacttttcagttccatcctctgtgtacacttgtttattcagagagatatcgaagcttgactacaaggtgattggagtcgagaagccatatggagatagcattgagtcgtttatggagataaaggggtttgatctggggaagaccaggtttattgaccactatcttctgaagccgcttgtggtggctatgcctgggattataagggagacgggggcgattcgagaggtgatgagcaacagatatgtgaagagtgttgagatagtctcgaaggaagttcttgggggagagggaagacactacttcgataagaacggaattataagggacatggtcctgagccacatgggcgagcttcttggggttgttgcgtctgacgtaacaaagccatcgaggattatggaagcattggcgagaatggaggttttcaaggcatgcaccgtcgacaccgagagatgcatttatgggcagtatgacgactatattaaggagattcacaaggactcgagtacggagacgttctgcatggttcccataagcatagggactccccgctggtctaaggttcccttcatcattgttgcagggaaggggatgaacgaaaagagaacagagataatacttgagtttcgaagagatgtatttgcgaagtgcattgagctgttttctatgccgaggcaatcttcgtgcaggattgttcacaccaacgaaatagaaacggttcgactggtctttaatatatatcctgaatgcgaagtatttctggaagttctcgtgggaggggagcctgtccggtatgttctgcatgacaagaaagagattgatggcctgatgcatgacagttatggaggataccatgactatgagatcatctttgacagtcttgtaagaggcaaggactttagcagcgtgagctctcaggaggcagagcttctgtggaaggtgtttaaccccatactatctattagcaaagaggacatgctgttctactattctaagggaattgacatgcctaaggaagctgaagaaatgatcagggaaattaaagaccattag

SEQ ID NO: 2808 - protein, 434 aa, Encephalitozoon cuniculi
MKVVIFGSSGDLAKRKLFPALSRIDLEGVGVVGYARTKYNIEFSEVLQEVGNYSPEFLSKVTYIPGPYDDLSKLKEVSDSETVLYFSVPSSVYTCLFREISKLDYKVIGVEKPYGDSIESFMEIKGFDLGKTRFIDHYLLKPLVVAMPGIIRETGAIREVMSNRYVKSVEIVSKEVLGGEGRHYFDKNGIIRDMVLSHMGELLGVVASDVTKPSRIMEALARMEVFKACTVDTERCIYGQYDDYIKEIHKDSSTETFCMVPISIGTPRWSKVPFIIVAGKGMNEKRTEIILEFRRDVFAKCIELFSMPRQSSCRIVHTNEIETVRLVFNIYPECEVFLEVLVGGEPVRYVLHDKKEIDGLMHDSYGGYHDYEIIFDSLVRGKDFSSVSSQEAELLWKVFNPILSISKEDMLFYYSKGIDMPKEAEEMIREIKDH

SEQ ID NO: 2809 - DNA, 2125 bp, Drosophila melanogaster
  CDS (158)..(1738)
gcgatttttgcctcagtctatacctccaggcaatatctatcactaatcttttttaaattacaactatttattcttggccaaaatttgacgttaccttgctttcttttattctctcaaaattatactttacccgaaatgatttccatggacccccacaatgaggaggcgtattccatcgtggtcttcggagcctcaggcggattggccaaaaagaaggtgtttccggcgctttgggctctcttccgggagaatcggctgccccagggcaccaaaatatttactttcacccggtccccgctgcagacgaagacgtaccggttgcagattcttccctatatggagctggacaagcatcgggaccccaagaagtacaacctctctttggacgaccgtgcactgtgtgcagggcgagtacgacaagccggagaactacgtggcactcacggaggcgatggtacaccaggagacaaagcacaatcaggtgcgcgcgaatcgaatcttctacctggcgctgccaccgatcgttttcgatcaggtgaccctcaatgtcagtcgaaaatgcagctcgaccacgggatggaaccgcataatagtggagaagcccttcgcgcgggacgacatctcctacaaggcctttcaaacctcgctgtgcaactgcttccgggagtcgcagatttacctgatggaccacctcctcagccggcaggtgatgcagaacttctttgcgctgcgctattcaaaccacttgtgggccgagaccctgaaccaccgccacgtggcggcggtgatgatatccataaagtgtgagctgccggtgtcggtgaatcgggcagactactttaatcagtttggcattattcgcgacctgatgaccaaccacatgatccagatgctggccatgctggctatggatcagccgtacgccaacactgctgacgacctgcgtgccgaacggctgaaggttcttcgccaggtgctaactcccaacataggcgacgtcgtcttggctcaataccgcaacaaccggcgggagactgaccccgcgaagtgcggctacacggagcacacctacatcccgaaggactcctttacgcccacattcgctctggtggtgctgcacatcaacaaccgccgttggaccggggtacccttcattctcagagcgggaaaggccttgaacgacaccaagtcggaggtgcgtatccagtacaagccggtggactgcgacaccttccacagcgacagtactgacattcgtaacgagctagtcctgagatccttccccacggaagaggtctttatgcgcatgcgcctcaagcggcagggcgaggatatctgccttcgggagagcgagatcaacctgcgagtggatgatcggggaccgaagggactccaaggactgcccggctacctgctcaacgtgtttcaaggcgaccagacgctcttcatgcgctccgatgagcagtgcgagatttggcgcatattctcccccgttctcgccaccatcgattcggatcgtccccgcccgttgcactatgactttggatcacggggtcctttgctggcctatcgcaaggccgagcgcgctggcttcgtattcttcgccacggacgagtggcatcagagcgaagagacgttagaatacacggtcaagaagagcaagcagctaatcggaccccataccgccctcaagccagtaagagatcctcggtccaagaggtcgaattccaatccttaggcgtagggagatagttaaagcttatacgaaagttttttaattaagcaagtgcagcctgctgtgttacaccagttggccaccacttcaccttggctgcccagtctaacccttcaccgctgtccgttccattcggttctaatccgttccgtgccattgttgcccatgttgccggtgaggatttcgccaagaggggcgtaaacaacacgcaagtcttggccattgtcctttgcagataggggtgagatgcactatagtgtatgggaactacgtaattctctataaatttatatctacttatatttgtacatacaaaattgttttcagtttaataaaaattttatttaaattacaaaaaaaaaaaaaaaaaaaaaaaaaaaaaaaaaaaaa

SEQ ID NO: 2810 - protein, 526 aa, Drosophila melanogaster
MRRRIPSWSSEPQADWPKRRCFRRFGLSSGRIGCPRAPKYLLSPGPRCRRRRTGCRFFPIWSWTSIGTPRSTTSLWTTVHCVQGEYDKPENYVALTEAMVHQETKHNQVRANRIFYLALPPIVFDQVTLNVSRKCSSTTGWNRIIVEKPFARDDISYKAFQTSLCNCFRESQIYLMDHLLSRQVMQNFFALRYSNHLWAETLNHRHVAAVMISIKCELPVSVNRADYFNQFGIIRDLMTNHMIQMLAMLAMDQPYANTADDLRAERLKVLRQVLTPNIGDVVLAQYRNNRRETDPAKCGYTEHTYIPKDSFTPTFALVVLHINNRRWTGVPFILRAGKALNDTKSEVRIQYKPVDCDTFHSDSTDIRNELVLRSFPTEEVFMRMRLKRQGEDICLRESEINLRVDDRGPKGLQGLPGYLLNVFQGDQTLFMRSDEQCEIWRIFSPVLATIDSDRPRPLHYDFGSRGPLLAYRKAERAGFVFFATDEWHQSEETLEYTVKKSKQLIGPHTALKPVRDPRSKRSNSNP

SEQ ID NO: 2811 - DNA, 1470 bp, Ralstonia solanacearum
  CDS (1)..(1470)
atgtcggtgcccgcattcgacatggtgttgtttggcggtacgggtgatctggcccgccgcaagctgattccggccttgttcgatgcgcaccaggggggcgagctccattcgcgcgggcggatctttgccatcggcacccagccgctggagaccgccggttacctggccctgctcgagcgggaggtgcgccccaccatgcgcctgtattccggcgcgcccgtgtcggacgatgcctgggcctctttcgtcgcccgcatcgtctaccagcaggtcgatgcccgcaagccggaacagttcgatgccctggccgccgcgctgggcgagaaccgcgccccggtcaccgtgtgctacctggccaccgcgcccggcattttcgtcgacatctgcgcgcagcttgcccgcgtcggcctgaacacgcccaacgtgcggttggtgctcgagaagccgctgggcaccgacctggcctccaacgagcgcatcaattcggccgtggccgagttctttgccgaagaccagatctaccggatcgaccactacctcggcaaggagtcggtgcagaacctgatggcgatccgcttcggcaacgcgctgttcgagccgctgtggcgccgcgagtggatcaaggacgtgcagatcaccatcgccgagcagctcggcgtggagaagcgcggcgacttctacgacggcgtcggcgccctgcgcgatatggtgcagaaccacctgctgcagctggtgtgcatcgtcgccatggagccgcccgccagcctgtcgcaggacgccatccgtgacgagaagctgaagatcctcaaggcgctcaagccgatcccgctgcaggaggtgcccgagaagaccgtgcgcggccagtatctggagggcgccatcgccgggcagccggtgcagggctacctggacgagcacggcattccgcatgacagccgcaccgagaccttcgtcgccatcaaggccgagatcgccaactggcgctgggccggcgtgccgttctacctgcgcaccggcaagcgcatgccgcagcggctggcggagatcgtggtgcgttttcatgacgtgccgcacgcgctgtttcccaagccgctggtccagttccccgagaaccgcctggtgatccgcctgcagccggaggaaagcatccgcctgcagttcctgaccaaaacgccgggcgcggcactgggcctgcagccgtccacgctggacctggatttcaccaaccacggcggcgtgcgccacgccggcgcctacgagcgcctgctgatggacgccgtcaacggccagcttggcctgttcgtgcgccgcgacgagcaggccgaggcctggcgctgggtcgagcccatcatcgaggcatggaaccaggcccgcacgccgcccaagggctacacggcgggcagctgggggccggccgcttccagcgcgctgctctcacgcgatgccgctgcctggcacgaggagatgtga

SEQ ID NO: 2812 - protein, 489 aa, Ralstonia solanacearum
MSVPAFDMVLFGGTGDLARRKLIPALFDAHQGGELHSRGRIFAIGTQPLETAGYLALLEREVRPTMRLYSGAPVSDDAWASFVARIVYQQVDARKPEQFDALAAALGENRAPVTVCYLATAPGIFVDICAQLARVGLNTPNVRLVLEKPLGTDLASNERINSAVAEFFAEDQIYRIDHYLGKESVQNLMAIRFGNALFEPLWRREWIKDVQITIAEQLGVEKRGDFYDGVGALRDMVQNHLLQLVCIVAMEPPASLSQDAIRDEKLKILKALKPIPLQEVPEKTVRGQYLEGAIAGQPVQGYLDEHGIPHDSRTETFVAIKAEIANWRWAGVPFYLRTGKRMPQRLAEIVVRFHDVPHALFPKPLVQFPENRLVIRLQPEESIRLQFLTKTPGAALGLQPSTLDLDFTNHGGVRHAGAYERLLMDAVNGQLGLFVRRDEQAEAWRWVEPIIEAWNQARTPPKGYTAGSWGPAASSALLSRDAAAWHEEM

SEQ ID NO: 2813 - DNA, 1521 bp, Enterococcus mundtii
  CDS (1)..(1521)
atgaatgaaaaaaacgtattatttactatatttggcggtacaggagatttagcacaacgtaaattgtatccttccctttttcgtttatacaaaaagggcaacttgagcgaacattttgctgtgatcggtacagcacgtcgtccttggagcgatgaacactatcgtgaagtggttaaaggaacaatcaaaacattgaatccttctgccgaagaagccgaacgatttgccagccatttttattatcaatcccatgatgtcaatgattcttctcattaccaaacattaaaagaattatctgatcgtttagatgaaaaataccacttgaatggtaatcgaatgtactatttagccatggctccacaatttttcggtacgatcgtttcacatttgaaatctcagaaaatcatcactgaagctggcttcaaccgattgattatcgaaaaaccttttggttctgatttccattctgcctttgaattgaatgaaaaaattcgacaagtctttccagaagatgatattttccgtattgaccattatttaggtaaagaaatgatccaaaatatctctgcgattcgctttgccaataatatttttgagtctcaatggaacaatcgttacatcgacaacatccaaatcacttttggtgagagtttaggtgttgaagatcgtggcggctattatgaccacagtggtgcgttaaaagatatggtccaaaatcatatccttcaagtattagctttacttgcgatggaaccaccagttgccttttccgaaaaagaaatccgatcagaaaaaatcaaagcgttaaaagctattcgtatttatgaaaaaaaagaagtcttagaaaattttgtacgtgggcaatatgctgcaggtcaattagatgatcagacattcaaaggctatcgtgaagaagacaacgttgatccagaatcaacaactgaaacatttgttgctggaaaattcacgatcgataacttccgttggtctggcgtaccgttttatgtacggactgggaaacgtcttactgaaaaaggtacacgaatcaatatcgtctttaaacaagtacctgtcaatgtatttaaaacatcgatcgacgaaccttgtaatgatccaacgttaccaccaaatgttttgactatctatattcaaccaacagaaggtttttcatttacattaaatggaaaaaaagttggtcaaggcttcgccaccgatccaatcaaactggaatatcgcaatagtgctgaaatggtcgaaaatagtcctgaagcgtatgaaaagcttatgttagatgcattgaacggtgatagtacaaacttctctcattgggaagaagtcgcacaatcttggcatatcgttgacgtgatccgccaagtttgggatcaagtacaaccggatttcccgaattataaagctggttctatgggtcctgaagcagcattcgagcttttagaaaaagacgggttcgaatggatctggcaaccagatcattggtaccgtgaacgtggtaaattggattag

SEQ ID NO: 2814 - protein, 506 aa, Enterococcus mundtii
MNEKNVLFTIFGGTGDLAQRKLYPSLFRLYKKGNLSEHFAVIGTARRPWSDEHYREVVKGTIKTLNPSAEEAERFASHFYYQSHDVNDSSHYQTLKELSDRLDEKYHLNGNRMYYLAMAPQFFGTIVSHLKSQKIITEAGFNRLIIEKPFGSDFHSAFELNEKIRQVFPEDDIFRIDHYLGKEMIQNISAIRFANNIFESQWNNRYIDNIQITFGESLGVEDRGGYYDHSGALKDMVQNHILQVLALLAMEPPVAFSEKEIRSEKIKALKAIRIYEKKEVLENFVRGQYAAGQLDDQTFKGYREEDNVDPESTTETFVAGKFTIDNFRWSGVPFYVRTGKRLTEKGTRINIVFKQVPVNVFKTSIDEPCNDPTLPPNVLTIYIQPTEGFSFTLNGKKVGQGFATDPIKLEYRNSAEMVENSPEAYEKLMLDALNGDSTNFSHWEEVAQSWHIVDVIRQVWDQVQPDFPNYKAGSMGPEAAFELLEKDGFEWIWQPDHWYRERGKLD

SEQ ID NO: 2815 - DNA, 2230 bp, Homo sapiens
  CDS (54)..(1601)
cacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctatgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacgagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagccaaaaaaaaaaaaaaaaaaaa

SEQ ID NO: 2816 - protein, 515 aa, Homo sapiens [sequence omitted]

SEQ ID NO: 2817 - DNA, 1470 bp, Rhizobium loti
  CDS (1)..(1470)
atgaccagccagatcattcccgtcgatcctttcgacttcatcattttcggcggcaccggcgacctgtcggaacgcaagcttctgccgtcgctctattatcgccagcgcgaccatcaattctccgagccgacgcgcatcatcggcacatcgcgctcgaaaatgagcgacgaggaattccgggccttcgccagccaggcgatctccgatcacgtcaagccggccgatatcgacgccaaggaattgaagaccttcctggcgcggctctcctatatctcggccgatgcgacgagcggcgctggcttcgacaagcttaagaaggcgatcggcgagagcgagagcatccgcgccttctatctggcggtggcgccggcgctgttcggcgatatctcgcacaagctgaaagagaacaagctgatcacgccgaactcgcgcatcgtgctggagaagccgatcggccgcgaccttgcctcggcgcgggcactcaacgatttggtcggcgacgacttccacgaaagccagattttccgcatcgaccactatctcggcaaggagacggtgcagaacctgatggcgctgcgctttgccaacgcgctctatgagccgctgtggaactccgcccatatcgaccacgtacagatcacggtggccgagaccgtcggcttggaagaccgcgtcacctactacgacaaggccggcgcgctgcgcgacatggtgcagaaccacatgctgcagttgctctgcctcgtggccatggaggcgccgtcgtcgatggacgccgacgccgtgcgcgacgagaagctcaaggtgctgcgggcgctgaagcgcatcaacggcaacgaggcgccgaagcacacggtgcgcggccagtatcgcgccggtgcatcggccggcgggccggtgaagggctatgtcgaggagctcggcaaggacagcaacaccgagaccttcgtcgccatcaaggccgagatcggcacctggcgctgggccggcgttccgttctacctcaggaccggcaagcgcttggcgacccgggtttcggaaatcgtcatcgagttcaagccgatcccgcattcgatcttcggcgacagcgccgggccgatcttcgccaaccagctggtcatccggctgcagccggacgagggcgtcaagcagttcatcatgatcaaggatccgggcccgggcggcatgcggctgcgccagatctcgctcgacatgagcttcgcgcaatccttcgacggccgcgcgcccgatgcctatgaacggctgatcatggacgtcatccgtggcaaccagacgctgttcatgcgccgtgacgaggtcgaggcggcgtggaaatggatcgacccgatccagaatgcctgggaaggcgccaagcaggaagcgcagggctatacggcaggcacatgggggccatctgcctcgatagcgctgatcgaacgtgacgggcggacatggcacgagagcaattga

SEQ ID NO: 2818 - protein, 489 aa, Rhizobium loti
MTSQIIPVDPFDFIIFGGTGDLSERKLLPSLYYRQRDHQFSEPTRIIGTSRSKMSDEEFRAFASQAISDHVKPADIDAKELKTFLARLSYISADATSGAGFDKLKKAIGESESIRAFYLAVAPALFGDISHKLKENKLITPNSRIVLEKPIGRDLASARALNDLVGDDFHESQIFRIDHYLGKETVQNLMALRFANALYEPLWNSAHIDHVQITVAETVGLEDRVTYYDKAGALRDMVQNHMLQLLCLVAMEAPSSMDADAVRDEKLKVLRALKRINGNEAPKHTVRGQYRAGASAGGPVKGYVEELGKDSNTETFVAIKAEIGTWRWAGVPFYLRTGKRLATRVSEIVIEFKPIPHSIFGDSAGPIFANQLVIRLQPDEGVKQFIMIKDPGPGGMRLRQISLDMSFAQSFDGRAPDAYERLIMDVIRGNQTLFMRRDEVEAAWKWIDPIQNAWEGAKQEAQGYTAGTWGPSASIALIERDGRTWHESN

SEQ ID NO: 2819 - DNA, 1428 bp, Rhizobium loti
  CDS (1)..(1428)
atgtcgaaaagccgaaggccggcaagtgacgccacagcgggagacgcacgcatgagccaggaacggtccgacacgctggtgctcttcggcgccaccggcgacctcgcccacaagaagatatttccggcgctttaccagatggtcgccaagggcacgctcaccgaaccggtgatcggcgtcgccttcgacgcctgggacatcaagcagttgcaggcccgcgcccgcgacggcatcgtcaacgcgctgggcaagatcgacgagaaggtgttcgccaaattcgcttcgttgctgcgctatgtcagcggcgactaccgcgatccggccaccttcgagaaactgaagaccgcgcttggcaccgcccagcggccgctgcactacatggcggtgccgccgaccatgttcgagactgtcgttcaagggttggagcagtcgggaaccgcgcgtggcgcacggctgatggtggaaaagccgttcggccatgatctgcagtcggcgcgctggctgaaccgggtgctgcatctggtgttcgacgaacagtcgatcttccgcatcgaccactatctcggcaaggaagcgatccagaacctgctttatttccgcttcgccaattccttcctcgagccgatctggaaccgcaatttcgtcgagagcgtgcagatcaccatggccgaggatttcggagtcgaggggcgcggccgcttctatgacgatgtcggctgcataagggatgtcatcgagaaccatctgctcaacatcctcctgctgctggccatggagccgccggtcggccgctccgccgacgacctgatcgacgagaaggtccaggtgctccgggcgatccggacgctgacgaaagacgatgtcgtgcgcggccagttcaccggctatctcgccgagcccggcgtggcgccgaattcgccggtcgaaaccttcgctgcggtgcggttcttcgtcgacacatggcgctggcaggacgtgccgttcttcattcgcgccggcaagaacatgccggtgcatgttacggaagtggtggtgcggctgaagcgcccgccgctcgacgtcttcgacccgatcaagcccgccgaccagaattacgtgcgcttccgcatcgacccgcaggtggtgatcgccataggcgcgcagcgcaaggcgcccggcgacgacatggtcggcgagcaggtggaactgacggcgctcgacgacagcaaggccgacatgccgccttacgagcgcctgatcggcgacgccatgaacggcaatggccagctcttcacccgccaggacgcggccgagctcgcctggcgcatcgtcgggccggtgcttggcgacaccacgccgccgcatctctacgagccgaaaacatggggaccggcgcacgccatggccggcttcgggccgcccaatggctggatcgacccggtggcatga

SEQ ID NO: 2820 - protein, 475 aa, Rhizobium loti
MSKSRRPASDATAGDARMSQERSDTLVLFGATGDLAHKKIFPALYQMVAKGTLTEPVIGVAFDAWDIKQLQARARDGIVNALGKIDEKVFAKFASLLRYVSGDYRDPATFEKLKTALGTAQRPLHYMAVPPTMFETVVQGLEQSGTARGARLMVEKPFGHDLQSARWLNRVLHLVFDEQSIFRIDHYLGKEAIQNLLYFRFANSFLEPIWNRNFVESVQITMAEDFGVEGRGRFYDDVGCIRDVIENHLLNILLLLAMEPPVGRSADDLIDEKVQVLRAIRTLTKDDVVRGQFTGYLAEPGVAPNSPVETFAAVRFFVDTWRWQDVPFFIRAGKNMPVHVTEVVVRLKRPPLDVFDPIKPADQNYVRFRIDPQVVIAIGAQRKAPGDDMVGEQVELTALDDSKADMPPYERLIGDAMNGNGQLFTRQDAAELAWRIVGPVLGDTTPPHLYEPKTWGPAHAMAGFGPPNGWIDPVA

SEQ ID NO: 2821 - DNA, 3584 bp, Plasmodium berghei
  CDS (370)..(3222)
ggaaaaactttaaaacttatatggcaggcaccaaaactaacaataaattgtattttttattcattaaaattaagggatatggaattgaaacacattataattccattaaataaaatgcaaatagttataaattcggataatataagggaaaggaaagaataaaaaaagtataattttatctatttaatagcaaaaattcaactgcttattaaatcatgctatttattttcaataaattgggggatagctaatacggaatgcacacatgcattatttatccatttcatctatttaataacgtatatatatattctatatattcattaatcccacctctgtatcaacatataaaataaagaatatataaatatggagtacgagacatctttaaaatgcttagatgaaataaggtgtgtgaacaatgtgaaatatatggaaaccgaagatttaacagactttaataaaaaatcggcatattatatttgtaaagaaatatatgagaaacaattaagtaatgaaaatgggtatgtagttataggtttatcaggtggaaaaacacctatagatgtttataaaaacatgtgtgcaataaaagatataaaaattgataaaaataagttaattttttttataattgatgaaaggtataaaaatgatgatcataaattcagtaattataataatataaaatttttatttgatgaattaaatattaataaagaaacccaattatataagcccgatacaaaaaaagatcttgttagttgcataagagattataatgaacaaattaaaagcatgatagaaaaatataaaaaaatagatattgtaatattaggtatggggagtgatttccatatagctagtttatttccaaatgtgtattataatatatacatgaataattatcaaaataattatatatatgaagacaatgaaacaataaggtcattaaatgccgacaataatgttaatttaagtttactaaatgagcaagtgtattttacaacaacaaataattttgatgtgagaaaaagaattacagtatcacttaacctattgtcaaattcaacaagtaaaatatttttattaaatacagcagataaattaaatttatggaaaaatatgctcttaaatttttatgttaatcctaactataatttatatccagcatttaaaatgatcgactctagcaatacaacggtcatagcatgtggccataaaaattattcaaaaatgttagaagatttatatgttcaaaaagatgaggcactttctccgatcagcaataataatgtagagaataaaaatgagttgctaacaatagttatatttggttgctctggtgatttagcaaaaaaaaaaatatatccagccttgtttaaattattttgtaataatttattaccaaaaaatataataataatcggttttgcaagaacaggacaagattttgaatccttttttaacaaaatagctatatatttaaaaatatctttaaacagttataaaaatttatcagtttttgaaaaagccgaacgcttaaattcttttaaaagcaaatgtagatattttattggaaactatttatctccggaaagttttgaaaattttgatgtatatataacccaggaagagaggatagcattaggctgttgtggtcagaaaggtaatgaaaaacacaaacaagtgaatgtcacatcacaattccctaataatcatactagcataaatattatcaacaatatagataacggatgtgaatctccaatgctcactgattctcccaaaagatacccctgcagttcaagttattccagtacatctggtaccgctgtatgcccttacagttcacaacatgatgttaagcctagtaataatggttgtccatacctttcaagccaagccaatacatctgatagttctggttgtccatacatttcataccatactaataaatctggtcatttgggttgtccttatactatcactagaatgctatacttagccttaccaccccatgtctttgtgagtacattacaaaattataaaaagtattgcttaaataaaaacagaatcaacaaaatattacttgaaaagccatttggaaaggatttggaatcatttaaaatattatcgaaacaaatattagaaacttttcctgaaaaaaacatatatagaattgatcattatttaggaaaagatatggtttcaggattattaaaactaaaatttacaaatatatttttgttatctttaatgaacagacattttataaaatgtataaaaataacattaaaagaaacaaagggagtatatggaagaggacagtatttcgatccatatggaattataagagatgttatgcaaaatcacatgctacaattactggcattaataactatggaacatccaacagatttaaatgataaatcgatacaaaatgagaaaataaaaatattaaaatctatagcttcaatcaaattagaagataccgttataggacaatatgttaaatcaaataatgatgatacaaataataatattaattcaaatatttctgaaaatgctagtatagataaatctaaaataaatcatagttatcatgatgatccacatgtagatccaaattcaataacccctacattttgtgcatgtgttttatatattaattcaataaattggcatggtgttccaataatacttaaagcaggaaagggactaaataatgatatatgtgaaattaaaattcaattccataatattatgggctcatctgacgaaagtatgtataataatgaatttgtaattattttacaacctgtagaaggaatatatctaaaacttatgataaaaaaaatgggttctgaagaaatggaagaagtgcaattgaatttaagccttaatgaaaataataataaagcatatgttccagaagcttatgaaactttattatcagaatgctataaaggatataaaaggaaatttatctcagatgaagaattatatgaatcttggagaatattcacccctttattaaatgagttacaagaaaagcatatcaagccgctatcttacccatttgggtcatcaggaccccaagaagcttatgacctcgtaagaaaatattacaattatggaaaaaactatgccacaactgctaaattttgcagaaaatcttcctactatgatgatagcttgtttgataatatgagagaataaaataattttcttttatattttttaattgtgcaatgtcattcattagctcaataaattggatacataaaacagtaattcttattgcaaaacgtggaatatctatcattcttatcgtttgatttcgacctctcaaaatagtaggaatggaatatattcaaaaaatttattatttttagcctatggctataaacagtggagaagaaatgccaaacttgccggcgtcatcactagtttatctatctggtccttgagggaggagaatcctatgcgtatattattatatatacttattaattggattcaatttatgaatcatatcatatttgcatggggtcatatttaatcttaatatatctaggtct

SEQ ID NO: 2822 - protein, 950 aa, Plasmodium berghei
MEYETSLKCLDEIRCVNNVKYMETEDLTDFNKKSAYYICKEIYEKQLSNENGYVVIGLSGGKTPIDVYKNMCAIKDIKIDKNKLIFFIIDERYKNDDHKFSNYNNIKFLFDELNINKETQLYKPDTKKDLVSCIRDYNEQIKSMIEKYKKIDIVILGMGSDFHIASLFPNVYYNIYMNNYQNNYIYEDNETIRSLNADNNVNLSLLNEQVYFTTTNNFDVRKRITVSLNLLSNSTSKIFLLNTADKLNLWKNMLLNFYVNPNYNLYPAFKMIDSSNTTVIACGHKNYSKMLEDLYVQKDEALSPISNNNVENKNELLTIVIFGCSGDLAKKKIYPALFKLFCNNLLPKNIIIIGFARTGQDFESFFNKIAIYLKISLNSYKNLSVFEKAERLNSFKSKCRYFIGNYLSPESFENFDVYITQEERIALGCCGQKGNEKHKQVNVTSQFPNNHTSINIINNIDNGCESPMLTDSPKRYPCSSSYSSTSGTAVCPYSSQHDVKPSNNGCPYLSSQANTSDSSGCPYISYHTNKSGHLGCPYTITRMLYLALPPHVFVSTLQNYKKYCLNKNRINKILLEKPFGKDLESFKILSKQILETFPEKNIYRIDHYLGKDMVSGLLKLKFTNIFLLSLMNRHFIKCIKITLKETKGVYGRGQYFDPYGIIRDVMQNHMLQLLALITMEHPTDLNDKSIQNEKIKILKSIASIKLEDTVIGQYVKSNNDDTNNNINSNISENASIDKSKINHSYHDDPHVDPNSITPTFCACVLYINSINWHGVPIILKAGKGLNNDICEIKIQFHNIMGSSDESMYNNEFVIILQPVEGIYLKLMIKKMGSEEMEEVQLNLSLNENNNKAYVPEAYETLLSECYKGYKRKFISDEELYESWRIFTPLLNELQEKHIKPLSYPFGSSGPQEAYDLVRKYYNYGKNYATTAKFCRKSSYYDDSLFDNMRE

SEQ ID NO: 2823 - DNA, 1491 bp, Pasteurella multocida
  CDS (1)..(1491)
atgaaaattgaagcagacaacaattgtattgtaatttttggtgcatcaggtgatttaacttatcgtaaattgattcctgcactgtataacttatataaaatcggtcgtttgactgagcatttctccgtgttaggtgtggcaagaacggaattaagtgatgagggtttccgtgaaaaaatgcgccaagcgttgatcaaaagtgaaaaagcgaatggcgaaacactcgatcaattttgtagccacctttattatcaggcattaaataccgcggatgctgccgattatggcaagttaattcctcgtcttgatgatttacatgataaatatcaaacctgtggtaacacactttactatttatccacgccgccaagtctttatggtgtgattccagaatgtcttgcggcacatgggttaaatactgaagagtttggctggaagcggttaattgtggaaaaaccgtttggttatgatatccgcacggcaaaagaactcgatattcaaattcaccgtttctttgatgaacaccaaatttatcgtattgaccactatcttggtaaagaaacggttcaaaatctgctcgtgctgcgtttttctaatggatggtttgaaccactctggaaccgtaattttattgattatattgaaatcacgggcgcagaatctatcggtgtagaagagcgtggtggttattacgatgattctggcgcaatgcgtgatatgttccaaaaccatttgttgcaagtgttagccatggttgcgatggagccaccggcaattattaatgctgactcaatgcgtgatgaagtggcaaaagtcttgtattgtttacatccattaagtgaggatgacttagaaaatcatttagtcttagggcaatatacggcaggcacagttgaaggtgaagcagttaagggctacttacaggaaaaaggtgtaccggcagagtctaatacggaaacttacatggcattacgctgtgaaattgacaactggcgttgggcgggtgtgccattttatgtgcgtactgggaaacggttaccaagtcgagtgaccgaaattgtgattcatttcaaaaccacaccacatccggtatttagccaaaaagcaccagaaaacaaattaattatccgtattcaacccgatgaagcgatttcgatgcgttttggtttgaaaaaaccgggagcaggttttgaagcaaaagaagtgtcgatggatttccgttatgcggatcttgcctcaccaagcttactgaccgcttatgagcgtttattattggattctatgaaaggcgatgccactttgtttgcgcgtactgatgcggtacatgcctgttggcagtttgtggagccgattttacaatataaagcacaaaatgggcgtgtttatgagtatgaagccggtacttggggaccgacagaagccgacaaactgatcgcgaaaacgggtcgtgtttggcgtaaaccaagtggattaatgaaaaagaaagtgtaa

SEQ ID NO: 2824 - protein, 496 aa, Pasteurella multocida
MKIEADNNCIVIFGASGDLTYRKLIPALYNLYKIGRLTEHFSVLGVARTELSDEGFREKMRQALIKSEKANGETLDQFCSHLYYQALNTADAADYGKLIPRLDDLHDKYQTCGNTLYYLSTPPSLYGVIPECLAAHGLNTEEFGWKRLIVEKPFGYDIRTAKELDIQIHRFFDEHQIYRIDHYLGKETVQNLLVLRFSNGWFEPLWNRNFIDYIEITGAESIGVEERGGYYDDSGAMRDMFQNHLLQVLAMVAMEPPAIINADSMRDEVAKVLYCLHPLSEDDLENHLVLGQYTAGTVEGEAVKGYLQEKGVPAESNTETYMALRCEIDNWRWAGVPFYVRTGKRLPSRVTEIVIHFKTTPHPVFSQKAPENKLIIRIQPDEAISMRFGLKKPGAGFEAKEVSMDFRYADLASPSLLTAYERLLLDSMKGDATLFARTDAVHACWQFVEPILQYKAQNGRVYEYEAGTWGPTEADKLIAKTGRVWRKPSGLMKKKV

SEQ ID NO: 2825 - DNA, 1470 bp, Pseudomonas putida
  CDS (1)..(1470)
atggctgcgatcagtgtcgatccttgcacgtttgccctgtttggcgcccttggcgacctggcgttgcgcaagctgtttcctgcgctctaccagctcgaccgggccaacctgctgcacccggacacccgcctgctggcgctggcccgcgaggcaggcagcgcgcaggagcacctgaacagcatcgaagcccacctgcgccggcatgtgcccgaggccgatatcgagcctgctgcattgggccgcttcctggcccggttgagctaccagcacctggacttcctgcaacctgagggttaccgggccctggccgagcagttgccgggcgacctgccgctgatcgcctacttcgccacggcggcagcggtgtacggggccatctgcgaaaacctcgacaacgccgggctggccccgcgtacccgggtggtgctggagaagcccatcggccacgacctggagtcgtcgcgacgggtcaacgatgccgtggcgcggttcttccccgaaaaccgggtgtaccgtatcgaccactatctgggcaaggagacggtgcagaacctgattgccctgcgcttcgccaatagcctgttcgaaacccagtggaaccagaattccatctcccacgtggagatcaccgttgccgagaaagtcggtatcgaaggccgctggggctacttcgacaaggccggccaactgcgcgacatgatccagaaccatctgctgcagttgctgtgcctgatcgccatggacccgcccagcgagctgtccgccgatgccattcgtgacgagaaggtgaaggtgctaaaggccctggcgccgatcacgggcgagggtttgagcacccaagtggtgcgtggtcagtatattgccggctacagcgagggcaagccggtacctggctacctggaagaggacaacgccaacgcccgcagcgacaccgaaaccttcgtcgccctgcgtgccgatatccgcaactggcgctggtcgggcgtgccgttctacctgcgtactggcaagcgcatgccgcagaagctgtcgcagatcgtcatccacttcaaggaaacgccgcactacattttcgccccggaacagcgtttgcaaatcggtaacaagctgatcattcgcctgcaaccggacgaaggcatttctttacgggtgatgaccaaggagcagggcctggacaaaggcatgcaactgcgcagcggtccgttgcagcttaatttttctgacacctggcgcagtacgcggattccggatgcctacgagcgcctgttgctcgaagtgatgcgtggcaaccagaacctgttcgtgcgcaaggacgaaatcgaatatgcctggaagtggtgcgaccagttgatcgccggctggcgtaatgcgggcgatgcgcccaagccttacgcggcgggctcctgggggccgatgagctcgattgcattgattacacgcgatgggagggcgtggtatggggatatctga

SEQ ID NO: 2826 - protein, 489 aa, Pseudomonas putida
MAAISVDPCTFALFGALGDLALRKLFPALYQLDRANLLHPDTRLLALAREAGSAQEHLNSIEAHLRRHVPEADIEPAALGRFLARLSYQHLDFLQPEGYRALAEQLPGDLPLIAYFATAAAVYGAICENLDNAGLAPRTRVVLEKPIGHDLESSRRVNDAVARFFPENRVYRIDHYLGKETVQNLIALRFANSLFETQWNQNSISHVEITVAEKVGIEGRWGYFDKAGQLRDMIQNHLLQLLCLIAMDPPSELSADAIRDEKVKVLKALAPITGEGLSTQVVRGQYIAGYSEGKPVPGYLEEDNANARSDTETFVALRADIRNWRWSGVPFYLRTGKRMPQKLSQIVIHFKETPHYIFAPEQRLQIGNKLIIRLQPDEGISLRVMTKEQGLDKGMQLRSGPLQLNFSDTWRSTRIPDAYERLLLEVMRGNQNLFVRKDEIEYAWKWCDQLIAGWRNAGDAPKPYAAGSWGPMSSIALITRDGRAWYGDI

SEQ ID NO: 2827 - DNA, 1566 bp, Trypanosoma brucei
  CDS (1)..(1566)
atgcagaattgtagaaaggttgcagacactctcaggaaggattcatgcgacatcatcccggatgctgctgcacctgaattgaaggaaagagcacttactattgtcgtgcttggggcaagcggtgacttggcgaggaataaaacgttcccggcgctgtttcaactattctgtaacggattaattccgcgaacgattaacattgtcggctacgctcgcaccaaaatgcctgacgtggagcaatggaaaaaagagagcctagctaagcattttcctcgggctaaggatcgctgcccccatattgaggctttcttgaagacaatcacctatatctcgggctcgtatgacggtgcggatgatttttttcgtcttaacgacgtgataacaaaatttgaggagtcgtttccaggaaaacagaaaggaggcaacaggttgttctaccttgcgttaccaccttctgtatttatgcatgcgtgcacggggattcgcactcatgtgatgcagaaaccgggcctggggtgggttcgaataattattgaaaagccattcgggcacgacacggaaagttctaatgaactttcgaggcagttggagcctcttttcgaagaatcccaaatttttcgaatcgatcattatcttgggaaggaaatggtgcaaaatattgttgtcacccgcttcgccaaccgtgttttcagtgcactatggaacaataataacatcgcgtgcgtccggatcacttttaaggagtctatcgggacggagggccgcggtggttactttgacaaggcgggtattatccgcgacgtggtgcaaaaccaccttacccagatcctttcactgttagcaatggagaaaccacgctcactaagcccagaggatatacgtgatgaaaaggtaattgtactaaggcatgtgaatcccgtgactcccgccgactgcgtgttgggacagtacacgaggtctgaagacggttctattcctggttacctggaggatccaacggtgccgaggggaagtaaatgcgcgacattcgtggtacttcgactgttcattaacaacgaccgctgggacggtgtgccattcatcatagaggcggggaaagcggtggagcggcgctatctcggcatacgcatccagtttaaggatgaaatccgcccctttggagttgccgcacagcgcaacgaactgatcatacgagcgcagccctcggaggcaatgtatttgagacttaccgcaaaaacacccggcgttctctcagacactcaccagaccgaacttgacctctcctacgaacatcgttacaacataactctgccagatgcctatgagagcctcattcacgaagcacttctggggaggtccaccaatttcgttcgaaaggatgaactcgatgccgcgtggaggatctacacaccactcttggaggctattgaacgtggagaaaccacaacgtacccctactccgctgggtcaaaggggccggcggaagcacaaaagtttgttgatgacactgggtttaaacctctcacaggggatatttaccagcagcggaagcttcatcatttgtaa

SEQ ID NO: 2828 - protein, 521 aa, Trypanosoma brucei
MQNCRKVADTLRKDSCDIIPDAAAPELKERALTIVVLGASGDLARNKTFPALFQLFCNGLIPRTINIVGYARTKMPDVEQWKKESLAKHFPRAKDRCPHIEAFLKTITYISGSYDGADDFFRLNDVITKFEESFPGKQKGGNRLFYLALPPSVFMHACTGIRTHVMQKPGLGWVRIIIEKPFGHDTESSNELSRQLEPLFEESQIFRIDHYLGKEMVQNIVVTRFANRVFSALWNNNNIACVRITFKESIGTEGRGGYFDKAGIIRDVVQNHLTQILSLLAMEKPRSLSPEDIRDEKVIVLRHVNPVTPADCVLGQYTRSEDGSIPGYLEDPTVPRGSKCATFVVLRLFINNDRWDGVPFIIEAGKAVERRYLGIRIQFKDEIRPFGVAAQRNELIIRAQPSEAMYLRLTAKTPGVLSDTHQTELDLSYEHRYNITLPDAYESLIHEALLGRSTNFVRKDELDAAWRIYTPLLEAIERGETTTYPYSAGSKGPAEAQKFVDDTGFKPLTGDIYQQRKLHHL

SEQ ID NO: 2829 - DNA, 1904 bp, Triticum aestivum
  CDS (153)..(1682)
aattcgattgccacccccctccccattcctacccacccagcatctcggcagtaactctcctccctcccacgcggcgcgcccgctcgccgcgcgcgcgaatctcggtcgcaactggtgtactgttgaaggaaggaaaaatcatcctatttgtcatggcgggaactgactcctcggcgtcatcgagacaaagcagtttcaactcattagcaaaggacctagaacttcctttggagaaagggtgcctcaccatcgttgtacttggggcttctggagatcttgccaagaagaaaacgttcccggcactctaccacctttttgagcaggggttcttacaatctggtgaagtgcatatagtggggtatgcgagaacaaatctttctgatgatgggttgagagggcgcatccgtgcataccttaaaggagcctcagaggaacatgtttcagaattcttgcaattgataaaatatgtcagtggttcctatgacagtggagaaggttttgaaaaactgaacaaggaaatatcagattatgagatgtcaaacaactcaggaagctcccgtaggctcttttatttggcattgcctccatctgtctacccttcagtgtgcaaaatgatccgaacatattgcatgagtccaacttctcgcgctggatggactagagtaattgttgagaagccctttggaaggggcctggactctgcagaagaattgagttcccaacttggggagctattcgaggaagatcaactctacaggattgaccactacttgggaaaagagttggtccaaaacttgcttgtgcttcgttttgcgaaccgtttgttcttaccactttggaaccgtgacaatgttgataatatacagattgtattcagggaggacttcggaactgatggacgtggaggatattttgatcaatatggaatcatccgtggtatcattcagaaccatttgttgcaggttttctgtttggttgcaatggaaaagcctgtatctcttaagcctgagcacatcagagatgagaaagtcaaggttctgcaatccgtgaacccgataaaggacgaagaggtagtccttggacaatatcagggctacaaggaggaccctacagtgccagatgactctaacaccccaacgtttgcatctattgtacttagggtacacaatgaaagatgggaaggtgttcctttcattcttaaagctggtaaagcattaaactcaagaaaagcagaaattcgtgtgcagttcaaggatgttcccggtgacatttttaaatgtaagaagcagggaagaaatgagtttgtcatacgcctccagccatcagaagccatgtacatgaaactaactgtgaagaaacctggattggaaatggctactgaacagagtgaacttgatctgtcatatgggatgcgttaccaagatgtcaaaattccagaggcatacgagcgcctcattttggatacaataagaggagaccagcaacactttgtgcgccgagatgagctgaaggctgcctggcagatcttcactcccttgttgcacgacatcgacgctggcaagctgaaggctgtttcatacaagcctggcagccgaggccccaaggaagctgatgaactgagtgagaaggttgggtacatgcagacccacggttacatctggataccacccacccttgcatagagtgcctccctcgatccttgtaggtttgtttagctaggaagagtgaaagtatcacggataaaaatcttacgaattttagctgtactgcggtttacctggcgttgtaataacggatctgttcgacggagtatacctcaccacggtgtgaaataaaaaatggagtgtttcaatcaaaaaaaaaaaaaaaaaaaagagtcgcgcgatcgatgccaatcactagtg

SEQ ID NO: 2830 - protein, 509 aa, Triticum aestivum
MAGTDSSASSRQSSFNSLAKDLELPLEKGCLTIVVLGASGDLAKKKTFPALYHLFEQGFLQSGEVHIVGYARTNLSDDGLRGRIRAYLKGASEEHVSEFLQLIKYVSGSYDSGEGFEKLNKEISDYEMSNNSGSSRRLFYLALPPSVYPSVCKMIRTYCMSPTSRAGWTRVIVEKPFGRGLDSAEELSSQLGELFEEDQLYRIDHYLGKELVQNLLVLRFANRLFLPLWNRDNVDNIQIVFREDFGTDGRGGYFDQYGIIRGIIQNHLLQVFCLVAMEKPVSLKPEHIRDEKVKVLQSVNPIKDEEVVLGQYQGYKEDPTVPDDSNTPTFASIVLRVHNERWEGVPFILKAGKALNSRKAEIRVQFKDVPGDIFKCKKQGRNEFVIRLQPSEAMYMKLTVKKPGLEMATEQSELDLSYGMRYQDVKIPEAYERLILDTIRGDQQHFVRRDELKAAWQIFTPLLHDIDAGKLKAVSYKPGSRGPKEADELSEKVGYMQTHGYIWIPPTLA

SEQ ID NO: 2831 - DNA, 2098 bp, Solanum tuberosum
  CDS (27)..(1775)
cacgagcttctctgatttctcaagatatggtaaccctttattcttccccttccactaactgttctggggccttttcatcatactccaattcttctattgggttctacaattatcattacaacttccctatttcatccagaaagtttggttctcacaagatttctttgcaaattaatgccgttcgcatgcaagatggtgctgtagtggctcaacctagcaaaacccaagatgaaactcctttgaagaaattaaaagatggaattttgtcaaaggagcagaaacatacatttgattttgattgcaacaaagataaatcaactgtcagtattactgttgttggtgcttcaggagatcttgccaaaaaaaagatatttcctgcactttttgcactttattatgagggttgcttaccggagcatttcactatttttggctatgcccggagtaagatgtctgatgacgaactcaggaacatggtcagcaagacacttacttgcaggattgataagagggaaaattgtggtgaaaagatggaacagtttctagaaaggtgtttctaccatagtggacaatatgattcccaggaacactttgcagagcttgataaaaagctgaaagaacatgaggctggaaggttttccaatcgtctgttctacttgtccattccaccaaatatttttataaatgctgtacgatgtgcaagcctctctgcatcatctgctcatggatggactagagtcattgtagagaaaccctttggtcgggattctgaatcctctgctgcattaacaggagcacttaagcagtacttgaaggaagatcaaattttcaggattgatcactatttagggaaggagcttgtggaaaacctttctgtccttcgtttcttcaacttgatatttgaacccttatggtcaaggcagtatataaggaacgtgcagtttattttctctgaagattttggcactgaaggaaggggaggttattttgatcattatgggataattagagacattatgcaaaaccatttgcttcaaattcttgccctctttgccatggaaacacctgtcagtttggatgcagaagatatcaggaatgaaaaggtaaaagttctgcgttctatgagacctttacaactagatgatgttatcgtcgggcagtacaaaagtcacacaaaagggggtgttaactatcctggttataccgacgacaagactgtacccaaggacagtctaaccccaacttttgctgcagctgctcttttcatagataatgcaagatgggatggggtgcctttccttatgaaggctggaaaagctttacataccaggagtgcggaaataagagtacaattcaggcacgtgccgggaaatttatacaataagaactttggctcagatctagatcaggcaacaaacgagcttgttatccgtgttcaacctgatgaagctatatacctaaagatcaataacaaagttcctggtctaggaatgagactggatcgcagtaatcttaatctgctttactcagcaagatacgcgaaggagatccctgatgcatatgagcggctacttcttgatgccatagaaggtgaacgtaggctttttattcgcagtgatgaactggatgctgcgtggtctcttttcacaccagtgttgaaagaacttgagcataagaaaatagtaccggaaagctacccctatggaagtcgaggacctattggagcacattaccttgcagcacgatataaagtaagatggggtgatcttgcttagacaaagtaatttgccattgctatgagaaaccatatgtagccttacaacttcttctgcttagtatgttgcaaccaaatttgttagtgggattccagtatccagactaacaaagcttgaagttgcttactgtcaaggcatatgacaatagagaacacacagttggtaaaacaaaagaagaggagaatctgggttcattttgttatttcaaataaatcttttctattgcaccaacgcatatccattggtagcagcttttttcatgtagcatttagtataccttgttagaatctaataattcgaaaagtaaaaaaaaaaaaaaaaaa

SEQ ID NO: 2832 - protein, 582 aa, Solanum tuberosum
MVTLYSSPSTNCSGAFSSYSNSSIGFYNYHYNFPISSRKFGSHKISLQINAVRMQDGAVVAQPSKTQDETPLKKLKDGILSKEQKHTFDFDCNKDKSTVSITVVGASGDLAKKKIFPALFALYYEGCLPEHFTIFGYARSKMSDDELRNMVSKTLTCRIDKRENCGEKMEQFLERCFYHSGQYDSQEHFAELDKKLKEHEAGRFSNRLFYLSIPPNIFINAVRCASLSASSAHGWTRVIVEKPFGRDSESSAALTGALKQYLKEDQIFRIDHYLGKELVENLSVLRFFNLIFEPLWSRQYIRNVQFIFSEDFGTEGRGGYFDHYGIIRDIMQNHLLQILALFAMETPVSLDAEDIRNEKVKVLRSMRPLQLDDVIVGQYKSHTKGGVNYPGYTDDKTVPKDSLTPTFAAAALFIDNARWDGVPFLMKAGKALHTRSAEIRVQFRHVPGNLYNKNFGSDLDQATNELVIRVQPDEAIYLKINNKVPGLGMRLDRSNLNLLYSARYAKEIPDAYERLLLDAIEGERRLFIRSDELDAAWSLFTPVLKELEHKKIVPESYPYGSRGPIGAHYLAARYKVRWGDLA

SEQ ID NO: 2833 - DNA, 1924 bp, Dunaliella bioculata
  CDS (68)..(1840)
gaattcggcacgaggtgttcagcatcatcaacccttagctcgtgccctccaggcgttcgtttttctcatgttgggtggaaggcagttgggtatggacaagctgtcccggaagctgtccggtgctcaacctgttgcgaactactcgcgtcgcccgatttcgcgcccatttcgcgcagcgcctgttcctcgagtcgcgcagaattcccaagatgctgtgacccagaatggcagcgggacaagcgaggcacccacctcctggcagaacccagcactcaagaaggccatccccactgtggtttctctctcagatgaggctgcagccatggcagctgatgactggagccaatctagcttgtcggttgttgtggtgggcgccagcggcgacctggccaagaagaaaatttttcctgcactttttgcccttttctatgagggcctgctgccaccggacttccagctctttggatatgcacgcagcaagatgactgatgaggagttccgagacctcatcggcaacaccctgacgtgccgcattgatgccaggtcccgctgcgaagactcccaggccgccttcttgtcgcgctgcttctactgcccaggccagtatgatgcccctgagggctatgccaacttggacaagaagtgcaaggagcaggaggccctgactggcaagatggtagccaaccgcatgttcttcctgtccatccctcccaacgtgtttgtgcaagcagcaggcggcgcagccgacaactgctcttctcccaccggctggacgcgcgtcattgtggagaagccctttggcagggacagcgccagcagtgctgagcttggcaggggtctggccaggcatttgacagaggaccagatctaccgtattgaccactacctggggaaggagctgattgagaacctgacagtgctgcgcttttcaaaccttgtgtttgagcccttgtggagcaggcagtacatccgcaatgtgcaggtgatcttctcagaagactttggcactgaaggccgcggaggctacttcgaccggtacggcatcatccgcgatgtcatgcagaaccacttgctccagattgtggcattgttcgccatggagccaccggtgtccctggatggagaggccatccgtaatgagaaggtcaaggtcctgcagtctatgtctcaagtggcgctggaggatgtcacactgggccaataccgcggcaggtctggcgctggccgttccggtggtgctgatttgcctggctacctggatgatgcaacagtgcccaagggctccctgtgccccacctttgctgccattgcgctgcacatcaacaatgcacgctgggatggtgtgccattcctgctcaaggctggcaaggcgctgcacacgcgcggcgctgagatccgtgtgcagttcaggcatgtgcccggcaacattttcaagcacaaagtgggccccaacatcgacatgaccaccaacgagcttgtgatccgcattcagccgcgggagtccatctacctcaagatcaacaacaaggtccctggcttgggcatgcgcctggataccaccaagctggacctggtgtacaacgacgcatactccaaggagttgccagatgcgtatgagcgcctcctgttggatgtggtgaacggcgataagcgcttgttcatccgcgatgatgagctggagcaggcctggaacatctttaccccagtgctgcatgagatcgagcgcagaaaggtggcacctgagctgtacccctacggcagcagaggccctgtgggggcacactacttggctgccaagtacaacgtgcgctggggagacttgacggaggatgagatctgaggtgtgaggccctggaccgacctcatccctggtgttcaatggttacatcagacatgagggcacctcaacacaggggcattccga

SEQ ID NO: 2834 - protein, 590 aa, Dunaliella bioculata
MLGGRQLGMDKLSRKLSGAQPVANYSRRPISRPFRAAPVPRVAQNSQDAVTQNGSGTSEAPTSWQNPALKKAIPTVVSLSDEAAAMAADDWSQSSLSVVVVGASGDLAKKKIFPALFALFYEGLLPPDFQLFGYARSKMTDEEFRDLIGNTLTCRIDARSRCEDSQAAFLSRCFYCPGQYDAPEGYANLDKKCKEQEALTGKMVANRMFFLSIPPNVFVQAAGGAADNCSSPTGWTRVIVEKPFGRDSASSAELGRGLARHLTEDQIYRIDHYLGKELIENLTVLRFSNLVFEPLWSRQYIRNVQVIFSEDFGTEGRGGYFDRYGIIRDVMQNHLLQIVALFAMEPPVSLDGEAIRNEKVKVLQSMSQVALEDVTLGQYRGRSGAGRSGGADLPGYLDDATVPKGSLCPTFAAIALHINNARWDGVPFLLKAGKALHTRGAEIRVQFRHVPGNIFKHKVGPNIDMTTNELVIRIQPRESIYLKINNKVPGLGMRLDTTKLDLVYNDAYSKELPDAYERLLLDVVNGDKRLFIRDDELEQAWNIFTPVLHEIERRKVAPELYPYGSRGPVGAHYLAAKYNVRWGDLTEDEI

SEQ ID NO: 2835 - DNA, 1976 bp, Cyanidium caldarium
  CDS (46)..(1848)
cacgagcaccattttattttcttcttctcaacgtgtaagagcaatatgtggatacctctattcataactggtttttggaataccaatacatcttcatctcacttatggaaaacaaaatatacaaagggatggacaactcctttgtatttctctaaagtggacaagtcgttctttgctcctcgtttagcttctattcaagctgttcaaggagatttggataatatcgcccctcaatggaacgactcttcattagaaacaactcttcctataactaccaatgaacgtccagctattccaagacaacacttcagccacctcggagacactttagatcctagtttgatggactccgtcaagaaacgaaaacagagagcaaaagaagagcctttatgtattgttgttattggtgctagtggagacttggcaaagaagaaaacttttcctgctttgttttccttgtattatcacgatttgttaccaaaggactttctcattgtaggttatgctagaagacaaatgactcaagaagagtttagaaactctattatggaatcattgacttgtagagttatcgatggcccacagtgtcaacgaaagatggatgagtttctacccaaatgtcactatatgtcaggtatgtatgatagaactgaagattttgttcgattggatcaatttttgaacaactttgaacaatcatttcccaatactcgagtggatagactatattatttagctgttccttctcaagtatttgaaaatgtggtacatcatgttcatgaaagcggaagaacgcaacgaggttggaatcgcatcgtcatggaaaaaccatttggaaaagacattacttcttatctacagcttcgaaatagtcttcgcaattgtatttctgaagatgaaatataccgaattgatcactatttgggaaaggagttggtacaaaatttgatggttttacggtttgccaattatctatttgagcctttatggaatcgagaccatatagcttccattcaaattgtgtttaaagagaattttggtgtggaaggaagagctggatatttcgatgaatatggaattattagagatattatgcagaatcatttattacaagtgatggcattgttgggtatggaacaaccagtaactttacatgcggaagatattcgagatgaaaaggtaaaatttctacgctctatacgtcctttaaaagcatcagactttgtacttggtcaatatagagaccgtcagaatcctcaacgttcttatttatcggaacctggagtaatgaatgatagtcatactcctacttttgctgcttgtgtatttcaagtggataatagaagatggtcaggtgtaccatttcttatgaaggctggtaaggcattggatgaacgcaaggcagaaatacgtattcagtttcaatctgttcctggtggactattttctcaagtagtttcgtcacatcttccacataatgaattggtgattatagtacaaccagatgaagccatttatatgcgtattcttagcaaggcaccgggttttacttcgcgtttggaagaggcacgtttgaatctcttctatcgtacggcttgggaagatagtaaagatatacctgatgcctatgagagacttattctggatgtcatacatggtgagaaaagtttgtttattcgtgatgatgaattggaagtggcttggaatatatttactccttcattgaaggaaatggaaatggctcaagattcgtggaaacctattttgtacgattacggtggaagaggtccaatcgaaagtgattatttggctgccaaatatgcagtgcaatggagtgaaggtgattgatgttcatgtaaggataatatagaaagaactggaatccattcagttgcaatggcattcatggattcttcatgtttctatataaaatagttgttcgtctaaaaaaaaaaaaaaaaaaaaaaaaaaaaaaa

SEQ ID NO: 2836 - protein, 600 aa, Cyanidium caldarium
MWIPLFITGFWNTNTSSSHLWKTKYTKGWTTPLYFSKVDKSFFAPRLASIQAVQGDLDNIAPQWNDSSLETTLPITTNERPAIPRQHFSHLGDTLDPSLMDSVKKRKQRAKEEPLCIVVIGASGDLAKKKTFPALFSLYYHDLLPKDFLIVGYARRQMTQEEFRNSIMESLTCRVIDGPQCQRKMDEFLPKCHYMSGMYDRTEDFVRLDQFLNNFEQSFPNTRVDRLYYLAVPSQVFENVVHHVHESGRTQRGWNRIVMEKPFGKDITSYLQLRNSLRNCISEDEIYRIDHYLGKELVQNLMVLRFANYLFEPLWNRDHIASIQIVFKENFGVEGRAGYFDEYGIIRDIMQNHLLQVMALLGMEQPVTLHAEDIRDEKVKFLRSIRPLKASDFVLGQYRDRQNPQRSYLSEPGVMNDSHTPTFAACVFQVDNRRWSGVPFLMKAGKALDERKAEIRIQFQSVPGGLFSQVVSSHLPHNELVIIVQPDEAIYMRILSKAPGFTSRLEEARLNLFYRTAWEDSKDIPDAYERLILDVIHGEKSLFIRDDELEVAWNIFTPSLKEMEMAQDSWKPILYDYGGRGPIESDYLAAKYAVQWSEGD

SEQ ID NO: 2837 - DNA, 2106 bp, Drosophila melanogaster
  CDS (28)..(1746)
gcgatttttgcctcagtctatacctccatgcaatatctatcactaatcttttttaaattacaactatttattcttggccaaaatttgacgttaccttgctttcttttattctctcaaaattatacttcaattaaattacccgaaatgatttccatggacccccacaatgaggaggcgtattccatcgtggtcttcggagcctcaggcggattggccaaaaagaaggtgtttccggcgctttgggctctcttccgggagaatcggctgccccagggcaccaaaatatttactttcacccggtccccgctgcagacgaagacgtaccggttgcagattcttccctatatggagctggacaagcatcgggaccccaagaagtacaacctcttttggacgaccgtgcactgtgtgcagggcgagtacgacaagccggagaactacgtggcactcacggaggcgatggtacaccaggagacaaagcacaatcaggtgcgcgcgaatcgaatcttctacctggcgctgccaccgatcgttttcgatcaggtgaccctcaatgtcagtcgaaaatgcagctcgaccacgggatggaaccgcataatagtggagaagcccttcgcgcgggacgacatctcctacaaggcctttcaaacctcgctgtgcaactgcttccgggagtcgcagatttacctgatggaccacctcctcagccggcaggtgatgcagaacttctttgcgctgcgctactcaaaccacttgtgggccgagaccctgaaccaccgccacgtggcggcggtgatgatatccataaagtgtgagctgccggtgtcggtgaatcgggcagactactttaatcagtttggcattattcgcgacctgatgaccaaccacatgatccagatgctggccatgctggctatggatcagccgtacgccaacactgctgacgacctgcgtgccgaacggctgaaggttcttcgccaggtgctaactcccaacataggcgacgtcgtcttggctcaataccgcaacaaccggcgggagactgaccccgcgaagtgcggctacacggagcacacctacatcccgaaggactcctttacgcccacattcgctctggtggtgctgcacatcaacaaccgccgttggaccggggtacccttcattctcagagcgggaaaagccttgaacgacaccaagtcggaggtgcgtatccagtacaagccggtggactgcgacaccttccacagcgacagtactgacattcgtaacgagctagtcctgagatccttccccacggaagaggtctttatgcgcatgcgcctcaagcggcagggcgaggatatctgccttcgggagagcgagatcaacctgcgagtggatgatcggggaccgaagggactccaaggactgcccggctacctgctcaacgtgtttcaaggcgaccagacgctcttcatgcgctccgatgagcagtgcgagatttggcgcatattctcccccgttctcgccaccatcgattcggatcgtccccgcccgttgcactatgactttggatcacggggtcctttgctggcctatcgcaaggccgagcgcgctggcttcgtattcttcgccacggacgagtggcatcagagcgaagagacgttagaatacacggtcaagaatagcaagcagctaatcggaccccataccgccctcaagccagtaagagatcctcggtccaagaggtcgaattccaatccttaggcgtagggagatagttaaagcttatacgaaagttttttaattaagcaagtgcagcctgctgtgttgcaccagttggccaccacttcaccttggctgcccagtctaacccttcaccgctgtccgttccattcggttctaatccgttccgtgccattgttgcccatgttgccggtgaggatttcgccaagaggggcgtaaacaacacgcaagtcttggccattgtcctttgcagataggggtgagatgcactatagtgtatgggaactacgtaattctctataaatttatatctacttatatttgtacatacaaaattgttttcagtttaataaaaattttatttaaattacatttaatttt

SEQ ID NO: 2838 - protein, 572 aa, Drosophila melanogaster
MQYLSLIFFKLQLFILGQNLTLPCFLLFSQNYTSIKLPEMISMDPHNEEAYSIVVFGASGGLAKKKVFPALWALFRENRLPQGTKIFTFTRSPLQTKTYRLQILPYMELDKHRDPKKYNLFWTTVHCVQGEYDKPENYVALTEAMVHQETKHNQVRANRIFYLALPPIVFDQVTLNVSRKCSSTTGWNRIIVEKPFARDDISYKAFQTSLCNCFRESQIYLMDHLLSRQVMQNFFALRYSNHLWAETLNHRHVAAVMISIKCELPVSVNRADYFNQFGIIRDLMTNHMIQMLAMLAMDQPYANTADDLRAERLKVLRQVLTPNIGDVVLAQYRNNRRETDPAKCGYTEHTYIPKDSFTPTFALVVLHINNRRWTGVPFILRAGKALNDTKSEVRIQYKPVDCDTFHSDSTDIRNELVLRSFPTEEVFMRMRLKRQGEDICLRESEINLRVDDRGPKGLQGLPGYLLNVFQGDQTLFMRSDEQCEIWRIFSPVLATIDSDRPRPLHYDFGSRGPLLAYRKAERAGFVFFATDEWHQSEETLEYTVKNSKQLIGPHTALKPVRDPRSKRSNSNP

SEQ ID NO: 2839 - DNA, 1777 bp, Mesembryanthemum crystallinum
  CDS (39)..(1589)
ccactacgaaatttctccgaactcaaattcttccaagaatggggtcaggcgagtggcacgtggaaaaaagatcgagcttgaagagtgaattatctaaagacataggagagtctgaaagttcacaagaatgtggctctctttctatcattgttctaggtgcctctggtgatcttgccaagaagaagaccttccctgctctgtttaatctttaccgccagggatttcttcctcccagtgaggttcacatatttggttatgcaaggtcaaagatgacagatgatgacttgagagatcgcatacgtggacatctgattcccaggaatgtaacagcggagatatctgaggatgttttgaactttctgcatctgattaaatatgttagtgggtcttatgacactgaggacggttttcacttgttagatgatgaaatatcaaagtatgagtgtcaaaagaacagccaggaacattctaagagactcttttatcttgctcttcctccatcagtatatccatcagtctgcagaatgataaagctttgctgtatgaataaatctgatcttgggtggactcggattgttgttgagaagccttttggaagagacttagaatcagcagaacaacttagtgctcagattggagagttgtttgatgagtcacagatttaccgaattgatcactatttggggaaggagttggtgcagaacttgctggtgatgcgcttcgcgaatcgtctttttctacctctctggaatcgggacaatattgcgaatgtgcagattgtcttcagggaagattttggaacacaaggtcgtggtgggtactttgatcaatatggaataatccgtgacattattcaaaaccaccttttgcaggttctttgtttagttgccatggagaagcctgtctcaatcaaaccagagcacattcgtgatgagaaagtgaaggttctccaagctgttaatctaataaaagatgaagaggttgttcttgggcaatatgaaggctacaaggatgatccaactgttcccgaagactcaaacactccgacatttgcgactatggttttgcggatacacaatgaaagatgggaaggtgttccatttatactaaaggcagggaaagcattgaattcacgaaaagcagaaatacgtgttcagttcaaagatgttcctggtgacatattcaaatgtaacaagcaggggagaaatgagtttgtaatacggctacagccttcagaagcactctatatgaagcttacggtgaagcagcctgggcttgaaatgtcaactatacaaagtgagctggatttgtcgtatgggcagcggtatcagggagtcgttattccagaggcctatgagcgtctgattctggacacgataaaaggcgatcaacaacattttgtccgtagagatgagttgaaggctgcgtgggagatctttactcctcttctacacagaattgataagggagaattcaagccaatttcatacaagcctggaactcgaggcccagcagaagcagatgagctactggcaaaggctggatacgttcaaactcatgggtacatctggattccacccaccttatagtcactcggaaaagctacacggattgaatcggccatcaaaatttgtgtttggatatagtttgagaaaagctcttcgtggtgctggtagctcttattgaaccttgacagtaatttgtcttgggtacactaaagctactacagttgtatgtaattcattttgctggtgtaataaaagtcatttccggtttt

SEQ ID NO: 2840 - protein, 516 aa, Mesembryanthemum crystallinum
MGSGEWHVEKRSSLKSELSKDIGESESSQECGSLSIIVLGASGDLAKKKTFPALFNLYRQGFLPPSEVHIFGYARSKMTDDDLRDRIRGHLIPRNVTAEISEDVLNFLHLIKYVSGSYDTEDGFHLLDDEISKYECQKNSQEHSKRLFYLALPPSVYPSVCRMIKLCCMNKSDLGWTRIVVEKPFGRDLESAEQLSAQIGELFDESQIYRIDHYLGKELVQNLLVMRFANRLFLPLWNRDNIANVQIVFREDFGTQGRGGYFDQYGIIRDIIQNHLLQVLCLVAMEKPVSIKPEHIRDEKVKVLQAVNLIKDEEVVLGQYEGYKDDPTVPEDSNTPTFATMVLRIHNERWEGVPFILKAGKALNSRKAEIRVQFKDVPGDIFKCNKQGRNEFVIRLQPSEALYMKLTVKQPGLEMSTIQSELDLSYGQRYQGVVIPEAYERLILDTIKGDQQHFVRRDELKAAWEIFTPLLHRIDKGEFKPISYKPGTRGPAEADELLAKAGYVQTHGYIWIPPTL

SEQ ID NO: 2841 - DNA, 1542 bp, Mus musculus
  CDS (1)..(1542)
atggcagagcaggtgaccctaagccggacccaagtgtgtgggatcctgagggaagagttgtaccaaaatgatgccttccaccaagctgatacacacatatttatcatcatgggtgcatcgggtgacctggccaagaagaagatctatcccaccatctggtggctgttccgggatggtcttctacccaaagaaaccttcattgtgggctatgcccgctcacaactcacagtggatgacatccaaaagcagagtgagcccttctttaaggccactccagaagaaagacccaagctggaggagttcttcacgcgtaactcctatgtagttggccagtatgatgatccagcctcctataagcacctcaacagctacattaatgccctgcaccaggggatgcaggccaaccatctattctacctggccttgccccccacagtctatgaagcagtcaccaagaacattcaagagacctgcatgagtcagacaggctttaaccgcatcatagtggagaaacccttcgggagagacctgcagagctccaatcaattgtctaaccacatctcctctcttttccgtgaagaccagatctaccgcattgaccactacctggacaaagagatggtccagaacctcatggtgctgaggtttgctaacaggatctttggccctatctggaatggagacaacattgtttgtgtgatcctcacatttaaagagccctttggtactgagggtcgtgggggctattttgatgaatttgggatcatcagggatgttatgcagagccacctcctgcagatgttgtgtctggtggccatggaaaagcctgctaccacagattcagatgatgtccgtaatgagaaggtcaaagtgttgaaatgtatctcagaggtggaaactgacaatgtgatccttggccagtatgtggggaaccccaatggagaaggagaagctgccaatggatacttagatgaccccacagtaccccgtgggtccacaactgccacctttgctgcagctgtcctctatgtgaagaatgaacggtgggatggggtacccttcatactgcgctgtggcaaagccctgaatgaacgcaaagctgaagtgagactgcaattccgagatataccaggcgacatcttccaccagaagtgcaagcgtaatgagctggtcatccgtatgcagcccaatgaggcagtatacaccacgatgatgaccaagaagcctggcatgttctttaaccctgaggagtcggagctggacctaacttatggcaacaaatacaagaatgtgaagctccctggtgcctatgaacgcctcatcctggatgtcttctgtgggtgccagatgcactttgtccgtactgatgaactcagggaaggctggcgtatcttcacaccactgctgcacaagattgaacgagaaaagccccagcccttcccctatgtatatggcagccgtggccccacagaggcagatgagctgatgaggagagtgggcttccagtacaagggtacctacaagggtactcacaagcactga

SEQ ID NO: 2842 - protein, 513 aa, Mus musculus
MAEQVTLSRTQVCGILREELYQNDAFHQADTHIFIIMGASGDLAKKKIYPTIWWLFRDGLLPKETFIVGYARSQLTVDDIQKQSEPFFKATPEERPKLEEFFTRNSYVVGQYDDPASYKHLNSYINALHQGMQANHLFYLALPPTVYEAVTKNIQETCMSQTGFNRIIVEKPFGRDLQSSNQLSNHISSLFREDQIYRIDHYLDKEMVQNLMVLRFANRIFGPIWNGDNIVCVILTFKEPFGTEGRGGYFDEFGIIRDVMQSHLLQMLCLVAMEKPATTDSDDVRNEKVKVLKCISEVETDNVILGQYVGNPNGEGEAANGYLDDPTVPRGSTTATFAAAVLYVKNERWDGVPFILRCGKALNERKAEVRLQFRDIPGDIFHQKCKRNELVIRMQPNEAVYTTMMTKKPGMFFNPEESELDLTYGNKYKNVKLPGAYERLILDVFCGCQMHFVRTDELREGWRIFTPLLHKIEREKPQPFPYVYGSRGPTEADELMRRVGFQYKGTYKGTHKH

SEQ ID NO: 2843 - DNA, 1485 bp, Actinobacillus actinomycetemcomitans
  CDS (1)..(1485)
atgaaagcagaaaactgttgtattgtaattttcggcgcctccggcgatctcacttatcgtaaacttattccggctttatataacctctataaaattgatcgactgggtgaagatttctccgttctcggcgtggcacgtaccgaactgaatgacaaatcattccgtgagaaaatgcgccaaacgctgatcaaaaatgaaggcgcgaaaggcgagtgcttggagcaattttgcagccacctgtattatcaggcggtcaatacggcggacaaagcggattacgccaaactggttccgcgtcttgacgaactgcacgacacctatcgcaccgaaggcaacaccttgtattatctttccacgccgccgagcctatatggcgtgattccggaatgtttgggcgaacatggcttaaataaagaagatcgcggctggaagcgtcttattgtggaaaaaccgttcggttatgaccgtgaaaccgccgaagcgctggatattcaaattcaccgtttctttgaagaacatcaaatttaccgtatcgaccattatcttggtaaagaaaccgtccaaaacctgcttgtgttgcgcttttccaacggttggtttgagccgttgtggaaccgtaatttcattgattacattgaaatcaccggcgcggaatctatcggtgtagaagagcgtggcggctattatgacggttccggcgcgatgcgcgatatgttccaaaaccatttattacaagtgctggcaatggtggcgatggagccgccggtgattatcaacgccaattccatgcgtgacgaagtggcgaaagtgctgcattgtttgcgcccgttgacccaggaagacgtggagcataatctggtgttgggacaatatgtcgcaggcgaagtggacggcgaatgggtgaaaggctatttagaggaaaaaggcgtgccgccgtattccaccaccgaaacctacatggcgctacgctgtgaaatcgaaaactggcgttgggcgggcgtgcctttctacgtgcgcaccggtaaacgtctgccggcacgcgtcacggaaatcgtgattcacttcaaaaccaccccgcacccggtattcagccaaaatgcgccggaaaataaactgattatccgtattcaaccggacgaaggcatttctatgcgttttggcttgaaaaaaccgggcgccggctttgaagccaaagaagtgtcgatggatttccgctatgccgatcttgcgggtgccaccgtcatgaccgcttatgagcgtttattgcttgatgccatgaaaggcgacgcgaccctatttgcgcgtaccgatgccgtacacgccgcctggaaattcgttcaaccgattttgaactataaagcccaaggcggcagactttatgattacgaggccggcacctggggaccgacggcagccgataaactcatcgccaaaagcggtcgtgtatggcgccgcccaagcgggttgatgaagaaaaaagtgtaa

SEQ ID NO: 2844 - protein, 494 aa, Actinobacillus actinomycetemcomitans
MKAENCCIVIFGASGDLTYRKLIPALYNLYKIDRLGEDFSVLGVARTELNDKSFREKMRQTLIKNEGAKGECLEQFCSHLYYQAVNTADKADYAKLVPRLDELHDTYRTEGNTLYYLSTPPSLYGVIPECLGEHGLNKEDRGWKRLIVEKPFGYDRETAEALDIQIHRFFEEHQIYRIDHYLGKETVQNLLVLRFSNGWFEPLWNRNFIDYIEITGAESIGVEERGGYYDGSGAMRDMFQNHLLQVLAMVAMEPPVIINANSMRDEVAKVLHCLRPLTQEDVEHNLVLGQYVAGEVDGEWVKGYLEEKGVPPYSTTETYMALRCEIENWRWAGVPFYVRTGKRLPARVTEIVIHFKTTPHPVFSQNAPENKLIIRIQPDEGISMRFGLKKPGAGFEAKEVSMDFRYADLAGATVMTAYERLLLDAMKGDATLFARTDAVHAAWKFVQPILNYKAQGGRLYDYEAGTWGPTAADKLIAKSGRVWRRPSGLMKKKV

SEQ ID NO: 2845 - DNA, 1473 bp, Buchnera aphidicola
  CDS (1)..(1473)
atgattatagaaactaatcaagcttgcgatctagtgatttttggaacaaaaggagatttagcaagaagaaaattgttaccagctttatataaattagaaaaatctcaaaaaatacatccagatacacgtataattggtacaggtcgtgctgattggaatacagaagattatataaagatagtaaaaaaagcaataaaaatgtttttaaatgaaaaaattgatgaaaaaatttggaaaaaattacgttcacgtttaaattttttttatattgatgtatttcaagatcttcactttttagaattaaaaaatatattaaatcaaaaaaaaaacattattatttattattgtgcagttccttcaaatacatttaatgctatttttacaggattaggaaaagttaatttaaattcttttccatcaagaatcataatcgaaaaaccactcggtgtatctttagaaacatcaaaaaaaatcaataatcaaattgctaaatattttttagaatcgcaaatctttcgtattgatcactatcttggaaaagaatcaatattaaatcttttagcattacgtttctcaaattcatttttttttcatagttggaataataaaattattgatcatattcaaattactgtatctgaagaagttggtattgaaaatagatggaattattttgatcaaatgggacaaacacgagatatggtacaaaatcatctcctgcaaattcttacaatcgtttctatggataaaccaaaaaatattacacctgaaggcataagagatgaaaaattaaaaatattgcgttctcttaaaaaaattgacttaaatgaaattcatattaagacagcacgaggtcaatatgcatctggaattataaatggtaaaaaggtaccttcttacatagaagaaaatggtgcaaacaaacatagtaaaacagaaacatttgtttcaattaaagttgatattaataatgatcgatggtttggagttccattttatttaagaacgggtaaacgtttagcatataaatactctgaaatagttattgtctttaaaaaaatatctaagaacttgtttcaagaattcaataaaaatttatcacctaacaaattgattatacgtctagaacctaatgaaagtattaaaatatattttttaaataaagtaccaggactcagtaaggaatataaattaaaaagtgataaaatggaatttaattttaatataaataatactaaaaattttgtcgacgcttatgaaaggctattatttgaaagtatgagaggaatacaatcattatttgtatgtcgagaagaagtagaagaagcgtggaaatggattgatccaataataaacggttggaaaaaaacaaatataaatactgtacagttatataaatctggtacatgggggccaaaaagttcggacgaaatcattatgcgagatggtcgattttgggaaacatttaattaa

SEQ ID NO: 2846 - protein, 490 aa, Buchnera aphidicola
MIIETNQACDLVIFGTKGDLARRKLLPALYKLEKSQKIHPDTRIIGTGRADWNTEDYIKIVKKAIKMFLNEKIDEKIWKKLRSRLNFFYIDVFQDLHFLELKNILNQKKNIIIYYCAVPSNTFNAIFTGLGKVNLNSFPSRIIIEKPLGVSLETSKKINNQIAKYFLESQIFRIDHYLGKESILNLLALRFSNSFFFHSWNNKIIDHIQITVSEEVGIENRWNYFDQMGQTRDMVQNHLLQILTIVSMDKPKNITPEGIRDEKLKILRSLKKIDLNEIHIKTARGQYASGIINGKKVPSYIEENGANKHSKTETFVSIKVDINNDRWFGVPFYLRTGKRLAYKYSEIVIVFKKISKNLFQEFNKNLSPNKLIIRLEPNESIKIYFLNKVPGLSKEYKLKSDKMEFNFNINNTKNFVDAYERLLFESMRGIQSLFVCREEVEEAWKWIDPIINGWKKTNINTVQLYKSGTWGPKSSDEIIMRDGRFWETFN

SEQ ID NO: 2847 - DNA, 1473 bp, Buchnera aphidicola
  CDS (1)..(1473)
atgaaaaataaaaattcaggatatgatttagttatttttggagcaaaaggagatctatcttgtagaaaactactaccttcattatatcaattagaaaaaaaaaataaattatgtactcacactagaataataggcgtaggtcgcgctaattgggataaaattatttatactaatgtagtatataaatcattaattaaatttttaaatgaaacaataatcgaatctatttggaaaaaattttcgtctcggttagaattttgtaatttagatattaattgcttgcacaattttaaaaaattaaaacaaataattcaacaaaataataacattataattaattatctagctatgccacctcacacatttggaaatatttgtttaggattagaatcaataaatttaaatttagaacctacgcgtattataattgaaaaaccattaggttcttctttaaaaacatctataaatattaataacaaaattggaaaattttttaaagaaaaacaaatttttcgaatagatcattatcttggaaaagaaactatacaaaatttgttagcattcagattttcaaattcacttttttactataattggaataataaatttattgatcatgttcaaattactgtatcagaaacaattggagttgaaggaagatttaattatttcgatacagttggacaaattaaagatatggttcaaaaccatttattacaaatattgacgattactactatgtcgacaccaattgattgccatgaaaatagcataagggatgaaaaagtaaaaattttaaaatcattacgaccatttaacattaataatattcataaaaatgtaatattaggtcaatatacttcaggaataataaatcaaaaaaaagttaaatcttatttagatgaaactaataatcaagaatatcaaatgaataaatataccgaaacatttgtatctatgaaaatatatatcgataatgatcaatggtctggagtcccattttatttgcgtactggaaaacgacttccaaaaaaatgttcagaaatcgttattttttttaaaacacctcctttaaatatttttagtaaaaattacaatacgttatctaaaaataagttaatattatcgttacagcctaacgaagcgattaagatatatattttaaataaaaaaccaaaactaacttctcaatacaaattagatttaattactttagattttaattattcaaaattttataaaaaaatacagttatctgatgcatatgaaaaattgttattagaaagcatgaaaggaattcagtctctatttgttagacgagatgaagttgaattagcatggaaatggattgactctactttgcaatgtttacatctaaaacctagattaccagatctatatccagctggaacttggggacctgcacgttcgaaaactatgataaataatgatggttacgaatggaatgaataa

SEQ ID NO: 2848 - protein, 490 aa, Buchnera aphidicola
MKNKNSGYDLVIFGAKGDLSCRKLLPSLYQLEKKNKLCTHTRIIGVGRANWDKIIYTNVVYKSLIKFLNETIIESIWKKFSSRLEFCNLDINCLHNFKKLKQIIQQNNNIIINYLAMPPHTFGNICLGLESINLNLEPTRIIIEKPLGSSLKTSININNKIGKFFKEKQIFRIDHYLGKETIQNLLAFRFSNSLFYYNWNNKFIDHVQITVSETIGVEGRFNYFDTVGQIKDMVQNHLLQILTITTMSTPIDCHENSIRDEKVKILKSLRPFNINNIHKNVILGQYTSGIINQKKVKSYLDETNNQEYQMNKYTETFVSMKIYIDNDQWSGVPFYLRTGKRLPKKCSEIVIFFKTPPLNIFSKNYNTLSKNKLILSLQPNEAIKIYILNKKPKLTSQYKLDLITLDFNYSKFYKKIQLSDAYEKLLLESMKGIQSLFVRRDEVELAWKWIDSTLQCLHLKPRLPDLYPAGTWGPARSKTMINNDGYEWNE

SEQ ID NO: 2849 - DNA, 2049 bp, Ceratitis capitata
  CDS (60)..(1640)
ttaaagtgtaaactaaaacatttttaagttttaaacaaattatttgatttgctttaaatatggccactcagcatttcaccaatggcagcgccaccgacgatggggagaccgcactcgaacatatcatcaaatcattggagactccaacaatgaagtgcgagggtacacatttcgattcccatgtgccgcacacgtttgtcatctttggtgcttcgggtgatttggccaaaaagaaaatctatccaaccttgtggtggctttaccgtgataatttactgccgaaatcaactaaattctgcggttatgcacgttcgaagttaacgattgaggagttgcgggcgaagtgtcatcaatacatgaaggtgcaaccggacgagcaggcaaaatatgaggaattctggcagaatcatgactacgctgcgggtagctatgatcagcgcagtgattttgtggctttaaaagaacgtttgagcagtttggagagctgcaattgtagttgtaatcgcatattttatttggccttaccgccgtccgtctttgagcgagttactgtgaacattaaggacatttgtttggctgaacgcggctggaatcgcgttattatcgaaaaaccttttggtcgcgacgatgtcacttcaaagaaactaagcgatcatcttgcatcactcttccacgaggaccaactctatcgtatcgatcattatctgggcaaggaaatggtgcaaaatctaatgaccattcgctttgccaataaaattctcaactccacatggaatcgggaaaatatcgcctcagtgctgatcacattcaaggaacccttcggcacacaaggacgcggcggctactttgacgagtttggcattatacgcgatgtcatgcaaaatcacctgctgcaaatattgtctttggtcgccatggagaaacccacctcctgccagccggatgatatacgcgatgaaaaagttaaagtattgaaaagcattccagcacttacattggacgatatggttttgggtcaatatgtgggcaatccaaatggcgttggtgagcaacgcgaggggtatctcgacgatccgacagtgtcgaacgactccaacacacccacttacgcgcagggtgtattgcgtatcaataatgaacgttgggacggcgtacccttcatcttacgttgcggtaaagcgctggacgaacggaaagccgtggtgcgtatacaatatcgtgatgtgcctggcgatattttcgagggcaatagcaaacgtaatgagttagttatacgtgtgcaacccggcgaggcgttgtatttcaaaatgatgaccaaaagtccgggtataactttcgatatagaggagaccgagttggacttaacctatgagcatcgctacaaaaactcctacctgccagatgcctacgaacgtctcattttggatgtattctgtggttcgcaaatgcatttcgtgcgttccgatgagctgagcgaggcgtggcgcatcttcacgccggtcttgaatgaaatcgaaaacaacaaggttaaacccataccttatgtatttggttcacgtggtcccaaggaggcggatcagaagacgtcggagaataacttcaaatattacggttcctacaagtggattggaaagaaatagagtttggtgtggctaaacctatggcagcagtgtgcacctacgtacatacatatgtttgtatgtatgtagggggaccaatgaataagataaacgcgtagaaaagacaaatacttaagcgattgtataagcaatttgaagaaaatgattgtgtacatatgtacatacatatttgtatatttgtatatttgtatatttgtaaatgtactcgtagcttgtagttaatgatgtaatgaatggattgtgcgagcgacctctgagctttgtaccagagcatcgggtatacaataatactttttgttaaatggaataatggatttataaataagttttttaagccaattttttttttgctcaaaatgaaatacaaaataaaacctaaaggacaagtgtaaaaaaaaaaaaaaaaaaa

SEQ ID NO: 2850 - protein, 526 aa, Ceratitis capitata
MATQHFTNGSATDDGETALEHIIKSLETPTMKCEGTHFDSHVPHTFVIFGASGDLAKKKIYPTLWWLYRDNLLPKSTKFCGYARSKLTIEELRAKCHQYMKVQPDEQAKYEEFWQNHDYAAGSYDQRSDFVALKERLSSLESCNCSCNRIFYLALPPSVFERVTVNIKDICLAERGWNRVIIEKPFGRDDVTSKKLSDHLASLFHEDQLYRIDHYLGKEMVQNLMTIRFANKILNSTWNRENIASVLITFKEPFGTQGRGGYFDEFGIIRDVMQNHLLQILSLVAMEKPTSCQPDDIRDEKVKVLKSIPALTLDDMVLGQYVGNPNGVGEQREGYLDDPTVSNDSNTPTYAQGVLRINNERWDGVPFILRCGKALDERKAVVRIQYRDVPGDIFEGNSKRNELVIRVQPGEALYFKMMTKSPGITFDIEETELDLTYEHRYKNSYLPDAYERLILDVFCGSQMHFVRSDELSEAWRIFTPVLNEIENNKVKPIPYVFGSRGPKEADQKTSENNFKYYGSYKWIGKK

SEQ ID NO: 2851 - DNA, 1524 bp, Chlamydia muridarum
  CDS (1)..(1524)
atggaagaaataaaagaaatggggcccacattaccagcctgccctccttgtgtcatggttatttttggggctacaggagacttgactgcaaggaagctttttcccgctttatacaatttaacaaaagagggacggttatctgaaaactttgtttgcgtgggatttgccagaagacccaaatctcatgagcaatttcgtgaagaaatgagacaagctattcaaaatttctctcattcatcagaaattgatattcgtgtttgggagagccttgaacacagaattttctatcatcaggcgaatttttccgaagcagaagggtattcttctttaagatctttcttagagagcgtggatcaaaaatatgggacaaaaggaaatcgtcttttctacctctccactcctccagattatttccaagaaataatccggaacttgaacagacaccaactattttatcatgagcaaggagcccaacagccctggtctaggctaattatagaaaagccttttggagttgatttacaaactgctcaagagcttcagcaatgcattgatgctaatatcaatgaagaatctgtttatcgaatagatcattatcttgggaaagaaactgttcaaaatattctgaccatacgttttgctaatacgctattcgaatcttgttggaactctcaatatatagatcatgtacagattagtgttagtgaatcgattggtataggctctcgagggaacttttttgaaaagtctggcatgctaagggatatggtgcaaaatcacctgatgcaattactgtgtctacttactatggagcccccttctgaattttcttctgcagagatcaaaaaagaaaaaattaagattctaaaaaaaatccttcctattcgagaagaagacgtaattcgtggtcaatatggtgaaggagttgtgcaaggcgtttctgtttctggctacagagaagaagaaaatgttgatccaaattctttggtagaaacttacgtagccttgaaattattcattgataatcctcgctggaaaggggttcctttttatttacaagcagggaaacgtcttcctaaaaggacaacggatattgccgttatctttaaaaaatctagttacgacttgtttaattcagaaaattgccctctgtgccctttagagaatgatttgctcatcatccgcattcaaccagatgaaggagttgctctacaatttaactgcaaagttccagggacaaataaactcgttcgtcctgtgaaaatggatttccgttacgatagttattttaatacagttactccagaagcttatgaacgattgttgtgtgattgtatccttggcgataggacccttttcactagcaatgaagaagtcttagcatcttgggaactattttctcccttattggagcaatggtctaagatccgtcccattttccctaattatattgcaggatctttgcgcccgcaaggagctgatgagctattatctagagatggaagagcatggcgttcttactaa

SEQ ID NO: 2852 - protein, 507 aa, Chlamydia muridarum
MEEIKEMGPTLPACPPCVMVIFGATGDLTARKLFPALYNLTKEGRLSENFVCVGFARRPKSHEQFREEMRQAIQNFSHSSEIDIRVWESLEHRIFYHQANFSEAEGYSSLRSFLESVDQKYGTKGNRLFYLSTPPDYFQEIIRNLNRHQLFYHEQGAQQPWSRLIIEKPFGVDLQTAQELQQCIDANINEESVYRIDHYLGKETVQNILTIRFANTLFESCWNSQYIDHVQISVSESIGIGSRGNFFEKSGMLRDMVQNHLMQLLCLLTMEPPSEFSSAEIKKEKIKILKKILPIREEDVIRGQYGEGVVQGVSVSGYREEENVDPNSLVETYVALKLFIDNPRWKGVPFYLQAGKRLPKRTTDIAVIFKKSSYDLFNSENCPLCPLENDLLIIRIQPDEGVALQFNCKVPGTNKLVRPVKMDFRYDSYFNTVTPEAYERLLCDCILGDRTLFTSNEEVLASWELFSPLLEQWSKIRPIFPNYIAGSLRPQGADELLSRDGRAWRSY

SEQ ID NO: 2853 - DNA, 2062 bp, Drosophila melanogaster
  CDS (303)..(1877)
aacgatcgtgcttatcttcattactactaccgcttccaccgaggcttcgcgactccgtacccgtactcgctttgttttacgtttgcgctactagttagtgaatccgacgacgacgacctgcgcgtgcgattaaagcgccgcaactctttgtaattacacagccagagccgcagaggttgctcaaaatccagcgactggagaaatcgtatatcgagttggaaatccgaatcgaaaggcttgcgtatacatagttgtcacacttttgcttttaaacagaaaaatccattcacattcgggtcaagatggcaacgcaaaaggaagatcacaccgccctggatctcataatcaagtcactcaagtcgcctacaatggtctgcgagggaacccactttgacggcaagattccgcacacgttcgtcatctttggggcgtcgggcgatctggccaagaagaagatctaccccacgctctggtggctctaccgcgatgacctgctgcccaagccgaccaagttctgcggctatgcccgttccatgctgaccgtcgatagcatcaaggagcagtgtctgccgtacatgaaggtccagccgcacgagcagaagaagtacgaggagttctgggccctcaatgagtacgtgtccggcagatatgacggacgcactggcttcgagctgcttaaccagcagctggagattatggagaacaagaacaaggccaaccgcatcttctatctggccctgccgcccagcgtcttcgaggaggtgactgtcaacatcaagcagatctgcatgtcggtctgcggttggaaccgcgtgatcatcgagaagcctttcggccgggatgacgcctcctcgcaggcgctgagcgaccatctggccggtctgttccaggaggatcagctgtaccgcatcgatcactacctgggcaaggagatggtgcagaacctgatgaccatacgcttcggcaacaagatcctcagctcgacgtggaaccgcgagaacatcgcctccgtgctgatcacgttcaaggagcccttcggcacgcagggtcgtggcggctacttcgacgagttcggcatcatacgcgacgtgatgcagaaccatctgctgcagatcctctcgctggtggccatggagaagccggtgagctgccacccggacgacattcgtgacgagaaggtcaaggtgctgaagagcatcgaggccctgacgctggatgacatggtgctgggccagtacctgggcaatccgcagggtacaaacgatgatgcgcgcacgggctacgtggaggaccccaccgttagcaacgattcgaacacgcccacctacgccctcggcgtgctcaagatcaacaacgagcgctggcagggagtgcccttcatcctgcgctgcggcaaggcgctgaacgagcgcaaggcggaggtgcgcatccagtaccaggacgtgctcggcgacatcttcgagggcaatacgaagcgcaacgagctggtcatacgcgtccagccgggcgaggccctgtactttaagatgatgaccaagagccccggcatcacgttcgacatcgaggagacggagctggacctcacctacgagcaccgctacaaggactcctacctgccggacgcgtacgagcgtctcatcctcgacgtcttctgcggctcccagatgcacttcgtccgctcggacgagctgcgcgaggcgtggcgcatcttcacgcccattctgcaccagatcgagaaggagcacattcgtccaatcacctaccagtacggatcgcgcggtcccaaggaggcggaccgcaagtgcgaggagaacaatttcaagtactccggctcctacaagtggcacggcggcaaggcggccacgtccaatcactgagcgtttggagcacaccaatccccgggctgggttcgcaggatactcctctttgtccgcacgtacatgtacatacatacatatatatgtatatatacatatatgcattctttggttatttgtaattcggtctgtacaagatttttttttattaaatatacaaaatagtgaaaaaaaaaaaaaaaaaa

SEQ ID NO: 2854 - protein, 524 aa, Drosophila melanogaster
MATQKEDHTALDLIIKSLKSPTMVCEGTHFDGKIPHTFVIFGASGDLAKKKIYPTLWWLYRDDLLPKPTKFCGYARSMLTVDSIKEQCLPYMKVQPHEQKKYEEFWALNEYVSGRYDGRTGFELLNQQLEIMENKNKANRIFYLALPPSVFEEVTVNIKQICMSVCGWNRVIIEKPFGRDDASSQALSDHLAGLFQEDQLYRIDHYLGKEMVQNLMTIRFGNKILSSTWNRENIASVLITFKEPFGTQGRGGYFDEFGIIRDVMQNHLLQILSLVAMEKPVSCHPDDIRDEKVKVLKSIEALTLDDMVLGQYLGNPQGTNDDARTGYVEDPTVSNDSNTPTYALGVLKINNERWQGVPFILRCGKALNERKAEVRIQYQDVLGDIFEGNTKRNELVIRVQPGEALYFKMMTKSPGITFDIEETELDLTYEHRYKDSYLPDAYERLILDVFCGSQMHFVRSDELREAWRIFTPILHQIEKEHIRPITYQYGSRGPKEADRKCEENNFKYSGSYKWHGGKAATSNH

SEQ ID NO: 2855 - DNA, 1536 bp, Emericella nidulans
  CDS (1)..(1536)
atgtccgccacgatagcccgcgccgaggagcagcagaatgggagcactgtcgaactcaaagatgacaccgtcattgtcgtactaggtgcctccggggatcttgcaaagaagaagactttcccagctctttttggcctttttcgcaacaagttccttcccaagggtatcaagatcgtcggatatgcccggacacagatggaccacaatgaataccttaagcgagtgcgctcatacattaagaccccgacaaaggagatcgaagagcaattgaacagcttttgcgagctttgcacatacatcagcggccaatacgaccaggatgactcattcaagaacctcgccaagcaccttgaggagattgagaaaaaccaaaaggaacagaacagagtcttttacatggcgttgccccccagcgttttcatcacagtctcagagcaactaaaacgcaactgctaccccaaaaatggtgtcgctcgtattattgtcgagaaacctttcggcaaggacctccagagctctcgtgatctccagaaggcccttgagcccaactggaaagaagaagagatcttccgtattgaccactacctcggcaaggagatggttaagaacatccttatcatgcgctttggcaacgagttcttcaatgccacctggaaccgccatcacatcgacaacgttcagatcacgttcaaggaaccattcggtacggagggccgtggaggttactttgatgaattcggcatcatccgtgacgttatgcagaaccaccttctgcaagttctcacactgcttgctatggagcgacccatctctttctccgccgaagacatccgtgacgagaaggttcgcgtcttgcgcgccatggaccccattcaacccaaggatgtcatcatcggccagtacggcagatcactagatggtagcaaacccgcatataaggaggatgatacagtgccacaggactctcgctgccccaccttctgtgcgctggtcgctcacatcaagaacgagagatgggatggtgttcctttcatcatgaaggcgggtaaagccctcaacgaacagaagaccgaaatccgtattcagttcaaggacgtcacttctggcatcttcaaggatatcccccgcaacgagcttgtcatccgtgtccaacccaacgaatctgtctacatcaagatgaactcgaaacttcctggactttccatgcagaccgtggttactgagctggatctcacctaccgtcgtcgattctccgacctcaagattcctgaagcctacgaatctttgatcttggatgctctcaaaggagaccactccaactttgtccgtgacgacgagctcgatgctagctggaggatgttcactcctctgctccactacctcgatgacaacaaggagatcatccctatggaatacccctacggttcccgcgggccctccgttcttgacgacttcaccgcttcctatggctacaagttcagtgatgctgcgggataccagtggccgttgacgcacactacgcctaacaggctgtag

SEQ ID NO: 2856 - protein, 511 aa, Emericella nidulans
MSATIARAEEQQNGSTVELKDDTVIVVLGASGDLAKKKTFPALFGLFRNKFLPKGIKIVGYARTQMDHNEYLKRVRSYIKTPTKEIEEQLNSFCELCTYISGQYDQDDSFKNLAKHLEEIEKNQKEQNRVFYMALPPSVFITVSEQLKRNCYPKNGVARIIVEKPFGKDLQSSRDLQKALEPNWKEEEIFRIDHYLGKEMVKNILIMRFGNEFFNATWNRHHIDNVQITFKEPFGTEGRGGYFDEFGIIRDVMQNHLLQVLTLLAMERPISFSAEDIRDEKVRVLRAMDPIQPKDVIIGQYGRSLDGSKPAYKEDDTVPQDSRCPTFCALVAHIKNERWDGVPFIMKAGKALNEQKTEIRIQFKDVTSGIFKDIPRNELVIRVQPNESVYIKMNSKLPGLSMQTVVTELDLTYRRRFSDLKIPEAYESLILDALKGDHSNFVRDDELDASWRMFTPLLHYLDDNKEIIPMEYPYGSRGPSVLDDFTASYGYKFSDAAGYQWPLTHTTPNRL

SEQ ID NO: 2857 - DNA, 1957 bp, Leuconostoc mesenteroides
  CDS (206)..(1666)
tatctaaaagctacttcatttgttgtactcctcatttgcttttttattattgtgtaacgaacaggtgataaggtcaagtgcaaaatttcacgacagatatccaattttagatgataaacgtttaaaaaacgctgaaaacggttactttttccgctattttgcgctataatgaaaagtgaatttaactaaaaataaggggtacatcatggtttcagaaatcaagacgttagtaactttctttggtggcactggtgacttggccaagcgtaagctttacccatcagttttcaatctttataaaaaaggctacttgcaaaagcattttgccattgttggaacggcccgtcaagccctcaatgatgacgaattcaaacaattggttcgtgattcaattaaagatttcactgacgatcaagcacaagctgaggcgttcatcgaacatttctcataccgtgcacacgacgtaacagatgctgcttcatacgctgttttaaaagaggcgattgaagaagctgccgacaaatttgatatcgatggcaaccgcattttctatatgtcagttgcgccacgtttctttggtacaattgccaaatatcttaagtcagaaggcctactagctgacactggttacaaccgtttgatgattgaaaagcctttcggtacatcatatgacacagctgccgaactccaaaatgacttggaaaacgcatttgatgataaccaactattccgtattgaccactaccttggtaaggaaatggttcaaaacattgctgcccttcgctttggtaacccaattttcgatgctgcttggaacaaggattacatcaagaacgttcaagtaacattgtcagaagtcttgggtgtcgaagaacgtgccggctactatgacacagccggtgcattgcttgacatgattcaaaaccacaccatgcaaattgttggttggttagccatggaaaaaccagaatcattcactgacaaagacattcgtgccgctaaaaacgcagcctttaatgctttgaagatctatgatgaagcagaagttaacaaatactttgttcgtgcacaatatggtgccggtgattcagctgacttcaagccataccttgaagaattagacgtacctgctgattctaaaaacaataccttcatcgccggcgaattgcaatttgatttgccacgttgggagggtgtcccattctatgtccgttcaggtaagcgcttagctgctaaacagacacgggttgatatcgtctttaaggctggcacgtttaactttggttcagaacaagaagcacaagaagctgtcttgtcaattatcattgatccaaagggtgctatcgaattgaagttgaacgccaagtcagttgaagatgctttcaacacacgtacaattgacttaggttggactgtatctgacgaagataagaagaacacgccagaaccatacgaacgtatgattcacgacactatgaatggtgatggctctaacttcgctgactggaatggcgtttcaatcgcttggaagttcgttgatgctatttcagccgtttataccgcagataaagcaccacttgaaacttacaagtcgggctcaatgggtcctgaagcatccgataaattattggctgccaatggtgatgcttgggtgtttaaaggttaattaaagccccaaaaaaacgatcgattgtgatcgtttttttattgcccaatttacacagtttcatcaagaatccgttttgtttcacgaaaaacagccgctaagtttttgtactgatccgcatgcagcacaacagtaacaaagtgatgctttttgtacgtaaagaacccaacaaatgacacaccagatttaacagaaacacctaatttaccacccgtgacctgatattttgtctgactaaaatagttattcattagtgaaaaaatttgacgcttgagttgtgccattgaaagt

SEQ ID NO: 2858 - protein, 486 aa, Leuconostoc mesenteroides
MVSEIKTLVTFFGGTGDLAKRKLYPSVFNLYKKGYLQKHFAIVGTARQALNDDEFKQLVRDSIKDFTDDQAQAEAFIEHFSYRAHDVTDAASYAVLKEAIEEAADKFDIDGNRIFYMSVAPRFFGTIAKYLKSEGLLADTGYNRLMIEKPFGTSYDTAAELQNDLENAFDDNQLFRIDHYLGKEMVQNIAALRFGNPIFDAAWNKDYIKNVQVTLSEVLGVEERAGYYDTAGALLDMIQNHTMQIVGWLAMEKPESFTDKDIRAAKNAAFNALKIYDEAEVNKYFVRAQYGAGDSADFKPYLEELDVPADSKNNTFIAGELQFDLPRWEGVPFYVRSGKRLAAKQTRVDIVFKAGTFNFGSEQEAQEAVLSIIIDPKGAIELKLNAKSVEDAFNTRTIDLGWTVSDEDKKNTPEPYERMIHDTMNGDGSNFADWNGVSIAWKFVDAISAVYTADKAPLETYKSGSMGPEASDKLLAANGDAWVFKG

SEQ ID NO: 2859 - DNA, 2055 bp, Macropus robustus
  CDS (94)..(1641)
attaacccgagcgcagcagcgggccctgtcgtctcccttcctctgccggatcagcaagtgacccaggatccggaggcgaagactgaaaacaacatggcagagcaggtggcactgagccggacccaagtgtgtggaattctccgggaagaattgtaccagggtgatgccttccaccagtcagacacacacatattcatcatcatgggagcctcgggtgacttagcaaagaagaaaatctaccctacaatctggtggctgttccgtgatgggcttctccccgaagacaccttcattgtgggctatgctcgctcaaacctcactgtggatgacatccgaaagcaaagcgagccctattttaaggccaccccggaagagaacctgaagctggaggagttcttctctcgaaattcctacgtggcaggccaatacgatgagccagcttcctttcagcgtctcaatgcccacatgaactccctgcatcatgggtcacaggccaaccgcctcttctacctggccttgccacccaccgtctatgaagctgtcactaagaacatcaaagagacttgcatgagccagataggttggaaccgggtcattgtggagaagccttttggaaaagatcttcagagctctgacaaactgtcaaaccacatttcctcactcttccatgaggaccagatctaccggatcgatcactacctgggcaaggaaatggtacagaacctcatggtgctaagatttggtaacaggatctttggaccgatctggaaccgagacaacattgcctgtgtcatcttcaccttcaaggagccctttggcactcttggccgagggggctattttgatgagtttgggatcattcgagacgtgatgcagaaccacctcttgcagatgctttgcctagtggccatggaaaaacctgcctccaccaactctgatgatgtccgggatgaaaaggtgaaggtcctgaagtgtatctcagaggtgagagcaactgatgtggtcttgggccagtatgtggggaacccagatggagaaggggaagccaccaaaggctatttggatgatcccacagtgccccggggctccaccactgccacctttgctgctgtggtcctctatgtggaaaatgaaagatgggacggagtcccctttatcctccgctgtggaaaggccctgaatgaacgcaaagcagaagtgaggttacagttccgggatgtggctggtgatatcttccagcgccagtgtaagcggaatgagctggtgatccgcgtgcagcccaacgaggctgtctacaccaagatgatgaccaagaagccagggatgttcttcaaccccgaagagtcagagctggacctgacctatggcaacagatacaaagatgtgaagctgcccgatgcttatgagcgccttatcctggatgtcttctgtggaagccagatgcactttgtgcgcagtgatgagcttcgggaagcctggaggatctttacgcccctgctgcaccacattgagaaggagaagacccagcccattgcctacgtctatggcagccgaggccctcctgaagcagacgaactgatgaagagagtgggcttccagtatgagggcacctacaagtgggtaaacccccacaagctctgaggcagcctggcagcccactagcttcctcccccttgtttcccatccccagcctccatgctcatccttttagccctttggcctcacttagggtctgtctctctgcccatcccctgttcatgttctactcaggcagaaactcttgggaccacaagaccaggagcccgtccctgggggagatggagggccccattgagagattccctgggccctttccactcccagaaggcccggggacccggccaccaacttctcagccctgtttacagctgcattaggtctgccattcagcagctaccagatacttcctcctgctttgagctcccagagccagctacattccaatagcagtcgctggaggtgtcctctgtttcccttcaggacagcagctttataaatacagagaattaccagtca

SEQ ID NO: 2860 - protein, 515 aa, Macropus robustus
MAEQVALSRTQVCGILREELYQGDAFHQSDTHIFIIMGASGDLAKKKIYPTIWWLFRDGLLPEDTFIVGYARSNLTVDDIRKQSEPYFKATPEENLKLEEFFSRNSYVAGQYDEPASFQRLNAHMNSLHHGSQANRLFYLALPPTVYEAVTKNIKETCMSQIGWNRVIVEKPFGKDLQSSDKLSNHISSLFHEDQIYRIDHYLGKEMVQNLMVLRFGNRIFGPIWNRDNIACVIFTFKEPFGTLGRGGYFDEFGIIRDVMQNHLLQMLCLVAMEKPASTNSDDVRDEKVKVLKCISEVRATDVVLGQYVGNPDGEGEATKGYLDDPTVPRGSTTATFAAVVLYVENERWDGVPFILRCGKALNERKAEVRLQFRDVAGDIFQRQCKRNELVIRVQPNEAVYTKMMTKKPGMFFNPEESELDLTYGNRYKDVKLPDAYERLILDVFCGSQMHFVRSDELREAWRIFTPLLHHIEKEKTQPIAYVYGSRGPPEADELMKRVGFQYEGTYKWVNPHKL

SEQ ID NO: 2861 - DNA, 1530 bp, Nostoc punctiforme
  CDS (1)..(1530)
atggttagtctgctagaaaatcccttgcgcgttggtctgcaacaacaagggatgcctgaaccccagattatagttatctttggcgcttctggtgatctcacctggcgcaaactagtgccagcactttacaaattgcggcgagaacggcgcattccaccagaaactactattgttggcgtagcacgtcgagaatggagccatgaatacttccgcgaacaaatgcagaagggcatggaagaggcacatcctgatgtcgatttaggggaactctggcaagacttctctcaaggtctcttctacagtcctggagatatagacaaccctgaaagctaccagaaactaaaaaccttactgagtgaattagacgaaaaacggggcacgcgaggcaatcgcatgttctacctatcggttgccccttcattctttcccgaagcaattaagcagctaggaagcggcgggatgctagaagatccctacaaacatcgtctagtaattgaaaaaccctttggtcgggacttggcttctgcccaaagccttaaccaagtggtacagaaatattgcaaagagcatcaagtatatcgtattgaccactacttgggtaaagaaacagtccagaatttgctggtgttccgctttgccaatgcgatttttgaacccttgtggaatcgtcaattcgttgaccacgtgcaaattaccgtagcagaaaccgtgggcgtagaagaccgggctggctactatgaaagcgccggcgcactgcgggatatgttgcaaaatcacctcatgcaactttactgcttaacggcgatggaagcacccaacgcaatggatgccgacagcatccgcacagaaaaagtgaaggtactccaagctactcgtttagctgatgttcacaatctgtcgcggtcagcagtccgtgggcaatacagtgctggctggatgaaaggtcaagcagtgccaggatatcgcacagaaccaggcgttgaccccaactccaccacacccacttatgtagcgatgaagtttttggtggataactggcgctggaaaggtgttcctttctacttgcggactggaaagcggatgccgaaaaaagtgagtgaaattgcaattcacttccgcgaagttccatctcggatgttccaatctgccgctcaacagacaaacgccaatattttgacgatgcggattcagccaaatgaaggtatttccctgcgttttgatgtcaaaatgccgggggcagaattccgcacccgttccgttgatatggactttagttatggttcctttggcatccaagcaacatccgatgcctacgatcgcttattccttgattgtatgatgggcgatcaaacattgttcacacgtgcagatgaagtagaagcagcttggcaagtagtgacaccagccctttccgtttgggatgcacccgccgatcctactactattccccagtacgaagccgggacttgggagccagaacaagcagaactcttaattaaccaggatggccgtcgctggcgcagactctaa

SEQ ID NO: 2862 - protein, 509 aa, Nostoc punctiforme
MVSLLENPLRVGLQQQGMPEPQIIVIFGASGDLTWRKLVPALYKLRRERRIPPETTIVGVARREWSHEYFREQMQKGMEEAHPDVDLGELWQDFSQGLFYSPGDIDNPESYQKLKTLLSELDEKRGTRGNRMFYLSVAPSFFPEAIKQLGSGGMLEDPYKHRLVIEKPFGRDLASAQSLNQVVQKYCKEHQVYRIDHYLGKETVQNLLVFRFANAIFEPLWNRQFVDHVQITVAETVGVEDRAGYYESAGALRDMLQNHLMQLYCLTAMEAPNAMDADSIRTEKVKVLQATRLADVHNLSRSAVRGQYSAGWMKGQAVPGYRTEPGVDPNSTTPTYVAMKFLVDNWRWKGVPFYLRTGKRMPKKVSEIAIHFREVPSRMFQSAAQQTNANILTMRIQPNEGISLRFDVKMPGAEFRTRSVDMDFSYGSFGIQATSDAYDRLFLDCMMGDQTLFTRADEVEAAWQVVTPALSVWDAPADPTTIPQYEAGTWEPEQAELLINQDGRRWRRL

SEQ ID NO: 2863 - DNA, 1476 bp, Rhizobium meliloti
  CDS (1)..(1476)
atgagcagccagatcattcccgtcgaaccgtttgactatgtggtgttcgggggcaccggcgatcttgcggagcgcaagctgctgccggcactttatcaccgtcagatggaaggtcagttcacggaaccgacgcggatcatcggcgcatcgcgcgcgagcctttcccatgacgaataccgcaggttcgcgagcgacgccctgaaagaacacctgaagtccggggagttcaacgaggcggaagtcgagaaattcacctcgcgtctctattacgtctccgtcgacgccaagtccgagcagggctgggacgatctgaagaagctcctggaagagggcaaggatcgtacccgtgccttctatctcgccgtcgggccggcgattttcagcgacatttccgaaaagatccgcgatcacaagcttatcacgaggaacacccgcatcgtcgtcgagaagccgatcggccgcgacctcgcttccgcgacggagctcaacgacacgatcggcaaggtcttccgcgaagagcagattttccgcatcgaccactatctcggcaaggaaacggtgcagaatctgatggcactgcgcttcgccaacgcactttacgagccattgtggaattccgcccacatcgaccacgtgcagatcaccgtttccgaagccgtcgggctcgagaatcgcgcaggctactacgacaaggcgggcgcgctgcgcgacatggtgcagaaccatatcctccagcttctctgtttcgtcgcaatggaggcgccgacgtcgatggacgcggaggccgtgcgcgacgagaagctcaaggtgcttcgcgcgctgaagccgatcaccgcctccaatgtcgagcaggtgacggtccggggccaataccgcgcgggcgcatcgtccggaggcccggtcaagggctatctcgaagagctcgaaggaggcgtttccaacacggaaaccttcgtcgcgatcaaggccgagatcagcaattggcgctgggcaggcgtgcccttctatctgcgtaccggaaagcgcatggcgggccgcatgtcggagatcgtcatcaccttcaagcagatcccgcactcgatcttcgatcagagtgccggccggatttcggccaaccagctgatgatccgcctgcagccgaatgaaggcgtcaagcagtcgctgatgatcaaggatcccggaccgggcggcatgcggctgaggaacgtgcccctcgacatgagcttcgccgaggccttcgcggtccgcaatgccgatgcctatgaacgcctgttgctggacgtcatccgcaacaaccagaccctgttcgtgcgccgcgacgaagtggaagcggcctggcaatggatcgacccgatcctcaaggcctgggaagcaaccggacagcaggtgcaaggatataccgccggaacctggggcccgagccagtcgatcgcgctgatcgagcgcgacggccgcacttggaacgatgcgatctag

SEQ ID NO: 2864 - protein, 491 aa, Rhizobium meliloti
MSSQIIPVEPFDYVVFGGTGDLAERKLLPALYHRQMEGQFTEPTRIIGASRASLSHDEYRRFASDALKEHLKSGEFNEAEVEKFTSRLYYVSVDAKSEQGWDDLKKLLEEGKDRTRAFYLAVGPAIFSDISEKIRDHKLITRNTRIVVEKPIGRDLASATELNDTIGKVFREEQIFRIDHYLGKETVQNLMALRFANALYEPLWNSAHIDHVQITVSEAVGLENRAGYYDKAGALRDMVQNHILQLLCFVAMEAPTSMDAEAVRDEKLKVLRALKPITASNVEQVTVRGQYRAGASSGGPVKGYLEELEGGVSNTETFVAIKAEISNWRWAGVPFYLRTGKRMAGRMSEIVITFKQIPHSIFDQSAGRISANQLMIRLQPNEGVKQSLMIKDPGPGGMRLRNVPLDMSFAEAFAVRNADAYERLLLDVIRNNQTLFVRRDEVEAAWQWIDPILKAWEATGQQVQGYTAGTWGPSQSIALIERDGRTWNDAI

SEQ ID NO: 2865 - DNA, 2853 bp, Homo sapiens
  CDS (273)..(2648)
tgaggcctgaggcctggggcgggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcaggtgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaaca

SEQ ID NO: 2866 - protein, 791 aa, Homo sapiens
MWNMLIVAMCLALLGCLQAQELQGHVSIILLGATGDLAKKYLWQGLFQLYLDEAGRGHSFSFHGAALTAPKQGQELMAKALESLSCPKDMAPSHCAEHKDQFLQLSQYRQLKTAEDYQALNKDIEAQLQHAGLREAGRIFYFSVPPFAYEDIARNINSSCRPGPGAWLRVVLEKPFGHDHFSAQQLATELGTFFQEEEMYRVDHYLGKQAVAQILPFRDQNRKALDGLWNRHHVERVEIIMKETVDAEGRTSFYEEYGVIRDVLQNHLTEVLTLVAMELPHNVSSAEAVLRHKLQVFQALRGLQRGSAVVGQYQSYSEQVRRELQKPDSFHSLTPTFAGVLVHIDNLRWEGVPFILMSGKALDERVGYARILFKNQACCVQSEKHWAAAQSQCLPRQLVFHIGHGDLGSPAVLVSRNLFRPSLPSSWKEMEGPPGLRLFGSPLSDYYAYSPVRERDAHSVLLSHIFHGRKNFFITTENLLASWNFWTPLLESLAHKAPRLYPGGAENGRLLDFEFSSGRLFFSQQQPEQLVPGPGPAPMPSDFQVLRAKYRESPLVSAWSEELISKLANDIEATAVRAVRRFGQFHLALSGGSSPVALFQQLATAHYGFPWAHTHLWLVDERCVPLSDPESNFQGLQAHLLQHVRIPYYNIHPMPVHLQQRLCAEEDQGAQIYAREISALVANSSFDLVLLGMGADGHTASLFPQSPTGLDGEQLVVLTTSPSQPHRRMSLSLPLINRAKKVAVLVMGRMKREITTLVSRVGHEPKKWPISGVLPHSGQLVWYMDYDAFLG

SEQ ID NO: 2867 - DNA, 1970 bp, Arabidopsis thaliana
  CDS (60)..(1790)
aaaaaacaatggcatcatcatcatcatcacatttgttttgacgctccaagaaaatttgcatggcgacacattctatgatcattccttctccttcttcttcttcctcgtctctcgctactgctgcgtctccgtttaaagagactctaccactctttagtagatctctcacattcccgagaaaatccttgttttctcaggttcgcttgagattcttcgccgagaaacattctcagcttgatacttcaaatgggtgtgccactaatttcgcttctttacaagattctggagatcaacttacagaggaacatgttacaaaaggagagtctactcttagtattacagttgttggagcgtcaggggacttagccaagaagaagatatttcctgcattgtttgctctcttttatgagggttgtcttcctcaggacttttctgtttttggttatgctcggactaaactcactcatgaagagcttcgtgacatgattagtagtactttaacttgccggattgatcagagggaaaaatgtggggataagatggagcagttcttgaaaagatgcttttaccattcgggtcagtataactcggaagaggattttgcggaactaaacaagaagctcaaagagaaagaggcaggaaagatatcaaacaggctgtactatttgtcgatacccccaaacatattcgttgatgtggttaggtgtgcaagtcttagagcctcctcagagaatggctggacaagggtcattgtggaaaagccatttggtcgtgactctgaatcatccggagagttaactagatgtctgaaacagtatcttacagaggagcaaatcttcaggattgatcactatttgggaaaggagcttgttgagaacctttcagtgctccgattctcaaatcttgttttcgagcctctgtggtcaagaaattacatacgcaacgttcagctgattttttctgaggatttcggaacagaagggcgtggaggttactttgatcaatatggaatcatacgagacatcatgcaaaaccatctcttgcaaatacttgcactttttgcaatggagacgccagtgagcttagatgctgaggacataagaagtgaaaaggtgaaagttttgagatcaatgaaaccgttgcggcttgaagatgtggttgttggtcaatacaaaggccataacaagggaggaaaaacttatccaggttatacagacgatccaacggttccaaatcacagtctcactcctacatttgctgcagcagccatgttcatcaacaatgcgagatgggacggtgttccttttcttatgaaagctggaaaagctctccataccagaggagcagagatcagagttcagttcagacatgtcccaggaaacttgtacaagaaaagttttgctactaatttagacaatgcaacaaatgaactagtgattagagttcagcctgatgaagggatatacctgaggatcaacaacaaagttcctggtcttggaatgagactagatcgcagcgaccttaaccttctatatcgatccaggtatccaagagagataccagatgcatatgaaagactgcttctcgatgcaatcgaaggagagaggaggttgtttatcagaagtgatgagctagatgcagcatgggatctattcacaccggctttgaaggaactagaggagaagaaaatcattcctgagctctatccatatggaagcagaggtcctgttggtgcacattaccttgcatctaagtacaatgtgagatggggagatcttggagaagcttaagctttcgacagaaacaatatgatttggtgttaatatgagtaaactaacttgtcgatattatcaatgcgtagataaatccttgttaccaaaacttgctttttctctgacattttttgattgtttttggttctaaatcgagcatttcggaggaatgtaccaaaactcttgcaggaatagacc

SEQ ID NO: 2868 - protein, 576 aa, Arabidopsis thaliana
MATHSMIIPSPSSSSSSLATAASPFKETLPLFSRSLTFPRKSLFSQVRLRFFAEKHSQLDTSNGCATNFASLQDSGDQLTEEHVTKGESTLSITVVGASGDLAKKKIFPALFALFYEGCLPQDFSVFGYARTKLTHEELRDMISSTLTCRIDQREKCGDKMEQFLKRCFYHSGQYNSEEDFAELNKKLKEKEAGKISNRLYYLSIPPNIFVDVVRCASLRASSENGWTRVIVEKPFGRDSESSGELTRCLKQYLTEEQIFRIDHYLGKELVENLSVLRFSNLVFEPLWSRNYIRNVQLIFSEDFGTEGRGGYFDQYGIIRDIMQNHLLQILALFAMETPVSLDAEDIRSEKVKVLRSMKPLRLEDVVVGQYKGHNKGGKTYPGYTDDPTVPNHSLTPTFAAAAMFINNARWDGVPFLMKAGKALHTRGAEIRVQFRHVPGNLYKKSFATNLDNATNELVIRVQPDEGIYLRINNKVPGLGMRLDRSDLNLLYRSRYPREIPDAYERLLLDAIEGERRLFIRSDELDAAWDLFTPALKELEEKKIIPELYPYGSRGPVGAHYLASKYNVRWGDLGEA

SEQ ID NO: 2869 - DNA, 2112 bp, Arabidopsis thaliana
  CDS (142)..(1932)
gatctcaaaaggttctcttatttgcagtatcgccccttaaatcctttttcgatgtttcttatgttcatcattattttttaactaaaaatctcatctttagacaacaattcaatttgccatctctctgttgtatctttgacgatggcggctttgtcttcctccgtcaccacccgatcatatcattccggttatttggcttctttctcaccggttaacggtgaccgacatcgatcactctcgttcctgtctgcttctcctcaaggattgaatcctcttgacctctgtgttagattccagaggaagtctggtcgtgcttctgtctttatgcaagatggtgcaatagtcactaattcaaattcatcagagagtaaaacttctcttaagggattgaaagatgaggtgctatcagctttatctcaagaagcagccaaggttggagtagaatctgatggtcaaagccagtcaacagttagtattacggtggttggagcctctggtgatcttgctaagaagaagattttcccggctcttttcgccctttactatgaaggttgtctccctgagcattttacaatatttggatattctaggagtaagatgacagatgttgaacttagaaacatggtcagcaaaaccctcacttgcagaattgataagagggcaaactgtggtgaaaagatggaagaatttctcaagagatgtttttaccattctggtcagtatgattctcaggaacattttactgaattggataagaagctcaaggaacatgaggctggaagaatctcaaaccgcctcttttatttgtctatccctccaaatatatttgtagatgctgtgaaatgtgcaagcacttctgcttcatctgtcaatggatggactagggttatcgtcgagaaaccttttggtcgagattctgaaacctcggctgctttaacgaaatccctcaagcagtatttggaggaagatcaaatttttaggatagaccattacctaggaaaggagctagtcgagaacttatctgttcttcgattctcaaaccttatatttgagccgctatggtcaaggcagtacataaggaacgtgcaatttatattttctgaggatttcggcactgaaggacgtggagggtactttgacaattacggaataataagagatataatgcagaatcatctgcttcaaatcttagccctctttgccatggaaacgcctgttagtttggatgcagaggatatcagaaatgaaaaggttaaggtgttacgttcaatgaggccaattcgagttgaagatgtggtaataggacaatacaagagccacacaaagggaggagtcacatatcctgcctacaccgatgataaaactgtaccaaaaggtagtctgactccaacatttgcagctgctgctcttttcatcgacaatgcaagatgggacggtgtgccctttttaatgaaagcgggcaaagcactacacaccaggagtgcagagataagggtgcagttcaggcatgttccggggaatttgtataaccggaatactggttctgatcttgatcaagctacaaatgagcttgtgatccgtgtccaaccagatgaagcaatctatttgaaaatcaacaacaaggtccctggtttaggaatgagattagatcgcagtaacttgaatcttctatactcagcaaggtattcaaaggagataccagatgcatatgagaggcttctgttagatgcaatagaaggagaaagaagattgttcataagaagtgacgagcttgatgcagcttggtcgctattcactccattgcttaaagagattgaagagaagaagagaatccctgagtactatccttatggtagccgtggtcctgttggtgctcattatctagctgctaaacacaaggtgcaatggggtgacgtcagtattgaccagtaaaacattttcttgtttgtattctcttttttttacattgataatagatttatctaggattcaagctttttctacgcctctttttacagctttaatttgtgcaatttggttatgtaccatttaataaataaataaaccaaaggggtttctcttattctctacaaggaaaatgtcttcttttta

SEQ ID NO: 2870 - protein, 596 aa, Arabidopsis thaliana
MAALSSSVTTRSYHSGYLASFSPVNGDRHRSLSFLSASPQGLNPLDLCVRFQRKSGRASVFMQDGAIVTNSNSSESKTSLKGLKDEVLSALSQEAAKVGVESDGQSQSTVSITVVGASGDLAKKKIFPALFALYYEGCLPEHFTIFGYSRSKMTDVELRNMVSKTLTCRIDKRANCGEKMEEFLKRCFYHSGQYDSQEHFTELDKKLKEHEAGRISNRLFYLSIPPNIFVDAVKCASTSASSVNGWTRVIVEKPFGRDSETSAALTKSLKQYLEEDQIFRIDHYLGKELVENLSVLRFSNLIFEPLWSRQYIRNVQFIFSEDFGTEGRGGYFDNYGIIRDIMQNHLLQILALFAMETPVSLDAEDIRNEKVKVLRSMRPIRVEDVVIGQYKSHTKGGVTYPAYTDDKTVPKGSLTPTFAAAALFIDNARWDGVPFLMKAGKALHTRSAEIRVQFRHVPGNLYNRNTGSDLDQATNELVIRVQPDEAIYLKINNKVPGLGMRLDRSNLNLLYSARYSKEIPDAYERLLLDAIEGERRLFIRSDELDAAWSLFTPLLKEIEEKKRIPEYYPYGSRGPVGAHYLAAKHKVQWGDVSIDQ

SEQ ID NO: 2871 - DNA, 2161 bp, Arabidopsis thaliana
  CDS (90)..(1967)
aaacttgcactcgtcttccactttgatccacttaaagcagctttaaagctttgaacatgtttagctataatccctgaggaactatcctcatgtctctctccagttgcttgcttcccttttctcaatcagcgacggctccgtcttcctccgtctgctcttgccatctcgccgcctctttttctaattttccggtttcgtcaagagactatagtttctccagaagtggaagccttgttctcaacggaggaggctcgaatctctgccggagattctgtggtttgaaactgtggatacttaagagcttgaatcgtagacaaggcaacaacagaaaacatcagcctgtaaacgagcttacaacacactcaaagcacactttcctcagcgatgatgaacgaggttttgctgaagaaactagagctgaagatttacgaccagaagagaatattctgggaacggatttgaatgatgggtttcacaatgttggagacttaccacctgtgtcaaaacaactctcggatgatctttcagatgttcgaagaagggcctcactttgcattgctgttgtaggagccactggtgagctagcaagagggaagattttcccggcattgtttgcgttgtattatagcggctaccttcctgaggatgttgctatatttggggtttcaagaaagaatctgacagatgaagacctcagatccatcattgcatcaacgctgacttgccgtgttgatcatcaggagaattgtgggggcaagatggatgcatttcagagtagaacatactatatcaatggaggttataataacagggatgggatgtcccgacttgccgagagaatgaaacagattgagggagaatcagaagcaaatagaatcttttacctctcagtacctcaagaagctctggtggatgtggcatgcaccattggagataacgctcaggcaccacgaggctggactcgaataatagttgagaaaccttttggttttaactcacattcgtctcatcagttaacaaagtcacttctctctaagtttgaagagaagcaaatctacaggatagatcacatgttaggaagaaacctcattgaaaatctgacagtgttaaggttttcaaatctagtttttgaaccactatggaacagaacatacatacgcaatatacaggttattatatcagaatcaattgcgcaaacagaaaagttttctgatggatatggaataatacgggacatagtgcacagccatatacttcagacaatcgcattacttgccatggaacctccgataagtctcgatggtgaagatatccgaaatgaaaaggtgaaggttttaagatcaattcgcaagatagacccgcgtgatgtcatccttggccagtataaatccagttcccgagacaagaacggtgtgatcttgaacggtgtagaccctacatattgtgcagcagccttgtatattgataatgcacgttgggatggtgtacctttccttgtaagagttggcactggcctcattaaacacagagtggagattcatgtgcaattccggcatgttcctggaaacctataccgagaaaatattggaataaacatagatttggggacaaatgagcttattctacgtgacgaacctgatgaggccatcctggtgaaaatcaacaacaaggttcctggtttaggtcttcagctagacgcttctgaacttaacttgctctataaagacaggtataaaaccgaagtaccagactcatatgaacacctaattcatgatgtaattgacggagacaatcatctgttcatgagaagcgatgaggttgcagcagcatggaacattcttagtccggttctagaagagatagacaagcatcacacagctccggagttgtatgaatttggtggacgaggaccagttgcggcatactatctttgggccaagcacggtgtcccatgggcagatgactgaagaagaaacatagatgcagcaacaaacaaatgagagtgattctgaatggttattgtgaagtgtgtttgtttagcttgaagctgtgccattccctgtagactgtacatatgtacacatgtatgtcatgttgctatatgaatgtccatcatggtggggtccataatagtgttgaaaagccaaaaaaaaaaaaaaaa

SEQ ID NO: 2872 - protein, 625 aa, Arabidopsis thaliana
MSLSSCLLPFSQSATAPSSSVCSCHLAASFSNFPVSSRDYSFSRSGSLVLNGGGSNLCRRFCGLKLWILKSLNRRQGNNRKHQPVNELTTHSKHTFLSDDERGFAEETRAEDLRPEENILGTDLNDGFHNVGDLPPVSKQLSDDLSDVRRRASLCIAVVGATGELARGKIFPALFALYYSGYLPEDVAIFGVSRKNLTDEDLRSIIASTLTCRVDHQENCGGKMDAFQSRTYYINGGYNNRDGMSRLAERMKQIEGESEANRIFYLSVPQEALVDVACTIGDNAQAPRGWTRIIVEKPFGFNSHSSHQLTKSLLSKFEEKQIYRIDHMLGRNLIENLTVLRFSNLVFEPLWNRTYIRNIQVIISESIAQTEKFSDGYGIIRDIVHSHILQTIALLAMEPPISLDGEDIRNEKVKVLRSIRKIDPRDVILGQYKSSSRDKNGVILNGVDPTYCAAALYIDNARWDGVPFLVRVGTGLIKHRVEIHVQFRHVPGNLYRENIGINIDLGTNELILRDEPDEAILVKINNKVPGLGLQLDASELNLLYKDRYKTEVPDSYEHLIHDVIDGDNHLFMRSDEVAAAWNILSPVLEEIDKHHTAPELYEFGGRGPVAAYYLWAKHGVPWADD

SEQ ID NO: 2873 - DNA, 1936 bp, Arabidopsis thaliana
  CDS (136)..(1686)
ctaatttatctatataaaaattcgaactatcaaactccaccccataacaaaattctccaaactagtgaaaattttgtcgccaccgtcgcaggtttgttctgtattttggttagagtgttaaaaaactattggaagatgggttctggtcaatggcatatggagaagaggtctactttaaagaatgattcgtttgtaaaagaatacaatccagtcacggaaactgggagtctctctatcattgttcttggtgcttctggtgatcttgctaagaagaagacttttcctgcacttttcaatctatttcatcagggatttcttaatccagatgaagttcatatatttggatatgcaaggagtaagattactgatgaggagcttagagataaaatccgcggatatcttgttgatgagaagaatgcatctaagaaaacagaagctttgtccaagtttctaaagctgattaagtatgtgagtggaccttatgattctgaggaagggtttaagagattagacaaggcgattttggagcacgagatatctaaaaagactgctgaaggatcttcgaggagattgttttatcttgcacttcctccgtctgtataccctcctgtaagcaagatgatcaaggcatggtgcactaacaaatctgatcttggtggatggactaggattgttgttgagaaaccatttggaaaggatttggaatctgcagagcagctgagttctcagattggagccttgtttgaagaaccacagatttatcgtattgatcactatctgggaaaagagttagttcaaaacatgttggttcttcggtttgccaatcgcttgtttttgccactatggaaccgcgacaatattgcaaacgtacagatcgttttcagagaagattttggaactgaaggtcgcggtggatattttgatgaatacggaatcattcgtgatattattcaaaaccacttgctccaggttctttgccttgtcgccatggagaaaccaatctctcttaaacccgagcacatccgggatgagaaagtgaaggttcttcaatctgtgattcccataaaagatgaagaggtggttcttggacaatatgaaggatatagagatgatccaactgttccaaatgactcaaacactccaacgtttgccacaacaattcttcgcattaacaatgaaagatgggaaggtgttccttttatactgaaggccggaaaggcaatgagttcaaagaaggcagatattcgcattcagtttaaagatgttcctggcgacatattcaaatgtcaaaaccaagggaggaacgagtttgttatacgcttgcagccttcagaggccatgtacatgaagctaactgtgaagcaaccgggtctggagatgcaaaccgtgcagagtgaactagacctatcgtacaagcagcgttaccaagatgtctcaattccagaggcttacgaacgccttattcttgacacaatcagaggcgaccaacaacactttgttcgcagagacgaattaaaggcagcttgggaaatcttcactccactgcttcacaggatcgacaagggagaagtgaaatcggtcccatacaaacaaggtagccgtggcccagcggaagcagatcagctacttaagaaagctggttatatgcagactcatggctacatttggatccctcctacattgtaaatggtataatcatagagatgatgatgatgagtacacacaaaataagagggttttttttcttttttttccttgcttgctgaataaaaactcttcaccagtttggagtttgtttaagtgaatcttatgtatactagtgatcttcactaggacattgtttgtttatgccttgtagtttttgttgtactagtcccttgttttctttttttacataatgcaaaacagctttgtggaaaagctaattaaattaaga

SEQ ID NO: 2874 - protein, 516 aa, Arabidopsis thaliana
MGSGQWHMEKRSTLKNDSFVKEYNPVTETGSLSIIVLGASGDLAKKKTFPALFNLFHQGFLNPDEVHIFGYARSKITDEELRDKIRGYLVDEKNASKKTEALSKFLKLIKYVSGPYDSEEGFKRLDKAILEHEISKKTAEGSSRRLFYLALPPSVYPPVSKMIKAWCTNKSDLGGWTRIVVEKPFGKDLESAEQLSSQIGALFEEPQIYRIDHYLGKELVQNMLVLRFANRLFLPLWNRDNIANVQIVFREDFGTEGRGGYFDEYGIIRDIIQNHLLQVLCLVAMEKPISLKPEHIRDEKVKVLQSVIPIKDEEVVLGQYEGYRDDPTVPNDSNTPTFATTILRINNERWEGVPFILKAGKAMSSKKADIRIQFKDVPGDIFKCQNQGRNEFVIRLQPSEAMYMKLTVKQPGLEMQTVQSELDLSYKQRYQDVSIPEAYERLILDTIRGDQQHFVRRDELKAAWEIFTPLLHRIDKGEVKSVPYKQGSRGPAEADQLLKKAGYMQTHGYIWIPPTL

SEQ ID NO: 2875 - DNA, 1959 bp, Arabidopsis thaliana
  CDS (194)..(1741)
aacaaaaatctgaaaaaaattgtcgacaaaaaaaagtgggagaaaatgacggaagctaaaaccacaccaaccccttcctcctccattttgtactagtagttgaagcttccttcttcttcttcttcttcacctaatacttcttctctatctctctcgccaaagaatcgtacttcttctctcaggttttaaggagatgggatctggtcaatggcacgttgagaaaaggtctacgtttaggaatgattcgtttgtgagagaatatggtatagttccagaaactggttgtctttcaatcatagttcttggtgcttctggtgatcttgctaagaagaagacttttcctgctctttttaacttataccgtcagggatttctcaatccagatgaagttcatattttcgggtatgcgaggactaagatttctgatgaagagctgagagataggattcgtggatatcttgttgatgagaagaatgctgagcaagctgaagctttgtcaaagtttctgcagctgattaagtatgtgagtggcccttatgatgctgaggaggggttccagagattagacaaggcaatttcagagcacgaaatctccaaaaatagtactgaagggtcttctagaagactgttttatcttgcacttccaccgtctgtttatccttctgtatgcaagatgatcaagacgtgctgcatgaacaaatctgatcttggtggatggacacggattgttgtggagaagccatttggcaaggaccttgaatctgcagagcaactgagttctcagattggagagttatttgatgaatcacagatctatcgtatagaccattatcttgggaaggaattagttcaaaacatgttggtcctccggtttgcaaatcgctttttcttgccactttggaaccgtgacaatatcgagaacgtgcagattgttttcagggaagattttggaactgaagggcgtggcggatattttgacgaatatggaataatccgtgatattattcaaaaccatctgctacaggttctttgccttgttgccatggagaaaccaatatctcttaaacctgagcatatccgggatgagaaagtgaaggtgcttcaatctgtggttccgataagcgatgacgaggtagttcttggacaatacgaaggatatagggatgatgatactgttccaaacgactcaaacactccaacatttgccacaacaatccttcgcatacacaacgaaagatgggaaggtgttccatttatattaaaggccggaaaagcgttgaattcaaggaaggcagaaattcgcattcaattcaaggatgtcccaggcgacatattcagatgtcaaaagcaaggaaggaacgagtttgtgatacgcttgcaaccttcagaggcaatgtacatgaaactaactgttaagcaaccaggtctagatatgaatactgtgcaaagtgaactagacttgtcgtatgggcaacggtatcaaggtgtcgctatccctgaggcatacgagcgcttaattcttgacacaatcaaaggcgatcaacaacatttcgttcgtagagacgaattaaaggttgcgtgggagatcttcacgccgctactccacaggatcgacaaaggagaagtaaagtcaatcccatacaaaccaggaagccgaggaccgaaagaagctgatcagctactagagaaagctggttatcttcagactcacggctatatctggatccctcctacactataaaaccctacatatatataaatacacaatacatgtatctacatgtatatgtataaattatgctgaatagtccctcctcgagtttggtgtttgtacgtgaaacttgctacttcagctgttcactttgacacttcctttggtcttgtatttgcggctttgtagaaataaaaataaaaatcttaccaataccataaatgaatttagcttttgttgtgctcgtt

SEQ ID NO: 2876 - protein, 515 aa, Arabidopsis thaliana [sequence omitted]

SEQ ID NO: 2877 - DNA, 1503 bp, Xenopus laevis
  CDS (1)..(1503)
atgagggaagaacttttaagcgaacaagagttccaccagtctgagacgcacatattcattgtcgttggagcttcgggagatctggccaaaaagaagatctaccccactctgtggtggctttacaacgatggtttgctcccagaagacacctacatagtaggctttgcacgttcaaagctgacagtgcaggatatcaaaaagcagagcgagccgtacttcaaggtatctgcagaggatgctttgaaacttgacacatttttcaagcgcaactcatatatttctggacaatactcagatgcagcctccttccaaaaccttaaccagcacctgaattcattacccaatggggcaaaagccaaccgcctcttctacctagcactaccacccagtgtgtatcatgatgttacccgcaacatcaaagagacctgcatgagctctgtaggatggaaccgtgttattgtggagaaaccttttggcaaagatctggaaagttccaatcgtttgtcggaacacatctcctccttatacaaggaaaaccagatctatcgtatcgaccattacctgggcaaagagatggtacagaacctcatgatcttaagatttggtaacaggatattcagccccctctggtccagggatcacataagtgcagtggttctgacatttaaagagcctttcggaacacaggggcgtggaggatactttgacgaatttggcatcatccgggatgtcatgcaaaatcacttgctccaaatgatgtgtttgatggctatggagaagccggtctccaccaactcggatgatgttagagatgaaaaggtgaaagtgttgaaatcagtggctcccctcaatcttgataatctggtaatagggcagtatattgggaatccggacggacaaggcgaggcacaagaaggctatttggatgaccgcactgttccaaaaggatctttgacccccacatttgccactgcagtcctatatgtgcagaatgagcgttgggatggtgtcccctttatcatgcgctgtggcaaggccttgaacgagaggaaggcagaggcacgactgcagtttcgtgatgtgcctggagatatattccaaggccaatgcaaaaggaatgaactggtgatcagagtgcagccaaatgaagctgtgtacaccaagatgatgaccaagaagccaggaatgttctttaaccctgaggagtcagagctagacttaacatatggcagcagatacaaggatgtgaagttgccagacgcatatgagcggcttattttggatgtgttctgtggaaatcagatgcactttgtacgcagtgatgaactgagagaagcttggaggatcttcacccctgttctccatcagctggagagagaaaaaatcaaaccccatccttataaatatggaagccgtgggcccgcagaaagtgacgagctaatgcagaaggttggcttccattatgcaggaacctacaaatgggtgaacccaaacaagctctga

SEQ ID NO: 2878 - protein, 500 aa, Xenopus laevis
MREELLSEQEFHQSETHIFIVVGASGDLAKKKIYPTLWWLYNDGLLPEDTYIVGFARSKLTVQDIKKQSEPYFKVSAEDALKLDTFFKRNSYISGQYSDAASFQNLNQHLNSLPNGAKANRLFYLALPPSVYHDVTRNIKETCMSSVGWNRVIVEKPFGKDLESSNRLSEHISSLYKENQIYRIDHYLGKEMVQNLMILRFGNRIFSPLWSRDHISAVVLTFKEPFGTQGRGGYFDEFGIIRDVMQNHLLQMMCLMAMEKPVSTNSDDVRDEKVKVLKSVAPLNLDNLVIGQYIGNPDGQGEAQEGYLDDRTVPKGSLTPTFATAVLYVQNERWDGVPFIMRCGKALNERKAEARLQFRDVPGDIFQGQCKRNELVIRVQPNEAVYTKMMTKKPGMFFNPEESELDLTYGSRYKDVKLPDAYERLILDVFCGNQMHFVRSDELREAWRIFTPVLHQLEREKIKPHPYKYGSRGPAESDELMQKVGFHYAGTYKWVNPNKL

SEQ ID NO: 2879 - DNA, 2004 bp, Arabidopsis thaliana
  CDS (51)..(1850)
gtttgcatccaaatccaattcataactcacactcgtctcaaattcgaaaaatgtcgtctctctcctgccctacctaccgctcccgcacttcgtcttcgtctcctttcttgtcgaatcatcatcattcttcgctgatcaatgttgttgacccacgccgctcactctccttccactacgcttctcctcaggggcttaatctagctgagctctgtgttgttagatcgcagaggaggtccgttcagagttctgttgtcgtgcaagatggatcagtagccaccgagtcaaactcgtccgaggaggcgaaagatgtaggggtgttaacgattccttcacttgaagctgacaaggttgtagcagagtctgatggcggtgaacaactttcaacagttagtatcacggtggtgggagcttctggtgatcttgccaagaagaaaatattcccagctcttttcgcactttactatgaaggctgtcttcctgagcattttaccatttttggctatgcaaggagtaagatgacagatgctgaacttagagttatggtcagcaaaacattgacatgtagaattgataagagggcaaactgcggtgaaaagatggaagagtttctcaagagatgtttttaccattcgggtcagtatgattctcaggaacattttgttgcattggacgagaagctcaaggagcatgagggtggaagactttcgaaccgtcttttctatctttcaatccctccaaatatctttgttgacgcggtgaaatgtgcaagctcatctgcttcatctgtcaatggatggactagggtcattgtcgagaaaccttttggccgggactccaaaacctcggctgcattaacaaagtctcttaagcagtacctggaggaagaccaaatatttaggatagaccattacttagggaaggagctggttgagaacttgtcggttcttcgattctcaaatcttatatttgaaccgctatggtcaaggcagtatataaggaacgtgcaattcattttttctgaggatttcggcactgaaggacgcggagggtacttcgacaattacggaataataagagatataatgcagaatcatctgcttcagatattagctcttttcgccatggaaacacctgtgagtttggatgcagaggatatcagaaatgaaaaggtaaaggtactacgttcaatgagaccaataaaacttgaagatgtggtgataggacagtacaagagccacagcataggaggagtcacttatccaagctatactgatgataaaactgtgccaaaaggtagtctgaccccgacatttgcagctgctgcactcttcatcgacaatgcaagatgggatggtgtaccttttctaatgaaagctgggaaagcactaaacacccgaagtgcggagataagagtccagttcaggcatgtgcctggaaatttatataaccggaattctggtactgatcgtgatcagaccacaaatgagcttgtcatccgcgtccaacctgatgaagctatctatttgaaaatcaacaacaaggtccctggtttaggaatgagattagatcagagtaacttaaatcttctctattcagcaaggtattcaaaggagattccagatgcatatgagaggcttttgttagatgcgatcgaaggtgaacgcagattgttcataagaagcgatgaacttgacgctgcttgggcgcttttcactccattgctcaaagagatagaagaaaagaagacaaccccagaattctatccttacggcagtcgtggtccagtcggtgcccattatctagccgcaaaacacaaggtccaatggggagacctaagtcttgatcagtgaaagagtggaagaacattttttgttcatagattcacgtcttagaattttcattatttgtgtggtttatggaaactttctttcgctttcagagataggagtgagttttgttcgattttgtatctggaataataagtaagaactaccctattcttgc

SEQ ID NO: 2880 - protein, 599 aa, Arabidopsis thaliana
MSSLSCPTYRSRTSSSSPFLSNHHHSSLINVVDPRRSLSFHYASPQGLNLAELCVVRSQRRSVQSSVVVQDGSVATESNSSEEAKDVGVLTIPSLEADKVVAESDGGEQLSTVSITVVGASGDLAKKKIFPALFALYYEGCLPEHFTIFGYARSKMTDAELRVMVSKTLTCRIDKRANCGEKMEEFLKRCFYHSGQYDSQEHFVALDEKLKEHEGGRLSNRLFYLSIPPNIFVDAVKCASSSASSVNGWTRVIVEKPFGRDSKTSAALTKSLKQYLEEDQIFRIDHYLGKELVENLSVLRFSNLIFEPLWSRQYIRNVQFIFSEDFGTEGRGGYFDNYGIIRDIMQNHLLQILALFAMETPVSLDAEDIRNEKVKVLRSMRPIKLEDVVIGQYKSHSIGGVTYPSYTDDKTVPKGSLTPTFAAAALFIDNARWDGVPFLMKAGKALNTRSAEIRVQFRHVPGNLYNRNSGTDRDQTTNELVIRVQPDEAIYLKINNKVPGLGMRLDQSNLNLLYSARYSKEIPDAYERLLLDAIEGERRLFIRSDELDAAWALFTPLLKEIEEKKTTPEFYPYGSRGPVGAHYLAAKHKVQWGDLSLDQ

SEQ ID NO: 2881 - DNA, 23 bp, artificial sequence
  primer
atgagtgaaggccccgtcaaatt

SEQ ID NO: 2882 - DNA, 25 bp, artificial sequence
  primer
ctaattatccttcgtatcttctggc

SEQ ID NO: 2883 - protein, 24 aa, consensus
  MISC_FEATURE (1)..(24): consensus for the disclosure of Xaa see table VIII
RXXXXXGPCSXXXXXXXXXYXXXX

SEQ ID NO: 2884 - protein, 42 aa, consensus
  MISC_FEATURE (1)..(42): consensus for the disclosure of Xaa see table VIII
XXXXMRXYXXKPRTXXXGXXGXXXXPXXXXXXXXXXGXXXXR

SEQ ID NO: 2885 - protein, 65 aa, consensus
  MISC_FEATURE (1)..(65): consensus for the disclosure of Xaa see table VIII
EXLXXXXXXXXXXXXXXXXXGARXXXXQXHRXXXSXXXXXXGXKNXXXGXXXXXXXXXXXXXXXX

SEQ ID NO: 2886 - protein, 71 aa, consensus
  MISC_FEATURE (1)..(71): consensus for the disclosure of Xaa see table VIII
XXGNXXXXXXXRGXXXXXXXXXXNXXXXXXXXXXXXXXXXXXXXXXXXXXXXXXDXXHXNXXKXXXXQXXX

SEQ ID NO: 2887 - protein, 41 aa, consensus
  MISC_FEATURE (1)..(41): consensus for the disclosure of Xaa see table VIII
GXMXESXXXXGXQXXXXXXXXXXXXXXXXXGXSXTDXCXXX

SEQ ID NO: 2888 - protein, 455 aa, consensus
  MISC_FEATURE (1)..(455): Xaa in all positions is any amino acid
XXXXXXXXXXXXXXXXXXXXXXXXXXXXXXXXXXXXXXXXXXXXXXXXXXXXXXXXXXXXXXXXXXXXLXXPXXXXXXXPXXXXXXXXXXXXRXXXXXIXXGXDXXXXRXXVXXGPCSXHDXXAAXXYAXXLXXXXXXXXXXXXLXXXMRXYXEKPRTXXXGWKGLIXDPXXXXXXXXXXGLXXXRXLXXXXXXXXGXPXAXEXLDXXXXQXXXDXXXXXAIGARTTESQXHRXXASXLSXPXGFKNXTXGXXXXAXXAXXXAXXXHXFXXXXXXGXXXXXXTXGNXXXHXXLRGGXXXXXXXXXNYXXXXXXXXXXXXXXXXXXXXXXXXXXXXXDXSHXNSXKXXXXQXXVXXXXXXQXXXGXXXXXXXXGXMXESXXXXGXQXXXXXXXXXXXXXXXXYGXSXTDXCXXWXXTXXXLXXXXXXXXXXXXXXXXXXXXXXXXXXXXXXXXXXX

SEQ ID NO: 2889 - protein, 26 aa, consensus
  MISC_FEATURE (1)..(26): consensus for the disclosure of Xaa see table VIII
XXRXXXXXGPCSXXXXXXXXXYXXXX

SEQ ID NO: 2890 - protein, 40 aa, consensus
  MISC_FEATURE (1)..(40): consensus for the disclosure of Xaa see table VIII
XXMRXYXXKPRTXXXGXXGXXXXPXXXXXXXXXXGXXXXR

SEQ ID NO: 2891 - protein, 58 aa, consensus
  MISC_FEATURE (1)..(58): consensus for the disclosure of Xaa see table VIII
XXXXXXXXXXXGARXXXXQXHRXXXSXXXXXXGXKNXXXGXXXXXXXXXXXXXXXXXX

SEQ ID NO: 2892 - protein, 25 aa, consensus
  MISC_FEATURE (1)..(25): consensus for the disclosure of Xaa see table VIII
XXGNXXXXXXXRGXXXXXXXXXXNX

SEQ ID NO: 2893 - protein, 52 aa, consensus
  MISC_FEATURE (1)..(52): consensus for the disclosure of Xaa see table VIII
XXXDXXHXNXXKXXXXQXXXXXXXXXXXXXXXXXXXXXXGXMXESXXXXGXQ

SEQ ID NO: 2894 - protein, 19 aa, consensus
  MISC_FEATURE (1)..(19): consensus for the disclosure of Xaa see table VIII
XGXSXTDXCXXXXXXXXXX

SEQ ID NO: 2895 - protein, 352 aa, consensus
  MISC_FEATURE (1)..(352): Xaa in all positions is any amino acid
LXXPXXXXXXXPXXXXXXXXXXXXRXXXXXIXXGXDXXXXRLXVXXGPCSXHDXXAAXXYAXXLXXXXXXXXXXXXLXXXMRXYXEKPRTXXXGWKGLIXDPXXXXXXXXXXGLXXXRXLXXXXXXXXXXPXAXEXLDXXXXQXXXDXXXWXAIGARTTESQXHREXASXLSXPXGFKNGTXGXXXXAXXAXXXAXXXHXFXXXXXXGXXXXXXTXGNXXXHXXLRGGXXXXXXXXXNYXXXXXXXXXXXXXXXXXXXXXXXXXXXXXDXSHXNSXKXXXXQXXVXXXXXXQXXXGXXXXXXXXGXMXESXXXXGXQXXXXXXXXXXXXXXXXYGXSXTDXCXXWXXTXXXL

SEQ ID NO: 2896 - protein, 296 aa, consensus
  MISC_FEATURE (1)..(296): Xaa in all positions is any amino acid
GPCSXXXXXXXXXXXXXXXXXXXXXXXXXXXXXXXRXYXXKXRTXXXGXXGXXXXPXXXXXXXXXXGXXXXRXXXXXXXXXXXXXXXXXXXXXXXXXXXXXXXXXXXXGARXXXXXXHRXXXSXXXXXXXXKNXXXGXXXXXXXXXXXXXXXXXXXXXXXXXXXXXXXXXGNXXXXXXXRGXXXXXXXXXXNXXXXXXXXXXXXXXXXXXXXXXXXXXXXXXDXXHXNXXXXXXXXXXXXXXXXXXXXXXXXXXXXXXXXMXEXXXXXGXXXXXXXXXXXXXXXXXXXGXSXTDXC

SEQ ID NO: 2897 - protein, 76 aa, consensus
  MISC_FEATURE (1)..(76): consensus for the disclosure of Xaa see table VIII
XXXXXXXXXXXXXXXXXXXXXXXXXXXXXXXXGXXXXXXXXXXXXXXXXXXXXXXRXXHXXXXXXXXXXXXXXXXX

SEQ ID NO: 2898 - protein, 39 aa, consensus
  MISC_FEATURE (1)..(39): consensus for the disclosure of Xaa see table VIII
XXXXXXXXGXXXXXXXXXXXXXXXXXXXXXXXDXAXXXX

SEQ ID NO: 2899 - protein, 84 aa, consensus
  MISC_FEATURE (1)..(84): consensus for the disclosure of Xaa see table VIII
XXHKXXXXXXXXXXXXXXXXXXXXXXXXXXXXXXXXXXXXXXXXSXXXXXXXXXXXXXXXXXXXXXXXXXXXXXXXXXXXXXXX

SEQ ID NO: 2900 - protein, 31 aa, consensus
  MISC_FEATURE (1)..(31): consensus for the disclosure of Xaa see table VIII
XXXXXXXXXXXXXXXXXXXYPPGXXXXXXGX

SEQ ID NO: 2901 - protein, 101 aa, consensus; identical to SEQ ID NO: 1322
  MISC_FEATURE (1)..(101): consensus for the disclosure of Xaa see table VIII

SEQ ID NO: 2902 - protein, 642 aa, consensus
  MISC_FEATURE (1)..(642): Xaa in all positions is any amino acid
PXXXXLXXXXXXXXXXXXXXXXXXXXXXXXXXXXXXXXXXXXXXXXXXXXXXXXXXXXLXXLXXXXGXXXXAXXXXAXXXXXXXXXXXXXGXSXXXXXXXXXXXXXXXXXXXXRNXHKSXXXXXXXXXXXXPXXXXXXXXXXXXXXXXXXXXXXXXXXXXXXXXXXXXXXXXXXXXXXXXXXXXXXXXTYXGXXXXXXXXXXXXXXXXXXXXXXXDXAXXXXXXFXXXXXXXXXXXXXXXXXXXXXXXXXXXXXXXXXXXXXXXXXXXXXXXXXXXXXXXXXXXXXXXXXSXHKXXXXXXQXSXXHXXXXXXXXXXXXXXXXXXXXXXXXXXXTSPXYXXXAXXXXXXXXXXXXXGXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXDPXKXXXXXXXXXXXXXXXXXXXXXXXXXXXXXXXXXIXXEXXXXXXXLXXXXXXXXXXXXXXLXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXAXXXXXYPPGXXXXXXGE

SEQ ID NO: 2903 - protein, 26 aa, consensus
  MISC_FEATURE (1)..(26): consensus for the disclosure of Xaa see table VIII
GXXXXGKXXXXXXXXXXXXXXXXXXX

SEQ ID NO: 2904 - protein, 75 aa, consensus
  MISC_FEATURE (1)..(75): consensus for the disclosure of Xaa see table VIII
XXXXXXXEXXXXXXXXXXXXXXXXXXXGGXXXXXXXXXXXXXXXXXXXXXXXXXXXXXXXXXXXXXXXXXXXXXX

SEQ ID NO: 2905 - protein, 160 aa, consensus
  MISC_FEATURE (1)..(160): Xaa in all positions is any amino acid
LXGXXGXGKXXXGXXXAXXXXXXXXDXDXXIXXXXXXXXXXXXXXXFXXXGEXXFRXXEXXXXXXXXXXXXXXXXXXXGGGXXXXXXXXXXXXXXXXXXXXXXXLXXXXXXXXXRXXXXXXXXXRPXXXXXXXXXXXXXXXXXXXXXXXXXXXXXRXXXY

SEQ ID NO: 2906 - protein, 72 aa, consensus
  MISC_FEATURE (1)..(72): consensus for the disclosure of Xaa see table VIII
GPCSXXXXXXXXXYXXXXXXXXXXXXXXXXXXXXMRXYXXKPRTXXXGXXGXXXXPXXXXXXXXXXGXXXXR

SEQ ID NO: 2907 - protein, 76 aa, consensus
  MISC_FEATURE (1)..(76): consensus for the disclosure of Xaa see table VIII
XXGARXXXXQXHRXXXSXXXXXXGXKNXXXGXXXXXXXXXXXXXXXXXXXXXXXXGXXXXXXXXGNXXXXXXXRGX

SEQ ID NO: 2908 - protein, 83 aa, consensus
  MISC_FEATURE (1)..(83): consensus for the disclosure of Xaa see table VIII
XXXDXXHXNXXKXXXXQXXXXXXXXXXXXXXXXXXXXXXGXMXESXXXXGXQXXXXXXXXXXXXXXXXXGXSXTDXCXXXXXX

SEQ ID NO: 2909 - protein, 456 aa, consensus
  MISC_FEATURE (1)..(456): Xaa in all positions is any amino acid
XXXXXXXXXXXXXXXXXXXXXXXXXXXXXXXXXXXXXXXXXXXXXXXXXXXXXXXXXXXXXXXXXXXXLXXPXXXXXXXPXXXXXXXXXXXXRXXXXXIXXGXDXRXXXXXXXXGPCSXHDXXXAXXYAXXLXXXXXXXXXXXXLXXXMRXYXEKPRTXXXGWKGLIXDPXXXXXXXXXXGLXXXRXLXXXXXXXXXXPXAXEXLDXXXXQXXXDXXXXXAIGARTTESQXHRXXXASXLSXPXGFKNXTXGXXXXAXXAXXXAXXXHXFXXXXXXGXXXXXXTXGNXXXHXXLRGGXXXXXXXXXNYXXXXXXXXXXXXXXXXXXXXXXXXXXXXXDXSHXNSXKXXXXQXXVXXXXXXQXXXGXXXXXXXXGXMXESXXXXGXQXXXXXXXXXXXXXXXXYGXSXTDXCXXWXXTXXXLXXXXXXXXXXXXXXXXXXXXXXXXXXXXXXXXXXX

SEQ ID NO: 2910 - protein, 23 aa, consensus
  MISC_FEATURE (1)..(23): consensus for the disclosure of Xaa see table VIII
XXXLPXPXXXXXXXXXXXXXXXX

SEQ ID NO: 2911 - protein, 27 aa, consensus
  MISC_FEATURE (1)..(27): consensus for the disclosure of Xaa see table VIII
XXXXXXXXXXXXXXXXXXXXXXXLXXX

SEQ ID NO: 2912 - protein, 16 aa, consensus
  MISC_FEATURE (1)..(16): consensus for the disclosure of Xaa see table VIII
XXXXXXXXXFXXXRXX

SEQ ID NO: 2913 - protein, 45 aa, consensus
  MISC_FEATURE (1)..(45): consensus for the disclosure of Xaa see table VIII
XXXXXXXXXXXWXXXXXXXXXXXXXXXXXXXXXXXXXXXFXXXXD

SEQ ID NO: 2914 - protein, 31 aa, consensus
  MISC_FEATURE (1)..(31): consensus for the disclosure of Xaa see table VIII
RXXXKXXXXXXXXXXXXXXXXXXXXXXXXXX

SEQ ID NO: 2915 - protein, 43 aa, consensus
  MISC_FEATURE (1)..(43): consensus for the disclosure of Xaa see table VIII
DXXXQXXXQXXXXXXXXXXXXXXEXXXXXXXXXXXXXXXXXXX

SEQ ID NO: 2916 - protein, 24 aa, consensus
  MISC_FEATURE (1)..(24): consensus for the disclosure of Xaa see table VIII
HXXXXXXXXXXXXXXXXXXXXXXX

SEQ ID NO: 2917 - protein, 150 aa, consensus
  MISC_FEATURE (1)..(150): consensus for the disclosure of Xaa see table VIII
XXXXEKPXXXXXXXXXXXXXXXXXXXXXXXXXXXDHXLXXXXXXXXXXXXXXNXXXXXXXXXXXXXXXXXXXXXEXXXXXXXXXXXXXXGXXXXDXXXXXXXXXXXXXXMXXPXXXXXXXXXXXXXXXXXXXXXXXXXXXXXXXXXXXXX

SEQ ID NO: 2918 - protein, 44 aa, consensus
  MISC_FEATURE (1)..(44): consensus for the disclosure of Xaa see table VIII
XXXXXXXXXXXXXSXXXTXXXXXXXXXXXXXXXXPXXXXXXKXX

SEQ ID NO: 2919 - protein, 97 aa, consensus
  MISC_FEATURE (1)..(97): consensus for the disclosure of Xaa see table VIII
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXXXX

SEQ ID NO: 2920 - protein, 1277 aa, consensus
  MISC_FEATURE (1)..(1277): Xaa in all Positions is any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXGDLXXXKXXPXXXXLXXXXXLXXXXXXXXGXXRXXXXXXXXXXXXXXXXXXXXXXXXXXXXXXXXXXXXXXXXXXXXXYXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXXPXXXXXXXXXXXXXXXXXXXXXXXXXXXRXXXEKPXGXDXXSXXXLXXXXXXXXXEXXXXRIDHYLGKEXVXNXXXXRFXNXXXXXXXWNXXXIXXXXIXXXEXXGXXXRXXYXXXXGXXXRDXXQNHXXQXXXXXAMEXPXXXXXXXXXXXEKXKXLXXXXXXXXXXXXXXXXXGQYXXXXXXXXXXXXXXXXXXXXXXXXXXXXXXYXXXXXXXXXXXXSXXXTXXXXXXXXXNXRWXGVPFXXXXGKXXXXXXXXXXXXXFXXXXXXXXXXXXXXXXXXXXXXXXXXXXXXNXXXXXXQPXEXXXXXXXXKXPGXXXXXXXXXXXXXXXXXXXXXXXXXXXXXXXXXXXXXXXXXAYEXLXXDXXXGXXXXFXXXXEXXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXGXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 2921 - DNA, 1371 bp, Escherichia coli K12
  CDS (1)..(1371)
atggaattatcctcactgaccgccgtttcccctgtcgatggacgctacggcgataaagtcagcgcgctgcgcgggattttcagcgaatatggtttgctgaaattccgtgtacaagttgaagtacgttggctgcaaaaactggccgcgcacgcagcgatcaaggaagttcctgcttttgctgccgacgcaatcggttaccttgatgcaatcgtcgccagtttcagcgaagaagatgcggcgcgcatcaaaactatcgagcgtaccactaaccacgacgttaaagcggttgagtatttcctgaaagaaaaagtggcggagatcccggaactgcacgcggtttctgaattcatccactttgcctgtacttcggaagatatcaataacctctcccacgcattaatgctgaaaaccgcgcgtgatgaagtgatcctgccatactggcgtcaactgattgatggcattaaagatctcgccgttcagtatcgcgatatcccgctgctgtctcgtacccacggtcagccagccacgccgtcaaccatcggtaaagagatggcaaacgtcgcctaccgtatggagcgccagtaccgccagcttaaccaggtggagatcctcggcaaaatcaacggcgcggtcggtaactataacgcccacatcgccgcttacccggaagttgactggcatcagttcagcgaagagttcgtcacctcgctgggtattcagtggaacccgtacaccacccagatcgaaccgcacgactacattgccgaactgtttgattgcgttgcgcgcttcaacactattctgatcgactttgaccgtgacgtctggggttatatcgcccttaaccacttcaaacagaaaaccattgctggtgagattggttcttccaccatgccgcataaagttaacccgatcgacttcgaaaactccgaagggaatctgggcctttccaacgcggtattgcagcatctggcaagcaaactgccggtttcccgctggcagcgtgacctgaccgactctaccgtgctgcgtaacctcggcgtgggtatcggttatgccttgattgcatatcaatccaccctgaaaggcgtgagcaaactggaagtgaaccgtgaccatctgctggatgaactggatcacaactgggaagtgctggctgaaccaatccagacagttatgcgtcgctatggcatcgaaaaaccgtacgagaagctgaaagagctgactcgcggtaagcgcgttgacgccgaaggcatgaagcagtttatcgatggtctggcgttgccagaagaagagaaagcccgcctgaaagcgatgacgccggctaactatattggtcgagctatcacgatggttgatgagctgaaataa

SEQ ID NO: 2922 - protein, 456 aa, Escherichia coli K12
MELSSLTAVSPVDGRYGDKVSALRGIFSEYGLLKFRVQVEVRWLQKLAAHAAIKEVPAFAADAIGYLDAIVASFSEEDAARIKTIERTTNHDVKAVEYFLKEKVAEIPELHAVSEFIHFACTSEDINNLSHALMLKTARDEVILPYWRQLIDGIKDLAVQYRDIPLLSRTHGQPATPSTIGKEMANVAYRMERQYRQLNQVEILGKINGAVGNYNAHIAAYPEVDWHQFSEEFVTSLGIQWNPYTTQIEPHDYIAELFDCVARFNTILIDFDRDVWGYIALNHFKQKTIAGEIGSSTMPHKVNPIDFENSEGNLGLSNAVLQHLASKLPVSRWQRDLTDSTVLRNLGVGIGYALIAYQSTLKGVSKLEVNRDHLLDELDHNWEVLAEPIQTVMRRYGIEKPYEKLKELTRGKRVDAEGMKQFIDGLALPEEEKARLKAMTPANYIGRAITMVDELK

SEQ ID NO: 2923 - DNA, 1343 bp, Pseudomonas putida
  CDS (75)..(1298)
cgattgccttcctgttcagcctgcgcctgccgaagcaggccgcgtacctgcaccacgatgactaaggacgtggcatgaccaaccaactgttcgacgcctacttcaccgcgccggccatgcgcgagattttctccgaccgtggccgcttgcagggcatgctcgatttcgaagccgcgctggcccgtgccgaagctgctgcggggctggtcccgcacagcgccgtggccgccatcgaggcggcatgcaaggccgagcgctatgacgtgggggcgctggccaatgccatcgcaaccgctggcaactcggcaatcccgctggtgaaggcgttgggcaaggtgattgccagtggcgtgcccgaggccgagcgctatgtgcacttgggcgccaccagccaggacgcgatggacaccggtctggtgttgcagttgcgcgatgccctcgacctgatcgaagcggacctgggcaaactggccgataccctgtcgcagcaggcattgaagcacgccgatacgccaatggtgggccgcacctggctgcaacacgctaccccggtgaccctgggcatgaaactggctggcgtgctgggggcattgacccgccaccgtcagcgcctgcaagagctcggcccgccctgttggtgctgcagttccggcggcgcctcgggcagcctggccgctctgggcagcaaggcgatgccggtggccgaggccctggccgagcaactgaagctgagcctgcccgagcaaccctggcacacccagcgtgatcgcctggtggagtttgcctcggtgctgggccttgtggccggcagcctgggcaagttcggccgcgatgtcagcctgctgatgcaaaccgaggcgggggaggtgttcgagccttctgcaccaggcaagggcggctcctcgaccatgccacacaagcgcaacccggtgggcgctgcggtgctgatcggtgccgcgactcgcgtgccggggctggtatcgacgctgttcgccgccatgccccaggagcacgagcgcagcctgggcctgtggcatgccgaatgggaaaccctcccggacatctgctgcctggtctccggcgcgctgcgccaggcccaggtcattgccgagggcattgaagtagacgcagcgcgcatgcgccgtaacctcgacctgacccaagggctggtgctggcagaagcggtgagtatcgtcctggcccgaacgcctgggccgcgaccgtgcccaccacttgctggagcaatgctgccagcgagccgtggccgaacagcggcacctgcgtgcggtgctgggtgatgacccgcaggtcagtgccgagctgtctgccgaagaacttgatcg

SEQ ID NO: 2924 - protein, 407 aa, Pseudomonas putida
MTNQLFDAYFTAPAMREIFSDRGRLQGMLDFEAALARAEAAAGLVPHSAVAAIEAACKAERYDVGALANAIATAGNSAIPLVKALGKVIASGVPEAERYVHLGATSQDAMDTGLVLQLRDALDLIEADLGKLADTLSQQALKHADTPMVGRTWLQHATPVTLGMKLAGVLGALTRHRQRLQELGPPCWCCSSGGASGSLAALGSKAMPVAEALAEQLKLSLPEQPWHTQRDRLVEFASVLGLVAGSLGKFGRDVSLLMQTEAGEVFEPSAPGKGGSSTMPHKRNPVGAAVLIGAATRVPGLVSTLFAAMPQEHERSLGLWHAEWETLPDICCLVSGALRQAQVIAEGIEVDAARMRRNLDLTQGLVLAEAVSIVLARTPGPRPCPPLAGAMLPASRGRTAAPACGAG

SEQ ID NO: 2925 - DNA, 1389 bp, Methanococcus jannaschii
  CDS (1)..(1389)
atggaacttaatcaaataataaagtcaggtgaaaaaatggctgtgcatccaattgattatagatatggaacaccagagatgagaaaagtttgggaagaagaaaataaattggaaaaaatgttaaaggtagaggctgcattagctaaagctcaggcagaactcggcttaattccaaaagaagccgctgaagagataaacaaaaaagcatcaacaaaatatgtaaaattggagagagttaaagaaattgagaaacaaacaaaacatgatgttgttgcaatgattagagctttagctgaagtatgtgaaggaaatgctggagaatacatacacttcggagctacatcaaacgatattgttgatactgccaactccctactaataaaagaatccattgaaattatagaagataagttaaagcagttaagagatatattattagacaaagcagaagagcataaatacactgtctgtgtaggaagaacacatggacagcatgcaattccaacaacctatgggatgagatttgctctatgggcggctgagattgacagacacttagagagattaaaagaagcaaaaaagagaatatgcgtctctatgattactggagctgttggaacaatggcggctatgggagagaagggtttggaagtgcataaaagagttgctgaaatcttaggcttagaaccagttttaatctcaaaccaagttattcagagagacagacatgctgaattcgtctttttattagctttaattgctcagacattaaacaagattggagttactgttagaagtatgcagagaactgaaattggagagctagaagaagagttcgaccctacaaagcaaactggttcatcaacaatgcctcacaagagaaatccaataacctttgagcaaatctgcggtttatcaagggttataaaatcactatgtatagctgaaatggacaatatcccattatgggaagagagggatttaacaaactcatcagctgagagatgtatatttgcagaggtttgcgttttaacagaccacatcttaacattagcaattaaaggagttaaaaagctaaaagtaaataaagaaaatgttgagagaaacttagaattaacaaaaggactgataatggctgagagaataatgattgaattggctaagagaggtatgggcagacaaacagctcatgaaatagtaaggcagtgtgcaatgaaagcctatgaagagaaaaggcatttaaaagatattttattagaaaatgaggaagttatgaagtatataacaaaagaagagttagaggaattgatgaatcctaaaacttacataggtttagctccacagatagttgatgaagttattaaaactctaaagaataaaaagtactaa

SEQ ID NO: 2926 - protein, 462 aa, Methanococcus jannaschii
MELNQIIKSGEKMAVHPIDYRYGTPEMRKVWEEENKLEKMLKVEAALAKAQAELGLIPKEAAEEINKKASTKYVKLERVKEIEKQTKHDVVAMIRALAEVCEGNAGEYIHFGATSNDIVDTANSLLIKESIEIIEDKLKQLRDILLDKAEEHKYTVCVGRTHGQHAIPTTYGMRFALWAAEIDRHLERLKEAKKRICVSMITGAVGTMAAMGEKGLEVHKRVAEILGLEPVLISNQVIQRDRHAEFVFLLALIAQTLNKIGVTVRSMQRTEIGELEEEFDPTKQTGSSTMPHKRNPITFEQICGLSRVIKSLCIAEMDNIPLWEERDLTNSSAERCIFAEVCVLTDHILTLAIKGVKKLKVNKENVERNLELTKGLIMAERIMIELAKRGMGRQTAHEIVRQCAMKAYEEKRHLKDILLENEEVMKYITKEELEELMNPKTYIGLAPQIVDEVIKTLKNKKY

SEQ ID NO: 2927 - DNA, 1350 bp, Methanobacterium thermoautotrophicum
  CDS (1)..(1350)
atggccattcatccagttgaattcaggtacgggacacctgaaatgagggttatctgggaggctgaaaataagctccagaagatgcttgacgttgaggcggcccttgcacaggcagagggcgaacttggaatcatacctgctgaagcggcctctgagatagtcaggaaggccagcacagaatttgtaacccttgaaagggttaatgagattgagagggacacaaagcatgatattgcatcccttgtaaaggcccttgcagagcagtgtgagggtgacgcaggggaatatgtgcacttcggtgcaacatccaatgacattgttgacacatccaattccctgcttctcagggactcaatctcggttctcagggataaactcaccagggtacttgaggttctccttgctctggcggatgaaaacagggacagggtctgcatcggaaggacccatggacagcacgccctcccaaccacctatggcatgaaattcgccatctgggcagatgagatccaccggcagctggagcgccttgatgcgtgcagtgaaaggctctgtgtcgggatgatgacaggagccgtcggaaccacagcggccctgggggaggagggcctggaggtccatgagagggtctcagagatactgggactcagaccggtcctgatatccaaccaggtcgtccagagggataaccatgcagagttcataatggtccttgccaacatagccacaacccttgataagatagccctcgagatcaggaaccttcagaggacagagataatggaggttggagagaaatttgaccctgagaaacaggtgggcagcagtaccatgcctcataagatgaacccaataactgcagagaggatatgtggtattgcgcgtgttataaggtcctatgttgtcgcggccctggagaacaacccattatggcatgagagggacctcacaaattcatcatccgaacgcataatccttcctgaggcatgcatcctcacggactacatacttaaactgacactggatgtcctctgcaacctcgtcttctaccctgagaatattaagaggaaccttgaattcacaggaggcctgataatggcggagaggctcatggctgagctaacaaggaggggcatgggtcggcagacagcatatgcagctgtgcgccagtgtgccattgaggccagcaggacaggaagaagcctaagggatgtggtccttgagaggtccgagatcatggattaccttacagtggaggaccttgaggagataatgaaccctgagacctacatcggatcagccaggaggatggttgagagggtccttgaggaatcacaaaaatggctctga

SEQ ID NO: 2928 - protein, 449 aa, Methanobacterium thermoautotrophicum
MAIHPVEFRYGTPEMRVIWEAENKLQKMLDVEAALAQAEGELGIIPAEAASEIVRKASTEFVTLERVNEIERDTKHDIASLVKALAEQCEGDAGEYVHFGATSNDIVDTSNSLLLRDSISVLRDKLTRVLEVLLALADENRDRVCIGRTHGQHALPTTYGMKFAIWADEIHRQLERLDACSERLCVGMMTGAVGTTAALGEEGLEVHERVSEILGLRPVLISNQVVQRDNHAEFIMVLANIATTLDKIALEIRNLQRTEIMEVGEKFDPEKQVGSSTMPHKMNPITAERICGIARVIRSYVVAALENNPLWHERDLTNSSSERIILPEACILTDYILKLTLDVLCNLVFYPENIKRNLEFTGGLIMAERLMAELTRRGMGRQTAYAAVRQCAIEASRTGRSLRDVVLERSEIMDYLTVEDLEEIMNPETYIGSARRMVERVLEESQKWL

SEQ ID NO: 2929 - DNA, 1296 bp, Thermotoga maritima
  CDS (1)..(1296)
atggtagaaaggtattcgctgtcaccgatgaaggatctctggacggaggaagcgaagtacagaagatggctggaagtggaactggcagtgacgagggcgtacgaagaactgggaatgattccgaagggagtcacagagaggataagaaacaacgctaagatagatgtggaactgttcaaaaagatagaagagaaaacaaaccacgatgtggtggcgttcgtcgaaggaatcggctcgatgataggagaagactcgagattcttccactacggtctcacctcgtcagatgttctcgacaccgcaaattccctcgctctcgtggaagcggggaaaatcctgttagagtctctaaaagagttctgcgacgtgctctgggaagtcgcgaatcggtacaaacacactcccaccatcggaagaacacacggagtccacgcggaacccacctcctttggcttgaaggtccttggatggtactccgaaatgaaaaggaacgttcagcgccttgagagggcgatagaggaagtttcttacggtaagatcagtggagctgttggaaactacgcaaacgtaccaccggaggtggaggaaaaagcgctttcgtacctgggcttgaaacctgaacccgtctccacacaggttgtaccgagggatcgtcacgctttctatctgtccacgctcgcgatcgtggcagcggggatagaaaggatcgctgtcgagatcagacatcttcagagaacggaagtgctcgaggtggaagaaccgttcaggaaaggtcagaggggctcgagtgccatgccccacaagaagaatcccatcacctgcgagcggctcacgggactttccagaatgatgagggcgtacgtcgatccttcccttgaaaacatcgcgctctggcatgagagggacatttcgcactcttccgtcgaaagatacgtttttcctgacgccacgcagactctttactacatgatcgtcacggccacaaacgtggtgaggaacatgaaagtgaacgaagaaagaatgaagaagaacatagatctcacgaaaggtctcgtgttctcccagagagtcctgctgaaactcatagagaaaggactcacgaggaaagaggcttacgatatcgtccagaggaacgctctgaaaacctggaattccgaaaaacacttcctcgagtacctcctcgaggatgaagaggttaagaaactggttaccaaagaagagctcgaagaactcttcgatatctcttactacttgaaacacgtagaccacatcttcgaacgctttgaaaaggagtga

SEQ ID NO: 2930 - protein, 431 aa, Thermotoga maritima
MVERYSLSPMKDLWTEEAKYRRWLEVELAVTRAYEELGMIPKGVTERIRNNAKIDVELFKKIEEKTNHDVVAFVEGIGSMIGEDSRFFHYGLTSSDVLDTANSLALVEAGKILLESLKEFCDVLWEVANRYKHTPTIGRTHGVHAEPTSFGLKVLGWYSEMKRNVQRLERAIEEVSYGKISGAVGNYANVPPEVEEKALSYLGLKPEPVSTQVVPRDRHAFYLSTLAIVAAGIERIAVEIRHLQRTEVLEVEEPFRKGQRGSSAMPHKKNPITCERLTGLSRMMRAYVDPSLENIALWHERDISHSSVERYVFPDATQTLYYMIVTATNVVRNMKVNEERMKKNIDLTKGLVFSQRVLLKLIEKGLTRKEAYDIVQRNALKTWNSEKHFLEYLLEDEEVKKLVTKEELEELFDISYYLKHVDHIFERFEKE

SEQ ID NO: 2931 - DNA, 1308 bp, Deinococcus radiodurans
  CDS (1)..(1308)
atgattgaccgctacctgacccccgaaatgaaggttctctggagcgaggcgaacaagtaccgcgcctggctgaaggtcgagctgagtgccctgcaggcgcaggcccggcacggcgaggtgcccgccgaagcgcatgccgcgctggtacaaaagagtgaagccgaccccctcgacgacgccttcgcgcagcaggtggccgaaatcgaggccgtgacccggcacgacatcgtggcctttacccgcgccctgaccgagcgttacggcgaggaggcccgctttatccaccacggcctgacgagcaccgacgtggtggacaccgcgcaaaacctgctgcttgacgaggccatggggctcatcatcaccgacgtgcagacgctgcgcgaggtgtgccgcatgcaggccgccgcgcacaagcacacgccggtcgtgggccgcacccacggcatccacgccgagccgatgaccttcggcctcaagttcctgaactggatggcgacgctcgaccgcgatctggaacggttgcaggccgcgcggggccgcgtgcaggtggtcatgctctcaggctcggtgggcacctacgcgcacgtctcacccaaaatcgaggaagaagtcgccgagagctggggctggcacgccgcgcccgtcaccaaccagacgcttgcccgtgaccgccacgccgaggtgctcgccgcgctcgccatcctgggcaccacgctggagaaaatcgccgtggaaatccgccacctgcaacgcagcgaggtgcgcgaggcgatggaacccttcggcaaggggcagaccggcagcagttcgatgccccacaagaaaaaccccatcctgaccgagaacgtgaccggctttgcccgtttgctgcgcggctttctggcgacgggcctggagaacgtggcactgtggcacgagcgcgacatcagccactccagcgccgagcgcgtcatcttgcccgacgccaccgccagcgcgagctacgcgacccgccgcctgaccggggtgctgcgcgacctggtggtcttccccgagcggatgctcaaaaatctggacgacctcggcggtctggtgttcagccagcgcgtgctgcacgccctgatcgacgataagggaatgatgcgcgaggcggcttacggcatcgtgcagcgcaacgccctgaagtcctgggaaaccggcgagggcctgcgcgacctgctgaaggccgacccagaaaacccgctgagtgacgcggaactcgacgccgccttcgacttgcagtggtacctgcggcacgtggacgacatctacgcccggtttgggatgtaa

SEQ ID NO: 2932 - protein, 435 aa, Deinococcus radiodurans
MIDRYLTPEMKVLWSEANKYRAWLKVELSALQAQARHGEVPAEAHAALVQKSEADPLDDAFAQQVAEIEAVTRHDIVAFTRALTERYGEEARFIHHGLTSTDVVDTAQNLLLDEAMGLIITDVQTLREVCRMQAAAHKHTPVVGRTHGIHAEPMTFGLKFLNWMATLDRDLERLQAARGRVQVVMLSGSVGTYAHVSPKIEEEVAESWGWHAAPVTNQTLARDRHAEVLAALAILGTTLEKIAVEIRHLQRSEVREAMEPFGKGQTGSSSMPHKKNPILTENVTGFARLLRGFLATGLENVALWHERDISHSSAERVILPDATASASYATRRLTGVLRDLVVFPERMLKNLDDLGGLVFSQRVLHALIDDKGMMREAAYGIVQRNALKSWETGEGLRDLLKADPENPLSDAELDAAFDLQWYLRHVDDIYARFGM

SEQ ID NO: 2933 - DNA, 1371 bp, Vibrio cholerae
  CDS (1)..(1371)
atggaactgtcagcattgactgctgtttcaccggtagatggccgctacggaagtaaaacgattgcgttacgcagtatcttcagtgagtttggtctcctaaagtaccgcactatcgttgaaattcgctggctacaaaagctagccgccactgctgagatcgcagaagtgcctgcattcagtgccgaagcgaatcaattccttgatgcgattgccgccaacttcaatgaggcggatgcactccgtatcaaagagattgaacgcaccaccaaccacgatgtaaaagccgtggaatacttcctgaaagagaaagtagcggccatgcctgagctgcatgccgtcaacgagttcattcactttgcttgtacttccgaagacatcaacaacacttcacatgcgttgatgctcaaagaagcgcgtgacacggtgatcctgcctgaaattcgcaacgtgattgacgcaattcgcaaactggccgaagagtaccgcgatattccgctgctttctcgtactcacggtcagccagcctctccatcgaccatgggtaaagagatggcgaacgtggcctaccgcatggagcgccaatacaagcagatcgctaacgtagaaatcctagccaaaatcaacggtgcggtgggtaactacaacgcgcacctttctgcttacccaacggtagattggcataaattcagcgaagagttcatcactgaatctttgggcgtagattggaacccgtacaccacgcaaatcgagccgcatgattacattgctgagctgtttgaagcggtggcacgttttaacaccatcttgatcgattttgatcgtgatgtttggggttacattgccctgggccacttcaaacaaagaaccatcgcgggtgaaattggttcttctaccatgccacacaaagtcaacccaatcgactttgaaaactcagaaggtaacttgggtctggcgaatgcggtatttacccatttagcgcaaaagctgcctatctctcgttggcaacgtgacctaacggattctaccgtgctgcgtaacctcggtgtgggtgtcggctatgccatcatcgcttatacctcaactttgaaaggcatcagcaagctggaagtgaaccgtgacgcactacttgcagaactggatcacaactgggaagttctggcagagccaatccaaactgtgatgcgccgctacggcattgaaaagccatatgagaagctcaaagaactgactcgtggtaagcgagtagatggcgaagcgatgcgtcaattcattgatggtttagcactgccagcggaagagaaaactcgcttgaaagccatgacaccagccagctatattggctacgcgattgagctgacggacaagctgtaa

SEQ ID NO: 2934 - protein, 456 aa, Vibrio cholerae
MELSALTAVSPVDGRYGSKTIALRSIFSEFGLLKYRTIVEIRWLQKLAATAEIAEVPAFSAEANQFLDAIAANFNEADALRIKEIERTTNHDVKAVEYFLKEKVAAMPELHAVNEFIHFACTSEDINNTSHALMLKEARDTVILPEIRNVIDAIRKLAEEYRDIPLLSRTHGQPASPSTMGKEMANVAYRMERQYKQIANVEILAKINGAVGNYNAHLSAYPTVDWHKFSEEFITESLGVDWNPYTTQIEPHDYIAELFEAVARFNTILIDFDRDVWGYIALGHFKQRTIAGEIGSSTMPHKVNPIDFENSEGNLGLANAVFTHLAQKLPISRWQRDLTDSTVLRNLGVGVGYAIIAYTSTLKGISKLEVNRDALLAELDHNWEVLAEPIQTVMRRYGIEKPYEKLKELTRGKRVDGEAMRQFIDGLALPAEEKTRLKAMTPASYIGYAIELTDKL

SEQ ID NO: 2935 - DNA, 1302 bp, Bacillus halodurans
  CDS (1)..(1302)
atgattgaacggtatactcgtcctgagatgggagcaatttggacagaagaaaatcgctatcaggcatggctagaagtagagattgttgcctgtgaagcatgggcggagcttggagagattccgaaagaggacgtaaagaaaatccgcgaacatgccagctttgatgtggagcgaattttggaaattgagcaggaaactcgccacgatgtggtggcgtttacccgtgcagtatccgaaacgctaggagaagagagaaaatgggttcattatgggttaacgtcaacagatgtcgtagatacagcgctatcctacttgctgaagcaagcaaatgaaattattgaggccgatcttgtcagatttcttgacatcttaaaagagaaggcattagagcacaagtatacggtaatgatgggacggacacatggcgttcacgcagagcctactacgttcgggttaaagctcgctctctggtatgaagaaatgaagcgcaaccttgagcgttttcgtcttgcagcagaaggcgttcgtgttggtaagctttcaggagcggtcggaacgtacgcaaacattgatccatttgtagagcagtatgtttgcgaaaagctaggtcttgagcgggctccaatttcaacgcaaacacttcaacgggatcgccatgcagaatatatggcgacgttggcccttatcgccacttcgattgagaagttcgctgttgaaattcgcgggttgcaaaaatctgaaacgagagaagtagaggaatattttgcgaagggacaaaaagggtcatcggctatgccacacaagcgcaatccgattggatctgaaaatatgacagggatcgcccgtgtcgtccgcggccatatgcttgcggcctatgaaaatgttcccctttggcatgagcgggacatttcccattcctctgctgaacggatcattttaccagatgcgacgattgctattaattacatgttaaaccgattcggaaacatcgtgaaaaacttaaccgtattccctgaaaacatgaagcgtaatatgacacgtacgtatggtcttatctactcgcaaagagtgttgctttctttgatcgacaaagggatggtacgggaagaagcatacgatcttgtccaaccgaaggcaatggaagcgtgggaaaaaggcgttcagttccgtgaattggttgagcaagaggaacggattacgtctgttttatcacctgaagaaatagaagcatgctttgactacaaccaccatttaaaacatgtggacacgatctttgagcgtctcggcttaacaaacgaataa

SEQ ID NO: 2936 - protein, 433 aa, Bacillus halodurans
MIERYTRPEMGAIWTEENRYQAWLEVEIVACEAWAELGEIPKEDVKKIREHASFDVERILEIEQETRHDVVAFTRAVSETLGEERKWVHYGLTSTDVVDTALSYLLKQANEIIEADLVRFLDILKEKALEHKYTVMMGRTHGVHAEPTTFGLKLALWYEEMKRNLERFRLAAEGVRVGKLSGAVGTYANIDPFVEQYVCEKLGLERAPISTQTLQRDRHAEYMATLALIATSIEKFAVEIRGLQKSETREVEEYFAKGQKGSSAMPHKRNPIGSENMTGIARVVRGHMLAAYENVPLWHERDISHSSAERIILPDATIAINYMLNRFGNIVKNLTVFPENMKRNMTRTYGLIYSQRVLLSLIDKGMVREEAYDLVQPKAMEAWEKGVQFRELVEQEERITSVLSPEEIEACFDYNHHLKHVDTIFERLGLTNE

SEQ ID NO: 2937 - DNA, 1296 bp, Lactococcus lactis subsp. lactis
  CDS (1)..(1296)
atggttattagccgttattcacgtccagaaatggcagagatttggtcagaagaaaacaagtataaagcatggcttgaagtcgaaattcttgcagatgaagcatgggcagagcttggggaaatcccagcagcagatgtgaaaaaaattcgcgaaaatgcaacttttaatgttgaacgtattcttgaaattgaaaaagaaacacgtcatgatgtggtagctttcacacgttctgtcagtgaatcattgggtgaagaacgcaaatgggttcattatggtctgacatcaacagatgtcgttgatacagcttatggttatctttataaacaagctaatgatattttgcgcaatgatctaaaaaactttgcagaaattgttaaaaataaagctttagagcataaatacacagtaatgatgggtcgaactcacggcgttcacgctgaaccaacaacttttggcttgaaattagcgacttggtacagcgaaatgaaacgaaatattgaacgttttgaacgtgctgcaaaagctgttgaagctgggaaaatttctggtgctgttggaacttttgctaatattcctccatttgtagaagcctatgtttgtgaaaaattagggactcgtccgcaagagatttcaacacaagtcttaccacgtgatttacatgcagaatacttccaaacgttggcgctcattgcgacatcaattgaacgcatggccacagaaatccgtggattacaaaaatctgaacaacgtgaagttgaagaattctttgctaaaggtcaaaaaggctcgtcagcaatgccacacaaacgtaacccaattggttctgaaaatatgacaggtttagcccgcgtcattcgtggacatgcaattacagctcttgaagatgttagtctttggcatgaacgtgacatttcacacagttctgctgaacgtatcattgcacctgatacaacagaattattggattatatgttgaatcgttttgggaatatcgttaaaaatttgactgttttcccagaaaatatgaagcgaaatatggatgcgacttttggcttgatttacagccaacatgtcatgttaatgttgattgaaaagggaatgacgcgtgaagcagcttacgatttagttcaacctttgactgcaaaatcttgggatgaacaagtgatgtttagaccattgcttgaagaaaatgaacaaattcgtcagtatttgaatgatgaagatattgataaagcttttgattacaattatcatttaacaagagtcgatgaaatttttgagcgtgtctttgattaa

SEQ ID NO: 2938 - protein, 431 aa, Lactococcus lactis subsp. lactis
MVISRYSRPEMAEIWSEENKYKAWLEVEILADEAWAELGEIPAADVKKIRENATFNVERILEIEKETRHDVVAFTRSVSESLGEERKWVHYGLTSTDVVDTAYGYLYKQANDILRNDLKNFAEIVKNKALEHKYTVMMGRTHGVHAEPTTFGLKLATWYSEMKRNIERFERAAKAVEAGKISGAVGTFANIPPFVEAYVCEKLGTRPQEISTQVLPRDLHAEYFQTLALIATSIERMATEIRGLQKSEQREVEEFFAKGQKGSSAMPHKRNPIGSENMTGLARVIRGHAITALEDVSLWHERDISHSSAERIIAPDTTELLDYMLNRFGNIVKNLTVFPENMKRNMDATFGLIYSQHVMLMLIEKGMTREAAYDLVQPLTAKSWDEQVMFRPLLEENEQIRQYLNDEDIDKAFDYNYHLTRVDEIFERVFD

SEQ ID NO: 2939 - DNA, 1293 bp, Listeria innocua
  CDS (1)..(1293)
atgttagaacgttatactcgtaaagaaatgggcaatatttggacagaacaaaatcgttatcaagcttggttagaagtagaaattttggcttgtgaagcgtgggcagagcttggtgatattccaaaagaagatgtaaagaaaattcgcgcgaatgctaagtttgatgtcgaccgtattcatgaaatcgaattagaaactagacatgatgtagtagcatttactcgttcggtatctgagtctcttggtgaggaacgtaaatgggtgcattatggcttaacttcaacagatgtagtagatacagcgaattcttacttactaaaacaagcaaatgaaattttaagaaaagacttggagaatttcattgcgattattggcgaaaaagcgaaagaacataaatatacagtaacgatgggtcgtacgcacggtgttcacgcggagccaacaacttttggtttaaaacttgctctatggtacgaggaaatgaaacgtaatttagaacgttttaactttgctgctgatggtgtagagttcggaaaaatttctggagctgttgggacttatgctaacattgatccttttgtggaagcatatgtttgtgaaaaattaggaactactccagcgccgatttcaacgcaaacattgcaacgtgatcgtcacgcagaatatcttgcaacgcttgctttaattgccacttctgtcgaaaaatttgctgttgaagtacgtgcactacaaaaaagtgaagtacgcgaagtagaagaattctttgcaaaagggcaaaaaggttcatccgcaatgccgcataaacgtaatccaattggttctgaaaatgtaacagggttagctcgcgttattcgtggacatatggttactgcttatgaaaatgtaccactttggcatgaacgtgatatttctcatagttcagcggaacgaattattttaccagattctactattttattagattatattttaaatcgttttggtaatattgtgaaaaacttgacggtattcccagaaaatatgaaacgtaatatggatagaactctaggattaatttattcgcaacgtgttttacttgcgctgattgataaaggcttagctcgagaagcagcttatgatgtcgtacaaccaagagcaatggaagcttgggaaaaacaagtaccattccgtgaattagtagaacaagatgcaaccattactgaaaatctatctgcagaagaaattgcagactgctttgattacaactatcacctgaagaatgtcgacttaatttttgatcgcttaggattataa

SEQ ID NO: 2940 - protein, 430 aa, Listeria innocua
MLERYTRKEMGNIWTEQNRYQAWLEVEILACEAWAELGDIPKEDVKKIRANAKFDVDRIHEIELETRHDVVAFTRSVSESLGEERKWVHYGLTSTDVVDTANSYLLKQANEILRKDLENFIAIIGEKAKEHKYTVTMGRTHGVHAEPTTFGLKLALWYEEMKRNLERFNFAADGVEFGKISGAVGTYANIDPFVEAYVCEKLGTTPAPISTQTLQRDRHAEYLATLALIATSVEKFAVEVRALQKSEVREVEEFFAKGQKGSSAMPHKRNPIGSENVTGLARVIRGHMVTAYENVPLWHERDISHSSAERIILPDSTILLDYILNRFGNIVKNLTVFPENMKRNMDRTLGLIYSQRVLLALIDKGLAREAAYDVVQPRAMEAWEKQVPFRELVEQDATITENLSAEEIADCFDYNYHLKNVDLIFDRLGL

SEQ ID NO: 2941 - DNA, 1296 bp, Nostoc sp. PCC 7120
  CDS (1)..(1296)
atgatagagcgttatactctgcccgaaatgggcaacctgtggactgacttttataaactaaaaacctggcttcaggtggaaattgcagtctgtgaagcccaagcggaattgggttatattccatctgctgctgttgaggaaatcaaggctaaggcaaattttgatccgcaacgggtgttggaaatagaggcggaagtccgtcacgatgtcatcgcctttttgactaatgtcaatgagtatgtgggtgatgctggacgttacattcacttgggcttaactagctctgatgtactagatacagctttagctttacaactggttgctagtttggatgtgttggcgcaacgtctggaagatttgattcaggtgattcgccaaaaggcacgggaacaccggtatacggtaatggctggccgatcgcatggtattcacgctgaaccaatcacttttgggtttaaactggctggttggttggcggaagtgttacgccaccaacaacggctgacaattttgcgggaaacgatcgccgtgggtaagatttctggcgcggtgggtacctatgccaatattgaaccacgggtggaggcgatcgcttgtcaaaaactcggactcaaacccgatacagcttctacacaagtcatttcccgcgatattcatgctgattttgtgcagcaattagccctcatcgctgcttctattgaacgctttgctgtagaaattcgcaatctacaaaaaacagacgttctggaagtagaggaatttttctcgaagggacagaaaggctctagtgcaatgccacacaaacgcaatcccatccgttcggaacggctgacggggatggcgcggttagtgaggagtcatgccggcgcagctttagaagatgtcgctttgtggcacgaacgggacatttcccatagttctgtggaacgagtggttctgccagatgcctgcattttgacccatttcatgctgatagaaatcactaatttggtggaaaatctgttagtttacccagaaaacatgacgcggaatctcaactgctatggtggcgttgtattcagccaaaaagttttactggcattggtagataagggactcagccgggaagaagcctatgcgatcgtgcagcaaaatgctcatacggcatggaataagccggaaggcaatttccacgacttgatcattaacgatcctcgtgtcactcaacatttgtcgcccgtagaaattgccgtgtgttttgacccacagcaacatctcaagcatttggatgaggtttatcataggttggatatttag

SEQ ID NO: 2942 - protein, 431 aa, Nostoc sp. PCC 7120
MIERYTLPEMGNLWTDFYKLKTWLQVEIAVCEAQAELGYIPSAAVEEIKAKANFDPQRVLEIEAEVRHDVIAFLTNVNEYVGDAGRYIHLGLTSSDVLDTALALQLVASLDVLAQRLEDLIQVIRQKAREHRYTVMAGRSHGIHAEPITFGFKLAGWLAEVLRHQQRLTILRETIAVGKISGAVGTYANIEPRVEAIACQKLGLKPDTASTQVISRDIHADFVQQLALIAASIERFAVEIRNLQKTDVLEVEEFFSKGQKGSSAMPHKRNPIRSERLTGMARLVRSHAGAALEDVALWHERDISHSSVERVVLPDACILTHFMLIEITNLVENLLVYPENMTRNLNCYGGVVFSQKVLLALVDKGLSREEAYAIVQQNAHTAWNKPEGNFHDLIINDPRVTQHLSPVEIAVCFDPQQHLKHLDEVYHRLDI

SEQ ID NO: 2943 - DNA, 1371 bp, Yersinia pestis
  CDS (1)..(1371)
atggaattatcctcactgaccgccgtttcaccaattgatggacgttacggcgacaaagtcagcgcactgcgccccatctttagcgaattcggtttgctaaaattccgtgtgcaggtcgaagtgcgttggctgcaaaaactggcagcctgcgcagaaattaaagaggttcctgcttttgatgccaacgcaaacgcttaccttgataaaattgtgcaagagttcaatgaacaagatgcacaacgcattaagaccatcgaacgcacaaccaatcatgatgtgaaggctgtcgagtattttctgaaagaaaaagtggaaaatctccctgcgttacatgccgtgtctgagttcattcactttgcttgtacttcagaagatatcaataacctgtcccacgcattgatgctgcaaactgctcgccaggatgtcctgctgcccgcatggcggcagattattgactcaataaaagcactggcccaccaatatcgcgatttacccttactgtcccgcacccacggccagcccgcgacaccctcaaccatcggtaaagagctggcgaatgtggcgtaccgcatggaacgtcagttccgccaactaacacaagtggaaattctgggtaaaatcaacggtgcagtaggcaactataacgcccacatcgtggcctaccctgaggttgattggcatcagtttagtgaaagttttgtgacatcgctgggaatcaactggaacccatacaccacgcaaatcgagcctcatgattatattgctgagttatttgactgtgtggcccgtttcaatactattttgatcgattttgaccgtgatatctggggttatattgctctgaatcacttcaagcaaaaaaccatcgcgggcgaaatcggttcaagcaccatgccgcataaagttaatccaattgatttcgaaaactcggaaggcaatttgggtctatcgaatgccgtgctaggtcacatggccagcaaactaccggtttctcgctggcaacgtgatctgaccgactcgaccgtgctacgtaatctgggtgtgggtctgggttatgccctgattgcctatcaggcaaccatgaaaggcatcagcaaactggaagttaacgaagcacatctgttgcaagagcttgatcataattgggaagttctggctgaacctattcaaacgatcatgcgccgttacggtattgaaaaaccgtatgaaaaactgaaagaattgacccgtggcaaacgtgtcgatgccgcaggtatgcaagcatttatcgatgggctggatctaccagaagaagaaaaaaaccggttgaaggccatgacgccagcgaattacattggccgcgccaccaccatggttgatgaattaaagtaa

SEQ ID NO: 2944 - protein, 456 aa, Yersinia pestis
MELSSLTAVSPIDGRYGDKVSALRPIFSEFGLLKFRVQVEVRWLQKLAACAEIKEVPAFDANANAYLDKIVQEFNEQDAQRIKTIERTTNHDVKAVEYFLKEKVENLPALHAVSEFIHFACTSEDINNLSHALMLQTARQDVLLPAWRQIIDSIKALAHQYRDLPLLSRTHGQPATPSTIGKELANVAYRMERQFRQLTQVEILGKINGAVGNYNAHIVAYPEVDWHQFSESFVTSLGINWNPYTTQIEPHDYIAELFDCVARFNTILIDFDRDIWGYIALNHFKQKTIAGEIGSSTMPHKVNPIDFENSEGNLGLSNAVLGHMASKLPVSRWQRDLTDSTVLRNLGVGLGYALIAYQATMKGISKLEVNEAHLLQELDHNWEVLAEPIQTIMRRYGIEKPYEKLKELTRGKRVDAAGMQAFIDGLDLPEEEKNRLKAMTPANYIGRATTMVDELK

SEQ ID NO: 2945 - DNA, 1353 bp, Agrobacterium tumefaciens
  CDS (1)..(1353)
atgctaaacgggcagcaaaattcctccactaagaaagtcattgccatgatccctcgttactcccggccggaaatggtcgccatctggtcgccggaaacaaaattccgcatctggttcgagatcgaggcccatgcctgtgacgcgctggccgagcttggtgtcatcccgaagtcagcagcccagaccatctgggaaaagggcggcagcgccacgtttgacgtcgcccgcatcgatgagatcgaggccgtgaccaagcacgacgtcatcgccttcctcacccatctcgccgaatttgtcggccccgacagccgttttgtgcatcagggcatgacctcttccgacgttctcgacaccaccctcaacatccagctcgtgcgcgccgccgatctgctgctcgccgacatcgaccgggtgctcgcggctctcaagacccgcgccttcgaacacaagaacacggtgcgcatcggccgcagccacggcatccatgccgagccgaccacgatgggcctgacctttgcccgcttctatgccgagatgcaccgtaaccgcgagcgcctcgttaatgcccgtgcggaaatcgccaccggcgcgatctccggcgccgtcggcaccttcgccaatatcgacccgcgcgtcgaggaacatgtctgcgaaaagcttggtctcatccccgagccggtctccacgcaggtcattccgcgcgatcgccacgccatgttcttcgccgttctcggcgtcatcgcctcgtcgatcgaaaacgtcgccatcgaaatccgccacatgcagcgcaccgaggttctggaagcggaagagttcttctctcccggccagaagggctcgtccgccatgccgcacaaacgcaacccggtcctgaccgaaaacctcaccggtcttgcgcgtctggtgcgcatgtccgtcgtgccggccatggagaacgtggcgctctggcacgagcgcgatatcagccactcctccgtggagcgcgccatcggccccgacaccacggttacgctggatttcgcgctgaaccgcctggccggcgtcatcgagaagctggtgatctatcccgacaacatgttgaagaacatgaacaagttccgcggcctcgtacattcgcagcgcgttctgctggcgctgacacaggccggtgtttcgcgtgaagacgcttaccgtctggtacagcgcaacgccatgcgggtctgggaacagggtgccgatttcctggaagaactgctgggcgacgaggaagtgcgcgcagcgctgcctgaagacgtgatccgtgaaaagttcgacctcggttatcataccaagcacgtcgacacgatcttcacccgtgtcttcggcaaggcctga

SEQ ID NO: 2946 - protein, 450 aa, Agrobacterium tumefaciens
MLNGQQNSSTKKVIAMIPRYSRPEMVAIWSPETKFRIWFEIEAHACDALAELGVIPKSAAQTIWEKGGSATFDVARIDEIEAVTKHDVIAFLTHLAEFVGPDSRFVHQGMTSSDVLDTTLNIQLVRAADLLLADIDRVLAALKTRAFEHKNTVRIGRSHGIHAEPTTMGLTFARFYAEMHRNRERLVNARAEIATGAISGAVGTFANIDPRVEEHVCEKLGLIPEPVSTQVIPRDRHAMFFAVLGVIASSIENVAIEIRHMQRTEVLEAEEFFSPGQKGSSAMPHKRNPVLTENLTGLARLVRMSVVPAMENVALWHERDISHSSVERAIGPDTTVTLDFALNRLAGVIEKLVIYPDNMLKNMNKFRGLVHSQRVLLALTQAGVSREDAYRLVQRNAMRVWEQGADFLEELLGDEEVRAALPEDVIREKFDLGYHTKHVDTIFTRVFGKA

SEQ ID NO: 2947 - DNA, 1371 bp, Salmonella enterica subsp. enterica serovar Typhi
  CDS (1)..(1371)
atggaattatcctcactgaccgccgtttcccctgtcgatggacgctacggcgataaagtcagcgcgctgcgcggaatttttagcgaatacggtttgctgaaatttcgtgtacaagtcgaagtacgttggctgcagaaattagccgcgcacgcagcgatcaaggaagttcctgcttttgctgccgacgcaaacggttacctggatacgcttgtggcaaacttcaatgaagaagatgccgcgcgcattaaaaccattgagcgcaccacgaatcacgatgtgaaagcggttgagtattttctgaaagaaaaagccgccgcgatcccggcgctacatgacgtttccgaatttatccactttgcctgcacctctgaggatattaacaacctgtcgcacgcgttaatgctcaaaactgcgcgcgatgaagtgatcctgccttactggcgtcaggtgattaacgcggttaaagatctcgccacgcagtatcgcgatattcctctgctctcccgcacccacggccagccggcaacaccttccactctgggtaaagagatggcgaacgtggcgtatcggatggagcgtcagttccgccagctcaatcaggtggagatcctcggtaaaattaacggcgccgtaggcaactataacgcgcatatcgccgcctatccggaagttgactggcatcagttcagcgaagagttcgtcacctcgctgggcatccagtggaacccttacaccacccagattgaaccgcatgattatattgcggaactgtttgactgtatcgcgcgctttaacaccatcctgatcgatttcgatcgcgatgtctggggctatattgcgttgaaccatttcaaacagaaaaccatcgccggagagatcggttcttctaccatgccgcataaagttaaccccattgactttgaaaactcagaaggcaacctcggtctgtctaatgcagtgttgcaccatctggcaaacaaactgccggtttcccgctggcagcgcgatctgaccgactcaaccgtcctgcgtaacctgggtgtcggcatcggctatgcgcttatcgcttatcagtcgaccctgaagggcgtcagcaagctggaagtgaaccgcgatcatctgcttgacgaactggatcacaactgggaagtattagccgaaccgatccagaccgtcatgcgccgctatggcattgaaaaaccatatgaaaaactgaaagagttgacccgtggcaagcgtgtcgatgccgaaggaatgaaacagcttattgatagtctggccctgccggaagcagaaaaaacgcgccttaaagccatgacgccggcaaattatatcggtcgcgctgtgaatctggtcgacgaacttaaataa

SEQ ID NO: 2948 - protein, 456 aa, Salmonella enterica subsp. enterica serovar Typhi
MELSSLTAVSPVDGRYGDKVSALRGIFSEYGLLKFRVQVEVRWLQKLAAHAAIKEVPAFAADANGYLDTLVANFNEEDAARIKTIERTTNHDVKAVEYFLKEKAAAIPALHDVSEFIHFACTSEDINNLSHALMLKTARDEVILPYWRQVINAVKDLATQYRDIPLLSRTHGQPATPSTLGKEMANVAYRMERQFRQLNQVEILGKINGAVGNYNAHIAAYPEVDWHQFSEEFVTSLGIQWNPYTTQIEPHDYIAELFDCIARFNTILIDFDRDVWGYIALNHFKQKTIAGEIGSSTMPHKVNPIDFENSEGNLGLSNAVLHHLANKLPVSRWQRDLTDSTVLRNLGVGIGYALIAYQSTLKGVSKLEVNRDHLLDELDHNWEVLAEPIQTVMRRYGIEKPYEKLKELTRGKRVDAEGMKQLIDSLALPEAEKTRLKAMTPANYIGRAVNLVDELK

SEQ ID NO: 2949 - DNA, 1335 bp, Archaeoglobus fulgidus
  CDS (1)..(1335)
atgatagttcaccccatcgattaccgctacggcacccccgaaatgaagaggatttggagcgaggatagcaagatcaagaggatggtaagggttgaaatggctcttctacgcgctcttgcaaaaaaaggatacctcagcgaagaggaggccaaagaggccaaaaagaaggcttacagcgtaacaccagagagagtgaaggaaattgaggcagagataaagcacgacataatggcgctggtaaaggccattaccgaggccaccggatgcaggtgggttcacttcggagccacatcaaacgacataatcgacacagcaacggctttgcagctaagggacagtttgaaaatcctcgaggttaaaataaagcgccttgcgaaggttcttgcggacaaagccttagaatataaggacgtggtctgcctcggcagaactcacggtcaggcggctttgcccacaacctacggcttcagattcgccctgtgggcggctgaggttgcaaggcactacatcaggctgcagcagatgaaggacaggcttctcgtagggcagatgagcggggcagtgggaacacaggccgccttcggcaaagacggcttcgagatagaggaggaggttatgaggctgctgaaccttaaaccggctctgatttcaagccagataatacccagggactcctactgcgagtacctcgagtttctcgcaaatcttgctgcaacactcgaaaagattgctctgaacttcagactccttcaaagagctgaagttggagagttgatggaaaaattcgaggccaagcaggtcggaagctccacgatgccccacaaaaggaacccaatagactgcgagaatgtttgcggcttggcgagggtcgtgagggggttcgtggagcctcagcaccagtcggcaattctgtgggaggagagagaccttacaaactcctcggcggagaggataacccttgttgagtcaacggttctggcggaccacattctaacgaagatgataaaggttgtttccagcgttagtctcaacctcgagaacatcaggaggaatcttgagatgcagagggggctcaacctgagcgaggcggtgatgatagagatgacgaaaagaggggtggggaggcaggaggcgcacgagattctcaggcaggcggcgatgagggcttacgagaacaattcatcgcttcttgacgagcttttgaaagacgagagagttatgaagtacttcaaagaggatgagcttagggagattctgaaacctgaaaattatctggggactgcaagggaaagggtcgagagggttgtgagatgggtgaacgaggtgttgaaatga

SEQ ID NO: 2950 - protein, 444 aa, Archaeoglobus fulgidus
MIVHPIDYRYGTPEMKRIWSEDSKIKRMVRVEMALLRALAKKGYLSEEEAKEAKKKAYSVTPERVKEIEAEIKHDIMALVKAITEATGCRWVHFGATSNDIIDTATALQLRDSLKILEVKIKRLAKVLADKALEYKDVVCLGRTHGQAALPTTYGFRFALWAAEVARHYIRLQQMKDRLLVGQMSGAVGTQAAFGKDGFEIEEEVMRLLNLKPALISSQIIPRDSYCEYLEFLANLAATLEKIALNFRLLQRAEVGELMEKFEAKQVGSSTMPHKRNPIDCENVCGLARVVRGFVEPQHQSAILWEERDLTNSSAERITLVESTVLADHILTKMIKVVSSVSLNLENIRRNLEMQRGLNLSEAVMIEMTKRGVGRQEAHEILRQAAMRAYENNSSLLDELLKDERVMKYFKEDELREILKPENYLGTARERVERVVRWVNEVLK

SEQ ID NO: 2951 - DNA, 1323 bp, Helicobacter pylori
  CDS (1)..(1323)
atgttagaacgctatgcgaatgaagaaatgaaagccctatggaatgagcaaaccaaatttgaaacttatttggaagtggaaaaagctgtcgttagggcgtggaataagcttgggcaaatccaagatagcgattgtgaaaaaatctgcttaaaagcggcattcaatcttgaacgcatcaaagaaattgaaaaaaccactaagcatgatttaatcgctttcactacttgcgtggctgaaagcttgggcgaagaatcccgcttctttcattatgggatcacttctagcgattgcattgatacggctatggcgttattgatgaccaaaagcttaaaactcattcaaaaaggcgttaaaaacctctatgaaacccttaaaaatagggctttagagcatcaagacacgctaatggtgggcagaagccatggggtgtttggcgaacccatcacctttggtctagttttagctctttttgctgatgaaatcaaacggcatttaaaagccctggatttaacgatggaatttatcagcgtaggggcgatcagtggggctatggggaatttcgcgcacgcccctttagaattagaagaattagcgtgcggatttttaggcttaaaaaccgctaatatcagcaatcaagtcattcaaagagaccgctacgctaggcttgcatgcgatctggctcttttagcgagcagttgtgaaaaaatcgctgtcaatatccgccatttgcaacgcagtgaagtctatgaagtggaagaagctttttcagcagggcaaaagggaagctctgcgatgcctcataaaagaaaccccatcttgagcgagaatatcaccgggctttgcagggtgattcgctcttttactacccccatgctagaaaatgtcgccttatggcatgaaagggacatgagccatagctctgtggagcgttttgcgctgcctgatctgtttatcaccagcgatttcatgctcagccgtttgaatagcgtgattgaaaatctggtggtttatcctaaaaacatgcttaaaaatttagctttgagtggggggctagtcttttcgcaacgggtgttattggaattgcctaaaaaaggtttgagcagagaagaaagctattctatcgtgcaagaaaatgcgatgaaaatatgggaggttttgcaacaaggcgcttttaaaaacgctgatgaaaatttatttttaaacgccctacttaacgatgaacgcttgaaaaaatatttgaatgagagcgaaatcagagcatgttttgattacagctattacactaaaaatgtgggggcgatttttaaaagggtgtttggataa

SEQ ID NO: 2952 - protein, 440 aa, Helicobacter pylori
MLERYANEEMKALWNEQTKFETYLEVEKAVVRAWNKLGQIQDSDCEKICLKAAFNLERIKEIEKTTKHDLIAFTTCVAESLGEESRFFHYGITSSDCIDTAMALLMTKSLKLIQKGVKNLYETLKNRALEHQDTLMVGRSHGVFGEPITFGLVLALFADEIKRHLKALDLTMEFISVGAISGAMGNFAHAPLELEELACGFLGLKTANISNQVIQRDRYARLACDLALLASSCEKIAVNIRHLQRSEVYEVEEAFSAGQKGSSAMPHKRNPILSENITGLCRVIRSFTTPMLENVALWHERDMSHSSVERFALPDLFITSDFMLSRLNSVIENLVVYPKNMLKNLALSGGLVFSQRVLLELPKKGLSREESYSIVQENAMKIWEVLQQGAFKNADENLFLNALLNDERLKKYLNESEIRACFDYSYYTKNVGAIFKRVFG

SEQ ID NO: 2953 - DNA, 1329 bp, Campylobacter jejuni
  CDS (1)..(1329)
atggttgaaagatatagcagagaaatcatggctaaaaaatgggacatgcaagcaaaatacgatgcgtggttaaaagtagaattagccgctgtaaaagcttggaacaaactcggtctcattgatgacacagactgcgaaaaaattcttaaaaatgcaaaatttgatattgcaagaatagacgaaatagaaaaaaccacaaaacatgatgttatagcttttcttacaagtgtaagtgaaagtttgggagaagagagtcgttttgtgcattatgcaatgacaagttctgattgtatagatacagctgttgctttacagataaaagagagtttggagcttattttagaagatgtttctttgcttttagaagcgatcaaaaagcgtgctttggagcataaaaacaccttaatggtaggaagaagtcatggaattcatggagaacctattacttttggtttggtgttagctatttggtatgatgaaatttcgcatgcaaaagagcttttagaacatgcaaaagaagtgataagctatggaaaaatcagcggtgcaatgggaaattttgctcatgctcctttagaatttgaagaagaagtttgtaaaaatttaggtcttaaggccgctcctgtttcaaatcaagtgatccaaagagatcgttatgctcaggttatttctgctattgcgattttagcttcaagttgtgagcaaatcgctgtagccataagacattttcaaagaactgaagtttatgaggctgaggagtattttagtgtaggacaaaaaggaagttcagctatgccacataaaagaaatcctgttttaagtgaaaatatcacaggactttgtcgtgtgcttagatcttttgtaactccagctttggaaaatgttgcactttggcatgaaagagatatatctcattctagtgttgaaagatttattttgcctgatgcttttatcacggctgattttatgcttatgcgtcttacaaatttgattgataagcttttggtttatcctgaaaatatgatgaaaaatttaaatcttacaggcgggcttgtattttcagggagggtgcttttagaacttccatttaaaggcattagccgtgaagaagcttataaaatagttcaaagaaacgctatgaaagtttgggcagatttgcaaaatggcaaggctgctatcaatgaaaaaaatgaaagtttgtttttgttagcgcttttaagcgatgaagatttaagaaaaagtttgagcgaagaggatgtaagaaaatgtttcgattataactactatacaaaaaatgttgatgcaatttttaaaagaacatttaaataa

SEQ ID NO: 2954 - protein, 442 aa, Campylobacter jejuni
MVERYSREIMAKKWDMQAKYDAWLKVELAAVKAWNKLGLIDDTDCEKILKNAKFDIARIDEIEKTTKHDVIAFLTSVSESLGEESRFVHYAMTSSDCIDTAVALQIKESLELILEDVSLLLEAIKKRALEHKNTLMVGRSHGIHGEPITFGLVLAIWYDEISHAKELLEHAKEVISYGKISGAMGNFAHAPLEFEEEVCKNLGLKAAPVSNQVIQRDRYAQVISAIAILASSCEQIAVAIRHFQRTEVYEAEEYFSVGQKGSSAMPHKRNPVLSENITGLCRVLRSFVTPALENVALWHERDISHSSVERFILPDAFITADFMLMRLTNLIDKLLVYPENMMKNLNLTGGLVFSGRVLLELPFKGISREEAYKIVQRNAMKVWADLQNGKAAINEKNESLFLLALLSDEDLRKSLSEEDVRKCFDYNYYTKNVDAIFKRTFK

SEQ ID NO: 2955 - DNA, 1380 bp, Pseudomonas aeruginosa
  CDS (1)..(1380)
atgagcgacgtacccgccaaccagttgttcgatgcctatttcatggcggcgccgatgcgcgcggtgttctccgaccgcggccgcctgcaaggcatgctcgacttcgaggccgccctggcccgcgccgaggcgcgcaccggggtggttcccgcgacggcggtggcgccgatcgaggcggcctgccgcgccgaactgtacgacccgctggcgctggccgaggcggtcgccactgccggcaactcggcgatcccgctggtcaaggcgctgggccgccaggtggcggctggcgacgccgaggccgagcgctacgtgcatctcggcgccaccagccaggacgccatggacagcggcctggtgctgcaactgcgccgtgcgctggccttgctcgagcaggatctgcaacgtcttgccgaggtcctggcggaccaggccgaacggcatgccgacacgccgctggccgggcgcacctggttgcagcacgccaccccggtgaccctgggcatgaagctcgccggcctgctcggtgccttgacccggcaccgccagcgcctgcgcgagttgcgcccgcgcctgctggtgctgcaattcggcggcgcctcggggacgctcgccgcgctcggcgaacaggccctgccggtggccgcggcgctggccgaggagctgggcctggctttgcccgaacaaccctggcacacccagcgcgaccgcctggtggaattcgccagcgtgctcggcctggtggccggtagcctcggcaagttcggtcgcgatgtcagcctgctgatgcagaccgaggccggcgaggtcttcgagccggccggcgccgggcgcggcggttcctcgaccatgccgcacaagcgcaacccggtgagcagcgcggtgctgatcgccgccgccacccgtgcgccggggctggtctcgaccctgttcgcggcgatgccgcaggaacacgagcgcagcctcggtctctggcacgccgagtgggaaaccctgccggaactctgttgcctggttgccggcgcgctgcaacaggcgatcggcctgctcgaaggcctggaggtggacgcccagcggatgcgccgcaaccttggcctgacccacggcctggtgctcgccgaggcggtgagcatcgccctggcccgccgtatcggccgcgaagccgcgcaccatctggtggaacagtgctgccgccgcgccgtcgagcagcgccgcgagttgcgcgcggtgctcggcgaagaggcgcgggtgagcgccgagttgtccggcgacgaactggaccgcctgctcgatcccgcccattacctcggccaggcccgcgcctgggtcgagcgcgcgctcgccgaacaccatgccctgggcttcgaaccccatcccgcctga

SEQ ID NO: 2956 - protein, 459 aa, Pseudomonas aeruginosa
MSDVPANQLFDAYFMAAPMRAVFSDRGRLQGMLDFEAALARAEARTGVVPATAVAPIEAACRAELYDPLALAEAVATAGNSAIPLVKALGRQVAAGDAEAERYVHLGATSQDAMDSGLVLQLRRALALLEQDLQRLAEVLADQAERHADTPLAGRTWLQHATPVTLGMKLAGLLGALTRHRQRLRELRPRLLVLQFGGASGTLAALGEQALPVAAALAEELGLALPEQPWHTQRDRLVEFASVLGLVAGSLGKFGRDVSLLMQTEAGEVFEPAGAGRGGSSTMPHKRNPVSSAVLIAAATRAPGLVSTLFAAMPQEHERSLGLWHAEWETLPELCCLVAGALQQAIGLLEGLEVDAQRMRRNLGLTHGLVLAEAVSIALARRIGREAAHHLVEQCCRRAVEQRRELRAVLGEEARVSAELSGDELDRLLDPAHYLGQARAWVERALAEHHALGFEPHPA

SEQ ID NO: 2957 - DNA, 1488 bp, Halobacterium sp. NRC-1
  CDS (1)..(1488)
atgaattcgcatactaacggcgtgtttcgggcgtccgttgccgggaaatgtacatcctcgtgcgtcggcgggatcggtaggcttttgcggcgagcaccgccagtcggtggcatgaccgacgaccacgccctgtacgcggtgtcgccactcgacggccggtacagcggccgcaccgacgcgctcgcgccgtacgtcagcgaggcggcgctcatgcgggcgcgcgtcgaagtcgaagccgagtacgtgctcgcgctcgcggacctcgacgccgtcccgctcgaactcgttggcgacgaacgcaccgcgctccgggacgcctacaagaccttcgacgcagccgacgccgacctcgtcaagcgcatcgagaccgagggcgcgctcggccacgccgccaccaaccacgacgtgaaagccgtcgagtacttcctgcgcgagcacgccccggcgcgcgcccactcctggatccacttcgggctcaccagcgaggacgtcaacaacctcgcgtaccgactgctcgtcgacggcgcgatcaccgccgtcctcacgcccgagttgcgcggcctccgcgacgacctcgtgtcgttcgcacacgactacgccgacctcccgatgctcgcgcgcacccacggccagcccgccaccccgacgacgttcggcaaggagatggccgtctacgccgcccgactcgggcgcgcgctcgcccgcatcaccgacgccgtcgacggactcacgggcaagctcgccggtgcctccggcacctgggcggcccacaccgcggcgttcccggacgtggactggcggtcgttcgctgcgcggttcgtggactccctggggctggcgtacgccgaaccaaccacgcaggtcaacccctgcgacgacctcacggcggtgttcgacgcggtcgcgggcgcgaacggcgtcctcgaagacctcgcggtcgacgcgtggctgtacgtctcccagcgctacctcggccaggacgccgccgacggcgaaaccggctcctcgacgatgccacacaaggtcaaccccatcgacttcgagaacgccgaaggcaacctcgcgaaagccaacagcgacctcgggttcctcggtgactcgctcaccaccagtcgcctccagcgggacctctcggattcgacggtgaaacgcaacatcggcgcggcgttcgcgcactgcctgctcgcctaccgcaagctcggggacggcctcgacgcagtcacccccaacgaggcggtgctccgggaggacctgcgcgccaaccccgaagtcatcggggaggccgtccagacgatcctccggcgggaaggccacgacgacgcctacgagcgcgtgaaagcactcacgcggggcgaacgcgtctccctggacgacttcaaggagctgtttgccagcctcgacatcgacgccgacacccgtgacgaactgctcgcgttgacccccgagcgctacgtcggcgtcgccgccgacatcgcgcgcgacgcctga

SEQ ID NO: 2958 - protein, 495 aa, Halobacterium sp. NRC-1
MNSHTNGVFRASVAGKCTSSCVGGIGRLLRRAPPVGGMTDDHALYAVSPLDGRYSGRTDALAPYVSEAALMRARVEVEAEYVLALADLDAVPLELVGDERTALRDAYKTFDAADADLVKRIETEGALGHAATNHDVKAVEYFLREHAPARAHSWIHFGLTSEDVNNLAYRLLVDGAITAVLTPELRGLRDDLVSFAHDYADLPMLARTHGQPATPTTFGKEMAVYAARLGRALARITDAVDGLTGKLAGASGTWAAHTAAFPDVDWRSFAARFVDSLGLAYAEPTTQVNPCDDLTAVFDAVAGANGVLEDLAVDAWLYVSQRYLGQDAADGETGSSTMPHKVNPIDFENAEGNLAKANSDLGFLGDSLTTSRLQRDLSDSTVKRNIGAAFAHCLLAYRKLGDGLDAVTPNEAVLREDLRANPEVIGEAVQTILRREGHDDAYERVKALTRGERVSLDDFKELFASLDIDADTRDELLALTPERYVGVAADIARDA

SEQ ID NO: 2959 - DNA, 1557 bp, Arabidopsis thaliana (mouse-ear cress)
  CDS (1)..(1557)
atggccaccaaaatcccttgttccggccttatacccataagaagtcttttaaacccatcaaaatctctgtctcatcttccaagagtttcattctctgtttcttctcctcattctctcaagctaatgacttcaacaaagttgatagcaatggctagtgcaagttccagagactttgagatgtcgaatttaacagcattatcgcctttggatggacgttattggggaaaagttaaggacttggcttcttctatgagcgagtttggattgatctatttccgagtacttgtcgagatcaaatggcttattaagctttcaaatatacctcaagtcactgaagttccaagctttagcaaagaagctcataagtacttgcaaggtataatcgatggatttagtatggatgatgcattgcaagttaagaagattgagagagtgacaaatcacgatgtgaaagcagtggagtattttttgaaacaaaagtgtgaatcacatccagagattgctaaggttctagagtttttccatttcgcttgtacgtctgaggacatcaacaatctttcccatgctttgatgcttcaagaagcacttagttcggttatacttcctaccatggatgagttgatcaagtctatctctctgatggctaagagctttgcatatgtacctatgctttcacgaactcatgggcagccagcttcacctacaacattggggaaggaaatggcgatttttgctgtgaggttaagtgtagaaaggagatatctttcagaaactaagattaaggggaaatttgcgggtgctgttggaaactacaacgcgcatatttccgcgtattctaatattgactggcctcatgttgcagaggagtttgttacttctcttggattaacatttaacccatacgtgactcagattgaaccacatgactatatggctagactttttaatacaattagccaattcaacaatgtcttgattgattttgacagagatatatggagctacatatctctaggttactttaagcaggcaacgggtgaaatcggatcatcgacaatgcctcacaaagtgaatcctattgactttgagaacagcgaagggaatctaggtaaagcaaatgcagagcttgcttttctcagcatgaagcttcccatttcacgaatgcagcgtgatttaacagattcaactgtcttgagaaacatgggtggagctttaggacactctcttctggcttacaagagcgcgatacagggaattgggaagcttcaggttaatgaagctcggttaaaagacgatttggatcatacttgggaagtcctcgctgaaccgatacaaactgtgatgaggagatatggtgttccagagccgtatgagaagctgaaggagctaacaagaggaagagctgtgaatgaagaaagcattagaaagtttattaaaagtttggaattgcctgaagaagcaaaagaccaacttttgaagctaactccacacacatatgttggcgctgctgctgcattggcactagccgtggatgatgctgtgcacttgggacattaa

SEQ ID NO: 2960 - protein, 518 aa, Arabidopsis thaliana (mouse-ear cress)
MATKIPCSGLIPIRSLLNPSKSLSHLPRVSFSVSSPHSLKLMTSTKLIAMASASSRDFEMSNLTALSPLDGRYWGKVKDLASSMSEFGLIYFRVLVEIKWLIKLSNIPQVTEVPSFSKEAHKYLQGIIDGFSMDDALQVKKIERVTNHDVKAVEYFLKQKCESHPEIAKVLEFFHFACTSEDINNLSHALMLQEALSSVILPTMDELIKSISLMAKSFAYVPMLSRTHGQPASPTTLGKEMAIFAVRLSVERRYLSETKIKGKFAGAVGNYNAHISAYSNIDWPHVAEEFVTSLGLTFNPYVTQIEPHDYMARLFNTISQFNNVLIDFDRDIWSYISLGYFKQATGEIGSSTMPHKVNPIDFENSEGNLGKANAELAFLSMKLPISRMQRDLTDSTVLRNMGGALGHSLLAYKSAIQGIGKLQVNEARLKDDLDHTWEVLAEPIQTVMRRYGVPEPYEKLKELTRGRAVNEESIRKFIKSLELPEEAKDQLLKLTPHTYVGAAAALALAVDDAVHLGH

SEQ ID NO: 2961 - DNA, 1353 bp, Pyrococcus abyssi
  CDS (1)..(1353)
atggcggttcaccctatagattatcgctacggtagcgaggaaatgaggagggtctgggaagaggaaaacaaactgcagaaactcctcgatgttgaagcggctttggctagggcccatgcaaaactcggaaacattccggaggaaagcgctagggtgatatcggaaagggcaaacacgaaatgggttaagcttgagagggtcaaggagatagaggctgaaattcaccacgatataatggccgtagtaaaagccttaagtgaggtctgcggggagcatggaaagtacgtccaccttggcgctacgtcaaatgacataatagacacggccaacgcacttctcataaaggagagtcttgccatagttgagaaggatttaaaggagctcagatctatattgaaggaactcgccaagaagcatatagataccgtatgcatagggagaacacatggacaacatgctgttccaacgacgtatggaatgaagttcgcactatggttggacgagatacagagacatatagagagacttcagcaacttaaggatagggttcttgtgggaaaaatgagaggtgcagtaggaacggcggcatcctttggagacaaggccttcgagatagagaaactcgtcatggaagatctaggcttaaagccagctaggataactaaccagataattcaaagagacgtgtacgctgaactgatgttcttcctagcattggtggcctcaaccctcgacaagatggctttggagataaggaacttgcagagaactgagatattggaggtaagcgagcccttcggggagaagcaagttggctcatcaaccatgccccacaagaggaacccgataagaactgagaaagtgtgcgggctcgccagggttctttactctaacgttattcctgccttacttaacaatcccctctggcacgaaagggatttaactaactcctcagtagagagggtaattctcccagaaagctttgttttgctcgatgaaatgctcaaggtcatgaagaaggttctcaaaggactagagttcttcccggagaacattaagaggaacctctatttaaccaagaacctgattatggccgagcctttgatgcttaagcttgccgagaaaggaatgggaagacaggaggctcacgaattggttagacagcttgctatgaaagcgtttaaagagggaagggatttgctcgaggttgttaggaaaaacgaggaagcgatgaaatatctcacagaaaacgatctagaaggcctaaaacctgaaaattacataggaaaagcaagagaaatcgtcgaaaacgttgttaattacgttgaagaaatggaaaggagaggtttatag

SEQ ID NO: 2962 - protein, 450 aa, Pyrococcus abyssi
MAVHPIDYRYGSEEMRRVWEEENKLQKLLDVEAALARAHAKLGNIPEESARVISERANTKWVKLERVKEIEAEIHHDIMAVVKALSEVCGEHGKYVHLGATSNDIIDTANALLIKESLAIVEKDLKELRSILKELAKKHIDTVCIGRTHGQHAVPTTYGMKFALWLDEIQRHIERLQQLKDRVLVGKMRGAVGTAASFGDKAFEIEKLVMEDLGLKPARITNQIIQRDVYAELMFFLALVASTLDKMALEIRNLQRTEILEVSEPFGEKQVGSSTMPHKRNPIRTEKVCGLARVLYSNVIPALLNNPLWHERDLTNSSVERVILPESFVLLDEMLKVMKKVLKGLEFFPENIKRNLYLTKNLIMAEPLMLKLAEKGMGRQEAHELVRQLAMKAFKEGRDLLEVVRKNEEAMKYLTENDLEGLKPENYIGKAREIVENVVNYVEEMERRGL

SEQ ID NO: 2963 - DNA, 1365 bp, Staphylococcus aureus
  CDS (70)..(1365)
ttgtttatttttattaaaaaatgttctgtttttgaaaattcgagtatacatacgataggagttaaaaaaatgattgaacgctattctagagaagaaatgtctaatatttggactgatcaaaatcgctatgaagcatggttagaagtggaaattttagcatgtgaagcatggagtgaattaggacatataccgaaagctgacgtacaaaaaattcgtcaaaacgcaaaggtaaatgtcgaacgtgcacaagaaattgaacaagaaacgcgccatgatgttgtagcctttactagacaagtttctgaaacgctaggtgaagaacgtaagtgggtacattatggtttaacttctactgatgttgtagatacagctttaagtttcgttattaaacaagcaaatgacattattgaaaaagatttagaaagatttatcgacgttttagctgaaaaagcaaaaaattataaatatacattgatgatgggacgtacacatggagtgcatgcagaaccaactacatttggtgtcaaaatggcattgtggtacacggaaatgcaacgtaacttacaacgtttcaaacaagtaagagaagaaattgaagtagggaaaatgagtggtgcagtaggtacttttgctaacattcctcctgaaatagaaagttatgtgtgtaaacatttaggtattggcacagcgcctgtatcaacgcaaacattgcaacgcgatcgacatgcatactatattgcgacattagcattaatcgcgacatcactagaaaaatttgccgttgaaatacgtaaccttcaaaaaaccgaaacgagagaagttgaagaagcatttgcaaaaggccaaaaaggttcatctgcaatgcctcataaacgaaatccaattggttctgaaaatatcacaggtatttcaagagtcattcgtggttatattactacagcttatgagaatgtgccattatggcatgaaagagatatttctcattcttctgctgagcgtattatgttaccagatgttacaatagcactagattatgcattgaatcgtttcacaaatattgtggaccgtttaactgtatttgaagataatatgcgtaataacatagataaaacatttggtctgattttctcacaacgtgtcttattagcattaattaataaaggtatggttcgtgaagaagcatacgacaaagtacaaccaaaagcgatgatatcttgggaaacgaaaacaccgttccgtgaattaatcgaacaagatgagtctattacaagtgttttaacaaaagaagaattggatgaatgtttcgatcctaaacatcatttgaatcaagttgacactattttcgaacgcgctggattagcatag

SEQ ID NO: 2964 - protein, 431 aa, Staphylococcus aureus
MIERYSREEMSNIWTDQNRYEAWLEVEILACEAWSELGHIPKADVQKIRQNAKVNVERAQEIEQETRHDVVAFTRQVSETLGEERKWVHYGLTSTDVVDTALSFVIKQANDIIEKDLERFIDVLAEKAKNYKYTLMMGRTHGVHAEPTTFGVKMALWYTEMQRNLQRFKQVREEIEVGKMSGAVGTFANIPPEIESYVCKHLGIGTAPVSTQTLQRDRHAYYIATLALIATSLEKFAVEIRNLQKTETREVEEAFAKGQKGSSAMPHKRNPIGSENITGISRVIRGYITTAYENVPLWHERDISHSSAERIMLPDVTIALDYALNRFTNIVDRLTVFEDNMRNNIDKTFGLIFSQRVLLALINKGMVREEAYDKVQPKAMISWETKTPFRELIEQDESITSVLTKEELDECFDPKHHLNQVDTIFERAGLA

SEQ ID NO: 2965 - DNA, 1314 bp, Aquifex aeolicus
  CDS (1)..(1314)
atgatagagcgctacaccagaaaggaaatgggcgatgtctggagtgaggttaataagtttaaaaagtggttggacgttgagatagcggtatgcagggcttgggcaaaactcggtaagatcccccgagatgccttaaaaaagatagaagaaaaaacttacgttgacaaaaaggttgttgagaaaattaaggaaaaggaaaaggtttttaaacacgacgttctggcgttcgtttctgtaatcgccgagcaggtaggagaagagggaaggtacatacacatgggtcttacctcttctgacgttgttgacacagccctcgcactcctcataagagaggcgattgacataatcctgaaggatatagacaaggtaatggaagagataaagagacttgcctttgaacacaaggataccctaatgatgggaagaactcacggagttcacgcagagccctacactttcggtctcaagatgtgcgtgtggtacgacgaaatgaggaggcaaaaggagagacttctctttgcaagggaaaatgtcctttacgggaaaatttcaggagctgttggcacttactccaacatcccacctgaggttgaaaagttagcccttgaagaactcggtcttaaaatagaacctgcatctactcaaatagtccacagagacaggcacgcccagctcctaacaaccctcggactaatagcgagttccttagaaaagtttgcaacggaaataagacacctccagaggacagaagttttggaagttttagaaccctttacgaaaggtcaaagaggctcttcggccatgccccacaagaagaacccaatacactcggaaagaatatgcggactcgcaagggttataagagccaactcaatacccgctatggaggacgtagttctgtggcacgagagggacatttcccactcttccgttgaaagggtaatacttccggactccttcatagcccttgactacatcctgaacctcttttacgaaatactgaaaggacttgtggtgaacaaggagagaatgagaaaaaatatggaactctcaaaagggctctacgcctcttcaaagatactcgtcctcctgacccaaaaagggctttcaagagattacgcctacgatatagttcagagatgtgcaatgaaggcttgggaaagcgataaaacttttaaagaaacactcttagaggaccccgaagttacgaaataccttacagaggaggaaatagagaaggctctggacccatgggagtttctgaagaacagggattacgtttatgaaaaggtttttggggatgaaatgggatag

SEQ ID NO: 2966 - protein, 437 aa, Aquifex aeolicus
MIERYTRKEMGDVWSEVNKFKKWLDVEIAVCRAWAKLGKIPRDALKKIEEKTYVDKKVVEKIKEKEKVFKHDVLAFVSVIAEQVGEEGRYIHMGLTSSDVVDTALALLIREAIDIILKDIDKVMEEIKRLAFEHKDTLMMGRTHGVHAEPYTFGLKMCVWYDEMRRQKERLLFARENVLYGKISGAVGTYSNIPPEVEKLALEELGLKIEPASTQIVHRDRHAQLLTTLGLIASSLEKFATEIRHLQRTEVLEVLEPFTKGQRGSSAMPHKKNPIHSERICGLARVIRANSIPAMEDVVLWHERDISHSSVERVILPDSFIALDYILNLFYEILKGLVVNKERMRKNMELSKGLYASSKILVLLTQKGLSRDYAYDIVQRCAMKAWESDKTFKETLLEDPEVTKYLTEEEIEKALDPWEFLKNRDYVYEKVFGDEMG

SEQ ID NO: 2967 - DNA, 1368 bp, Campylobacter jejuni
  CDS (1)..(1368)
atgacaggaattagcgtatttgatcatagattactagcagactcatggagcacgcaggaaatgcgtgctattttttgcgaacaaaaccgcatacaaaaatggctcgatgttgaagcagctttagcaaaagcacaagcaaaacttaaaattatccctaaaaaagcagctgatgagatcgcaaaaaaagctcattataaatttatggatatggactttatctttgctgaatttaaaaagaccaaacaccctttagttcctactgtaagaggattagaaaaagcttgcgataataatttaggcgaatatgtacattttagagtaaccactcaagatatcatcgatacaggactggttttacaatttaaagaagcaatgactcttgtaaaaagcgaattaaaagctatcgcaaaagccttagcgaaactagctaaaacccataaaaacactgctatgatgggaagaactcttgctttacaagctttaccgatcacctttgggcataaggtagccatctggcttagcgagcttgatcgtcattttgaaagaatacttgaacttgaaaaaagactttatgtaggcagcatagtaggagctgttggaaccaaggcgagtttaagcgatgaatgcaacgaagtagaaaagctaactttagagaatttaggacttgaagtgcctaatatctcttggcagagcacacgtgatcgctttatagagcttggttttgtactaggcaatatcaatgcaacttttaacaaaatcgctcatcaattactcatactctcacacaatgaaatcgatgaagtagcagaaccttttggcaaaggacaagtaggatctagcactatgccacacaaaagaaatcctgcagtaagcgaaaatgcagttacagtaagcaatgcctttaaggcaaatttagccattttaagcgatattgaaagacacgagcatgaaagagatgggcaagtttggaaaatggaatggaaacttttacctgaaatgtttttaatgctttctgtggttttagcaaatatgaaatttgctcttagtgacctagaagttaaaaaagataaaatgcttaaaaatcttgacactcttaaaggctttgtactggcagaacgcgttatgtttgcactaagcgatcattacggcaaacaacacgctcatgaaatcgtttatgaaaacgctatgctaggtatcgaacaacaaaaaactttcaaagaagtattgcttgcagatacaagagtatctcaagtcttaaaagaaaaagatatcgatgctttacttgatgcaacaagttatgtaggatatgcaccaaaacttgtagatgaatttttggcaaaaatcaaaaatagcgctatcttaaaatag

SEQ ID NO: 2968 - protein, 455 aa, Campylobacter jejuni
MTGISVFDHRLLADSWSTQEMRAIFCEQNRIQKWLDVEAALAKAQAKLKIIPKKAADEIAKKAHYKFMDMDFIFAEFKKTKHPLVPTVRGLEKACDNNLGEYVHFRVTTQDIIDTGLVLQFKEAMTLVKSELKAIAKALAKLAKTHKNTAMMGRTLALQALPITFGHKVAIWLSELDRHFERILELEKRLYVGSIVGAVGTKASLSDECNEVEKLTLENLGLEVPNISWQSTRDRFIELGFVLGNINATFNKIAHQLLILSHNEIDEVAEPFGKGQVGSSTMPHKRNPAVSENAVTVSNAFKANLAILSDIERHEHERDGQVWKMEWKLLPEMFLMLSVVLANMKFALSDLEVKKDKMLKNLDTLKGFVLAERVMFALSDHYGKQHAHEIVYENAMLGIEQQKTFKEVLLADTRVSQVLKEKDIDALLDATSYVGYAPKLVDEFLAKIKNSAILK

SEQ ID NO: 2969 - DNA, 1599 bp, Xylella fastidiosa
  CDS (1)..(1599)
atgcagccactgccaaagccgtgcctaagcaggatcacaggatcacaggatcacaggatcacaggatcacaggatcacaggatcacaggatcacaggatcacaggatcacaggatcacaggatcacaggatcacaggatcacaggatcaggaatggaccatattccaacccagaaagggcagacaggtgcagcgtagaatagcggtgctcccgcttccctcaattacggccatgtcacatttacccctacttgctttgtcgccactggatgggcgctatctgtctaaagtcgatacattgcggccaattttttccgaatacggcttgatcaaagcccgggtgaaagtcgagattgcatggttactggcgttggccgcagaaccaaacattgtcgagttggcaccgttctccgttgccgcgcaaacacgcctgcgtgcgttagcagacggtttgacgatcgagcacgccgcacgtgtgaaagagattgagcacaccaccaatcacgacgtaaaagcagtggaatatttcatcaaagagcagcttaaggacgatacagagctgcgccccggactggagtttgtccatttcgcctgcaccagcgaggacatcaacaacctgtcctatagcttgatgttgcaacaagccagaaatgacgtactgctcccgacactggacggtatcgctacacatctgcgcaccctggcccatactcaggccgcacaaccgatgctctcacgcacccacgggcaaaccgcctcacctaccacgctgggcaaggaaatcgccaatgtggtagcccgtttggaacgccagcgccatcaaatcgccacgattgcactgagcggaaagatcaacggtgctgtgggcaattacaacgcacataccatcagctatccggagatcaattggcctgcattcgcacaacgttttgttgagagcctgggcttggtcttcaacccatacaccacacaaattgagccgcacgacaccatcgccgagatcagcgacgcaacccgccgcgccaacaccattctgatcgacctggcacgcgatctttggggctatatctcgttgggttacttcaaacaaaagctcaaggaaggtgaagtcggctcctcaacgatgccgcacaaagtcaacccgattgacttcgaaaatgccgaaggcaatttcggcgtggccaacgcattatttgagcatttttcgaccaagctgccgatcagtcgttggcaacgtgacctcaccgattccaccgtactacgcgcactcggcaccgcgtttggccatactcaggtggctttagattctttaaacaaagggctacacaagctcagcccaaatccagaacgtattgacgctgacctggacgcggcatgggaagtgctggccgaagcagtacagacaatcatgcgccgccacaacctacccaacccctacgagcaactgaaagcgctgacccgtggtcagggcatcaccgccgattcgatgcgcgctttcatcgaaacgctggatctgccaaccgaagccaaacagcggctgcacgatttaactccaagggcttataccggcctggcgaagcagttggcactgaacatctaa

SEQ ID NO: 2970 - protein, 532 aa, Xylella fastidiosa
MQPLPKPCLSRITGSQDHRITGSQDHRITGSQDHRITGSQDHRITGSQDQEWTIFQPRKGRQVQRRIAVLPLPSITAMSHLPLLALSPLDGRYLSKVDTLRPIFSEYGLIKARVKVEIAWLLALAAEPNIVELAPFSVAAQTRLRALADGLTIEHAARVKEIEHTTNHDVKAVEYFIKEQLKDDTELRPGLEFVHFACTSEDINNLSYSLMLQQARNDVLLPTLDGIATHLRTLAHTQAAQPMLSRTHGQTASPTTLGKEIANVVARLERQRHQIATIALSGKINGAVGNYNAHTISYPEINWPAFAQRFVESLGLVFNPYTTQIEPHDTIAEISDATRRANTILIDLARDLWGYISLGYFKQKLKEGEVGSSTMPHKVNPIDFENAEGNFGVANALFEHFSTKLPISRWQRDLTDSTVLRALGTAFGHTQVALDSLNKGLHKLSPNPERIDADLDAAWEVLAEAVQTIMRRHNLPNPYEQLKALTRGQGITADSMRAFIETLDLPTEAKQRLHDLTPRAYTGLAKQLALNI

SEQ ID NO: 2971 - DNA, 1371 bp, Buchnera sp
  CDS (1)..(1371)
atggaattaacctctttaacagccatctctcctgttgatggtcgatacagcaatttaacaatattattaagaaatatttttagtgaatttggttttttaaaatatcgtttgaacattgaagttcagtggctaaaaaaaatcattagtatgtctcaaatattagatattaataatattgaatataaagaaatattatttcttgatagtattgttgaagaatttaatgaaaaagatgcaattcttattaagaatatagaaaaagaaaccaatcatgacattaaggctttagagtattttttaaaaaacaagatcgctcaatctaaaaatcttttaactatttcagagttcgtacattttggatgtacttcggaagacattaacaatatagcatactcattaatgattaaagatgctcgtgataaaataattttaccattatggtataaaattataagtactttaaaaaaaatggtttttaaatatcaacactatcctttattatctttaactcatggacaacccgctactccatcaactatgggaaaagagattgctaatttttattaccgaatgaaacggcagtatatcatactcaaaaaaatagaaatattaggaaaaattaatggaagtactggtaattataatgcacatttagcagcatatcctgatattaactggcataagataagtaaagatttcatcacgtcatttggtattaattggaacccatatactactcagatcgaacctcatgattatattgcagaattttttagttgcatgtctctatttaatacaatattaattaattttaatcgcgacatgtggggttatatttcacttaattattttaaacaaagaacaatagattatgaaataggttcttcaataatgccccacaaagtcaatcctattgattttgaaaattctgaaggtaatttaggactttctaatgctcttatgaatcatatgattacaaaattacctatttctagatggcagcgtgatttaagtgattctacggtattaagaaatataggtgtggctatttcttatgcaataattgcatataattctgtattatcaggaattaataaattagaaattaatgaatctgaattattaaaaaatttggataaaaattggtctattttatcggaacctattcagactattatgcgtcgttatggaattaaaaacgcatatgaaaaattaaaaaaattgactcgaggaaaagaaataaatagaaatgtcatacatacatttatttctagtttaaatattcctgaagaagaaaaaaaacgtttaaaaaatatgactcctttcaactatattggagcagcgagtcaaattatcaatgaaatagaataa

SEQ ID NO: 2972 - protein, 456 aa, Buchnera sp
MELTSLTAISPVDGRYSNLTILLRNIFSEFGFLKYRLNIEVQWLKKIISMSQILDINNIEYKEILFLDSIVEEFNEKDAILIKNIEKETNHDIKALEYFLKNKIAQSKNLLTISEFVHFGCTSEDINNIAYSLMIKDARDKIILPLWYKIISTLKKMVFKYQHYPLLSLTHGQPATPSTMGKEIANFYYRMKRQYIILKKIEILGKINGSTGNYNAHLAAYPDINWHKISKDFITSFGINWNPYTTQIEPHDYIAEFFSCMSLFNTILINFNRDMWGYISLNYFKQRTIDYEIGSSIMPHKVNPIDFENSEGNLGLSNALMNHMITKLPISRWQRDLSDSTVLRNIGVAISYAIIAYNSVLSGINKLEINESELLKNLDKNWSILSEPIQTIMRRYGIKNAYEKLKKLTRGKEINRNVIHTFISSLNIPEEEKKRLKNMTPFNYIGAASQIINEIE

SEQ ID NO: 2973 - DNA, 1425 bp, Sulfolobus solfataricus
  CDS (1)..(1425)
atgagattacagtataagttaataaatgttgaacatactttacaattagccatggaggatagtatatgtcctttagaatggagatacggtagtaatgagatgagaaagtttttcagtagagaagaaatcttgaaaaggagaattcaagtagaaatagcgttattaaaagcattaaccaaatatggtttagtaaaagaggaagacgttcaaaaagttgagaaagcttcattaacaataagaccagaggaagtagatgaacttgaatcaaaaattggtcatgatgtaatggctatggtagtcttaatggcagaaagaagtggagattctggaagatacgttcattttggggcaacaagttatgatattgtagatacagcttatgcgttagtatttagagacgcaataagattagtaaagacaaaagtagtagaaatattggaaatgatggttagtttagcaattaagtataaagatttagcaatggtaggaagaactcatgggcagcatgcattgcctataacattaggctttaaaattgcaaattatatctatgaattttctagatcactagagaggttaaatgaggttgagaaaagaatagtaaaaggtaaaatggcaggtgcagttggcacgatggcagcttggggcaatatagggttagaaatagaagagaatgttatgaaatttttaggattaagacctcatgagatttcaactcaagttgctccacgagacgcatttgcagaattaacttctgatcttgcaattttggcatctcaatgtgatcgattcgcattagaagttagggaactaatgagaccggaaataaatgaaataagtgaaggcgtagaaggtcgtgtaggaagtagtactatgcctcagaaggaaaatccagtcacgtcagaaaagattgggggtttagcaaaagttttacgctctcttgtcgtagcgtcactagaaaatattccattatggcacgaaagagatctgactaacagttcgtcagagaggataataatatcacatgaatttctagttattgacgaaatattagatagtatgataagtcttttgaggaatttaagggttaacttcgagaatattgaaaagaatttgaacttaactaaaggacaaataatggcagaaagtctgatgataaacttaaccttaaagggcatgaaaaggcatgaagctcatcaatacgttaacaaactgacgtcaaaagtaagacaaactggaaaaacgttattagaggtttgcctagaggatagtttaattttaagttatttctctaagcaagaacttgagaacgtacttaatcctaaaaactacttgggttcctatgataaattaatagagagagctattagctatgcaaaaggcgtaatcaaaggttcagaaatacgagaagctcaagatagatga

SEQ ID NO: 2974 - protein, 474 aa, Sulfolobus solfataricus
MRLQYKLINVEHTLQLAMEDSICPLEWRYGSNEMRKFFSREEILKRRIQVEIALLKALTKYGLVKEEDVQKVEKASLTIRPEEVDELESKIGHDVMAMVVLMAERSGDSGRYVHFGATSYDIVDTAYALVFRDAIRLVKTKVVEILEMMVSLAIKYKDLAMVGRTHGQHALPITLGFKIANYIYEFSRSLERLNEVEKRIVKGKMAGAVGTMAAWGNIGLEIEENVMKFLGLRPHEISTQVAPRDAFAELTSDLAILASQCDRFALEVRELMRPEINEISEGVEGRVGSSTMPQKENPVTSEKIGGLAKVLRSLVVASLENIPLWHERDLTNSSSERIIISHEFLVIDEILDSMISLLRNLRVNFENIEKNLNLTKGQIMAESLMINLTLKGMKRHEAHQYVNKLTSKVRQTGKTLLEVCLEDSLILSYFSKQELENVLNPKNYLGSYDKLIERAISYAKGVIKGSEIREAQDR

SEQ ID NO: 2975 - DNA, 1416 bp, Plasmodium falciparum
  CDS (1)..(1416)
atggatgtacatgtgaaccaactgaaaaacatatcgcccatcgacgggagatacaaaagatcgtgccaggaagtaagcgaatatttttcagagtacgctttaataaaatatcgaataatagttgaaataaaatggttattatttttaaatgacaaagaatatttctttccaaaagttagtgagaagagtttgagtaatatcacatcgattatggaattaataaatgataatgatatattacgtgtaaaaaagatagaagaagaaacgaatcatgatgttaaggcggttgaatattttataagagagaaattagaaagtttaaaaaatgaagaaataacaaaagtaataccatatgtacattatttatgtaccagtgaagatattaataatatagcatatggtttatgcttatataattgtatacataatataataataccaaatatacaaaacattatagacaaattaaaagaattctcttttaattattctgatgtatctttattatcaaaaacacatggacaacctgcatcaccaactacctttggtaaagaaatgtccaactattattatcgtttatataagcatataaataaattaaaaaatattgagatatatgtaaaatttaatggagctgtaggaaattttaatgcgcataaagtctgtgatcctaatattgattggatcgataatattaaatattttatagaaacatattttaatttacatttttcattatattgtactcaaatacaagatcatgattatatatgtgagatttcagatacattggctcgtttaaattatacattgatcgatttatctgttgatatgtggttatatatctcatcaaatgttttaaaacttaaagttatacaaaaagaaattggaagtagtaccatgccacataaagtaaatcctatagattttgaaaatgctgaaggtaatttacatttagctaattctttattcaagttatttagttccaaattaccaataagtagattgcaaagagatctatctgattcaactgttcttagaaatttaggctcatcatttgcgtattccctaatatcatataaatcattattaagaggattaaataaaattgatgtagatcaaaatgttatgaatgaacaactcaatcaaaattggtgcacattagcagaacccatacaaattattatgaaaaaatataatattgctgattcgtatgaacaacttaaaaacttcactagagggaaatccatagacaaacaatgcatgtatcaatttattcaacaaaactgtagtcatctaccaaaaaatgcaatcgatgaattgatgaatttaacaccgcacaattatcttggctacgcaagctatttgtcaaaaaatgtggagcacttctcacaggaatatataaaaaaaaattaa

SEQ ID NO: 2976 - protein, 471 aa, Plasmodium falciparum
MDVHVNQLKNISPIDGRYKRSCQEVSEYFSEYALIKYRIIVEIKWLLFLNDKEYFFPKVSEKSLSNITSIMELINDNDILRVKKIEEETNHDVKAVEYFIREKLESLKNEEITKVIPYVHYLCTSEDINNIAYGLCLYNCIHNIIIPNIQNIIDKLKEFSFNYSDVSLLSKTHGQPASPTTFGKEMSNYYYRLYKHINKLKNIEIYVKFNGAVGNFNAHKVCDPNIDWIDNIKYFIETYFNLHFSLYCTQIQDHDYICEISDTLARLNYTLIDLSVDMWLYISSNVLKLKVIQKEIGSSTMPHKVNPIDFENAEGNLHLANSLFKLFSSKLPISRLQRDLSDSTVLRNLGSSFAYSLISYKSLLRGLNKIDVDQNVMNEQLNQNWCTLAEPIQIIMKKYNIADSYEQLKNFTRGKSIDKQCMYQFIQQNCSHLPKNAIDELMNLTPHNYLGYASYLSKNVEHFSQEYIKKN

SEQ ID NO: 2977 - DNA, 1371 bp, Neisseria meningitidis
  CDS (1)..(1371)
atgatcaaccccatcgcctcgctttcccctttagacggccgttatgcccaatccgttgaagcattgcgcccgattttctcagagtacggcctgatgaaagcgcgcgtcaaagtcgaattaaactggctcaaagccctcgccgccgagccgaagattgccgaagtgccgcccttcagtgccgaaacgcttgccgaaatcgacacggtgattgaaaacttttcattggaagacgcggccgccgtcaaagccatcgaagccacgaccaatcatgatgtcaaagccattgaatattggctgaaaaaacgttttgccgaagtgccggaagtcgccgccgtgagtgagttcatccacttcgcctgcaccagcgaagacatcaacaacctgtcccacgctttaatgctgcaagaagcgcgtgaggctgttttgctgcccaaactggcagaaatcatcgaaaaactgaccgctatggcgcacgaccttgccgccgtcccgatgatgagccgcacccacggccagcccgccacgccgaccactttgggcaaagaaaccgccaatgtcgtgtaccgcctgcaacgccagtttaaaagccttcaggcgcaagagttcctcggcaaaatcaacggcgcggtcggcaactacaacgcccacatggtcgcctatcccgacgtcgattgggaaacccactgccgcaacttcgtcgaaatcagccttggcctgaccttcaacccctacaccatccaaatcgagccgcacgactacatggctgaattcttccaaaccctcagccgcatcaacaccatcctgatcgactttaaccgcgacgtttggggctacatttctttggggtacttcaaacaaaaagtcaaagcgggcgaagttggttcttccaccatgccgcacaaagtcaaccccatcgactttgaaaactccgagggcaaccttggtatggcaaacgccgtattgggttttttggcggaaaaactgccgatttcccgttggcagcgcgacctgaccgacagcaccgtcttacgcaatatgggcgtgggcgtgggctatgccgtgttgggtttcgccgcccacctgcgcggtctgaacaagctcgaacctaaccccgccgcgcttgccgccgatttggatgccacttgggagctgctcgccgagccgattcaaaccgtaatgcgccgttacggcgtggccaatccttacgagaagctgaaagacctgacgcgcggcaaaggcggcatcacgcccgaagtgctgaaaggctttatcggattgctggaaatccccgccgaagccaaagccaaattgcttgagctgacccccgcgctgtatgtgggcaaggctgaagcgttggcgaaacggatttga

SEQ ID NO: 2978 - protein, 456 aa, Neisseria meningitidis
MINPIASLSPLDGRYAQSVEALRPIFSEYGLMKARVKVELNWLKALAAEPKIAEVPPFSAETLAEIDTVIENFSLEDAAAVKAIEATTNHDVKAIEYWLKKRFAEVPEVAAVSEFIHFACTSEDINNLSHALMLQEAREAVLLPKLAEIIEKLTAMAHDLAAVPMMSRTHGQPATPTTLGKETANVVYRLQRQFKSLQAQEFLGKINGAVGNYNAHMVAYPDVDWETHCRNFVEISLGLTFNPYTIQIEPHDYMAEFFQTLSRINTILIDFNRDVWGYISLGYFKQKVKAGEVGSSTMPHKVNPIDFENSEGNLGMANAVLGFLAEKLPISRWQRDLTDSTVLRNMGVGVGYAVLGFAAHLRGLNKLEPNPAALAADLDATWELLAEPIQTVMRRYGVANPYEKLKDLTRGKGGITPEVLKGFIGLLEIPAEAKAKLLELTPALYVGKAEALAKRI

SEQ ID NO: 2979 - DNA, 1452 bp, Pseudomonas aeruginosa
  CDS (1)..(1452)
atggatgctgaatcgctggaaatgcttgcccgttcctcgtgcaccgcgcatccgcagagcttcggcggcgcaccggccgagtcgtcctgcaagcacgaacacagtcacatcgttgactctaaaacccatggcggcggctacgccggtccggtgagccgacggatcttctgtagccactgccgcctgcaacgctggctcgacgtggaggcggcgctggcgctggcgcaggccgatgtcggcgtcattccgcccgaggccgcgctggagatcgcgaaggccgccaggctttcggccgttgacctgcagcagatcgccgacggcgtggccagcaccgggcactcgctgatgcccctgctgggtgcgctgcaacggaactgcagccccagcgcgcgcgagtacgtgcatttcggcgcgaccacgcaggatatccaggacaccgcgcagtccctggaaatgcgcgatgtgctggatgaaacggagcgggcgctggacatcctcctggaccggctctcggtgctggcgagcgggacccgcaatgcgctgatggtcgccaggacccactcgatcccggcgttgccgaccaccttcgggctgaaggtggccggctggatcgacgagttgctgcgtcaccgcgaacgcctgggcgaggcgcgcaagcggatcctggtggtgcaactgttcggcggcgtgggcacgatggccgccttcggcgacgaggccatgctcctgctcgaaagcttcgcgcggcggctgtcgctggacgtgccgctggcgggttggcacgtgtcccgcgaccgggttaccgagttcgtcagcaccctggccatggtcaccgcgtccctggcgcggatcgccgacgagatccgcaccctgaaccgctgggagatcggcgagctggaggtgggctggacgcagcagcagatcggtagcagcaccatgccccacaagcgcaatccggaaggctgcgagcaggtcgtggtgctggcccggctggccaaggcccaggtcctgctcgcgttggacgccatgatcctcgagcacgagcgggactaccgcggcacgcgcctggaatggtgtgcggtggcggacgtttcccactatgcgctgatggcgctgtcgctgctgaccgacaccatcgacgggctcacggtccacgacgagaccatggcgcggacggcgaatgcatacagcgatgcgatctgtaccgaggcgttcgtcttcgagatggccaagcaactgggcaagagcagcgcttacgaaatcatcttcgagatcacccaggcctgccagcgcaagcggattccgatgcgccaggcgctcgagtcggatccgcgggtgggcgccgtcatgccgaaggaaaccctggccaggctgttcgagccgcggacccatctcggcatggccgggaccatcgtcgacaaggtgctggacaaggtcgccagccaccactga

SEQ ID NO: 2980 - protein, 483 aa, Pseudomonas aeruginosa
MDAESLEMLARSSCTAHPQSFGGAPAESSCKHEHSHIVDSKTHGGGYAGPVSRRIFCSHCRLQRWLDVEAALALAQADVGVIPPEAALEIAKAARLSAVDLQQIADGVASTGHSLMPLLGALQRNCSPSAREYVHFGATTQDIQDTAQSLEMRDVLDETERALDILLDRLSVLASGTRNALMVARTHSIPALPTTFGLKVAGWIDELLRHRERLGEARKRILVVQLFGGVGTMAAFGDEAMLLLESFARRLSLDVPLAGWHVSRDRVTEFVSTLAMVTASLARIADEIRTLNRWEIGELEVGWTQQQIGSSTMPHKRNPEGCEQVVVLARLAKAQVLLALDAMILEHERDYRGTRLEWCAVADVSHYALMALSLLTDTIDGLTVHDETMARTANAYSDAICTEAFVFEMAKQLGKSSAYEIIFEITQACQRKRIPMRQALESDPRVGAVMPKETLARLFEPRTHLGMAGTIVDKVLDKVASHH

SEQ ID NO: 2981 - DNA, 1371 bp, Pseudomonas aeruginosa
  CDS (1)..(1371)
atgcagctttcctcgctcaccgcggtatcccccgtcgatggccgctatgccggcaaaaccagcagcctgcgtccgatcttcagcgaatacggcctgatccgtttccgcgtcatggtggaagtccgctggctgcagcgcctcgccgcccacgccgggattcccgaggtcgcgccgttctccgccgaagccaacgccctgctcgacagcctggccagcgacttccagctggaacacgccgaacgcatcaaggaaatcgagcgcaccaccaaccacgacgtgaaagccgtggagtacctgctcaaggaacaggccgccaagcttccggagctggccgcggtcagcgagttcatccacttcgcctgcacctccgaggacatcaacaacctgtcccacgccctgatgctccgcgagggtcgcgacagcgtgctgctgccgctgatgcgccagatcgccgaggccatccgcgaactggcggtgaaactcgccgacgtgccgatgctctcccgcacccacggccagcctgcctcgccgaccaccctgggcaaggaactggccaacgtcgtctaccgcctggagcggcagatcaagcaggtcgccggcatcgagttgctgggcaagatcaacggtgccgtgggcaactacaacgcccacctgtccgcctatcccgaagtcgactgggaagccaacgcgcgccagttcatcgaaggcgacctcggcctgaccttcaacccctacaccactcagatcgagccgcacgactacatcgccgagctgttcgatgcgatcgcccgcttcaacaccatcctcatcgacttcgaccgcgacgtctggggctacatctccctcggctatttcaagcagaagaccgtggccggcgagatcggctcctcgaccatgccgcacaaggtcaacccgatcgacttcgagaactccgagggcaacctcggcatcgccaacgcgctgttccagcacctggccagcaagctgccgatctcgcgctggcagcgcgacctgaccgactccaccgtgctgcgcaacctcggcgtcggcatcgcccacagcatcatcgcctacgaggccagcctgaagggcatcggcaagctggagctgaacgcccagcgcatcgccgaggacctggacgcctgctgggaagtcctcgccgagccggtgcagaccgtgatgcgtcgctatggcgtggaaaacccctacgagaagctgaaggaactgacccgcggcaaaggcatcagcgccgaagccttgcagactttcatcgaagagctggcgattcccgccgaggccaaggtcgagctgaagaagctgaccccggccggctacgtcggcaatgccgccgcccaggccaagcgcatctga

SEQ ID NO: 2982 - protein, 456 aa, Pseudomonas aeruginosa
MQLSSLTAVSPVDGRYAGKTSSLRPIFSEYGLIRFRVMVEVRWLQRLAAHAGIPEVAPFSAEANALLDSLASDFQLEHAERIKEIERTTNHDVKAVEYLLKEQAAKLPELAAVSEFIHFACTSEDINNLSHALMLREGRDSVLLPLMRQIAEAIRELAVKLADVPMLSRTHGQPASPTTLGKELANVVYRLERQIKQVAGIELLGKINGAVGNYNAHLSAYPEVDWEANARQFIEGDLGLTFNPYTTQIEPHDYIAELFDAIARFNTILIDFDRDVWGYISLGYFKQKTVAGEIGSSTMPHKVNPIDFENSEGNLGIANALFQHLASKLPISRWQRDLTDSTVLRNLGVGIAHSIIAYEASLKGIGKLELNAQRIAEDLDACWEVLAEPVQTVMRRYGVENPYEKLKELTRGKGISAEALQTFIEELAIPAEAKVELKKLTPAGYVGNAAAQAKRI

SEQ ID NO: 2983 - DNA, 1311 bp, Caulobacter crescentus
  CDS (1)..(1311)
atgatcagccgctacgcccgccccgaagccgccgccatctggtccagccagaccaagtacaagatctggttcgagatcgaggcccacgccgccgacgccatggccgagctgggagtcatccccaagctcgccgccgagacgatctgggaaaagggccgcgacgcggtctgggacagcgaccgcatcgatgagatcgagcgcgtcactaagcacgacgtcatcgccttcctgacccacgtctccgagatcgtcggtcccgaagcccgcttcctgcaccagggcatgaccagcagcgacgtgctggacacctgcttcgccgtgcagctgtcgcgcgccaccgacctgctgctggaagacgtcgatctggtgctggccgcgctgaagcgccgggccctggaacacaagatgaccgtctgcgtcggccgcagccacggcatccacgctgagccgatcacctttggcctgaagctcgcaggctactacgccgagttccagcgcgccaaggagcgcctggcgatggccaagttcgagatcgccacctgcgcgatctcgggcgcggtgggcaccttcgccaatgtcgatccgcgcgtcgaacagcacgtggccgacaagatgggcctggctgtcgagccggtctcgacccaggtgatcccgcgcgaccgccacgcggcctatttcgcggccctgggcgtggtggcctcgtcggtcgagcgcctggccaccgagatccgccacctgcagcgcaccgaggtgctggaagccgaagagccgttcgatccgggccagaagggctcgtcggccatgccgcacaagcgcaacccgatcctgaccgaaaacctcaccggcctggcgcgcttggtccgttcggccgtggtgccggcgatggagaacgtcgccctctggcacgagcgcgacatcagccactcgtcggtcgagcgcggcatcggccccgacgccaccatccacctcgacttcgccctgcgccgtctggccggcgtgatcgagcgcttcaacatctatcccgacaacatggccaagaacctggacaagttggggggtctcgttttctcccagcgcgtcatgctggccctgacccacaaggacgtctcccgcgaggacgcctatgcggccgtgcagggcaacgccatgaaggtctggcgcggcgaaggccggttcctcgacttcctgaaggccgatccggtcgtgtccaaggccctgaccgagaccgaactcgaagagctgttcgaccttggctaccacaccaagaatgtcgacgtgatctttcagcgcgtcttcggcgaacagggctga

SEQ ID NO: 2984 - protein, 436 aa, Caulobacter crescentus
MISRYARPEAAAIWSSQTKYKIWFEIEAHAADAMAELGVIPKLAAETIWEKGRDAVWDSDRIDEIERVTKHDVIAFLTHVSEIVGPEARFLHQGMTSSDVLDTCFAVQLSRATDLLLEDVDLVLAALKRRALEHKMTVCVGRSHGIHAEPITFGLKLAGYYAEFQRAKERLAMAKFEIATCAISGAVGTFANVDPRVEQHVADKMGLAVEPVSTQVIPRDRHAAYFAALGVVASSVERLATEIRHLQRTEVLEAEEPFDPGQKGSSAMPHKRNPILTENLTGLARLVRSAVVPAMENVALWHERDISHSSVERGIGPDATIHLDFALRRLAGVIERFNIYPDNMAKNLDKLGGLVFSQRVMLALTHKDVSREDAYAAVQGNAMKVWRGEGRFLDFLKADPVVSKALTETELEELFDLGYHTKNVDVIFQRVFGEQG

SEQ ID NO: 2985 - DNA, 1434 bp, Pseudomonas aeruginosa
  CDS (1)..(1434)
atgccaagtcacattacggaatcccgtatacacgggggcgcctactcgtccccggcattcgccgcgatcttttccgataccaaccaggtgcggaggtggctggatgtcgagcgagccttggcggcgacccaggccgagatgggcatcatcccccacgaggcggcgcgggagatcgaccgcgccgcccaggtggagcgcttcgacctcacccaactgggccgcgaaagcctggagacagggcacctgctggtgcctaccatccgcgccctggcgaggtcgtgcgagggtagctggggggagtacgtgcactatggcgtgaccacccaggacatcctcgacaccgggctgatgctgcaggtcaaggaagcctggggccatgcgctcgggctcctgcactcgatccgtggccatctgctggcgcttgccctgcgccaccagcacacgccgatggttgcacgcacccacgggcagcaggcgctgcccacgaccttcggctacaaggtcgccgtctgggtggatgaaatcgaccgtcacctggcgcgcttcgacgaagcgcgcgaacgcgtcctggtcggcaacctgaccggtgccgtgggaaccctggcgtcgttcggcgcccagggcttcgagctacagcggcgaaccctggccaggcttggcctcggcgcgccgtcgaccagttggcacagcgcccgggaccgggtgctggaggttgccgggttgctggtccaggtgtcggtgacgctgggccgggtggcgaacgagatctaccacctgcagcgcagcgaaatcgacgaggtacgcgagggcagccggccgggacaggtgggcagcagcaccatgccgcacaagcggaacccgtcgtcggtcgacctggtcagcgcgctgtcgcggctggtgcgggcacagatggtggcgctcaccgatgccgcgttccagttgcacgagcgcgacggcaccgcctggcgcatcgagtgggcggcgttgccggagctgttcgtctacgccggcgccttgctgacccgcatggaggcggtgctggccgaggggctcgaggtgcgcgaggaacgcatgcgcgccaacctcgacctgctgggtgggctgatcctgtcggagcgggtcatgctcgcgctggcggggcagttcggcaagcagaccgcccacgaactgctccatgagataacccaggcctcccagcggcagggcgttccgttccgcgaggcgctgctcgggcagccaaggttgcgcggctgtttcagcgccgaggcgctcgaagaactgctcgaccccgtcggctacgtcggcctcgccgcggagatggtcgacctggtcgccgacaaaccacgaaccggcgcgtcgggcgacaggcccgaaggcgccgcctcttcccaaggaaatcccggtcagtcccagtacgtgatggaggataggtga

SEQ ID NO: 2986 - protein, 477 aa, Pseudomonas aeruginosa
MPSHITESRIHGGAYSSPAFAAIFSDTNQVRRWLDVERALAATQAEMGIIPHEAAREIDRAAQVERFDLTQLGRESLETGHLLVPTIRALARSCEGSWGEYVHYGVTTQDILDTGLMLQVKEAWGHALGLLHSIRGHLLALALRHQHTPMVARTHGQQALPTTFGYKVAVWVDEIDRHLARFDEARERVLVGNLTGAVGTLASFGAQGFELQRRTLARLGLGAPSTSWHSARDRVLEVAGLLVQVSVTLGRVANEIYHLQRSEIDEVREGSRPGQVGSSTMPHKRNPSSVDLVSALSRLVRAQMVALTDAAFQLHERDGTAWRIEWAALPELFVYAGALLTRMEAVLAEGLEVREERMRANLDLLGGLILSERVMLALAGQFGKQTAHELLHEITQASQRQGVPFREALLGQPRLRGCFSAEALEELLDPVGYVGLAAEMVDLVADKPRTGASGDRPEGAASSQGNPGQSQYVMEDR

SEQ ID NO: 2987 - DNA, 1323 bp, Helicobacter pylori
  CDS (1)..(1323)
atgttagaacgctatgcgaatgaagaaatgaaagccctatggaatgagcaaaccaagtttgaaacctatttagaagtggaaaaagctgtcgttagggcgtggaacaagcttgggcaaatccaagatagcgattgtgaaaaaatctgtgcgaaagcggcattcaatcttgaacgcatcaaagaaattgaaaaaaccactaagcatgatttaatcgctttcactacttgcgtggctgaaagcttgggcgaagaatcccgctttttccattatgggatcacttctagcgattgcattgatacggctatggcgttattgatgacaaaaagcttaaaactcattcaaaaaggcgttaaaaacctttatgaaacccttaaaaacagggctttagagcataaagacacgctgatggtgggcagaagccatggggtgtttggcgaacccattacttttggcttagtgttagccctttttgctgacgaaatcaaacggcatttaaaagccttggatttaacgatggaatttatcagcgtgggagcgatcagtggggctatggggaatttcgcacacgcccctttagaattagaagaattagcgtgcgaatttttaggcttaaaaaccgccaatatcagcaatcaagtcattcaaagggaccgctacgctaggcttgcatgcgatctggctcttttggcgagcagttgtgaaaaaatcgctgtcaatatccgccatttgcaacgcagtgaagtctatgaagtggaagaagctttttcaacagggcaaaaagggagctctgcgatgcctcacaaaagaaaccccatattgagcgagaatatcaccgggctttgcagggtgattcgctcttttacgacccctatgctagaaaatgtcgccttatggcatgaaagagacatgagccatagctctgtggagcgttttgccttgcccgatctgtttatcactagcgattttatgctcagccgcctgaatagcgtgattaaaaatttggtggtttatcctaaaaacatgcttaaaaatttagctttgagtggagggttagttttttcgcaacgggtgttattggaattgcccaaaaaaggtttgagccgagaagaaagctattctatcgtgcaagaaaatgcgatgaaaatatgggaggttttgcaacaaggcgcttttaaaaacactgatgaaaatttgtttttaaacgccctactcaacgatgaacgcttgaaaaaatatttgagcgaagatgaaatcaaagcatgttttgattacaattattacactaaaaatgtgggggcgatttttaaaagggtgtttgaataa

SEQ ID NO: 2988 - protein, 440 aa, Helicobacter pylori
MLERYANEEMKALWNEQTKFETYLEVEKAVVRAWNKLGQIQDSDCEKICAKAAFNLERIKEIEKTTKHDLIAFTTCVAESLGEESRFFHYGITSSDCIDTAMALLMTKSLKLIQKGVKNLYETLKNRALEHKDTLMVGRSHGVFGEPITFGLVLALFADEIKRHLKALDLTMEFISVGAISGAMGNFAHAPLELEELACEFLGLKTANISNQVIQRDRYARLACDLALLASSCEKIAVNIRHLQRSEVYEVEEAFSTGQKGSSAMPHKRNPILSENITGLCRVIRSFTTPMLENVALWHERDMSHSSVERFALPDLFITSDFMLSRLNSVIKNLVVYPKNMLKNLALSGGLVFSQRVLLELPKKGLSREESYSIVQENAMKIWEVLQQGAFKNTDENLFLNALLNDERLKKYLSEDEIKACFDYNYYTKNVGAIFKRVFE

SEQ ID NO: 2989 - DNA, 1353 bp, Pyrococcus horikoshii
  CDS (1)..(1353)
atggcggttcacccaatagattaccgctacggtagtgaggagatgaggaagatatgggatgaaaagaacaagttgcaaaagctacttgacgttgaagctgccctagcaagggctcatgctaaggtaggaaacattccggaagagagcgctaaggttatttcggaaagggctaatacaaagtgggttaagcttgagagggttaaggagatagaggccgagatccatcatgatataatggccgtcgttaaagcgttaagcgaggtttgcggagaacatggaaagtacgttcatcttggggcaacttctaatgatataatagatacggccaatgcattgttaatcaaggaaagccttgagatagttgaaagggatcttaaagagcttagatccattttgaagcagcttgcggaaaagcatataggtacggtatgcatagggaggacccatggccaacatgcagttccgacgacttatggaatgaagttcgccctgtggcttgatgagatccagaggcatatagagaggttataccagcttaaggagagggttctcgttggtaagatgagaggggccgtgggaactgcggcctcatttggagaaaaagcctttgaaattgagagattggtgatggaagatcttggtctcaagcctgcaaggataacgaatcaaatagtgcaaagggatgtctacgctgaactacttttcttcctggctttagtggcttcaactctggataagatggggttggagataaggaacctgcagaggactgaaatacttgaggtaagcgaacccttcggggagaagcaagtaggttcatctacgatgccccacaagaggaaccccataagaactgaaaaggtctgtggacttgcgagggttttgtactccaacgttattccggcgttgctaaataacccactctggcatgagagggatttgacgaattcttccgttgagagggttatccttccagagagctttgtattgcttgatgagatgctcaagaccatgaagaaggttttaactggactggagttcttccccgagaacataaggaggaacttgtatttaacaaagaacttgatcatggccgagccccttatgttaaagcttgccgagaaaggaatgggaagacaggaagctcatgaagtagtaaggcaacttgcaatgaaagctttccgtgaaaacagagacctcctggaagttgcaaaggaaagtagagaaataactaagtatctaaccgagagagatcttgaggagctaaaaccagaaaattacattggcaaagcaagggaaatagtcaaaaaagtcattgaatatgttgaggagatggaaagaaggggattataa

SEQ ID NO: 2990 - protein, 450 aa, Pyrococcus horikoshii
MAVHPIDYRYGSEEMRKIWDEKNKLQKLLDVEAALARAHAKVGNIPEESAKVISERANTKWVKLERVKEIEAEIHHDIMAVVKALSEVCGEHGKYVHLGATSNDIIDTANALLIKESLEIVERDLKELRSILKQLAEKHIGTVCIGRTHGQHAVPTTYGMKFALWLDEIQRHIERLYQLKERVLVGKMRGAVGTAASFGEKAFEIERLVMEDLGLKPARITNQIVQRDVYAELLFFLALVASTLDKMGLEIRNLQRTEILEVSEPFGEKQVGSSTMPHKRNPIRTEKVCGLARVLYSNVIPALLNNPLWHERDLTNSSVERVILPESFVLLDEMLKTMKKVLTGLEFFPENIRRNLYLTKNLIMAEPLMLKLAEKGMGRQEAHEVVRQLAMKAFRENRDLLEVAKESREITKYLTERDLEELKPENYIGKAREIVKKVIEYVEEMERRGL

SEQ ID NO: 2991 - DNA, 1299 bp, Streptococcus pneumoniae
  CDS (1)..(1299)
atgatcaaccgttactctcgccctgagatggcgaatatttggagtgaagaaaataaataccgtgcttggcttgaggtggaaatcctctctgacgaggcatgggctgagttgggggaaatccctaaggaagatgtggctttgattcgcaagaaggcggactttgacatcgaccgtattttggaaattgagcaggagacgcgccacgatgtggtggctttcacgcgtgcggtttctgagactcttggtgaagagcgcaagtgggttcactatgggttaacttctaccgacgtggtggatactgcttatggttacctctacaagcaggccaacgacatcatccgtcgtgaccttgaaaacttcactaatatcatcgctgacaaggccaaggagcacaagttcaccatcatgatggggcgtactcatggtgtgcacgctgagccgacaacttttggtcttaaattggcaacttggtatagcgaaatgaaacgcaatatcgagcgtttcgagcatgcggctgctggtgtagaagctggtaagatttctggtgcggttgggaactttgccaatatcccaccatttgtagaggagtatgtctgcaacaagcttggtatccgtgctcaagaaatctctacacaagtccttcctcgtgaccttcacgctgagtactttgcagttcttgccagcattgcgacttcaatcgaacgtatggcgactgagattcgtggtctacaaaaatctgagcaacgcgaagtagaagagttctttgctaaagggcaaaaagggtcttcagcaatgcctcacaaacgcaacccaatcggttctgaaaatatgactggtctggcgcgtgtcattcgtggtcacatgattacggcttatgaaaacgtcgctctctggcacgaacgcgatatttcccactcatcagctgagcgtatcatcacaccagatacgaccattttgattgactacatgctcaaccgttttggaaatatcgtcaagaacttgacagtcttcccagaaaatatgatccgaaacatgaactcgacttttggtcttatctttagccaacgggctatgttgacattgattgaaaaaggcatgacccgtgagcaagcctatgacttggtgcaaccaaaaacagcctactcttgggacaaccaagtagactttaaaccacttcttgaggcagattcagaagtaacatcacgtctcactcaagaagaaatcgatgaaatcttcaacccagtttattacaccaaacgagtggatgatatctttgaacgtcttggactaggtgattaa

SEQ ID NO: 2992 - protein, 432 aa, Streptococcus pneumoniae
MINRYSRPEMANIWSEENKYRAWLEVEILSDEAWAELGEIPKEDVALIRKKADFDIDRILEIEQETRHDVVAFTRAVSETLGEERKWVHYGLTSTDVVDTAYGYLYKQANDIIRRDLENFTNIIADKAKEHKFTIMMGRTHGVHAEPTTFGLKLATWYSEMKRNIERFEHAAAGVEAGKISGAVGNFANIPPFVEEYVCNKLGIRAQEISTQVLPRDLHAEYFAVLASIATSIERMATEIRGLQKSEQREVEEFFAKGQKGSSAMPHKRNPIGSENMTGLARVIRGHMITAYENVALWHERDISHSSAERIITPDTTILIDYMLNRFGNIVKNLTVFPENMIRNMNSTFGLIFSQRAMLTLIEKGMTREQAYDLVQPKTAYSWDNQVDFKPLLEADSEVTSRLTQEEIDEIFNPVYYTKRVDDIFERLGLGD

SEQ ID NO: 2993 - DNA, 1449 bp, Saccharomyces cerevisiae
  CDS (1)..(1449)
atgcctgactatgacaattacactacgccattgtcttctagatatgcctccaaggaaatgtcagcaacgttttctttgagaaacagattttccacatggagaaaactatggttaaatttggctattgctgagaaggaattgggcttaactgttgttacagatgaagcaattgagcaaatgcgcaaacacgtcgaaatcactgatgatgaaatcgcaaaagcttctgctcaagaagccattgtaagacatgatgttatggcacatgttcatacatttggtgaaacttgtccggctgctgcgggtatcattcacttaggtgctacttcctgtttcgttacagacaatgctgatctaatctttattagggacgcctacgatattattattccaaaacttgttaacgtcatcaacagattggctaagtttgctatggaatacaaggatttgcctgtattgggttggactcactttcaaccagcacaattaacgaccttgggtaagagagctactttatggatacaagagctattgtgggatttgagaaactttgaaagagctagaaacgatatcggtctacgtggtgttaagggtactactggtactcaggcatcattcttggccttattccatggtaatcatgataaagttgaagcccttgacgaaagagtaactgaattattaggtttcgataaggtatatccagtcactggtcaaacctactcaagaaaaattgacattgacgtgttggctcctttgtcttcttttgctgctactgcacacaaaatggctactgacataagattattagccaacctgaaggaagttgaggaaccttttgagaaatcacaaatcggatcctctgctatggcttacaagagaaacccaatgcgttgtgagagagtgtgctccttggctagacacttaggttccttgtttagtgacgccgttcaaactgcatccgttcaatggttcgaaagaactctggatgattctgctattagaagaatttctttaccaagtgcatttttaaccgcagatattctattatctactttgttgaacatctcatccggtttagttgtgtatccaaaggttatcgaaaggagaattaagggtgaactaccttttatggctactgaaaatatcatcatggctatggtagaaaagaatgcctccagacaagaagtacatgagcgtattagagtgctctctcatcaagccgcagcagtagtcaaggaagaaggtggggaaaatgatttaattgaacgagtaaagagggatgaatttttcaagcctatctgggaagaattagattctttactggaaccatccacttttgttggtagagctccacaacaagttgagaaatttgttcaaaaagacgttaacaatgctttacaacctttccaaaagtacctaaacgatgaacaagtcaagttaaatgtttag

SEQ ID NO: 2994 - protein, 482 aa, Saccharomyces cerevisiae
MPDYDNYTTPLSSRYASKEMSATFSLRNRFSTWRKLWLNLAIAEKELGLTVVTDEAIEQMRKHVEITDDEIAKASAQEAIVRHDVMAHVHTFGETCPAAAGIIHLGATSCFVTDNADLIFIRDAYDIIIPKLVNVINRLAKFAMEYKDLPVLGWTHFQPAQLTTLGKRATLWIQELLWDLRNFERARNDIGLRGVKGTTGTQASFLALFHGNHDKVEALDERVTELLGFDKVYPVTGQTYSRKIDIDVLAPLSSFAATAHKMATDIRLLANLKEVEEPFEKSQIGSSAMAYKRNPMRCERVCSLARHLGSLFSDAVQTASVQWFERTLDDSAIRRISLPSAFLTADILLSTLLNISSGLVVYPKVIERRIKGELPFMATENIIMAMVEKNASRQEVHERIRVLSHQAAAVVKEEGGENDLIERVKRDEFFKPIWEELDSLLEPSTFVGRAPQQVEKFVQKDVNNALQPFQKYLNDEQVKLNV

SEQ ID NO: 2995 - DNA, 1296 bp, Synechocystis sp
  CDS (1)..(1296)
atgatcgaacgttataccctgcctgaaatgggcaaaatttggacggatacctacaagctacaaacctggctagacgtggaaatcgccgtttgtgaagcccaggcggagttgggttatattccccaggcagcggtggacgaaatcaaggccaaagctaagttcgatccccaacgagtgctggaaattgaggcggaagtgcgtcacgatgtcatcgcctttttaaccaacgttaatgaatatgtgggggatgcggggcgttatattcacctgggactaacaagctccgacgtactggacaccgctctggcgttgcaattggtggcgagcctagacctgattttggagcagttggaaaaactaattcaggccatccgttaccaagctcagcagcatcgttacaccgtcatggtgggccgttcccatggtatccatgccgaacccatcacattcggatttaaactcgctggttggttagcggaagtattgagaaaccgcgatcgcctggtgcgggtagcccaatccattgccgtgggtaaaatttccggcgccgtgggcacctatgccaacattgaccccaaagtggaggcgatcgcctgtcagaaattaggcttagaaccagatacggcttccacccaggtcatttcccgagatcgccatgcggaatacgtgcaacagttggctttgctggccgcctctttggaacggtttgcagtggaaattcgcaacctgcaacgcaccgatgttttggaagtggaggaatatttttccaagggccaaaagggttcttccgctatgccccataaacgtaaccccatccgctcagaacgattaacgggaatggcccggctggttcggggtcatgcagtggcggcgttggaaaatgtagctctctggcatgaacgggatatttcccacagttctgtggagcgggttgcttttcccgactgctgtattctcacccattttatgttgaaggaaaccacggatttggtgaaaaatctgttggtctatcccgaaaatatgaaacgcaatatgaacgtttacggcggggtaattttcagccaaaaagttctgcttgccctagtggaaaaaggcatgaatcgagaagatgcctaccgagtggtgcagggttccgcccaccaagcctggaacacggaagggggcaattttgaagagctagtccgagctgatgcccaggtaacggccctactttctgccgaagaaattgaccagtgctttgacccccaacaacatttgactaacctggcggaaatttacagccgtttggatatttag

SEQ ID NO: 2996 - protein, 431 aa, Synechocystis sp
MIERYTLPEMGKIWTDTYKLQTWLDVEIAVCEAQAELGYIPQAAVDEIKAKAKFDPQRVLEIEAEVRHDVIAFLTNVNEYVGDAGRYIHLGLTSSDVLDTALALQLVASLDLILEQLEKLIQAIRYQAQQHRYTVMVGRSHGIHAEPITFGFKLAGWLAEVLRNRDRLVRVAQSIAVGKISGAVGTYANIDPKVEAIACQKLGLEPDTASTQVISRDRHAEYVQQLALLAASLERFAVEIRNLQRTDVLEVEEYFSKGQKGSSAMPHKRNPIRSERLTGMARLVRGHAVAALENVALWHERDISHSSVERVAFPDCCILTHFMLKETTDLVKNLLVYPENMKRNMNVYGGVIFSQKVLLALVEKGMNREDAYRVVQGSAHQAWNTEGGNFEELVRADAQVTALLSAEEIDQCFDPQQHLTNLAEIYSRLDI

SEQ ID NO: 2997 - DNA, 1404 bp, Arabidopsis thaliana (mouse-ear cress)
  CDS (1)..(1404)
atggctataacacaccccaaaatcccttctttcggttttacacccaccggaatattcctaaacccatcaaaatcagtgtgtttggcttcacatcatcggcttccgagagtttcatgctctgtttctactactactgattctcccaagctagtgacttcaacaaaggtgacggcaatggatggagtgagctctagagacttggagatgtcgaatttaacggcgttatcgcctttggatggacgttattggagtaaagttaaggacttggcttcttctttgagcgagtttggattgatctatttccgagtttttgtcgagatcaaatggcttcttaagctttcgaatattcctgaagtcactgaagttccaagctttagcaaagaagctcagagtttcttgcaaggcataatcgatggatttagcatagacgatgcattggaaattaagaagattgagagagtaacaaatcatgatgtgaaagcagtggagtatttcttgaaacaaaagtgtgaatcacaaccagagattgctaaggttcttgagtttttccatttcgcttgcacgtctgaggacatcaacaatctttcccatgctttgatgcttcaagaagcacttagttcggttatacttcctaccatggatgagctgatcaagtcaatctctctgatagctaagaactttgcttatgtccccatgctttcacgaactcatgggcagccagctacgccaacaactttggggaaagaaatggcgaattttgctgtgaggttaagcgaagaaaggagatatctttcagaaactaagattaaggggaaatttgcaggtgctgttgggaactacaacgcccatatttccgcatattcgaatattgactggcctcatgtttccgaggagtttgttacttctcttggattaacattcaacccatacgtgactcagacaactaaagcgggtgaaattggatcgtcgacaatgcctcacaaagtgaatcctattgactttgagaacagcgaagggaatctagggaaagcaaacgcagagcttacttttctcagcatgaagcttcccatttcacgcatgcagcgtgatttaactgattcaactgtcttgagaaacatgggtggagctttaggacactctcttctcgcttacaagagtgcgatacagggaatcgggaagcttcaggtgatgaggagatacggtgtccctgagccgtatgagaagctgaaggagctaacaagaggaaaagctgtgaatgaagaaaccataagaacgtttatcaaaggtttggaattgccttcagaagcaaaagaccaacttctggagctaactccacacacatatgttggtgctgctgctgcattggcactggccgtggatgaagctctgcacttgggacattga

SEQ ID NO: 2998 - protein, 467 aa, Arabidopsis thaliana (mouse-ear cress)
MAITHPKIPSFGFTPTGIFLNPSKSVCLASHHRLPRVSCSVSTTTDSPKLVTSTKVTAMDGVSSRDLEMSNLTALSPLDGRYWSKVKDLASSLSEFGLIYFRVFVEIKWLLKLSNIPEVTEVPSFSKEAQSFLQGIIDGFSIDDALEIKKIERVTNHDVKAVEYFLKQKCESQPEIAKVLEFFHFACTSEDINNLSHALMLQEALSSVILPTMDELIKSISLIAKNFAYVPMLSRTHGQPATPTTLGKEMANFAVRLSEERRYLSETKIKGKFAGAVGNYNAHISAYSNIDWPHVSEEFVTSLGLTFNPYVTQTTKAGEIGSSTMPHKVNPIDFENSEGNLGKANAELTFLSMKLPISRMQRDLTDSTVLRNMGGALGHSLLAYKSAIQGIGKLQVMRRYGVPEPYEKLKELTRGKAVNEETIRTFIKGLELPSEAKDQLLELTPHTYVGAAAALALAVDEALHLGH

SEQ ID NO: 2999 - DNA, 1365 bp, Streptomyces coelicolor
  CDS (1)..(1365)
atgacatcacctgccgtccccgaccccgccgggagcgaacccgacgccgacacgggcctgctcgcccccgggtggacgggctcgccggccgcctccgcgaccggtgaccgcgcgtatctgcgggccctgctcgacgcggaggcggcgctgacccgcgcccaggccgcgctggggctcgccccggccgaggcggcggacgcggtgggcgcggtcgccgccgacccggccgccttcgacgcgcgctcgctcgccgagcgcgcccgggacggcgggaacccggtcatccccctggtggccgacctgacgaaggcggtcggcgagccgtacgggccgtacgtgcaccggggcgcgaccagccaggacatcctggacacggcgacgatgctggtcgccgcccgcaccctggacctgctgctgcccgatctcgcccgcacggaacgggcgctggcccggctggccgccgagcaccgggacacgccgatgccgggccggaccctgacccagcacgccgtgccgaccgtcttcgggctcaaggcggccggatggcgcgcgctggtgctggacgcgcgggaccggatcacggcggtgcgggacgccctgcccgcccagctcggcggcgcggcgggcaccctggccgccttcgaggcgtacggcgcgacggacccgaccgcgctgcccgccgcctacgccggtgaactggggctgcgggcacccgtactgccctggcacacgctgcgcactccgatcgccgacctggccgggaccctcgccttcaccgccggggcgctcgggaagatcgccgtggacgtgctgacgctgtcgcgcaccgagaccggcgaggtcgccgagggcggcgggggcggttcctcggcgatgccgcacaaggccaacccggtccggtccacgctgatcgcggcggcggcccggcgcgcaccgcagctcgcggccacgctgtacggctcgctggccgccgaggacgagcggccggccggggcctggcacgcggagtgggagccgctgcgggacctgctgcggctgaccgggggtgccgcccgcgatgccgcggagctggccgaggggctgcgggtgcgcccggacgcgatgcgggcgcacctcgggcgcacccacgggctgatcgtctcggagcggctctcggccgagctggcgccggtgctcggccgggcccgtgcccgggaactgctcaccgaactggcggcgcgcgcctacgccgaggaccggaaccttggtgaactcctggccgaggtgccggagttgcggggtctcgacctggccggcccgaccgaccccgctcgctacacgggcgccgccgccaccctcaccgaccgtgctctggagcgacgttga

SEQ ID NO: 3000 - protein, 454 aa, Streptomyces coelicolor
MTSPAVPDPAGSEPDADTGLLAPGWTGSPAASATGDRAYLRALLDAEAALTRAQAALGLAPAEAADAVGAVAADPAAFDARSLAERARDGGNPVIPLVADLTKAVGEPYGPYVHRGATSQDILDTATMLVAARTLDLLLPDLARTERALARLAAEHRDTPMPGRTLTQHAVPTVFGLKAAGWRALVLDARDRITAVRDALPAQLGGAAGTLAAFEAYGATDPTALPAAYAGELGLRAPVLPWHTLRTPIADLAGTLAFTAGALGKIAVDVLTLSRTETGEVAEGGGGGSSAMPHKANPVRSTLIAAAARRAPQLAATLYGSLAAEDERPAGAWHAEWEPLRDLLRLTGGAARDAAELAEGLRVRPDAMRAHLGRTHGLIVSERLSAELAPVLGRARARELLTELAARAYAEDRNLGELLAEVPELRGLDLAGPTDPARYTGAAATLTDRALERR

SEQ ID NO: 3001 - DNA, 1803 bp, Schizosaccharomyces pombe
  CDS (190)..(1638)
catggaggcacaataaattatcgtttgatttttcatgcgcgttaactaattaatatggaaattacaaaataataaatctgatggtcttctcaaggtggagcatttgtagagcactacttagtgttggttcctcactgtccattcaccacaacaggtagaaattttttggcgagcttaagattatcgaatatggaggattatggttcatatagtacaccattgacagcaagatatgcttctgctgaaatgtctcatctcttttcaagagaaatgcgtattaatacttggagacaattgtggttgaatctcgccattgctgaaaagcaactcggtttaactcaaattactgatgaagctattgagcaacttaaagcgcatgtcaaaattacagctccagaatttgaaatcgctgctaaggaagagaagcgtcagagacacgatgttatggctcacatctatacatatggtcttgctgctcctgctgcttctggtattattcatttgggtgctactagctgttttgtaaccgataatgctgacttgattttcttacgcagcgccatggatcttttgatccctaagttagtcaacgttatcaatcgtcttagccagtggtctttgcgatacaaagacattcctactcttgggtttacacattatcaaccagctcaattaactaccgttggtaagcgtgccactctttggattcaagagcttttatgggatttgagaaattttgtaagagctagaaatgacattggtttccgtggtgtcaagggtaccaccggcactcaggcttccttcttagccctttttgagggcgatcatgccaaggttgaggaattggataaattggttgccaagctttccggttttgataacgtttatcctgtaaccggccaaacctatgatcgtaagatcgatattgacgttttgcaaccattagcttctttcggtgctactgctcataagattgcaactgatatccgtctccttgctaatttgaaagaagtagaagagccatttgaggctggtcaaattggcagttctgctatggcttacaagcgtaatccaatgcgttgtgaacgtatttgttctcaagctcgttatattatgaacttgattcctaatgctcttaatactgcttctgttcaatggtttgagcgtactttggatgatagctctaaccgtcgttctctgttacctgaagccttcttgtttacagatagcgttcttaagattctattgaacgttatttctggtatggtcatttatcctaaggttattcaaaaacacattcgtgctgaattgcccttcatggccactgaaaacattatcatggctatgactaagcacggtgctagtcgtcatgagtgtcacgagcagattcgtgtcttgtctcatcaagctggccgagtagtcaaggaagagggaggggataacgacttaattgagcgtattaagaatactccttattttgctcctatttatgatgagctagattctttgttggatgcatccacttttgttggacgtgctcccgagcagactgaatcctttgtaaataaggacgtctctcaagcgcttgcgcctttcaagagcatgatcactgaggaaaaggttgatcttgccgtttaaatagtttaaattttggtttgcttcgtagtggatacgaacttttttgatttgtttaaaatagaaagaatacatttttttcatcgttagtatgaatttttgtttgtaaaacaaatattaaaagcagaggaaatagcaaaataactctactagataaaccggtttatt

SEQ ID NO: 3002 - protein, 482 aa, Schizosaccharomyces pombe
MEDYGSYSTPLTARYASAEMSHLFSREMRINTWRQLWLNLAIAEKQLGLTQITDEAIEQLKAHVKITAPEFEIAAKEEKRQRHDVMAHIYTYGLAAPAASGIIHLGATSCFVTDNADLIFLRSAMDLLIPKLVNVINRLSQWSLRYKDIPTLGFTHYQPAQLTTVGKRATLWIQELLWDLRNFVRARNDIGFRGVKGTTGTQASFLALFEGDHAKVEELDKLVAKLSGFDNVYPVTGQTYDRKIDIDVLQPLASFGATAHKIATDIRLLANLKEVEEPFEAGQIGSSAMAYKRNPMRCERICSQARYIMNLIPNALNTASVQWFERTLDDSSNRRSLLPEAFLFTDSVLKILLNVISGMVIYPKVIQKHIRAELPFMATENIIMAMTKHGASRHECHEQIRVLSHQAGRVVKEEGGDNDLIERIKNTPYFAPIYDELDSLLDASTFVGRAPEQTESFVNKDVSQALAPFKSMITEEKVDLAV

SEQ ID NO: 3003 - DNA, 1296 bp, Bacillus subtilis
  CDS (1)..(1296)
atgatcgaacgttattcaagacctgaaatgtccgcgatttggacggatgaaaacagatttcaagcatggttagaggttgaaattcttgcctgtgaagcgtgggcggagcttggcgtcattccgaaagaagatgtaaaggttatgcgcgaaaacgcgtcatttgacatcaaccgcattttagaaatcgaaaaggacacgcgccatgacgttgtcgcttttacgcgcgctgtatccgaatcactgggcgaagaaagaaaatgggtgcattacggcttaacgtcaactgacgttgttgatacggctctttcctacttattaaaacaggcaaacgatattttgctcaaggatcttgagagatttgttgacattataaaagaaaaagcgaaagaacataaatacacagtcatgatggggcgcacacacggcgtacacgctgagcctacaacattcggcttaaaacttgcgctttggcatgaagaaatgaaacgtaatcttgagcgcttcaaacaagcgaaagcaggcatcgaggttggaaagatttccggtgctgtcggcacatatgcgaacattgatccatttgttgaacaatatgtctgtgagaagctcggattgaaagcagcaccgatttccactcaaacccttcagcgtgaccgccatgctgactatatggcaacacttgctttgatcgcgacaagcatcgagaaattcgctgtggaaatccgcggactgcaaaagagtgaaacacgtgaagtagaggaatttttcgcgaaagggcaaaagggttcatctgcaatgccgcataaacgaaatccgattggctctgaaaacatgacaggcatggcgcgcgtgatccgcggctacatgatgacagcttacgaaaatgttccattatggcatgagcgcgatatttctcattcttcagcagaacgaattattcttccggatgcgacaattgcgctgaactacatgctgaaccgcttctccaacatcgtgaagaacttaacggtcttcccggaaaacatgaagcgcaacatggaccgcactctcggccttatctattctcagcgtgtgctccttgctttgattgacacaggcctgactcgtgaagaagcctatgatacagttcagccgaaagcaatggaagcgtgggaaaaacaagtgccgttccgcgagcttgtggaagcggaagagaaaatcacgtcacgtctttctccagaaaaaattgctgactgctttgattacaattaccatctgaaaaatgttgatctgatctttgaacgtttaggtttagcatag

SEQ ID NO: 3004 - protein, 431 aa, Bacillus subtilis
MIERYSRPEMSAIWTDENRFQAWLEVEILACEAWAELGVIPKEDVKVMRENASFDINRILEIEKDTRHDVVAFTRAVSESLGEERKWVHYGLTSTDVVDTALSYLLKQANDILLKDLERFVDIIKEKAKEHKYTVMMGRTHGVHAEPTTFGLKLALWHEEMKRNLERFKQAKAGIEVGKISGAVGTYANIDPFVEQYVCEKLGLKAAPISTQTLQRDRHADYMATLALIATSIEKFAVEIRGLQKSETREVEEFFAKGQKGSSAMPHKRNPIGSENMTGMARVIRGYMMTAYENVPLWHERDISHSSAERIILPDATIALNYMLNRFSNIVKNLTVFPENMKRNMDRTLGLIYSQRVLLALIDTGLTREEAYDTVQPKAMEAWEKQVPFRELVEAEEKITSRLSPEKIADCFDYNYHLKNVDLIFERLGLA

SEQ ID NO: 3005 - DNA, 1464 bp, Mycobacterium leprae
  CDS (1)..(1464)
atgttcccgttttgcagtgcgaacccgaccgtaagctgtgcttctgtgagcattccgaatgttctagccgcccgatacgccagcgctgaattggtcgcgatatggtctccggaagccagggttatcgcggagcggcagttgtggctggccgtgctacgagcacaggcggaactgagtgttccgatgcctgttaaagcgatcgccgactacgagcgggtgcttggcgaggtcgatttggcttcgatcgccgcccgcgaacgtgtgttgcgtcacgacgtcaaggcgcgcatcgaggaattcaacgcgctggccggccatgagcaggtacataaggggatgaccagccgcgacttgaccgagaacgtggagcaactgcagatccggcggtcgttggaattggttttctgccatggtgtggccgtagtagcacggctggccgaatgcgcggtgtcctatcgcgacctggtgatggccggacgcagccataacgttgccgcgcaggccacgacattgggcaaacgcttcgcgtccgcgacgcaggaaacactgatagcgttgactaggctgcgcgagttgatcgaccgctacccactgcgcggtatcaagggcccgatgggtaccgggcaggacatgctcgacctgcttggcggtgacgctgcggcgctagcagaacttgagcaaagaatagctgaattcctaggattcacaaaggttttagccagtgtcgggcaggtatatccgcgttcactagaccacgatgtgatttcagcgttggtgcagctcggtgccggctcttcctcgttagcgcacaccatacggttgatggcaggtcacgagctcgttaccgaaggctttgcaccggggcaggttggctcgtcagcgatgccacacaagatgaacagccgcagctgtgaacgggtcaacggtctgcaggtggtgttgcgcggttacgccgcaatggcagccgaactagctggcgcgcagtggaacgagggcgacgttttctgctcagtagtacgtcgagttgctttgccagacagcttctttgccatcgacggccagatcgagacgtttttgacggtgctcgacgagtttggtgcttacccggcagtgatccgccgcgagctggaccgctatttgccattcctggccaccaccaaggtgctgattgcggctgtgcgtgctggtatgggtcgcgaggccgctcaccacgtgattcgcgaacacgcggtggcgacggcgctggccatgcgggagtgcggtgccgagcctgacctgctggaccggttggctgccgatgggcggttgccgctggaccgagcggcgctagacgccgcgctggccgacaagaaggcgttcaccggcgccgcggcagaccaggtagacgaggttgtcgcgatggtcgacaagctagtgggccgctacccggaagcagccaagtacacgccgggtgctatcctgtga

SEQ ID NO: 3006 - protein, 487 aa, Mycobacterium leprae
MFPFCSANPTVSCASVSIPNVLAARYASAELVAIWSPEARVIAERQLWLAVLRAQAELSVPMPVKAIADYERVLGEVDLASIAARERVLRHDVKARIEEFNALAGHEQVHKGMTSRDLTENVEQLQIRRSLELVFCHGVAVVARLAECAVSYRDLVMAGRSHNVAAQATTLGKRFASATQETLIALTRLRELIDRYPLRGIKGPMGTGQDMLDLLGGDAAALAELEQRIAEFLGFTKVLASVGQVYPRSLDHDVISALVQLGAGSSSLAHTIRLMAGHELVTEGFAPGQVGSSAMPHKMNSRSCERVNGLQVVLRGYAAMAAELAGAQWNEGDVFCSVVRRVALPDSFFAIDGQIETFLTVLDEFGAYPAVIRRELDRYLPFLATTKVLIAAVRAGMGREAAHHVIREHAVATALAMRECGAEPDLLDRLAADGRLPLDRAALDAALADKKAFTGAAADQVDEVVAMVDKLVGRYPEAAKYTPGAIL

SEQ ID NO: 3007 - DNA, 1314 bp, Symbiobacterium thermophilum
  CDS (1)..(1314)
atgattgaacgctacacccggccgcgcatggccgagctgtggtcggcggcgaatcgctttcagaagtggctggaggtggagctcctcgcctgcgaggcctgggcgaagctgggggtcatcccggccgaggcggtggccgagctccgggcccgggcgttcaccgtggacgaggcctttgtccgccgggtggcggagatcgagcagaccacccggcacgacgtgatcgccttcaccaccgcggtggccgagcgcatcgaccacccggcggcccggtacatccactacggcctcacctccaccgacgtggtggacacggccctgtcggccgtgctcaacgaggccgtccgagagatccagaaggggctggacgggctgatcgccgcgctgggccgccaggcggtgcggtacaaggatacccccatcatggggcggacccacggcgtgcatgccgagccgacatccttcgggctgaagctggccgtcttctacgcccagttccggcgggacgccgaccggctggagcaggcgcgccggtccatcgccgtcggtaagctctccggggctgtgggcaactatggtaacatcgatccgttcgtggagcagtacgtctgcgagaggctggggctcggggtcgccgacatctccacgcaggtgctccagcgggaccggcacgcgcacctgctcaccaccctcgcgatcctcggctcctcgctggacagcctggccaccgagctccggctgctgcagaagaccgagacccgcgaggtggaggagcccttctccaagggccagaaaggctccagcgccatgccccacaagcgcaaccccgtcaccctggagcagatctccggcctcagccgcatcctgcgcgccaacgccatcgcggccttggagaacgtgccgctctggcacgagcgggatatctcccactcgtcggtggagcgggtcatcctgcccgactccaccatcctggccgactacctgctggacaagatgacgtggatcatcgagaacctgcacgtctaccccgagaacatgcggcggtccatgcaggcctcctacggcctcacctcctcgggctccgtgctgctgtccctggtggagaaagggctgtcgcgtgagcaggcctacgccgtcgtgcaggagaaggccatgcgggcctgggcggaggggatccacctgcgccggctgctggaggaggatccgacggtgcaggcgctgctcacgcctgcggagttggacgccgccttcgacctgaagcaccacctgcgtcatgtggataccatcatgaagcgactggggttgatcgaatga

SEQ ID NO: 3008 - protein, 437 aa, Symbiobacterium thermophilum
MIERYTRPRMAELWSAANRFQKWLEVELLACEAWAKLGVIPAEAVAELRARAFTVDEAFVRRVAEIEQTTRHDVIAFTTAVAERIDHPAARYIHYGLTSTDVVDTALSAVLNEAVREIQKGLDGLIAALGRQAVRYKDTPIMGRTHGVHAEPTSFGLKLAVFYAQFRRDADRLEQARRSIAVGKLSGAVGNYGNIDPFVEQYVCERLGLGVADISTQVLQRDRHAHLLTTLAILGSSLDSLATELRLLQKTETREVEEPFSKGQKGSSAMPHKRNPVTLEQISGLSRILRANAIAALENVPLWHERDISHSSVERVILPDSTILADYLLDKMTWIIENLHVYPENMRRSMQASYGLTSSGSVLLSLVEKGLSREQAYAVVQEKAMRAWAEGIHLRRLLEEDPTVQALLTPAELDAAFDLKHHLRHVDTIMKRLGLIE

SEQ ID NO: 3009 - DNA, 1380 bp, Leifsonia xyli
  CDS (1)..(1380)
atgaccgccctgcctccccagccgttgagccccctagacggacgctaccgcccggcggtgctcggcctcggcgaccacctctccgaggcgggcctcaaccgtgctcgcgttcaggtggaggtcgaatggctcctgtacctcacaaaccaccggatgttcggatcgagtccgctgagcgccgagcaggccggacagctgcgggccctggccgacggcttcggacaggccgagatcgaccggctggccgagctggaggcgaccaccaagcacgatgtcaaagccgtcgagtacctcgttcgtgagcgcctccacacgctcggactggaccacatcgccgaactcacgcacttcgcggcgaccagcgaagacatcaataacctctcctacgcgctcacggtcagcgccgccgtcaacgaggtctggctacccaattaccgcgccgtgatcgccgaattgcgggcgcaggccgctcagcaccgcgacgccgcgatgctcgcgcggacccacggccagcccgcgacgcccaccacgatgggcaaggagctcgcggttttcgcacaccgtctcgaacgcatccgcaagcaggtcgagcagaccgaataccttggcaagttctccggcgcgaccggcaccttcgcagcgcacctcatcgccgatccctccgccgactggctcgcgatctccgaagagttcgtccgcagcctcgggctcgactggaaccccctcaccacccagatcgaatcccacgactggcaggcggagctttacgggcgtatctcacacgccaaccgcgtcctgcacaacctctgcaccgatatctggacgtacatctcgctcggctacttccgccagacgcccgaacccggcgccaccggatcttcgaccatgccgcacaaggtcaacccgatccacttcgagaacgccgaggcgaacctcgaactctccagtgccatcctggactcgctcgcggccaacctggtcacaagccggctccagcgtgacctcaccgactccagcgcgcagcgcaacatcggcgtcgggatcggccactccgtgctcgcgctcgacaacatccagcgcggactcggccagatctcgctcgatgcggacgccctggatgcggacctcgacaccaactgggaggtgctggccgaagccatccagaccgtcatccgcgcggatgtcacagcgggccgctcgaccatcgaagacccgtacgcactgctcaagagcctgacccgcggcaagcgcgtcgaccacgccgcgctgaccgagttcgtcaccggcctcgacatcggcccggcagccaagaaccgtctgctggaactcacaccggcgggctacatcggcctcgcctcgcagctggtcggccgcctctga

SEQ ID NO: 3010 - protein, 459 aa, Leifsonia xyli
MTALPPQPLSPLDGRYRPAVLGLGDHLSEAGLNRARVQVEVEWLLYLTNHRMFGSSPLSAEQAGQLRALADGFGQAEIDRLAELEATTKHDVKAVEYLVRERLHTLGLDHIAELTHFAATSEDINNLSYALTVSAAVNEVWLPNYRAVIAELRAQAAQHRDAAMLARTHGQPATPTTMGKELAVFAHRLERIRKQVEQTEYLGKFSGATGTFAAHLIADPSADWLAISEEFVRSLGLDWNPLTTQIESHDWQAELYGRISHANRVLHNLCTDIWTYISLGYFRQTPEPGATGSSTMPHKVNPIHFENAEANLELSSAILDSLAANLVTSRLQRDLTDSSAQRNIGVGIGHSVLALDNIQRGLGQISLDADALDADLDTNWEVLAEAIQTVIRADVTAGRSTIEDPYALLKSLTRGKRVDHAALTEFVTGLDIGPAAKNRLLELTPAGYIGLASQLVGRL

SEQ ID NO: 3011 - DNA, 1449 bp, Debaryomyces hansenii CBS767
  CDS (1)..(1449)
atgtcagctaacgataaatactccactccattatcttcaagatatgcgtcggatgagatgtccaaaatcttttcgttgaggaacagattctcaacctggagaaagttatggctcaatttagctatcgctgagaaggaagtcggattagacatgatttcagacaaggctattgagcaaatgaaggcacacttggaaatcactgatgaagaaattgaagctgcttccaaggaagacgcaatcgttagacacgacgttatggcccacgttcacgtctttggtaaaacttgtccagatgctgctgggattatccatctaggtgctacctcatgtctcgtcacagacaatgccgatctcaccctcttgagggatgcctacgacgttttgattccaaaattggtcaatgtcattaacagattatctgaatttgcattaaagtataaggatttgccagttttaggatggactcacttccagcctgctcaattgacaactgttggtaagagagctacattgtggattcaagagttgttatgggatttgagaaacatggaaagagctagaaatgatctcgggttgagaggagttaaaggtaccacaggtacacaagcttcattcttgtctttgttccacggtaaccacgaccaagttgaacaattagatgaaagagttgttgaattattaggattcgaccatgtttatccagttactggtcaaacttattctagaaaaattgatattgatgttttatccccattagcgtccttgggtgctactgcgcacaaatttgctactgatatcagattattagctaacttgaaggaagttgaagaaccatttgagaagtcccaaattgggtcttctgctatggcttacaagagaaacccaatgagatgtgaaagagtctgctctttagcaagacacatgggtggtttattaaatgatgccattcagaccgcctccgttcaatggtttgaaagaacattagatgattcagccattagaagaatctcccttccatcagcgtttttaactgctgacattttattatccaccatgaataacatttcctctggattagtcgtctatccaaaggtcattgaaagaaggatcaattccgaattaccattcatggctactgaaaatatcattatggccatggttgaaaagggtgaatctagacaagaatgtcacgaagaaatcagagtcttgtcccaccaagccagtgctgtcgttaagcaagaaggtggtgataatgacttaatccaaagggtcagagccactgaatatttcaagcctatctggaacgagttagatactttgttagacccttccactttcgttggtagagctcctcaacagactgaaaagtttattaataaggacgttgcgaatgctttaaaaaattacaagcatttggttaacgatgaatcagtttccttgaacgtttaa

SEQ ID NO: 3012 - protein, 482 aa, Debaryomyces hansenii CBS767
MSANDKYSTPLSSRYASDEMSKIFSLRNRFSTWRKLWLNLAIAEKEVGLDMISDKAIEQMKAHLEITDEEIEAASKEDAIVRHDVMAHVHVFGKTCPDAAGIIHLGATSCLVTDNADLTLLRDAYDVLIPKLVNVINRLSEFALKYKDLPVLGWTHFQPAQLTTVGKRATLWIQELLWDLRNMERARNDLGLRGVKGTTGTQASFLSLFHGNHDQVEQLDERVVELLGFDHVYPVTGQTYSRKIDIDVLSPLASLGATAHKFATDIRLLANLKEVEEPFEKSQIGSSAMAYKRNPMRCERVCSLARHMGGLLNDAIQTASVQWFERTLDDSAIRRISLPSAFLTADILLSTMNNISSGLVVYPKVIERRINSELPFMATENIIMAMVEKGESRQECHEEIRVLSHQASAVVKQEGGDNDLIQRVRATEYFKPIWNELDTLLDPSTFVGRAPQQTEKFINKDVANALKNYKHLVNDESVSLNV

SEQ ID NO: 3013 - DNA, 1449 bp, Yarrowia lipolytica CLIB99
  CDS (1)..(1449)
atgtccaacaacgactcgtaccagactcccctgtcctcgcgatacgccagcaaggagatgtcgtcgctcttctctatgaagaaccgatactccacctggcgaaagctgtggtacaacctggctgtggccgagaaggagcttggaatcacccagatcaccgacgaggcccttgagcagctcaaggcccaccaggagatcaccgacgacgagatcgccgaggccaccaagcaggaagccattgtgcgtcacgacgtcatgtcccacgtccatgtgtacggactcactgcccccgctgccgctggcatcatccatctgggagccacctcctgctttgtcaccgacaacgccgatcttatcttcctgcgagacggtctggacattctgatccccaagctcgttaacgtcattgaccgactctctcagtttgccctcaagtacaaggatctgcccgttctgggatggacccacttccagcccgcccaactgaccaccgttggtaagcgagccacactctggatccaggagcttctgtgggatctgcgaaacctgcagcgagcccgagacgaccttggtctccgaggtgtcaagggtaccaccggtactcaggcctctttcctgtctctgtttgagggtaaccacgacaaggtcgagcagcttgacgagcgagtcgttgagctccttggcttcgactacgcctacccctgcactggacagacctactctcgaaagattgatgtcgacgtccttgcccctctcgcctctctcggctgcactgcccacaagttcgccaccgacgtgcgtctccttgccaacctcaaggagatggaggagcctttcgagaagtcccagatcggatcatctgccatggcctacaagcgaaaccccatgcgatccgagcgaatctgctctctgtctcgacacctgcagtcttgtttccaggacgcaactcagaccgcttctgtccagtggttcgagcgaactctcgatgactctgctattcgacgagtctctcttcccggcgccttcctcaccgccgacattgttctgtccactcttctgaacgttgtctctggtctggtcgtctaccccaaggtcattgagcgacgaattgccgccgagcttcctttcatggccactgagaacatcatcatggcaatggtccagcgaggaggagaccgacagcagtgccacgaggagatccgagttctttctcaccaggccgcccaggttgtcaaggagcagggaggagataacgatcttattgagcgaatcaagaacaccccctacttcaagcccgttcacgacgaccttgacaagctgctcgatccctctactttcgtcggccgagcacccgagcagaccgaaaagtttgtcaacaagactgttgccaaggctctagagccttacaagaagatgatcaaccaggagggcttccagcttgctgtctaa

SEQ ID NO: 3014 - protein, 482 aa, Yarrowia lipolytica CLIB99
MSNNDSYQTPLSSRYASKEMSSLFSMKNRYSTWRKLWYNLAVAEKELGITQITDEALEQLKAHQEITDDEIAEATKQEAIVRHDVMSHVHVYGLTAPAAAGIIHLGATSCFVTDNADLIFLRDGLDILIPKLVNVIDRLSQFALKYKDLPVLGWTHFQPAQLTTVGKRATLWIQELLWDLRNLQRARDDLGLRGVKGTTGTQASFLSLFEGNHDKVEQLDERVVELLGFDYAYPCTGQTYSRKIDVDVLAPLASLGCTAHKFATDVRLLANLKEMEEPFEKSQIGSSAMAYKRNPMRSERICSLSRHLQSCFQDATQTASVQWFERTLDDSAIRRVSLPGAFLTADIVLSTLLNVVSGLVVYPKVIERRIAAELPFMATENIIMAMVQRGGDRQQCHEEIRVLSHQAAQVVKEQGGDNDLIERIKNTPYFKPVHDDLDKLLDPSTFVGRAPEQTEKFVNKTVAKALEPYKKMINQEGFQLAV

SEQ ID NO: 3015 - DNA, 1449 bp, Kluyveromyces lactis NRRL Y
  CDS (1)..(1449)
atgtctgattacgataagtacaccacaccactatcttctcgttatgcttctgaggagatgtcttccatattctctttgagaaacagattctctacctggagaaagctttggttgaatttggctattgctgaaaaggaattaggtcttgatgtcattagtgaagaagccattgagcaaatgaaggctcatttgaccatcaacgatgaagaaatcgctgctgcttccaagcaagaggccattgtcagacacgatgttatggctcacgttcacacttttggtgaaacttgtcctaaagccgctggtatcatccatctaggtgctacctcatgttttgtcaccgataatgctgacttgatcttcttgagagatgcttacgatatcttgattcctaagttggtcaatgttatcaacagattgtccaagtttgctttggagtacaaggatctaccagtattgggctggactcatttccaaccagctcaattgactaccttgggtaaaagagtcacattgtggatccaagaactattgtgggatctaagaaactttgtcagagctagaaacgatatcggtctacgtggtgtcaagggtaccaccggtacccaagcttctttcttaactttgttccatggtgatcacgacaaagtggaagctttggacaagagagttgctgaactattgggattctctactgtctacccagttaccggtcaaacttattctagaaagattgatatcgacgtgttggctccattatcctcatttgcagctactgctcacaagatggcgactgatatcagattattggctaacttgaaggaattggaagaaccgttcgaaaaatctcaaattggttcctctgccatggcttacaagagaaacccaatgcgttgcgaacgtgtgtgttctcttgccagacatttgggttctttgttcaacgatgccgtacaaaccgcgtcagtgcaatggtttgaaagaactttggatgactctgccatcagaagaatctctttgccaagtgctttcttgaccgcagacattctactatccactttgctaaacatctcttccggtttagtcgtttatccaaaggtcatcgaaagaagaattatgggtgaattgccattcatggccactgaaaatattatcatggccatggtcgagcacggtgcatccagacaagaagttcatgaagctatcagagtgctatctcaccaagctgccgctgtcgtcaaggaacaaggtggtgacaacgacttgatcgaacgtgtgagacaggacaagttcttcgaacctatctggaatgaattggactcattgttggagccatccacctttgtcggtagagctcctcaacaagttgagaagttcgttgccaacgatgtcaaacaagcgttggctgctttccaaaatgatatcactgatgtcgaagttaagctaaacgtttaa

SEQ ID NO: 3016 - protein, 482 aa, Kluyveromyces lactis NRRL Y
MSDYDKYTTPLSSRYASEEMSSIFSLRNRFSTWRKLWLNLAIAEKELGLDVISEEAIEQMKAHLTINDEEIAAASKQEAIVRHDVMAHVHTFGETCPKAAGIIHLGATSCFVTDNADLIFLRDAYDILIPKLVNVINRLSKFALEYKDLPVLGWTHFQPAQLTTLGKRVTLWIQELLWDLRNFVRARNDIGLRGVKGTTGTQASFLTLFHGDHDKVEALDKRVAELLGFSTVYPVTGQTYSRKIDIDVLAPLSSFAATAHKMATDIRLLANLKELEEPFEKSQIGSSAMAYKRNPMRCERVCSLARHLGSLFNDAVQTASVQWFERTLDDSAIRRISLPSAFLTADILLSTLLNISSGLVVYPKVIERRIMGELPFMATENIIMAMVEHGASRQEVHEAIRVLSHQAAAVVKEQGGDNDLIERVRQDKFFEPIWNELDSLLEPSTFVGRAPQQVEKFVANDVKQALAAFQNDITDVEVKLNV

SEQ ID NO: 3017 - DNA, 1365 bp, Erwinia carotovora
  CDS (1)..(1365)
atggcatcacatcttattgattttcttcttatagggaataattttggcacgcctgaaatgcgcggcgtctggtccgagcataaccgtctgactaagcaggtcgaggtagaagttgccttggcgcttgccgagggtgaactgggtgtcattccgctggatgcggcaaaaaccattgcagaaaacgctgacgcaagcgcgcttaacgttgaagagattgcaaaagatgcggcacgcatgaagcactccctgatgccgacgattgcagcgattcagagacaatgtggcgcggcgggtgaatttattcattacggcgtgaccacgcaggacatcgttgataccgcgacagtgttacaactgaaacaatcttttgatattgtcgtcagagatacacaactgctggccgttgaactgaaacgtttggcgaagaaacatcaacacacgctgatggctggccgtacccacggcatgcaagcgctgcccaccacgtttggcttcaaactggctgtctggctggatgaatttatccgtcacctcgaacgcctgggtgaaatcaaagagcgtgttttggtcggcaacatcaatggtgccatttgtacctatgcctcttttggcgagaaagggccagaaattgagcgcctgacgctggataaactggggctgaatacaccgaatatcggctggcagtctgcccgcgatcgcttctccgaatatgcctccgttacggttctgatcagcggtacgctgggcaagattggcaacgagctgtacaacctgatgcgcaccgagattaatgaaatcgaagagccgttctctgaagggaaaatcggttctaccacgatgccgcacaaacgtaaccctgccgcgttggaagggctggcgagcttgactgcaccgctgtttaagagcgccgcgctgattcacgaatccatgaaagttgagcatgaacgtgatgcgatgagctggcgtgcagagtggatcgcgctgccagaaatcaacatctatctgtctgctcagcttcagaatgcgcttggcatcctgcgtggaatgtccgtcaacgagaagcaaatgctggcgaacctcgatctgcaaaatggcctgttgttatccgagaaagtgatgtttgagattggcaaacgtctcggtaagcagaccgcccaccatctggtttacgaatgctctatgcaggcattcgagcagaatcagccttttaaatcggtactgttggcgcatccagtcctttccgagcaggtgactgccgccgatctggacgaatggctgaacccagccaactacgtcggcagtgcaccgcagaaagtcgatgaggtgattcgctatgcggataactccggtctgctgccagcataa

SEQ ID NO: 3018 - protein, 454 aa, Erwinia carotovora
MASHLIDFLLIGNNFGTPEMRGVWSEHNRLTKQVEVEVALALAEGELGVIPLDAAKTIAENADASALNVEEIAKDAARMKHSLMPTIAAIQRQCGAAGEFIHYGVTTQDIVDTATVLQLKQSFDIVVRDTQLLAVELKRLAKKHQHTLMAGRTHGMQALPTTFGFKLAVWLDEFIRHLERLGEIKERVLVGNINGAICTYASFGEKGPEIERLTLDKLGLNTPNIGWQSARDRFSEYASVTVLISGTLGKIGNELYNLMRTEINEIEEPFSEGKIGSTTMPHKRNPAALEGLASLTAPLFKSAALIHESMKVEHERDAMSWRAEWIALPEINIYLSAQLQNALGILRGMSVNEKQMLANLDLQNGLLLSEKVMFEIGKRLGKQTAHHLVYECSMQAFEQNQPFKSVLLAHPVLSEQVTAADLDEWLNPANYVGSAPQKVDEVIRYADNSGLLPA

SEQ ID NO: 3019 - DNA, 1350 bp, Erwinia carotovora
  CDS (1)..(1350)
atggcttcgaatgtgcttgattcagttctattccgtgattcatttggtaccccagcaatgcgggcaatcttcgatgaccgagaactcgtccgtaagtatgtggaagtagagatcgcactggccaatgcgcaagcacgttgtggcgtgattccagaagaagctgccgcagaaatcacagccagctgtaacgccgacacgctcgattttgagctgctgcgccacgaaacagaaattgtgggctaccctatcctgccgctagtacaccagatttccaagcaggccggccaatctggcggctatgtacactggggcgcaacgacacaggacattatggatacggccgtggtgctacaaatccgtgatgcattcgcgttaattgaagcagatatcgacgcactacgttctattttagccagactggccgtgcgttaccgcaatacgccaatggctgggcgtacccatttacaacaggcgctaccgattacattcggctacaaagcggccatctggctagatatgttcgatcgccatgccgagcgcctcgcacagctacgtcctcgcgtgctggtgggagagttcgcgggtgcagcagggacactcgcctcattgggtgacaaagggctcgcggtgcaaaaagcactgatggcagagcttggactgggtgtaccgacctcaacctggcatgtggctcgtgatgggtttgccgaagccgtcaacctgctagcggtaatcaccggttcattagggaaaattggctatgacgtcatgctgatggcctccaacgaattcggcgaactgtatgaaccgtttgtcaaaggccgtggagccagcagcaccatgccgcaaaagcgtaaccctatttccagcgaactgatgctggcctgttccaaaggcgttcgtcaacaggctgggttaatgctggatgcgatggtgcaagatctggaacgcgccacaggcccctggcatgcggagtggatcgccatcccggaaagtttcattctctccgcaggcgcacttcatcaagccaagttcatgctagacggcctcattgttgatgagaagatgatgctgaaaaacctcaatatgaccaacggcctgattgtggcagaagccgttatgatggggctggcaccgtatattggtcgtcaggaagcgcatgacatcgtctacgatgcctgccgtatcgtaaatgagaaaggtggcacgctggccgatgttctcaatgctatgccaagcgtcgcaagccgcctcgatcccaaattaatcgaagacctgaccaaccccgtcaactatttggggagcgcgcctgaaatggttgaccaggtagtaaataaaatggaaagaaaatag

SEQ ID NO: 3020 - protein, 449 aa, Erwinia carotovora
MASNVLDSVLFRDSFGTPAMRAIFDDRELVRKYVEVEIALANAQARCGVIPEEAAAEITASCNADTLDFELLRHETEIVGYPILPLVHQISKQAGQSGGYVHWGATTQDIMDTAVVLQIRDAFALIEADIDALRSILARLAVRYRNTPMAGRTHLQQALPITFGYKAAIWLDMFDRHAERLAQLRPRVLVGEFAGAAGTLASLGDKGLAVQKALMAELGLGVPTSTWHVARDGFAEAVNLLAVITGSLGKIGYDVMLMASNEFGELYEPFVKGRGASSTMPQKRNPISSELMLACSKGVRQQAGLMLDAMVQDLERATGPWHAEWIAIPESFILSAGALHQAKFMLDGLIVDEKMMLKNLNMTNGLIVAEAVMMGLAPYIGRQEAHDIVYDACRIVNEKGGTLADVLNAMPSVASRLDPKLIEDLTNPVNYLGSAPEMVDQVVNKMERK

SEQ ID NO: 3021 - DNA, 1371 bp, Erwinia carotovora
  CDS (1)..(1371)
atggaattatcctcactgaccgccgtttcccctattgatggacgctacggcgataaagtcagcacattgcgcaccattttcagcgaattcggtttgctgaaattccgtgtgcaggttgaagtacgttggttgcaaaaactggcagcctgtgcagagatccaggaagttcctgcatttgacgctgacgcaaacgctttccttgataaaattgtcgccgaatttagcgaagaagatgcggcccgcattaaaacgatcgagcatacgaccaaccacgatgtgaaagccgttgagtattttctgaaagagaaagtcgctgctattccagcactgcatgccgttaacgaattcatccacttcgcctgtacctcagaagacatcaacaacctgtctcacgcactgatgctggataccgctcgccgcgacgtcatcctgccgcactggcgtcaaattattgatgcgctgaaaacgctggcacaggaataccgcgatatcccgctgctttcccgtacacacggtcagccagccacgccatccaccatcggtaaagagttcgctaacgtggcttaccgtatggagcgccaatatcgtcagctacaacaggttgagattctgggcaaaattaatggtgctgtcggcaactataatgcccatctggcagcctacccggaagtggactggcaccagttcagcgaaagctttgtcacgtcactgggtatcaactggaacccgtacaccacacagatcgaaccgcacgattacatcgccgagctgttcgactgcatcgcacgtttcaacaccattttgatcgactttgaccgtgatatctggggctacatcgcactgaatcacttcaaacaaaaaaccattgcgggcgaaatcggttcctctaccatgccacataaggttaacccgattgacttcgaaaactcggaaggcaatctggggctgtcgaacgccgtactggcgcacctggctagcaaattgccggtttctcgctggcagcgcgaccttaccgactctaccgtgctgcgaaacttaggcgtgggtgtgggctatgcactgattgcgtatcaggccacgatgaaaggcatcagcaaactggaagtgaaccgcgatcgtctggctgacgaactggatcacaactgggaagtgttggcagagccgattcaaaccgtgatgcgccgctacgggattgaaaaaccgtacgagaaactgaaagaactgacacgcggcaaacgtattgatgcgacgggtattcaggcatttatcgatggtctggaattacctgaagcggaaaaaacgcgtctgaaagcgatgacgccagccaactatattggccgcgctatcgccatggtcgatgacctgaaataa

SEQ ID NO: 3022 - protein, 456 aa, Erwinia carotovora
MELSSLTAVSPIDGRYGDKVSTLRTIFSEFGLLKFRVQVEVRWLQKLAACAEIQEVPAFDADANAFLDKIVAEFSEEDAARIKTIEHTTNHDVKAVEYFLKEKVAAIPALHAVNEFIHFACTSEDINNLSHALMLDTARRDVILPHWRQIIDALKTLAQEYRDIPLLSRTHGQPATPSTIGKEFANVAYRMERQYRQLQQVEILGKINGAVGNYNAHLAAYPEVDWHQFSESFVTSLGINWNPYTTQIEPHDYIAELFDCIARFNTILIDFDRDIWGYIALNHFKQKTIAGEIGSSTMPHKVNPIDFENSEGNLGLSNAVLAHLASKLPVSRWQRDLTDSTVLRNLGVGVGYALIAYQATMKGISKLEVNRDRLADELDHNWEVLAEPIQTVMRRYGIEKPYEKLKELTRGKRIDATGIQAFIDGLELPEAEKTRLKAMTPANYIGRAIAMVDDLK

SEQ ID NO: 3023 - DNA, 1299 bp, Mesoplasma florum
  CDS (1)..(1299): transl_table=4
atgataaaaagatattctgtaaataagatagaaaagatttgagacgaaaacaataaattaaatgtttgacttgatgtagagaaaaaagtaacttttgcatgaatgaaattaaatgttatttcaaaagaagaatatttgctaattgataaaaatgcaaaaataaacattggtagaatgctagaaatagaaaatgaaacacgtcatgatgttgttgcgtttactagagctatttctgaaacactaggtaatgaaaaaaaatgaattcatcttggtctgacttcaactgatgttgttgatacagcacaaaacaaattaatacaagaatctaatgaagttgttttagagtcattaataaacttaaaaaatacattaaaagagaaagcattaatctataaaaaaactttaacaatgggaagatctcatggtatttatggtgaaccaacttctttaggacttaaatttttattatgatttgatgaaatagacagacaaattgaaagattttcattagccagaaaacaaattgaagtagcgaaaatatctggctcaatgggaaactacgctaatttagaatttgaaatagaagaaattgttgcagaacaaatgggtttagggattgataatatatcaactcaagtaactcaacgtgatagacatgcatttttgataagtgtatttgccaacattgcatctactcttgaaaaaattgctactgaaataagattatttcaaagaagtgaagttaaagaatggcatgaaggttttaaagcaaatcaaaaaggatcaagctcaatgcctcataaaaaaaatccaataagttctgaaaatataactggtctttcaagatacttaagatcatttactaatacagcttttgaaaataatgtgttatgacatgaaagagatatttcacatagttctaatgaaagaattatttttagtgatgtattcaatgttttagtttacacattagatagattaaaaaatacattagacgatttagtaatagatgaaaataaaatgttagaacacattaattctcagtttaatgttttttacagtcaaccaatattaaattaccttcttattaattgcgataaatcaagagaagaaatatatgattttattcagaaatgtacttttgaaacaatgaataataaagtagactttaaacaatctttaattaataacggtatagaaaaatatattgataatatagaagtattaaataaactttttaatattgattacttcataagaaatgttgagaagatatataacagaacattaaataaataa

SEQ ID NO: 3024 - protein, 432 aa, Mesoplasma florum
MIKRYSVNKIEKIWDENNKLNVWLDVEKKVTFAWMKLNVISKEEYLLIDKNAKINIGRMLEIENETRHDVVAFTRAISETLGNEKKWIHLGLTSTDVVDTAQNKLIQESNEVVLESLINLKNTLKEKALIYKKTLTMGRSHGIYGEPTSLGLKFLLWFDEIDRQIERFSLARKQIEVAKISGSMGNYANLEFEIEEIVAEQMGLGIDNISTQVTQRDRHAFLISVFANIASTLEKIATEIRLFQRSEVKEWHEGFKANQKGSSSMPHKKNPISSENITGLSRYLRSFTNTAFENNVLWHERDISHSSNERIIFSDVFNVLVYTLDRLKNTLDDLVIDENKMLEHINSQFNVFYSQPILNYLLINCDKSREEIYDFIQKCTFETMNNKVDFKQSLINNGIEKYIDNIEVLNKLFNIDYFIRNVEKIYNRTLNK

SEQ ID NO: 3025 - DNA, 1389 bp, Acinetobacter sp
  CDS (1)..(1389)
atgaacgctttaactgccctctctccattagatggacgttatgccagcaaatgtgatgctttacgcccttttctttctgagtttggtttaatccatgctcgtgtgactgttgaagtacgctggttacaagcgctctctaaccatgcagggatcattgaagtcgctcctttttctacagaaaccaatgctgctttagattcaattgtggcaaatttttctgaagatgatgcaaatcgtattaaagaaatcgaacgcaccaccaatcatgatgtaaaagccgttgagtattttcttaaagagaaaatcgcaggtctggatgaattaaaaaatgcaggtgaattcattcactttgcatgtacctctgaagacatcaataacttgtctcatgctttgatgcttaaaaatggtcgtgaagttctggtttcaagcatgaaacagattctaaatgcaattgcagccttagccactacacatgctgaacaaccaatgttgtcacgtacacatggtcaaactgcaagcccgacaacactgggcaaagaaatggcaaacgtcgcctatcgtttggcacgtcagattaaacaatttgaaaatgtcgaattgcttggcaaaatcaatggtgctgtcggtaactacaatgcgcacctttctgcttatccagatattgattgggctgcgcattcacaagcatttgtggaatctttaggtttaacctttaacccatataccactcaaattgaaccacacgactatatggcggaattgttcgatgcattgcgtcgttacaacacaattctgatcgattttaaccgcgatgtatggggttatatttctttaggttacttcaaacaaaaactgaaagatggtgaagtgggttcttcaacgatgccacataaagttaacccgattgattttgaaaactctgaaggtaacttaggcattgcaaatgctgtattaggccatttgggtgaaaaacttccagtttctcgctggcagcgcgatttaacagactcgactgtactgcgtaatatgggtgttggctttgcacaaagcctgattgcttttgatgcttgcctaaaaggaattggtaaactagagctcaatgcagctcgtcttgcagaagatctcaatcaagcacaagaagtcttggctgaaccaattcaaactgttatgcgtcgttacaatgttgaaaaaccttatgaaaagttaaaagcattaacacgtggtcaagcaatgacgcgcgacatgatggttaactttgtaaacggtgatgaacttagtcaggtacctgccgaagaacgtgcacgcttagcagaaatgacaccagccagctatacaggtaacgctgcagatcaagcaaaacagatcaatgatttgatcaataaaatttaa

SEQ ID NO: 3026 - protein, 462 aa, Acinetobacter sp
MNALTALSPLDGRYASKCDALRPFLSEFGLIHARVTVEVRWLQALSNHAGIIEVAPFSTETNAALDSIVANFSEDDANRIKEIERTTNHDVKAVEYFLKEKIAGLDELKNAGEFIHFACTSEDINNLSHALMLKNGREVLVSSMKQILNAIAALATTHAEQPMLSRTHGQTASPTTLGKEMANVAYRLARQIKQFENVELLGKINGAVGNYNAHLSAYPDIDWAAHSQAFVESLGLTFNPYTTQIEPHDYMAELFDALRRYNTILIDFNRDVWGYISLGYFKQKLKDGEVGSSTMPHKVNPIDFENSEGNLGIANAVLGHLGEKLPVSRWQRDLTDSTVLRNMGVGFAQSLIAFDACLKGIGKLELNAARLAEDLNQAQEVLAEPIQTVMRRYNVEKPYEKLKALTRGQAMTRDMMVNFVNGDELSQVPAEERARLAEMTPASYTGNAADQAKQINDLINKI

SEQ ID NO: 3027 - DNA, 1449 bp, Candida glabrata CBS138
  CDS (1)..(1449)
atgtctgagtttgataagtacgctaccccactatcgtccagatatgcttctaaggagatgtctgctgttttctctttgagaaacaggttctctacatggagaaagttatggttgaatctagccattgctgaaaaggaattaggtcttgatgtcattacagatgaggccattgaacaaatgaaggcccacttggaaattacagatgaagaaattgccaaggctagtgaacaagaagctattgtcaggcatgatgttatggcccatgttcatacatttggtgaaacatgtcctgctgcggctggtatcatccacttgggtgccacttcttgttttgtcacagacaatgccgatttaatcttcctaagagatgcatacgatattgttattccaaaactcgtcaatgttatcaaccgtttagctaaatttgctctagagtacaaggacttaccagttctgggttggactcacttccaaccagctcaattaactactttgggtaagagagcaactctatggatccaagaactactatgggatttgagaaactttgaaagagctagaaatgatattggtttgcgtggtgttaaaggtaccactggtacacaagcgtcattcttggccctatttcacggtaatcatgacaaagttgaagaacttgatgaaagagttactgaacttctaggctttgacactgtttatccagtcactggtcaaacttactccagaaagatcgacattgatgttcttgcaccattatcatcatttgctgccagtgcccacaagatggctaccgatatcagactgctagccaacttgaaggaagttgaagagccatttgaaaaatcccaaattggttcttcagcaatggcttataagagaaacccaatgcgttgtgaacgtgtttgttctttggctagacatttgggctctctattcagtgatgctgtccaaactgcttccgtccaatggttcgagagaacattagatgactcagctataagaagaatctctttaccaagtgctttcctaacaacagatatcttgttgactacaattctaaatatctcttcaggtttagttgtatatccaaaggtaattgaaagaagaattaagagtgagttgccattcatggctactgagaatatcattatggctatggtcgaaaagggtgcttctaggcaagaagtgcatgaagaaatcagagtcctgtctcaccaagctgctgctgtggtaaaagaacaaggtggtgacaatgacctgatcgaacgtgtcaaggccaatgagtttttcaagcctatctggaatgaattggatcaattgctagatccatctacatttgttggtagagctcctcaacaaacagaaaaatttgttggtaaggatgttaagaacgccttgcagccattccaaaaatacatcaacgatgctgaagttaaactaaatgtttga

SEQ ID NO: 3028 - protein, 482 aa, Candida glabrata CBS138
MSEFDKYATPLSSRYASKEMSAVFSLRNRFSTWRKLWLNLAIAEKELGLDVITDEAIEQMKAHLEITDEEIAKASEQEAIVRHDVMAHVHTFGETCPAAAGIIHLGATSCFVTDNADLIFLRDAYDIVIPKLVNVINRLAKFALEYKDLPVLGWTHFQPAQLTTLGKRATLWIQELLWDLRNFERARNDIGLRGVKGTTGTQASFLALFHGNHDKVEELDERVTELLGFDTVYPVTGQTYSRKIDIDVLAPLSSFAASAHKMATDIRLLANLKEVEEPFEKSQIGSSAMAYKRNPMRCERVCSLARHLGSLFSDAVQTASVQWFERTLDDSAIRRISLPSAFLTTDILLTTILNISSGLVVYPKVIERRIKSELPFMATENIIMAMVEKGASRQEVHEEIRVLSHQAAAVVKEQGGDNDLIERVKANEFFKPIWNELDQLLDPSTFVGRAPQQTEKFVGKDVKNALQPFQKYINDAEVKLNV

SEQ ID NO: 3029 - DNA, 1320 bp, Bartonella quintana
  CDS (1)..(1320)
atgatagaacgttattctcgccctgaaatggtaacaatttggtcacctaaaacgaaatatcgcatttggttcgaaattgaagcacatgcctgtgatgccctcgctcaactgggtattattccaaaagaagcagcaaaggtgatttgggaaaaaggagcagcagccgaatttgatgttaatcgcattaatgaaattgaggcgatcaccaaacatgatgttatagcatttttaacgcacttaggtgaatttattggcccagaagctcgctttatccaccaaggcatgacatcatcagatgtcctagatacaacacttaatattcaattgatgcgtgcgagtgatattttgctaaaagacatagatcagcttcttgaagcattgaaaaaacgtgcttttcaacataaagaaacaatcactattgggcgtagtcacggtattcatgctgaaccgacaacatttggagtcaaatttgctcttgcatatgctgaattttctcgttgtcacaaccgtcttcttgctgcacgagaagaaatttctacttgtgctatctcaggagctgtaggaacttttgctaatattgatccatatattgaagaacatgtagcaaaagcgttagggttacgcattgaacctgtttccacccaagttataccacgtgatcgtcacgccatgttctttgcaacgcttggtgttattgcttcatccattgaaagattagccatagaaatacgccatttgcaacgaacagaagttcttgaagcagaagaacatttttcacctggacaaaagggatcatccgccatgccccataaacgtaatccagttttaacagaaaatttaactgggttagcacgcatggtgcgtgcctttgcaatacctgccatggaaaatgtagcactttggcatgaacgtgatatttctcattcatccgttgaacgttatattggccctgatgctaccattactcttgattttgctcttgctcgactgacctacgtaattgaaaatttaattgtctatccagaaaatatgcaaaaaaatctcaataaatttcgtggtcttgttcattcacaacgggtgcttttagcacttacacaagctggaatcagtcgtgaagattcttatcggattgtacaacgaaatgcgatgaaagtttgggaacaaggaaaagactttttagaagaattgctcaacgacaaagatgtaacaaaagcattaagtaaagcagaaatttgcgaaaaatttgacctttcttaccatacaaaacatatcgacacgatttttaaacgcgtctttgagagtgacaaaaattgtatataa

SEQ ID NO: 3030 - protein, 439 aa, Bartonella quintana
MIERYSRPEMVTIWSPKTKYRIWFEIEAHACDALAQLGIIPKEAAKVIWEKGAAAEFDVNRINEIEAITKHDVIAFLTHLGEFIGPEARFIHQGMTSSDVLDTTLNIQLMRASDILLKDIDQLLEALKKRAFQHKETITIGRSHGIHAEPTTFGVKFALAYAEFSRCHNRLLAAREEISTCAISGAVGTFANIDPYIEEHVAKALGLRIEPVSTQVIPRDRHAMFFATLGVIASSIERLAIEIRHLQRTEVLEAEEHFSPGQKGSSAMPHKRNPVLTENLTGLARMVRAFAIPAMENVALWHERDISHSSVERYIGPDATITLDFALARLTYVIENLIVYPENMQKNLNKFRGLVHSQRVLLALTQAGISREDSYRIVQRNAMKVWEQGKDFLEELLNDKDVTKALSKAEICEKFDLSYHTKHIDTIFKRVFESDKNCI

SEQ ID NO: 3031 - DNA, 1305 bp, Bartonella henselae
  CDS (1)..(1305)
atgatagcacgttattcccgccctgaaatgataacaatttggtcacccgaaacgaaatatcgtatttggtttgaaatcgaagcacatgcctgtgatgccctagctcaactgggtattattcccaaagaagcagcaaaggtaatttgggaaaaaggaaaagcagccaaatttgatattaatcgcattaatgaaattgaggcaatcaccaagcatgatgttatagcatttctgacccacttagctgaatttattggaccagaagcacgttttgttcaccaaggcatgacatcatcggatgttctagataccacgcttaatattcagttgatgcgtgccagcgatattctgctaaaagacatagatcaacttctagaagcattaaaaaaacgtgcttttgaacataaagagacaatcaccattgggcggagtcatggcattcatgctgaaccaataacatttggagtcaagttcgctcttgcatatgctgaattttcaagatgtcgcaaacgtcttcttgctgcacaggaagaaatttctacttgtgctatttcaggagctgtaggaacttttgcaaatattgatccacgcgttgaagagcatgtagcaaaagcattgggattgcgtgctgaacctgtttccacccaagtgataccacgcgatcgtcacgccatgttctttgcaacgcttggtgttattgcttcatctattgaaagattagctatagaaatacgccatctacaaagaacagaagttttggaagcagaagagtatttttcaccagggcaaaaaggttcatcggctatgcctcataaacgtaatcctgttttaacagaaaatttaacgggattagcgcgtatggtgcgtgcatttgcaatacctgccatggaaaatgtagcactttggcatgaacgtgatatttctcattcctctgttgagcgttatattggccctgatgcgactattacacttgactttgctctcgctcgactcacatctgtcattgaaaatttaattgtctatccagaaaatatgcaaaaaaatctcaataaatttcgaggacttgttcattcacaacgggtgcttttagccctcacacaagctggaataagccgcgaagattcttatcggatcgtacaacgaaacgcgatgaaagtttgggaacaagaaaaagattttttagaagaattgcttcacgacaaagatgttacagaagctttaagtgaaacagaacttcgtgaaaaatttgacctttcttaccacaccaaacatatcaacacgatttttaaacgcgtttttggggaataa

SEQ ID NO: 3032 - protein, 434 aa, Bartonella henselae
MIARYSRPEMITIWSPETKYRIWFEIEAHACDALAQLGIIPKEAAKVIWEKGKAAKFDINRINEIEAITKHDVIAFLTHLAEFIGPEARFVHQGMTSSDVLDTTLNIQLMRASDILLKDIDQLLEALKKRAFEHKETITIGRSHGIHAEPITFGVKFALAYAEFSRCRKRLLAAQEEISTCAISGAVGTFANIDPRVEEHVAKALGLRAEPVSTQVIPRDRHAMFFATLGVIASSIERLAIEIRHLQRTEVLEAEEYFSPGQKGSSAMPHKRNPVLTENLTGLARMVRAFAIPAMENVALWHERDISHSSVERYIGPDATITLDFALARLTSVIENLIVYPENMQKNLNKFRGLVHSQRVLLALTQAGISREDSYRIVQRNAMKVWEQEKDFLEELLHDKDVTEALSETELREKFDLSYHTKHINTIFKRVFGE

SEQ ID NO: 3033 - DNA, 1356 bp, Picrophilus torridus
  CDS (1)..(1356)
atgattatttctccaatagattatagatacggcagggataatgtaaaatacatattttctgaggagaacaggatgagacttatgttaagggttgaggctgcacttgcacaggccgagtatgaatataatataattagcagggatgcctttcttgacattaaaaatgcggtcgattcaaattccgtgagaattgaaagggttcatgaaatagagtcaagaatacatcatgatacaatggcacttgttgaggcactcacagagcagtgcagcgcaggaaaaaattttgttcattttggtgtaacatcaaatgatattattgatactgcaacagcaatgcagataaaatcagcagtaaaaataataaaagacgatataaaaaatcttatgaaaacattgataaaactaatagatgagaacaaggactcggtcatggttggaagaacgcatgggcagcacgcaagcccaataaccttcggccttaaattatctgtataccttgatgaaatgtccaggcatttaaaacgtttaacagaggccggggatagaatagtggccggaaagatatcaggacctgttggcaccggtgcatcccttggaaaggattcaatagagatacagaacagggtatgcgagatacttggaataaaaagcgagattgcatcctcgcagatcgtctgcagggacaggtacatagagtatttatcaattataaataatattgcaacatcacttgaaaagttcgcaaccgagataagaaaccttcaaaggcctgagataaatgaggtctctgaatacttcgatgagcgatcacaggttggttcaagctcaatgccaagcaagaggaatccaatagtttctgagaatatatcaagcctgtgcagattcataaggtcattaataataccagaatatgaggctgcggttatatggcacgaacgtgatcttgcaaacagtgctcttgaaagattcacgataccatacgcctctgtgcttattgattacgttttatataacatgaacgatgtgttctcacatctatatataaacaaagaggagatgcttagaaaggcaagatccgatgagtttataatgtccgaaagtatagtgagggcattaacgttgagtggcatgccaaggcaggaggcgcatgaatttgtaagaaaagcttctatggaggcctataaaaataataaatctttaaaatcatctctaatttcagcaggtgtattgaaatacattgatgaaaaaacacttgaggctgccatggatcctgttaaattcacagggcaggccgttagtatatgtaataacgtaataaataatgcggaaagggtgatgaaagacgcagatgaataa

SEQ ID NO: 3034 - protein, 451 aa, Picrophilus torridus
MIISPIDYRYGRDNVKYIFSEENRMRLMLRVEAALAQAEYEYNIISRDAFLDIKNAVDSNSVRIERVHEIESRIHHDTMALVEALTEQCSAGKNFVHFGVTSNDIIDTATAMQIKSAVKIIKDDIKNLMKTLIKLIDENKDSVMVGRTHGQHASPITFGLKLSVYLDEMSRHLKRLTEAGDRIVAGKISGPVGTGASLGKDSIEIQNRVCEILGIKSEIASSQIVCRDRYIEYLSIINNIATSLEKFATEIRNLQRPEINEVSEYFDERSQVGSSSMPSKRNPIVSENISSLCRFIRSLIIPEYEAAVIWHERDLANSALERFTIPYASVLIDYVLYNMNDVFSHLYINKEEMLRKARSDEFIMSESIVRALTLSGMPRQEAHEFVRKASMEAYKNNKSLKSSLISAGVLKYIDEKTLEAAMDPVKFTGQAVSICNNVINNAERVMKDADE

SEQ ID NO: 3035 - DNA, 1368 bp, Photobacterium profundum
  CDS (1)..(1368)
atggaactgtcagctctgactgctgtttccccggtcgacggccgttacggaagtaaaacaagtgtacttcgcagcattttcagcgaatttggtctgttaaaataccgcactatcgttgaaatccgttggctacaaaagctggctgcaactgatgctatcgtagaagttcctgcatttagtgacgaagcaaatcaatttttagatcgtgttgctgctgagtttagtgaagaagatgcactgcgcattaaagctattgagcgcacaactaaccacgacgttaaagcggttgaatacttcctaaaagagaaagtagcagagcttcctgaactacacgctgtgaatgaattcattcactttgcatgtacatcagaagacatcaacaacctttctcacgctcttatgctgactgaagcgcgtgaaaaagtaatgttacctgaagtacgtaacgttattgattctattaaaacgcttgcaaatgagtaccgcgaaattccattgctttcacgtacacacggtcagcctgcttctccatctacgatgggtaaagaaatggctaacgttgcgtaccgtatggaacgtcaattcaagcaaatcgaaaacgttgaaattcttggtaaaattaacggcgcagtaggtaactacaacgcacacgttattgcttaccctgaagttgactggcaccagtacagcgaagagtttgtaacgtcgctaggtattacttggaacccatacacaactcaaattgaaccgcatgactacatcgcagagttgttcgatggttttgctcgtttcaacacaattcttttagactttgaccgtgacgtatggggctacattgctctaggtcacttcaagcaaagaacaattgcaggtgaaattggctcttcaacaatgccgcataaagttaaccctatcgacttcgaaaactctgaaggcaatctaggcttagcgaatgcaatcttctcgcacctatcacagaaactaccggtttctcgctggcagcgtgaccttactgactcaacagtgcttcgtaacctaggtgttggttgtggttatgcaatcattgcttatacttcgacgctaaaaggtattagcaagcttgaagttaaccgagcagcgctagaagctgaactagacaaaaactgggaagtattggctgaaccagtacaaacagtaatgcgtcgctacgctatcgaaaagccatatgagaagctaaaagagctaactcgtggcaaacgtgttgatggcgaaggtatgcgtaactttattgacagccttgagcttcctgagcacgagaaaacgcgtcttaaagaaatgacaccggctaactacatcggtgatgcagtgaagctaacagaccaactataa

SEQ ID NO: 3036 - protein, 455 aa, Photobacterium profundum
MELSALTAVSPVDGRYGSKTSVLRSIFSEFGLLKYRTIVEIRWLQKLAATDAIVEVPAFSDEANQFLDRVAAEFSEEDALRIKAIERTTNHDVKAVEYFLKEKVAELPELHAVNEFIHFACTSEDINNLSHALMLTEAREKVMLPEVRNVIDSIKTLANEYREIPLLSRTHGQPASPSTMGKEMANVAYRMERQFKQIENVEILGKINGAVGNYNAHVIAYPEVDWHQYSEEFVTSLGITWNPYTTQIEPHDYIAELFDGFARFNTILLDFDRDVWGYIALGHFKQRTIAGEIGSSTMPHKVNPIDFENSEGNLGLANAIFSHLSQKLPVSRWQRDLTDSTVLRNLGVGCGYAIIAYTSTLKGISKLEVNRAALEAELDKNWEVLAEPVQTVMRRYAIEKPYEKLKELTRGKRVDGEGMRNFIDSLELPEHEKTRLKEMTPANYIGDAVKLTDQL

SEQ ID NO: 3037 - DNA, 1350 bp, Methanococcus maripaludis
  CDS (1)..(1350)
atggcaattcaccctatcgactttagatacggaactcctgaaatgaaaaaagtatggggagaagaaacaaaacttcaaaaaatgttagaagttgaagcggcccttgctttagcagaatctgaacttggaatgattccaaaagaagctgcagaagaaataaacagaaaaaaatcaactgaatttgtaaaacttgaaagagtaaaagaaattgaaatggcgacaagacatgatgttgtttcagttgtaaaagcttttgcagaacagtgcgaaggaactgctggagaatacatccactttggttccacttcaaatgatattatcgatactgcacagtccctccaatttaaagatgcttttgaagttttggaaagtaaattaaaaattttaagaggggaactcttaaaaaaagcagaagagcacaaaaatacagtttgtattggaagaacacacggacagcatgcagttccaaccacctacggaatgaaatttgcattatgggctacagaaattcaaagacatattgaaagacttgaaagctctaaaaaaaggctctgtgtttcaatgattactggtgcagttggtacaatggctgcaatcggtgaaaatggaattttagtccacaaaagagttggagaaattttaagccttgatccagttttaatttcaaaccaggttgttcaaagagacagacacggagaattcatggctactttagcattaattgcacagactttgaataaaataggagttactgtaagaagcatgcagagaagtgaaattaaagaattagaagaagaatttgacgcgtcaaaacagactggttcatccacaatgccgcacaaaagaaatccaattacatttgagcagatttgcggactttcaagaattgtaaaagcaaatgcacttgcagaatttgataacattccgctttgggaagaaagagatttaacaaactcatcttctgaaagatgcttgttcccagagtcatgcgtacttttggaccacataataaacctttcgataaaaggaatgagaaaattaagtgtaaatcttgaaaatgttaataaaaaccttgaaatgacaaaaggactcatcatggcagaaagagttatgatgtttttagcaaatagtggaatgggaagacagacaggtcacgaaactgttagaaaatgtgcaatgaaggcccacgatgaaggaagacacttaaaagaagtacttttggaagagcctgaagttatgaaatacgtttcacttgatgaaattgaaaaaatgtttgattataaaacatatatcggattagctcctgaaattgtagaaaatgtactcaatgaagctaaaaattgggaataa

SEQ ID NO: 3038 - protein, 449 aa, Methanococcus maripaludis
MAIHPIDFRYGTPEMKKVWGEETKLQKMLEVEAALALAESELGMIPKEAAEEINRKKSTEFVKLERVKEIEMATRHDVVSVVKAFAEQCEGTAGEYIHFGSTSNDIIDTAQSLQFKDAFEVLESKLKILRGELLKKAEEHKNTVCIGRTHGQHAVPTTYGMKFALWATEIQRHIERLESSKKRLCVSMITGAVGTMAAIGENGILVHKRVGEILSLDPVLISNQVVQRDRHGEFMATLALIAQTLNKIGVTVRSMQRSEIKELEEEFDASKQTGSSTMPHKRNPITFEQICGLSRIVKANALAEFDNIPLWEERDLTNSSSERCLFPESCVLLDHIINLSIKGMRKLSVNLENVNKNLEMTKGLIMAERVMMFLANSGMGRQTGHETVRKCAMKAHDEGRHLKEVLLEEPEVMKYVSLDEIEKMFDYKTYIGLAPEIVENVLNEAKNWE

SEQ ID NO: 3039 - DNA, 1257 bp, Bdellovibrio bacteriovorus
  CDS (1)..(1257)
atgggccttctttgggacgccgaccacaagttcggaaaaatgatggaagttgaaattgcggtggcgcaggttcaatcccagcttggcatcatccccaagaacgcagccaagatcatcgctcaaaaagctcgcttcaacgtaaaaagaatctctgaaatcgaacgcgaaaccaaacatgacgtgatcgcctttgtttcaaatctggcagaaaacgtcggcccgcagggaaaattcatccactacggcatgacgtcttcggatgttctggatacggccttcagcttgcaggtgcgcgaagccggagtcgttctgatgaaatccatcgtcgctctggaaaaatccctgaaaaccctggtgaccaagcatgcggaaaccctgtgtgccggacgcacccacggcatgtttgccgagccgaccactttcggattcaagatggcgggcttcctggctgaagcccagcgcaataaaaaacgtgtgaaagccgctcttgataatatgatgatttgcaaactcagcggtgcggtggggacttattcttctcaagctccaaaaattgagtctttggtggctaaaaagctgaaattgaaaactgaaaccatcgcaactcaagtgatcccgcgcgaccgtcatgccgagatgctttcagccctggctttgttcggaacaggccttgaacgcctggccgtagagcttcgtcatctgcagcgcagtgatgtggccgaagtgactgaaggctttaccaagggccaaaagggctcttcagcgatgcctcacaagaaaaacccaatcagtgcggaaaacataaccggcctttcccgtttgctgcgtggttatgccattgccggatttgaaaacgtggcactttggcacgaacgcgacatcagtcattcctcagtggagcgcgtggtgttcccggatgccttcatcgtggcggactatgcctgtaatcgtatgagcattctgttggatggtctggatgtgaacaagaagcgcatgatggacaatatcgaaagttcgcaaggacagatttttagctcccatgtgttgctggcgctgattcaaaaaggaatgattcgtgaggaagcgtatgctttggtgcagcgtctttgtcattctctgtcttacggagaacatctgaaagacaaacttttggtggacgatcagatccagaagcttttgaagcccaaagagatcgacgagatctttaccggcaaaaaacacaaaaaagccatcaaagacatcatcaagagagtatag

SEQ ID NO: 3040 - protein, 418 aa, Bdellovibrio bacteriovorus
MGLLWDADHKFGKMMEVEIAVAQVQSQLGIIPKNAAKIIAQKARFNVKRISEIERETKHDVIAFVSNLAENVGPQGKFIHYGMTSSDVLDTAFSLQVREAGVVLMKSIVALEKSLKTLVTKHAETLCAGRTHGMFAEPTTFGFKMAGFLAEAQRNKKRVKAALDNMMICKLSGAVGTYSSQAPKIESLVAKKLKLKTETIATQVIPRDRHAEMLSALALFGTGLERLAVELRHLQRSDVAEVTEGFTKGQKGSSAMPHKKNPISAENITGLSRLLRGYAIAGFENVALWHERDISHSSVERVVFPDAFIVADYACNRMSILLDGLDVNKKRMMDNIESSQGQIFSSHVLLALIQKGMIREEAYALVQRLCHSLSYGEHLKDKLLVDDQIQKLLKPKEIDEIFTGKKHKKAIKDIIKRV

SEQ ID NO: 3041 - DNA, 1308 bp, Mycoplasma mycoides
  CDS (1)..(1308): transl_table=4
atgaatttgatgattagtagatatcaagttaaagaaatcacagatatttgaagtgatcaaaataaatacaacacttggttaaaaattgaacaattagtaactaatggttgagctaaaattataaaaatcaataaagatgatctttttaaaattaataatgatttaaaagttgatttaaatagaatgttagaaattgaacaagagacaaaacatgatgttgttgcttttactagaatgttatcagaacaattagataatgaaagtaaatgaattcatttaggaattacttcaactgacattgttgacactgctcaaaattatttaattaaacaatctaatcaaattgtttttaatgaattagaaaatattttaaagactttaaaaacactagctatagaacataaaaatacattaattatgggaagaactcatggaatgtatggtgaacctactagtttagggttaaagttttgtttatgatatgatgaatttttaagacatattaaacgttttgaattagctagaaatgatatagaagttgttaaaatatcaggatcaatgggaaattatgctaacttagatccgcaaatcgaattatatgtagctaataaattaaatatgaacattgatagtttatcaactcaagtaagccaaagagatagacatatttttttagttgaagttttagcaaatattgcttcaactttagaaaaaatttcaactgaaattagattatttcaaagaagtgatgttaatgaacttgctgaaggttttttaaaaaaccaaaaaggtagttcttcaatgcctcataaaaaaaacccaatttctagtgaaaatgtagctggattaagtagatatattaaatcaattgttcatattgttttagaaaataataatttatgacatgaaagagatatttctcattcttcaaatgaaagaatttatttaccagatatttttaatttaattgtttatatattaaaaagaatgaatgaaacattaactaatttagttattaataaaactcaaatgttagaacacattaaacaagctaaaaatatttacttttctcaaagagttttaacatttattttattagaacaaccaaatgttactagagatcaagtttatgatttaattcaacaaatcacttttaaatgctctaaaaataatttagattttaaaactgaagttttaaatagtaaattaactgaatttgttttaattgataaattagaacaactttttgatgatcaattctttttaagacatgttgattatatttttaatagagtgtttaataaataa

SEQ ID NO: 3042 - protein, 435 aa, Mycoplasma mycoides
MNLMISRYQVKEITDIWSDQNKYNTWLKIEQLVTNGWAKIIKINKDDLFKINNDLKVDLNRMLEIEQETKHDVVAFTRMLSEQLDNESKWIHLGITSTDIVDTAQNYLIKQSNQIVFNELENILKTLKTLAIEHKNTLIMGRTHGMYGEPTSLGLKFCLWYDEFLRHIKRFELARNDIEVVKISGSMGNYANLDPQIELYVANKLNMNIDSLSTQVSQRDRHIFLVEVLANIASTLEKISTEIRLFQRSDVNELAEGFLKNQKGSSSMPHKKNPISSENVAGLSRYIKSIVHIVLENNNLWHERDISHSSNERIYLPDIFNLIVYILKRMNETLTNLVINKTQMLEHIKQAKNIYFSQRVLTFILLEQPNVTRDQVYDLIQQITFKCSKNNLDFKTEVLNSKLTEFVLIDKLEQLFDDQFFLRHVDYIFNRVFNK

SEQ ID NO: 3043 - DNA, 1308 bp, Rhodopseudomonas palustris
  CDS (1)..(1308)
atgatcccgcgttatacccgtccggaaatggctgccatttgggagccgctgacccgcttcaagatctggttcgagatcgaggcccatgcctccgacgcgcaggctgcgctcggggtgatcccgaaggaggccgccgaggcgatctggaagggaggcaaggacgccgcgttcgacgtggcgcggatcgacgagatcgagcgcgaggtcaagcacgatgtcatcgccttcctgacccatctggccgagttcgttgggccgatgtcgcggttcgtgcaccagggcatgacctcgtcggacgtgctcgacacctgcttcaacgttcagctcacccgcgccgccgacatcctgctggccgacctcgaccgcgtgctggcggcgctgaaggcccgcgccttcgaacaccggatgacgccgtcgatcggccgctcacacggcatccacgccgagccggtgacgttcggcctgaagatggcctacgcctatgccgaattcagccgcgcccgcgaccgcctggtggcggcccgtaaggaagtcgcgacctgcgcgatctccggctcggtcggcaccttcgcccacatcgatccgcgggtcgaagagcacgtcgccaaagcgatgggcctcgcggtcgagccggtgtcgacgcaggtcatcccgcgcgaccgccacgcgatgttcttcgccgtgctcggcgtgatcgcctcgtcgatggagcggctcgccaccgagatccgccatctgcagcgcaccgaagtgctcgaggccgaggagtatttctccgagggccagaagggttcctcgtcgatgccgcacaagcgcaacccggtgctgaccgagaacctgaccggcctcgcccgcatggtgcgcgcctatgtgatgccggcgatggagaacgtggtgttgtggcacgagcgcgacatctcgcactcctcggccgagcggatgttggcgcccgacgccaccgtgacgctcgacttcgcgctgaaccgcctcgccggcgtgatcgagaagctggtggtgtatccggagaacatgaccaagaacctcgaccgcctcggcggcctggtgcattcgcagcggctgctcaccgcgctgacccagaagggctgctcgcgcgaggagagctacaagctggtccagcgcaacgcgatgccggtgtggcgcggcgaaggcgacttcctgtcgctgctgaagaaggacccggacgtcaggaagtacatgaccgacgacgagatcgaagagcagttcgacctcggctatcaccacaagcacgtcgacaccatcttcaagcgggtgttcggcgagagctga

SEQ ID NO: 3044 - protein, 435 aa, Rhodopseudomonas palustris
MIPRYTRPEMAAIWEPLTRFKIWFEIEAHASDAQAALGVIPKEAAEAIWKGGKDAAFDVARIDEIEREVKHDVIAFLTHLAEFVGPMSRFVHQGMTSSDVLDTCFNVQLTRAADILLADLDRVLAALKARAFEHRMTPSIGRSHGIHAEPVTFGLKMAYAYAEFSRARDRLVAARKEVATCAISGSVGTFAHIDPRVEEHVAKAMGLAVEPVSTQVIPRDRHAMFFAVLGVIASSMERLATEIRHLQRTEVLEAEEYFSEGQKGSSSMPHKRNPVLTENLTGLARMVRAYVMPAMENVVLWHERDISHSSAERMLAPDATVTLDFALNRLAGVIEKLVVYPENMTKNLDRLGGLVHSQRLLTALTQKGCSREESYKLVQRNAMPVWRGEGDFLSLLKKDPDVRKYMTDDEIEEQFDLGYHHKHVDTIFKRVFGES

SEQ ID NO: 3045 - DNA, 1440 bp, Corynebacterium diphtheriae
  CDS (1)..(1440)
atgagctacgtggctgagaagaagaagatcgcaaacgtcctgtccaaccgctacgcctctgctgagctcaccgaactgtggagcccagaggcaaagatcctcctagaacgccagttgtggatcgcagtaatgaaggcccagaaaaatctgggtgttgatattccaacagaagcaatttctgcttatgaagcagtgatcgaccgcatcgatcttgacagcatcgcacagcgtgagaagatcacccgccatgatgtgaaagctcgtatcgaggagttcaatgctctcgcaggctacgagcatattcataagggcatgacctcccgcgacctcaccgagaacgtggaacagctgcagatctaccgttcgcttgagatgatgcgtaacaagtcggtgtctgttgccgctgctatcgcacagcacgcagcacagtaccagtccttggtcatggctggccgctcccacaacgtggctgctcaggctaccactttgggtaagcgttttgcctctgctgccgaggaaattttggttgctattgaccgcgttgaggatcttctgagccgctatccactgcgcggtattaagggccctatgggcaccgcccaagacatgcttgatctcgttggtggcgatgagtccaagcttgccgcattggaaactcaaatcgcagatcacctaggtattgcccgcgtgttcgattcagtgggacaggtttacccccgctccttggacttcgatgcggtgtctgctctggttcagttgggtgctggtccatcctcgttggctcacaccatccgtttgatggctggcaatgagacggtgactgagggctttaaggaaggccaggtcggttcctcggctatgccgcacaagatgaatgcgcgttcgtgtgagcgtgttggcggcctgcaggtgatcttgcgtggttacctcaccatggtggcggatctttctggtcagcagtggaatgagggcgacgtgttctgctcggttattcgtcgtgtggctcttccggatgcgttcttcgcgctggatggcatgtacgagacattcctcacagtgttggctgagttcggtgctttcccagcgatgattgatcgtgagcttgagcgctacctgccattccttgctaccactcgtattctgatggctgctgttcgcgtgggtgttggccgtgaaactgcccatgaggtgattaaggagaacgctgtggcggttgccttgaacatgcgtgaaaacggtggtgagcaagacctcattgatcgccttgcggcggatgagcggttgccgatgactcgtgaacagttggatgaggcgttggctgatcgacatgcctttattggtgctgcagaatcgcaggttgctcgcgttgttgaccgcgtgaatgatctggttcgtcgttatccagcggctgcccagtacacccccggtgacattctctag

SEQ ID NO: 3046 - protein, 479 aa, Corynebacterium diphtheriae
MSYVAEKKKIANVLSNRYASAELTELWSPEAKILLERQLWIAVMKAQKNLGVDIPTEAISAYEAVIDRIDLDSIAQREKITRHDVKARIEEFNALAGYEHIHKGMTSRDLTENVEQLQIYRSLEMMRNKSVSVAAAIAQHAAQYQSLVMAGRSHNVAAQATTLGKRFASAAEEILVAIDRVEDLLSRYPLRGIKGPMGTAQDMLDLVGGDESKLAALETQIADHLGIARVFDSVGQVYPRSLDFDAVSALVQLGAGPSSLAHTIRLMAGNETVTEGFKEGQVGSSAMPHKMNARSCERVGGLQVILRGYLTMVADLSGQQWNEGDVFCSVIRRVALPDAFFALDGMYETFLTVLAEFGAFPAMIDRELERYLPFLATTRILMAAVRVGVGRETAHEVIKENAVAVALNMRENGGEQDLIDRLAADERLPMTREQLDEALADRHAFIGAAESQVARVVDRVNDLVRRYPAAAQYTPGDIL

SEQ ID NO: 3047 - DNA, 1404 bp, Borrelia miyamotoi
  CDS (1)..(1404)
atggatgaatatataaatcccctaaaatcaagatatgcaagtaaaaaaatgctttacattttttcaccaaaatttaaatatactacatggagaaaattgtggtacaacttagctttagtccaaaaagaattaggaatagatattagcaaaaaacaacttgataaattatctaaacatattgaaaacattgattttgagattgtaaaaaaatatgaggaaaaatttcaacatgaaatcatggcacatccttatgcttatgctgacttagttggcgacgatgctagaaaaattttacaccttggcgttacaagtgcatatttaacagataacacagacttaatccaaatcaaagaagctctattgatcatcaagaataatctaataaaattcattaaatctttaaaagaattctcaacaaagcataaaaacctgacaactcttgcatatacacatctacaaaaagcacaattgacaactcttgggaaaagaagtagcttatggcttcaaagtctaatttttgactttgaagaactcaatttcattctatccaatatgtgtcttagaggagtcaagggaacagttggaaatcaaaacagctttaatgaattgttttcgtctaactttgaaaaggtaaaaaatctagacattagtctagcaaaaaaaatgggatttaacaaagtttataaagtaactagtcaaatctacgaccgtaaatttgatgcatcaatattaaattttttaagcaacctatctcaaagtgcacacaaaatcactaatgacattagattcatgcaacatcttgaagagattgaagaacattttgaaaaaaaccaaataggttcatcagcaatgccttataaaagaaaccctatttatagtgaaagagtagcttcccttgctaagtttatcatgagtctacaatcaagtggtggatttatagcggcaacgcaatggcttgagagaactctagacgattcagcttgcaagaggatcaatattcctcaagcattcctagccgctgatgctattttaatattattaaataaaatatttaataatattagagtaaacaaaacaataattgaaaaacatgtcaaaaaagaaataccatttatattaacagaagacatattgatgaaagcaacaaaaaatggtggtgatagacaaatattacatgaaaagataagaatttattcaatgcaagtaagagaaaatcttacttcaaaaacaactgaaaacgacttaattaaactaatcctcaatgatgaaagctttaaattaacacctaaagatatagatgaagttttaaatccaaatgaaaatataggttttgcatcattgcaagtcgaagactttattaaagagacagttgatcctattcttgaaaaaaataagaaatactag

SEQ ID NO: 3048 - protein, 467 aa, Borrelia miyamotoi
MDEYINPLKSRYASKKMLYIFSPKFKYTTWRKLWYNLALVQKELGIDISKKQLDKLSKHIENIDFEIVKKYEEKFQHEIMAHPYAYADLVGDDARKILHLGVTSAYLTDNTDLIQIKEALLIIKNNLIKFIKSLKEFSTKHKNLTTLAYTHLQKAQLTTLGKRSSLWLQSLIFDFEELNFILSNMCLRGVKGTVGNQNSFNELFSSNFEKVKNLDISLAKKMGFNKVYKVTSQIYDRKFDASILNFLSNLSQSAHKITNDIRFMQHLEEIEEHFEKNQIGSSAMPYKRNPIYSERVASLAKFIMSLQSSGGFIAATQWLERTLDDSACKRINIPQAFLAADAILILLNKIFNNIRVNKTIIEKHVKKEIPFILTEDILMKATKNGGDRQILHEKIRIYSMQVRENLTSKTTENDLIKLILNDESFKLTPKDIDEVLNPNENIGFASLQVEDFIKETVDPILEKNKKY

SEQ ID NO: 3049 - DNA, 1365 bp, uncultured bacterium 578
  CDS (1)..(1365)
atgacatttgataaccttacatctatttcacccatcgatggtcgttacagcgctaagacaggtccacttaaaaggatttttagtgagtatggtttaattaagtacaggctcttgatagaggttcgatggctagaagcaatgtcaaagaattctcaaatccctgaagttcctgaattcagcttaaaatctaaaaacgttttgtcaaatattgttgataatttctccttagaggatgctaaggtaattaaagaaattgaaaagacaactaatcatgacgtaaaggcagttgaatactaccttaaagaaaaagtttcttctactcctgagcttcaaaatgtaaatgagtttattcattttgcttgtacttcagaagacattaataatctatctcatgcactaatgcttgaggatggaaggcaagttctacttgatgagatgagaaaaactttgaatctaattacagatttagctaaagataatgtagatgttgcaatgctttctagaacgcatggtcaaacagcttcaccgacaactcttggaaaggaaatggctaatttttcttaccgattgatgagacaaattgaacagcttgaagaagtcaaaataatgggcaagtttaatggcgcagtaggtaattttaatgcccatataagtgcttaccctaatcttgattggcctaatacttcgaagaactttatcgaaagtctcggtataaattatgccccctatagttcgcaaatagagacacatgattatattgcagagtattttcatgcactaaatcgttttaatacaattctgattgatttttgtcgtgacgtttggggctatatttcgttaggttatttcacacaaaaaactattgaaggcgaggttggatcatcaactatgcctcataaggttaatccaattgactttgaaaatgcagaaggaaatctagggttagctattgcaataggtgaacacttcgcaacaaaacttcctatatctagatggcaaagagatttaacagattcaacggtattaagaaatctaggagttagctgtgcacattgcctaatttcatatgcctctataagtaaagggatttcaaaacttgaagttaatcaagataagttaattgatgatttgaatgaagcatgggaagttcttgctgaaccaattcaaactgttatgcgtcgatacggagtcaaaaacccttacgaaaaactcaagtctcttactcgcggtaagaaaattgatgccaaaatattggcagactttataggctctttagatatacctgaagatgcgaaagaagaacttcgaaaactaacccctaagaactatatcggtgatgcgattaaattagcacgcgacatttaa

SEQ ID NO: 3050 - protein, 454 aa, uncultured bacterium 578
MTFDNLTSISPIDGRYSAKTGPLKRIFSEYGLIKYRLLIEVRWLEAMSKNSQIPEVPEFSLKSKNVLSNIVDNFSLEDAKVIKEIEKTTNHDVKAVEYYLKEKVSSTPELQNVNEFIHFACTSEDINNLSHALMLEDGRQVLLDEMRKTLNLITDLAKDNVDVAMLSRTHGQTASPTTLGKEMANFSYRLMRQIEQLEEVKIMGKFNGAVGNFNAHISAYPNLDWPNTSKNFIESLGINYAPYSSQIETHDYIAEYFHALNRFNTILIDFCRDVWGYISLGYFTQKTIEGEVGSSTMPHKVNPIDFENAEGNLGLAIAIGEHFATKLPISRWQRDLTDSTVLRNLGVSCAHCLISYASISKGISKLEVNQDKLIDDLNEAWEVLAEPIQTVMRRYGVKNPYEKLKSLTRGKKIDAKILADFIGSLDIPEDAKEELRKLTPKNYIGDAIKLARDI

SEQ ID NO: 3051 - DNA, 2330 bp, Nicotiana tabacum
  CDS (37)..(1665)
taactccagctatggagttatagctttaacaaaaaaatggaactaagaacttgtttcaattcttcaaatatcaatcaaacaatgtttttatcagtccccattacccaaaaatccaatttacttccaaattctttgctcaatccctttaacttttctttcccaactataaaaaactgttcttgcagagcaattgctaaagggtccatcgttagctccttgaaaactcaagaaaaggtcaaagggatgtcttctgatcattctcaagatctagaactctcaagtttatcagctctatgcccattggatggacgttattggggtaaagtcaaagaattggctccttttatgagcgagtttggcttaattcgtttacgcgttttggttgagattaaatggttgttaaaaatgtctcaaatacatgaaatctctgaagttccaaacttctctgaaggagctcagacatttttgcaaaacttgatcgatgaatttagtatgaatgacgccttggaagttaagaagattgagagagtcacgaaccatgatgtgaaagcagttgaatacttcttgaaacaaagatgtcaatcacatccagagatagttaaggtgctcgagttttttcactttgcttgtacatctgaggacatcaacaatcttgcccatgcattgatgctaaaaggagctttgaacacggtcattttgccagtcatggatgaattgactagagcgatctgtgacatggccacaaaatattcttctgttcccatgctttctcgcacccacgggcagccagcttcaccaacaacccttggaaaggaaatggcaatttttgcttatcgattaagcagggaaagaagggaaatttctcaaattgagatgctcgggaaatttgctggtgctgtaggaaattacaatgcgcatgtagctgcatatcctgaagtaaactggccacaaattgccgaggagtttgtaatgtcacttggattaaaattcaatccatatgttcctcagatcgaaactcatgactatatggccaagctttttcactcgattgtccagtttaacaacattttggttgattttgatagagacgtttgggggtatatttctctgggttactttaagcagacaactaaagctggtgaaattgggtcctcgacgatgcctcacaaagtaaatccaatcgactttgaaaatagtgaaggcaatcttggagtagctaatggaaatctatcccatttgagcactaaactacctatttcgcgttggcagcgggatttgacagattcaactgttctgagaaacatgggagtaggactaggacattctcttcttgcttacagaagtgcactacagggaattcataagcttcaggtgaatgaagctgctctgagtgaagatttagataaatgttgggaggttcttgctgaaccaatacaaacggtgatgcgaaggtatggtgtgccagagccgtatgagaaactgaaggcgttaacccgaggaagaacagtgaccaaagaaatttgtagagattttatacaaaaattggacataccggctgatgcgaagacagctctcttgaacttaacacctcatacttatattggaacagctgcagatttggctaagaacataaatgaggccataaatctagagaatggagcttaacacctcatacttatattggaacagctgcagatttggctaagaacataaatgaggccataaatctagagaatggagctcaaatcttttgaaatgagagccgagaacgttcacagccctttgcatcggtggcggatggagcatacaatcaacagggaatataagatgcgaggaagcaacatgaagtgtttagaggcaataacgtgaagaaaacacccactcaagaagtacccaaacacaaaagagcaaaaagagaaggaacgcggagacaaaaaggccgagcatactcaccgcagtccgcgccgcgattggagtcagtgttctccgcggtcgacgcggcggccgcggcggcaggttcacagtccagaaagttaaggggccaaagtgtcaattcgggaaaacttttgtaaaacccttataagatgtaggaaactcgcccaagagaggagagagtttattttgagattattttggcaagaagaacaagtgtgagagatcacccaaaacatcatagttcttattctcttctattttttttttgcgattttccattatgaatattttcgtagtttattcttacgttgtcatgagtagctaaatgctttaatctaaagttttggtgaaacccgttggggatgacttggttgttatattaatatagtttgaat

SEQ ID NO: 3052 - protein, 542 aa, Nicotiana tabacum
MELRTCFNSSNINQTMFLSVPITQKSNLLPNSLLNPFNFSFPTIKNCSCRAIAKGSIVSSLKTQEKVKGMSSDHSQDLELSSLSALCPLDGRYWGKVKELAPFMSEFGLIRLRVLVEIKWLLKMSQIHEISEVPNFSEGAQTFLQNLIDEFSMNDALEVKKIERVTNHDVKAVEYFLKQRCQSHPEIVKVLEFFHFACTSEDINNLAHALMLKGALNTVILPVMDELTRAICDMATKYSSVPMLSRTHGQPASPTTLGKEMAIFAYRLSRERREISQIEMLGKFAGAVGNYNAHVAAYPEVNWPQIAEEFVMSLGLKFNPYVPQIETHDYMAKLFHSIVQFNNILVDFDRDVWGYISLGYFKQTTKAGEIGSSTMPHKVNPIDFENSEGNLGVANGNLSHLSTKLPISRWQRDLTDSTVLRNMGVGLGHSLLAYRSALQGIHKLQVNEAALSEDLDKCWEVLAEPIQTVMRRYGVPEPYEKLKALTRGRTVTKEICRDFIQKLDIPADAKTALLNLTPHTYIGTAADLAKNINEAINLENGA

SEQ ID NO: 3053 - DNA, 1699 bp, Brachydanio rerio
  CDS (169)..(1617)
aaaatgtgaaaggagagtttttcaaatgaaccgaggagggcagcaataggcattagatgggacttgtctgccgcaaataacagaagaagaagaacaaaacctaatgcagacttgcggttcccgtgcagtccgtgtgcgagctagacgctccgtttaaccgctgcaggcatggagggatccggagaagagttcctgaaataccgctcaccgctggtgtcccggtacgccagcaaagagatggcctacaacttcagtgacaggaaaaaatttaccacatggagaaagctgtggatttatctcgcgaaggccgaaaagtctttgggcctccccataagcgatgctcaggtaagcgagatggagtctcactcggaggacattgatttcgttatggctgcggaggaggagaggaagctcaggcatgatgtcatggctcatgtgcacacattcgctcaatgctgtcccaccgctgctcccatcatccacttgggtgctacttcttgttatgtgggtgacaacacggatctgattatgctacgtgatggatttgatatcctgctgcccaagttggctcgtgtcattgacagactggcgaattttgcagagaagtacgctgacctgccgacattaggcttcacccactatcaacctgctcagctgacgacggtggggaagcgatcttgtttgtggctgcaggatctgctcatggacatgagaaaccttcagcgggccagagacgacctgcgcttcaggggtgttaaaggaaccactggcactcaggccagcttcctgcagctcttccagggggatcatgacaaggtggaggagttggataatatggtcactgagatggctggatttaaaaaatcatatctggtgaccggtcagacgtacagtcggaaggtggacattgactcgctctgtgtgctgtccagcctagcagccacaatacacaagatttgcactgatatccgtctgctggctaatctaaaagagattgaggagccgtttgagaaagagcaaattggttccagtgccatgccatacaagaggaaccccatgcgtgcggagcgctgctgcagtctggcccgccacctgatggcgctggtgtccaatccattgcagacggcagcagtgcagtggctggaaagaacgctggacgacagcgctaacaggaggatctccttgcctgaggcctttcttacagctgatatcatcctcagcacactgcagaacatcactgaaggcctggtggtctatcctaaggtgattgagaggcacatccgtcacgagctgcccttcatggctactgaaaacattatcatggccatggtgaaggctggaggaaacagacaggactgccatgagaagatccgtgtgctgtcccagcaagctgcagccgtagtcaaacaggaagggggagataatgacctcttggctcgggttcaagctgatccatatttcgcccctatattaggagagctggatgccttactggaccccaaaaccttcatcggccgagctccacaacaggttactaggtttttgtctgaggaggtcaggcctgttctagagccatacaaaagtaaaatggatgtgaagattgaactggagctctgaagcgcacatgactgtatgactgacacatcagaactgtatgacaatgaataaatgtcaatctgcaaaaaaaaaaaaaaaaaaa

SEQ ID NO: 3054 - protein, 482 aa, Brachydanio rerio
MEGSGEEFLKYRSPLVSRYASKEMAYNFSDRKKFTTWRKLWIYLAKAEKSLGLPISDAQVSEMESHSEDIDFVMAAEEERKLRHDVMAHVHTFAQCCPTAAPIIHLGATSCYVGDNTDLIMLRDGFDILLPKLARVIDRLANFAEKYADLPTLGFTHYQPAQLTTVGKRSCLWLQDLLMDMRNLQRARDDLRFRGVKGTTGTQASFLQLFQGDHDKVEELDNMVTEMAGFKKSYLVTGQTYSRKVDIDSLCVLSSLAATIHKICTDIRLLANLKEIEEPFEKEQIGSSAMPYKRNPMRAERCCSLARHLMALVSNPLQTAAVQWLERTLDDSANRRISLPEAFLTADIILSTLQNITEGLVVYPKVIERHIRHELPFMATENIIMAMVKAGGNRQDCHEKIRVLSQQAAAVVKQEGGDNDLLARVQADPYFAPILGELDALLDPKTFIGRAPQQVTRFLSEEVRPVLEPYKSKMDVKIELEL

SEQ ID NO: 3055 - DNA, 1293 bp, uncultured marine alpha proteobacterium HOT2C01
  CDS (1)..(1293)
atgatccctcgttattctagagccgagatgactaacgtttggagctctaactctaaatttaaaatatggctcgatattgaactctatgcttgcgaagccatggagaaattaggaactgttcctaagggaacaagtaaaaaaattagatcaaaagcaaagattaatgaaaagagaattgatcaaattgaaaaaaaagtgaaacacgatgtaattgcttttttaacaacaatttctgaatacgcgggtccacctgcaagatttcttcaccaaggcctaacttcttcagatattttagatactgcttttaatgttcaactaaaacagtcctcagtcataattgagaaggaaatattaaatttactaaaatcattaaaaaagattgcattaaaacataagaacacgccttgcattggaagaagtcatgggattcatgcggaacccacaacttttggcgttaaaatggcatctttttatgcagaatttcagaggaatcataagcgttttctaaaagcaatcgaagaaataaatatatgcgcgatttcaggcgcagtcggcaattatgcaaatattgatccacgtgttgaacagtacgtggcaaaaaagttaggcatgaaagcagaaacgatttcaactcaaataattccaagagatcgtcacgcagtatattttaatactcttgcggtaattgcaagttcaattgaacgtttagccaccgagataagacatttacaaagaactgaagttctagaagttgaagaatttttttcaaaaggacaaaaagggtcatcagcaatgcctcacaaaagaaatccagttatgactgagaatttaaccggactggcaagactgattagaggttatacggttcctgctttagaaaatatcactctttggcatgaaagagacatatcacattcaagtgtagagagaataatagcgccagatgcaaatattataatcgactttgcactttcacgaatgaataatgtgatatcaaatcttgttgtatatccaaaaaaaatgaaaactaatttagatagattaaaaaaattgccaatgtctgagggtttgatgctggcaatgacacaaaaaggtttatcgcgagaaaatgcgtacaagatagttcaacgaaatgcaatggaagtatggaaaacgaatacagattttgaggaaatacttaacaaagatgaagaattaaaaaaatacctaagcaaaaaagagatatcaaaaattttagatttgaaacacgccgctcgcagaactgactatattttcaaaaaagtttttaagtga

SEQ ID NO: 3056 - protein, 430 aa, uncultured marine alpha proteobacterium HOT2C01
MIPRYSRAEMTNVWSSNSKFKIWLDIELYACEAMEKLGTVPKGTSKKIRSKAKINEKRIDQIEKKVKHDVIAFLTTISEYAGPPARFLHQGLTSSDILDTAFNVQLKQSSVIIEKEILNLLKSLKKIALKHKNTPCIGRSHGIHAEPTTFGVKMASFYAEFQRNHKRFLKAIEEINICAISGAVGNYANIDPRVEQYVAKKLGMKAETISTQIIPRDRHAVYFNTLAVIASSIERLATEIRHLQRTEVLEVEEFFSKGQKGSSAMPHKRNPVMTENLTGLARLIRGYTVPALENITLWHERDISHSSVERIIAPDANIIIDFALSRMNNVISNLVVYPKKMKTNLDRLKKLPMSEGLMLAMTQKGLSRENAYKIVQRNAMEVWKTNTDFEEILNKDEELKKYLSKKEISKILDLKHAARRTDYIFKKVFK

SEQ ID NO: 3057 - DNA, 1368 bp, uncultured crenarchaeote
  CDS (1)..(1368)
atgccaatattacctattgactctggaagatacggtagcaatgaaataaggaaaatttttgaagaagaaaatcgactcagatatcagcttaattttgaagcacaagttgcattatctcaaggcaaacttagaatgattcctctaaaagcctcaagagaaatagcacgaatagcaagatcaaataagatcacaacagcaaagatcaaggaacttgaatcaataagtgagcatgacacagcttcgttagtacaggcaattagcgaatattgttcacccacaacaagaccatggatacattacggattaaccagtaatgatgttgtagatacatctacgtcaatgcaattaaaagatgcgtttaaagtaattgaaccaaaaatattcaagctaatttcgttattgataaatagggtaagaaaatatgacttgttaccttctgtaggaagaactcatggacagcacgcaagcataatttcctttggattaaaatttgcgatttgggcaaacgagctttcatatcacatagaaagaatcgaagagggtaagaagagatttcttttatgtaaaacattgggagtggttgggacaggttccttgatgggatcaaaggccctggatgtacaggacaaggtagccaaaacgcttggtctttattctatagaggcagctacacaagtaatacccagagaaagactagcagaagttcaattcataatttcgttaataggaagttctttggataaaatggcaacagaaattagaaatttacaaagaactgagattggagaggtagaagaaccatttaaaaaagggcaattgggaagcagtgcagttccagtaaagaggaatcccataaagagtgaaagaatatcttcacttgcaagaatacttcgttccttttcaaatatcgctcaagagaatatttcactctggcatgagagagatctctcaaattccgcaaatgaaagatttactattccgatgggcatcattcttttggacgaaatgataaataatatgattagggtaattgaaggattaacagtaagtagtcaaagaattatagataatataaataaaacaaagggaagaatttttgcagagtttattcttgaagccctagtaaagaaggggattcctcgaatgaaagcctatgagagcatacaacgtgttgcttttgaaactctagtggatgatagagactttagagatgcgataatgaaggatccttctattggagaacatttaaacaagaatgaattgaaaacaatatttgatcctaacactcatctggctgcatcgtcaagaataataaagaatgtcataaaaaggaccgagcaaatacgtaaaaactacaaaccacattaa

SEQ ID NO: 3058 - protein, 455 aa, uncultured crenarchaeote
MPILPIDSGRYGSNEIRKIFEEENRLRYQLNFEAQVALSQGKLRMIPLKASREIARIARSNKITTAKIKELESISEHDTASLVQAISEYCSPTTRPWIHYGLTSNDVVDTSTSMQLKDAFKVIEPKIFKLISLLINRVRKYDLLPSVGRTHGQHASIISFGLKFAIWANELSYHIERIEEGKKRFLLCKTLGVVGTGSLMGSKALDVQDKVAKTLGLYSIEAATQVIPRERLAEVQFIISLIGSSLDKMATEIRNLQRTEIGEVEEPFKKGQLGSSAVPVKRNPIKSERISSLARILRSFSNIAQENISLWHERDLSNSANERFTIPMGIILLDEMINNMIRVIEGLTVSSQRIIDNINKTKGRIFAEFILEALVKKGIPRMKAYESIQRVAFETLVDDRDFRDAIMKDPSIGEHLNKNELKTIFDPNTHLAASSRIIKNVIKRTEQIRKNYKPH

SEQ ID NO: 3059 - DNA, 1293 bp, Desulfovibrio vulgaris
  CDS (1)..(1293)
atgatcgaccgctatacccgccccgagatgggcaacatctggacactggacaaccggttccgcgcctggctcgaggtggagatcgccgtctgtgaggcgtggcatcgcctcggcgtcatcgatgcagagagcatgcagaccatccgcgacaaggccgacttcgagaccgaccgtatccttgagattgagcaggtcacgcgacacgacgtcatcgccttcctgaccgccgtcgaagagaaggtcggccccgccgcccgcttcatccacctcggctgcacgtcatcggacatcgtcgacaccgccaacggcctgctcctcgtcagggccggcgagctcatcgtcaagggcttcgagcggctgctcgacgtcatcggcaaggtcgcccacgccaacaagggccgcctgtgcatgggccgcacccacggcatccacgccgaacccacgagcttcggcctcaagatggcctgcttccatgccgagttccagcgccacctcgcccgcttcaaggacgccctcgaaggcatccgcgttggcaagatatccggcgcggtgggcacctatgccttcctttcccccgagatggaagccatcgccctcgacctcatcggcctcaaggtcgaccccgtctcgacgcagatcatccagcgcgaccgccacgcccactacttcacctcgctggcgctggccgcaggcggcgtcgaaaggctgtgcgtcgaactgcgccacctgcaacgcaccgaagtgcttgaagccgaagaagggttcgccaaggggcagaagggttcgtccgccatgccccacaagaagaaccccatctccgccgagaacatgacgggccttgcgcggctcatccgcaccaacgccctcgcgtccatggagaacatggcgctgtggcacgaacgcgacatcagccattcgtccgtcgagcgcgtcatcatgcccgactcgaccatcctcatggactacgtgctgcatcgcctcgccaacctcgtcgagaacctgcgcatcatccccgagaacatggaccgcaacctcgccatgtcgtacgggctgttctactcgcagcgcgtgctgctgaccctcgtggaaagcggcatggcacggcaggaggcctatgtcatggtgcagcgctgcgccatgcaaagctgggagacgcaccgccccttccccgacatcgtgcgggcagacgcggacatctcgtcgcgcatcgacgccgcgaccctcgatgccctgttcgacccctcgtactatctgcgccacgaagacaccatcttccgtcgcgtcttcgcctaa

SEQ ID NO: 3060 - protein, 430 aa, Desulfovibrio vulgaris
MIDRYTRPEMGNIWTLDNRFRAWLEVEIAVCEAWHRLGVIDAESMQTIRDKADFETDRILEIEQVTRHDVIAFLTAVEEKVGPAARFIHLGCTSSDIVDTANGLLLVRAGELIVKGFERLLDVIGKVAHANKGRLCMGRTHGIHAEPTSFGLKMACFHAEFQRHLARFKDALEGIRVGKISGAVGTYAFLSPEMEAIALDLIGLKVDPVSTQIIQRDRHAHYFTSLALAAGGVERLCVELRHLQRTEVLEAEEGFAKGQKGSSAMPHKKNPISAENMTGLARLIRTNALASMENMALWHERDISHSSVERVIMPDSTILMDYVLHRLANLVENLRIIPENMDRNLAMSYGLFYSQRVLLTLVESGMARQEAYVMVQRCAMQSWETHRPFPDIVRADADISSRIDAATLDALFDPSYYLRHEDTIFRRVFA

SEQ ID NO: 3061 - DNA, 1311 bp, Thermus thermophilus
  CDS (1)..(1311)
atgatcgcccgctaccagacgccggagatggcccgcctctggtcggaggaaagccgctaccggatgtgggcccgggtggaggcctacgccctcgaggcctgggaggccttaggggaggtgcccaagggcctttcggcgaggcttctcgccaagctggaggaaaagcccctggacggggccttcgcccggagggtagcggagctggaggcggtaacccgccacgacctcgtggccttcacccgggccctcgccgagtggacgggggacgaggaggtggggcgctacctccacctgggccttaccagctccgacatcgtggacacggcgcaaaacgccctcctggtggaggccctaggcctcgtcctggaggagcttaagggggtggaggaggccttaaaggccctcgccctccgccacaagcacacccccgccatcgcccgcacccacggggtccacgccgagcccacgagcttcggcctccgcttcctctccttcctcgccgccttccaaagggacgaggaaaggcttaagcgggcgagggagaccatcggggtcgccatgctctcgggctccgtgggcaactacgcccacgtcccccccgaggtggaggcccacgtggcccggcgcctgggcctccgccccgagcccatttccacccaggtcgtcccccgggaccggcacgccgaggtcatggcggccctcgccatcctgggggggaacatagagcgggtggccgtggagctacgccacctccagcgcacggaggtcctcgaggcccaggagcccttccacgaagggcagacggggagctcctccatgccccacaagaagaaccccgtgggcctggagaacctcaccggggtggcgaggctccttaggggttacctccagcccgccctggaggacatcgccctctggcacgagcgggacatctcccactcctccgtggaaagggtcatcctccccgacgccaccaccctggcccactacgccctgaggcgcctcaaggggatcctcgagggcctcgaggtctttgaagagaacctggccaggaacctggacctcacccggggcctcgtctactcccagcaggtcctcaacgccctcatcgcccggggcctctcccgggacaaggcctacgccctcgtccagcggaacgccttgaggagctggaaagaggggaagagcttcctggagctcttggaggccgaccccgaaaaccccctcaagggaaaggagctaagggccctctttgatcccaagcccttcctccggcacgtggacgccatctacgcccggttcgggctctga

SEQ ID NO: 3062 - protein, 436 aa, Thermus thermophilus
MIARYQTPEMARLWSEESRYRMWARVEAYALEAWEALGEVPKGLSARLLAKLEEKPLDGAFARRVAELEAVTRHDLVAFTRALAEWTGDEEVGRYLHLGLTSSDIVDTAQNALLVEALGLVLEELKGVEEALKALALRHKHTPAIARTHGVHAEPTSFGLRFLSFLAAFQRDEERLKRARETIGVAMLSGSVGNYAHVPPEVEAHVARRLGLRPEPISTQVVPRDRHAEVMAALAILGGNIERVAVELRHLQRTEVLEAQEPFHEGQTGSSSMPHKKNPVGLENLTGVARLLRGYLQPALEDIALWHERDISHSSVERVILPDATTLAHYALRRLKGILEGLEVFEENLARNLDLTRGLVYSQQVLNALIARGLSRDKAYALVQRNALRSWKEGKSFLELLEADPENPLKGKELRALFDPKPFLRHVDAIYARFGL

SEQ ID NO: 3063 - DNA, 1302 bp, Leptospira interrogans
  CDS (1)..(1302)
atgatcgatcgatattccaatcctgaaatttccaaaatctgggaattagaaaacaagttcgaaatttggaaagaaatagaaatacttgcctgcgaaatcagaatgaaacgaggcgaagttccacaagaagattttcaagaaatcaaatcgaaagctaagtttaatgtggatgaaatccttgaaattgaaagcaaggttcatcacgacgtgatcgcgtttttgacaaatatgaattcctacatcgggcctgcgggaaggcacgttcattacggtttgacttcttcggatattggggacacggctctttgtgtgcaaatggttcaggcaatggatttgattctaaaaaaaacggactcgctgatcgaagtggttcgggaaaaggcgatccagtataagaatcttccctgtatcggacgttctcatgggatccacgccgaacctatgactctgggacttaagttcgcattattttttgaagaattaaaccgaaatagaaaaagaatggccgaagcaagaaacgaaattgctgttggaaaactttccggagccgtcggaacttattctaacatcgatcctgaaatcgaaacctacgtatgtgagaagatgggtttgagggtggatccaattgcaactcaggttgtttctagggatcgtcatgctttttatctttctgtattgggagttaccgcttcttctttggatcgtatggcgaccgagatccgacttttacaaaagacagaaggaagagaagtagaggagcctttttctgcgggtcaaaaagggtcatccgcaatgccccacaaaagaaatcctgtgatctgcgaaagaatctccgggctttccagagtgattcgcgcaaatgtaaacgtgggtttacaagacgtggctctttggcacgaaagggatatttctcattcttctgcggaaagggttgtacttccagattctactattgctttagaatatatcttggataagatgttgttcgtgatcaaaaatcttcacgtttatccagatgcgatcgaaagaacgttaggcgtcactcgtggacttgtattttcgcaaaaggttttactcgctctgatcgaaaaaggtaaaattataagagaagaagcgtatttgatcgttcaagaacacgctatggcggtttgggctagccagtcagaaactttgaaatctagattggaaaaagacgatcgggtcagtaaagttttgactcaaaaagacttagacgacatttttaaaatagaaccttatttggaaaaagtaggattgatctataaaagattgggtcttgaataa

SEQ ID NO: 3064 - protein, 433 aa, Leptospira interrogans
MIDRYSNPEISKIWELENKFEIWKEIEILACEIRMKRGEVPQEDFQEIKSKAKFNVDEILEIESKVHHDVIAFLTNMNSYIGPAGRHVHYGLTSSDIGDTALCVQMVQAMDLILKKTDSLIEVVREKAIQYKNLPCIGRSHGIHAEPMTLGLKFALFFEELNRNRKRMAEARNEIAVGKLSGAVGTYSNIDPEIETYVCEKMGLRVDPIATQVVSRDRHAFYLSVLGVTASSLDRMATEIRLLQKTEGREVEEPFSAGQKGSSAMPHKRNPVICERISGLSRVIRANVNVGLQDVALWHERDISHSSAERVVLPDSTIALEYILDKMLFVIKNLHVYPDAIERTLGVTRGLVFSQKVLLALIEKGKIIREEAYLIVQEHAMAVWASQSETLKSRLEKDDRVSKVLTQKDLDDIFKIEPYLEKVGLIYKRLGLE

SEQ ID NO: 3065 - DNA, 1308 bp, Bacillus cereus
  CDS (1)..(1308)
atgattagtcgttatacacgcccagaaatgggtgcaatttggacggaagagaacaaatttaaagcgtggttagaagttgagattttagcttgtgaagcatgggctgagcttggcgatattccgaaagaagatgttaaaaaaattcgtgagcatgcatcatttgatattgatcgtatttatgaaattgaaaaagagacacgtcatgacgtagttgcattcactcgtgctgtatcagaaacaccagcattaggcgaggaacgtaaatggattcattacggtttaacatctacagacgtagtagatacagcgttatcttacattttaaaacaagcgaatgaaatcatattaaaagacttagaaaactttgtaagtattttagctaacaaagcgaaagagcataaatacacgatcatgatgggaagaacacacggtgttcatgcagaaccaacaacattcggtttaaaacttggtctttggtatgaagaaatgaaacgtaacgtagagcgtttcaaacaagctgctaatacagttcgtgttggtaaattatctggtgcggttggtacatatgcaaatatcgatccattcgtagaaaagtatgtttgtgaaaacttaggattagaagcagcaccaatttcaacacaaacattgcaacgtgatcgccatgcacattacatgtcaacacttgcattaatcgcaacgtctatcgaaaagatggcagttgagattcgtggtttacaaaagagtgaaacacgtgaagttgaagaagctttcgcaaaaggtcaaaagggttcttctgcaatgccgcataagcgtaatccaattggatctgaaaatatgactggtttagctcgtgttatccgcggttatatgatgacagcttatgagaatgttccattatggcatgagcgtgatatttctcactcttcagcagaacgcgtaattttaccagatgctacaatcgcgttaaattacatgctaaaccgctttggtaatattgttaaaaacttaactgtatacccagagaatatgaaacgtaatatgacaagaacatacggcttaatttattctcagcgcgtaatgcttacattaatcgataaaggtatggtacgtgaggaagcttacgatatcgtacaacctaaagcgatggaagcttgggaaacacaagtacaatttaaagagcttgtagaagctgatgagcgtattacgagcaagttaacacaagaagaaattaatgaatgcttcaactatgagcatcatatgcaacacgttgatacaatctttgaacgccttggattaaacgaagcgtaa

SEQ ID NO: 3066 - protein, 435 aa, Bacillus cereus
MISRYTRPEMGAIWTEENKFKAWLEVEILACEAWAELGDIPKEDVKKIREHASFDIDRIYEIEKETRHDVVAFTRAVSETPALGEERKWIHYGLTSTDVVDTALSYILKQANEIILKDLENFVSILANKAKEHKYTIMMGRTHGVHAEPTTFGLKLGLWYEEMKRNVERFKQAANTVRVGKLSGAVGTYANIDPFVEKYVCENLGLEAAPISTQTLQRDRHAHYMSTLALIATSIEKMAVEIRGLQKSETREVEEAFAKGQKGSSAMPHKRNPIGSENMTGLARVIRGYMMTAYENVPLWHERDISHSSAERVILPDATIALNYMLNRFGNIVKNLTVYPENMKRNMTRTYGLIYSQRVMLTLIDKGMVREEAYDIVQPKAMEAWETQVQFKELVEADERITSKLTQEEINECFNYEHHMQHVDTIFERLGLNEA

SEQ ID NO: 3067 - DNA, 1293 bp, Wolbachia pipientis wMel
  CDS (1)..(1293)
atgattccccgctatagcagaaaagaaatgtcttccatttgggaggaaaataataaatttaatatatggcttaaaatagaaaaattagcgtgtgaagctcaagcaaagttaggagtgattccgaataatattgctgagaacctctctggtgctattgaatttgatgttgaatgtatcaacgaaattgaatccattgtaaaacatgatgttatagcttttctgacatatattgctaaaaaagcgggagttgatgttcgttatcttcattatggaatgacaagttctgatgttttggatacatgccttgcggtgcaactgaaagagtcctgtgatattttgctcgagaatctaaaaaatttacttgcagcattgaaaaaaaaagctgaggactataaagatattgtttgtgttggacgcagtcacggaatgcatgcagaaccaacaactcttggaataaaatttgccagattttatgctgaatttaaacgcaattatcagagattaattagcgcgcaaaaagagatctcaatttgtaaaatatcaggtgcagtaggcaattttgcaaatgttgatccgtttgttgaagaatatgtagcgaaagaaatgggactcatacctgaaaccatatcatctcaaatcattcctcgtgatagacatgccatgttcttttcagttttgggagtaattgcaagttcaatagaaaatgttgctgttgaaattcgtcatttgcaaagaactgaaatcggcgaaatttctgagcatttttccactgggcagaagggaagctctgctatgccacacaaatgtaatcctattttaagtgaaaatctgactggactctcacgtttaatacgcagttatgtttttcctgcgttagaaaatgttgcattgtggcacgaacgtgatatatcacactcgtctgtggaaagatgcattgctcctgatgcttgtataacaatggattttgctttagtgcgattaacagatttgatagataaattggtgatcaataaggaaaacattgaaaagaacttaaattcttcaaaaggtttagttttctcacagcgtgtattgcttgagttagtaaatagtggtttggcgagggaagaggcgtataaaattgttcagagcaatgcaatgaaagtgaaacaaaacaacagtgattttctggccgaattgaaacaagataaacccttacttaaggttattaactcggaaaaacttgaatctttgtttgatttgaagtattatacgaaacatatagatcgtgtgtataataaggtttttaattag

SEQ ID NO: 3068 - protein, 430 aa, Wolbachia pipientis wMel
MIPRYSRKEMSSIWEENNKFNIWLKIEKLACEAQAKLGVIPNNIAENLSGAIEFDVECINEIESIVKHDVIAFLTYIAKKAGVDVRYLHYGMTSSDVLDTCLAVQLKESCDILLENLKNLLAALKKKAEDYKDIVCVGRSHGMHAEPTTLGIKFARFYAEFKRNYQRLISAQKEISICKISGAVGNFANVDPFVEEYVAKEMGLIPETISSQIIPRDRHAMFFSVLGVIASSIENVAVEIRHLQRTEIGEISEHFSTGQKGSSAMPHKCNPILSENLTGLSRLIRSYVFPALENVALWHERDISHSSVERCIAPDACITMDFALVRLTDLIDKLVINKENIEKNLNSSKGLVFSQRVLLELVNSGLAREEAYKIVQSNAMKVKQNNSDFLAELKQDKPLLKVINSEKLESLFDLKYYTKHIDRVYNKVFN

SEQ ID NO: 3069 - DNA, 1443 bp, Treponema denticola
  CDS (1)..(1443)
atggaaactagaagtatttttaaaaatatatcgccgatagatcatcgttattccctcccgcaaggaggtctttatgatgaactgtcggtttttttatcggaagaagcaggcatcgtttattgtgccatggccgaaatggccattgtaaaggctcatcttaaaattgcagaagaaaaaaaaggctctttacttccaaaactaagcggcgagcttgaaaaaacattggacgatattgccttaaatattgatccttccgaagtttatgaagaagaacataagacccagcacaatataagagccttggtaaatgtcttaaagaaaaaagtccccgaaaatacggctcccttggttcaccttggagctaccagtgccgacatcctcgacacggccttttctatgaggataagggacgctgtcataaaggtaataattcctcttttaaagaaaaccgaacttttactttgcgatatagctgaaagagaggctgaaacacctcaggtagggagaactcacggtcagcatgcggttccgattaccttcggttatgccgtttccgaatatgtagcccgtttgggtaagtcgattttaaaaatggaagatcttgtaaaagatttgcgcggaaaatttgccggagccgtcggggcttataatgcggcatctttaatagtttccgatccgatgagatttgaaaaaatctaccttgattatctcggcttaaagccttcagaatattctcatcagcttgtggagcccgaatacatgctccgcctccttcttgaagcaaatattgccttcggcataattgcaaaccttgcagacgatttacgcaatttgcaaagaaccgagataggggaggtttttgaatattttagtgcaacacaggtaggctcttctactatgcctcaaaagcgtaacccatggaattccgagcatgtaaaaagcttgtggaaggctttttctccccgcataatgagtttttatatggaccaaatctcggagcaccaaagagatttatccaactctgcaagccaaaggtttatagccgattatctgacaggccttgccttggcctttaaccgtatgaattcaattttaaagggcttacaggccgatagggaaaatatgctcaaaaaccttttacagggcggtggaaaggttaggggaggcgttatggccgagcccgcttatatccttttggcggaatgcggcgtttccgatgcccacgaggtaatacgcaagattacccttgctgccgaaaatcaaaagataagtttttatgaggccttaaaggccgaagaaaaggtctttgctcttgttacggaaagattaaaagagcttaactttgataagccggaagaattttttgcaaaccccgaacgctaccgaggtcttgcaaatgtaaaggcaaaagccttggccgaaaaatataaggctttaatgtaa

SEQ ID NO: 3070 - protein, 480 aa, Treponema denticola
METRSIFKNISPIDHRYSLPQGGLYDELSVFLSEEAGIVYCAMAEMAIVKAHLKIAEEKKGSLLPKLSGELEKTLDDIALNIDPSEVYEEEHKTQHNIRALVNVLKKKVPENTAPLVHLGATSADILDTAFSMRIRDAVIKVIIPLLKKTELLLCDIAEREAETPQVGRTHGQHAVPITFGYAVSEYVARLGKSILKMEDLVKDLRGKFAGAVGAYNAASLIVSDPMRFEKIYLDYLGLKPSEYSHQLVEPEYMLRLLLEANIAFGIIANLADDLRNLQRTEIGEVFEYFSATQVGSSTMPQKRNPWNSEHVKSLWKAFSPRIMSFYMDQISEHQRDLSNSASQRFIADYLTGLALAFNRMNSILKGLQADRENMLKNLLQGGGKVRGGVMAEPAYILLAECGVSDAHEVIRKITLAAENQKISFYEALKAEEKVFALVTERLKELNFDKPEEFFANPERYRGLANVKAKALAEKYKALM

SEQ ID NO: 3071 - DNA, 1419 bp, Mycobacterium paratuberculosis
  CDS (1)..(1419)
atgagcattccgaatgtgctggctgcccggtacgccagtgccgagatggttgcgatctggtcgccggaagccaaagtggtcgccgagcggcggctgtggctcgcggtgctgcgcgcgcagcaacagttgggtgtcgcggttcccgccgaggcgatcgcggactacgagcgggtactcgaggacgtcgatctggcctcgatcgcggaccgcgaacgcctgctgcgccacgacgtcaaggcccgcatcgaggaattcaacgcgctggccggccacgagcacgtgcacaagggcatgaccagccgggatctgaccgagaacgtcgagcagctgcagatccggcgctccctggaactggtcttcgcccacggcgtcgcggtcgccgctcggctggccgaacgggcggtggcctaccgcgatctggtgatggccgggcgcagccacaacgtcgccgcccaggccaccaccttgggcaagcgattcgcctcggccgcccaggagacgctgatcgcgttggcccggctgcgcgagttgatcgaccgttacccgttgcgcggcatcaagggcccgatgggcacgtcgcaggacatgctcgacctgatcggcggcgacccggccaagctcgccgaactcgagcggcgggtcgccgaattcctgggtttctcaatggttttgaccagcgtcgggcaggtgtacccgcggtcgctggaccacgacgtggtctccgcgctggtgcagctgggcgccggcccctcgtcgatggcgcacaccatccggctgatggccgggcacgaactggtcaccgagggattcgcgccgggtcaggtcgggtcgtcggcgatgccgcacaagatgaacacccgcagctgcgaacgggtcaacggcctacaggtggtgctgcgcggctacgcctcgatggccgccgaactggccggcgcgcagtggaacgagggcgacgtgttctgctcggtggtgcgccgagttgcattgccggacagcttctttgccatcgacgggcagatcgagacgtttctgacggtgctcgacgagttcggcgcctacccggcggtgatcggtcgcgagctggaccgctacctgccgttcttggccaccaccaaggtgttgatcgccgcggtgcgcgccgggatgggccgcgaggccgcgcatcacgtgatccgcgagcacgcggtggccacggcattggcgatgcgggaacacggcgccgagcccgacctgttggagcggctggccgccgacgagcggctgccgctggaccgggcggccctggacgccgcgctggccgacaggcgggcgttcaccggcgccgccgccgaccaggtggacgaggtggccgcccaggtggacgccctggtgagccgctacccggacgcggccaagtacaccccgggggccatcctgtga

SEQ ID NO: 3072 - protein, 472 aa, Mycobacterium paratuberculosis
MSIPNVLAARYASAEMVAIWSPEAKVVAERRLWLAVLRAQQQLGVAVPAEAIADYERVLEDVDLASIADRERLLRHDVKARIEEFNALAGHEHVHKGMTSRDLTENVEQLQIRRSLELVFAHGVAVAARLAERAVAYRDLVMAGRSHNVAAQATTLGKRFASAAQETLIALARLRELIDRYPLRGIKGPMGTSQDMLDLIGGDPAKLAELERRVAEFLGFSMVLTSVGQVYPRSLDHDVVSALVQLGAGPSSMAHTIRLMAGHELVTEGFAPGQVGSSAMPHKMNTRSCERVNGLQVVLRGYASMAAELAGAQWNEGDVFCSVVRRVALPDSFFAIDGQIETFLTVLDEFGAYPAVIGRELDRYLPFLATTKVLIAAVRAGMGREAAHHVIREHAVATALAMREHGAEPDLLERLAADERLPLDRAALDAALADRRAFTGAAADQVDEVAAQVDALVSRYPDAAKYTPGAIL

SEQ ID NO: 3073 - DNA, 1296 bp, Geobacter sulfurreducens
  CDS (1)..(1296)
atgatcgaacgttacagccgtcccgaaatggcccgtatctgggaaccgcgcaatcgctaccagaagtggctcgacatcgagatttacgcctgcgaggcccacgctgacctgggcaacgtgccccgcgacgcggtagagcgcatcaaggcaaaggctgacttcgacgtagaccgcattgatgagatcgagcggacggtgaagcacgacgtcatcgcctttctcacctccgttgccgactacatcggagatgattcacgctttgtccacttgggactcacctcgtcggacgtgctcgatacctcgttcgccatgctgctggccgaggcctccgatctcatcatcgatgacatcaagcggctcatggaggtcattaagcgccgcgcctacgaacacaaggatacgccgatgatggggcgttcccacggcatccatgccgaaccggtcaccttcggcatcaagatggctctctggtacgacgagatgaagcgcaatctccgccggatggaggctgcccgggaaaccattgcctacggcaagatatccggggcggtcggcacctttgccaacattgatccgatggtagaggaggctgtttgcgccaaggcagggctcaagccggctccctgttcgacccaggtgatccagcgggaccgccacgcggagttcttctccaccctggcgatcatcgccacctccatcgagaagtttgccgtggagattcgtcatctccagcggaccgaagtgctcgaggccgaagagtttttcagcaaggggcaaaaggggtcgtcagccatgccccacaaacgcaatcccgtcctctccgagaacctgaccggtcttgcacggctcatgcggggctattcggtatccgccctcgaaaacgtacccctctggcacgagcgggacatctctcactcgtccgtcgagcgagtcatcggcccggatgctaccatctgtctcgatttcatgctcaaccggaccatcggcctcatcgacaatctcgtggtttaccccgagaacatgatgcggaacctgaatctcatgcgcggactcattttctctcagcgggtgctccttaagttggccactgccggtgcgtcccgcgagaaggcctatgaactggtccagcgcaatgctatgaaggtgtgggagcagggcaaggatttccaggaagaacttctggccgacggtgaagtgcgcggtttcctcccggaggatgaaatccgtgaggcttttgacctcaactaccacctgaagcatgtgaacaccatcttcacgagggtcttcggtggctga

SEQ ID NO: 3074 - protein, 431 aa, Geobacter sulfurreducens
MIERYSRPEMARIWEPRNRYQKWLDIEIYACEAHADLGNVPRDAVERIKAKADFDVDRIDEIERTVKHDVIAFLTSVADYIGDDSRFVHLGLTSSDVLDTSFAMLLAEASDLIIDDIKRLMEVIKRRAYEHKDTPMMGRSHGIHAEPVTFGIKMALWYDEMKRNLRRMEAARETIAYGKISGAVGTFANIDPMVEEAVCAKAGLKPAPCSTQVIQRDRHAEFFSTLAIIATSIEKFAVEIRHLQRTEVLEAEEFFSKGQKGSSAMPHKRNPVLSENLTGLARLMRGYSVSALENVPLWHERDISHSSVERVIGPDATICLDFMLNRTIGLIDNLVVYPENMMRNLNLMRGLIFSQRVLLKLATAGASREKAYELVQRNAMKVWEQGKDFQEELLADGEVRGFLPEDEIREAFDLNYHLKHVNTIFTRVFGG

SEQ ID NO: 3075 - DNA, 1296 bp, Lactobacillus johnsonii
  CDS (1)..(1296)
atgttagaacgttatactcgtccagaaatgggcaaaatttggtccttagaaaataaatacgctgcttggttaaaggtagaaatcgctgcaactaacacatgggcagaacttggtgaagtgccagaagcagatgctaagaagattgcagacaatgcttcttttactgttgagcgtgtttcagaacttgaagccattacccaccatgatgtggttgcttttacgagaacagtttctgaaagtttaggtgaagagaagaagtgggttcacttcggcttaacttcaactgatgttgtggatactgcacaaggttatatcttaaagcaagctaatgagatcattttgaaagacttagaggctttaaaagaaactattgccgaaaaagctaagaagtacaaatacactgttgaaatgggccgtactcacggtgttcaagcagaaccaactacttttggtttgaagcttgctcgctggtatgctgagattaaccgtgatattgaacgctttaaagcagcagctaaagatgtagaatctggtaagatttctggtgccgttggtacttttgcaaatgtgccaccagcagttgaaactagcgttttaaagcagttaggtttaactcagcaacctgtaactagtcaagttttaccaagagatttacatgcgtactacattgctacaattgccttaattgcaaccagtattgaaaattgggctactgaaattcgtggtttgcaaagaagtgaaattcatgaagttgaagaacactttagagctggccaaaagggctcttctgcaatgcctcataagcataatccaattggttctgaaaacttatgcgggatggcgagagtaatgcgtggctacatggtaccagcttatgaagatgtagctttatggcatgaaagagatatttctcattcaagtgctgaacgtgtaattttacctgatgcaaccattggaattgactacatgttgaaccgtttcaaccgcatcttaaccaacttagatgttttcccagaaacaatgctcaagaatatggatcgtacttatggcttgatctattcacaacgtgtgcttttgaagttaattgatgaagcaggtttatcacgtgaaaaggcttatgatatggtgcaaaagctagctaataagtcttggcaagaacaaacttcatttagaaagttaattgaagacagtgaagttatgaattacttgtctgaagaagatctagacgatgcttttgattatcattatcacttgaagcatgttgatgaaatttttgaaaagtgcggcttagattaa

SEQ ID NO: 3076 - protein, 431 aa, Lactobacillus johnsonii
MLERYTRPEMGKIWSLENKYAAWLKVEIAATNTWAELGEVPEADAKKIADNASFTVERVSELEAITHHDVVAFTRTVSESLGEEKKWVHFGLTSTDVVDTAQGYILKQANEIILKDLEALKETIAEKAKKYKYTVEMGRTHGVQAEPTTFGLKLARWYAEINRDIERFKAAAKDVESGKISGAVGTFANVPPAVETSVLKQLGLTQQPVTSQVLPRDLHAYYIATIALIATSIENWATEIRGLQRSEIHEVEEHFRAGQKGSSAMPHKHNPIGSENLCGMARVMRGYMVPAYEDVALWHERDISHSSAERVILPDATIGIDYMLNRFNRILTNLDVFPETMLKNMDRTYGLIYSQRVLLKLIDEAGLSREKAYDMVQKLANKSWQEQTSFRKLIEDSEVMNYLSEEDLDDAFDYHYHLKHVDEIFEKCGLD

SEQ ID NO: 3077 - DNA, 1449 bp, Ashbya gossypii
  CDS (1)..(1449)
atgtctgagtttgataagtacgctacacccctctcctcgcgttatgcgtctgaggagatgtcatcgctcttctccttgagacacaggttttctacttggagaaagctctggctaaacctggccattgccgagaaggaactcgggctgtctgtcatcacagatgaggccattgcacagatgagggagcatctcacgatcaccgatgaggagattgctcaggccgctaagcaagaggcgattgtgagacatgacgttatggcgcaggtccatacctttggtgaaacctgccctgcagcagcaggtatcatacatttgggcgctacctcttgttttgttaccgataacgcggacctgatcttcatgcgcgatgcttatgacattattattccgaaattggtgaacgtcatcaacaggctctcaaagtttgcttgcgaatataaggatttaccagttcttggatggactcatttccagccggcacagctcacgacccttgggaagagagccaccctgtggatccaggaacttctctgggacctgcggaactttgtaagagcgagaaacgatatcgggctaagaggtgtcaagggtactaccggtactcaagcgtccttcctggcgttatttcatggcgaccacgacagggtcgaagcgttggacaagagagttacagagctactggggttcgacattgtctacccggtgactggccagacatattccagaaagatagatattgacattctggggagcggatcatcttttgaagccactgcgcacaagatggccaccgacatcaggttgttggcaaacctgaaggaagtggaggaaccctttgagaagacccagattgggtcttcagcgatggcatacaagagaaaccccatgagatgcgagcgcgtctgctctctggcccgccatctgggctctctatttaacgacgctgttcagacagcctcggtccaatggtttgagaggaccttggacgactcggccattagaagaatctcgctccctagtgcatttttgactgccgacattcttttgagtactttgttgaacatttcatccggtatggtggtctatccaaaggtcatcgaaagaagaatcaagagcgagctgccgttcatggccaccgagaacgtgatcatggccatggtcgagaagggcgcctcgagacaggaggtgcacgaggccatcagggtcctgtcccaccaggcggccgctgtcgtcaaggaagagggcggtgacaacgacctgatcgagcggatcaaggccgacgcattgttccagcccatctggaacgagctggattccctgctggacccctccacgtttgtgggcagggccccacagcaggtggagaagttcatcaacaacgacgttaaatctgcattggcccccttcagcgaacacatcaccgatgccgcgttcaaccttaacgtctga

SEQ ID NO: 3078 - protein, 482 aa, Ashbya gossypii
MSEFDKYATPLSSRYASEEMSSLFSLRHRFSTWRKLWLNLAIAEKELGLSVITDEAIAQMREHLTITDEEIAQAAKQEAIVRHDVMAQVHTFGETCPAAAGIIHLGATSCFVTDNADLIFMRDAYDIIIPKLVNVINRLSKFACEYKDLPVLGWTHFQPAQLTTLGKRATLWIQELLWDLRNFVRARNDIGLRGVKGTTGTQASFLALFHGDHDRVEALDKRVTELLGFDIVYPVTGQTYSRKIDIDILGSGSSFEATAHKMATDIRLLANLKEVEEPFEKTQIGSSAMAYKRNPMRCERVCSLARHLGSLFNDAVQTASVQWFERTLDDSAIRRISLPSAFLTADILLSTLLNISSGMVVYPKVIERRIKSELPFMATENVIMAMVEKGASRQEVHEAIRVLSHQAAAVVKEEGGDNDLIERIKADALFQPIWNELDSLLDPSTFVGRAPQQVEKFINNDVKSALAPFSEHITDAAFNLNV

SEQ ID NO: 3079 - DNA, 1377 bp, Plasmodium chabaudi chabaudi
  CDS (1)..(1377)
atggaaaacctaaaaaacatttccccaatcgatgggaggtacaaaaagtcttgtaaagagatttccgaatatttctctgagtatgctttgataaaatataggatatatgtagaaatacaatggcttatttttttaagtgaaaaggaatttttttataaaaaactaagtgtaaaagcaattgatgagttacaaaaaatagcagatataaatgatgaggatgtattgagattgaaaaaaattgaagaagaaacaaatcatgatgttaaggcagttgaatattttattaaagaaaaaataaatcaaaataatggtgagcttgttaatataaaagagtatgtacattatttatgtactagtgaagatataaataatatagcatatgctatatgtataaaatcctgtttaaataatataataatacctcatatagagaaaataatgaatcgattaaaagagttagcatctgagtatagtcaggtttctatattatctagaacccatggccaacctgcatctgcaacaacctttggaaaagaaatggcgaactattttgatagattaaagagacatatatctacattaaaaaacataaaaatatatggaaaatttaatggagcagttggtaattttaatgctcataaaatagctaatagtaatattgattgggtaaataatataaaatactttgtagaaaaatattttgatattaattatagtttatattgtacacaaatacaagatcatgattatatatgtgaaatttcagatgcattaggaagaattaattccacacttttagatttatctatagatatatggttatatatatcaaataatttattaaaattaaaacacgtaaaaaatgaaataggtagtagtactatgccacataaaataaacccaattgattttgaaaatgctgaaggaaatttacatctagctaatgcactttttaaagccttcagtgcaaaactttctataagtaggttacaaagagatttatcggattcaacagttttacgaaatattggtagttcatatgcttattctcttattgcttataaatcaattttaagaggtttaacaaaaattgatatcaatgagcaatcagcatctcaagagttaaataataattggagtaccctagctgagcccgttcaaattgttttaaaaaattttaattttccaaatgcttatgaagaattaaaaaattttacacgtggaaagactattgataaagaactaatgcaagaatatattaaaaccaaatcagaattcataccaccaaatgctatgaaccaattgttggaacttactcccaacacttatataggatatgctgattatttagctaacaatgttgataaaacggaataa

SEQ ID NO: 3080 - protein, 458 aa, Plasmodium chabaudi chabaudi
MENLKNISPIDGRYKKSCKEISEYFSEYALIKYRIYVEIQWLIFLSEKEFFYKKLSVKAIDELQKIADINDEDVLRLKKIEEETNHDVKAVEYFIKEKINQNNGELVNIKEYVHYLCTSEDINNIAYAICIKSCLNNIIIPHIEKIMNRLKELASEYSQVSILSRTHGQPASATTFGKEMANYFDRLKRHISTLKNIKIYGKFNGAVGNFNAHKIANSNIDWVNNIKYFVEKYFDINYSLYCTQIQDHDYICEISDALGRINSTLLDLSIDIWLYISNNLLKLKHVKNEIGSSTMPHKINPIDFENAEGNLHLANALFKAFSAKLSISRLQRDLSDSTVLRNIGSSYAYSLIAYKSILRGLTKIDINEQSASQELNNNWSTLAEPVQIVLKNFNFPNAYEELKNFTRGKTIDKELMQEYIKTKSEFIPPNAMNQLLELTPNTYIGYADYLANNVDKTE

SEQ ID NO: 3081 - DNA, 1329 bp, Wolinella succinogenes
  CDS (1)..(1329)
atggttgagcgctacgctagggaagagatgaagaatctatggacacaagaggccaaatatgatgcatggctcaaggttgaaaaagccgcagtcaaagcatggaatcgcttgggtctcatccccgatgaggcgtgtgaaaaaatctgtgccaatgcctcttttagcgtagcaagaatcgatgagatcgaagcgaccaccaagcatgatgtgatcgctttcctcacctcagtctctgagagcctcggcgaggaatcgcgctttgtccactatggcatgaccagctctgattgtatcgataccgctgttgccctccagatgcgcgatagtctaagccttatcctccaagatgtgaacgaattgatggaggcgctcaaaaaacgcgcacttgagcatcaacacactctcatggtcggacgaagccacggaatccatggcgaacccatcacttttggattggtgttagcgatttggtatgatgagatccatcgccacctcaaagccctccaagagacgatgaaggtgatctctgcgggcaaaataagcggtgcgatgggtaacttcgcccacgcccccttagagcttgaggagtatgtctgcgaagagcttgggctcactccagcgcctgcaagcaaccaagtgattcagcgcgatcgctacgctaggcttatgagcgaccttgcgctcctagcgagcagttgcgaaaagatcgccattgctatacggcactatcagcgcaccgaggtttacgaggcggaggagtatttctcccccggtcaaaagggaagctccgccatgccccacaagcgtaatcctgtcctcaccgaaaacatcacagggctttgccgcatgattcgaagctatgcgattcccgccatggagaatgtcgccctttggcatgagcgtgacatctctcacagttccgtggagcgattcatcctgcctgatggctttatcaccaccgatttcatgctcaagcgcctcactggagtgatcgaaaagctagtggtctatccagaaaacatgatgaaaaacctcaacctcacgggcggtcttgtcttctctcaaagaatccttctagagcttcctttgcagggggtgagtcgtgaggatgcctacaagatcgttcagcgcaatgcgatgaaggtttgggccgatctccagcaagggaaaagcgcgctcaatgagaaaggtgagagcctctacctccagcacctcttaggggatgaagagcttcgcgaaaagctctccgaagaggccatcagagcctgctttgactatggttattacaccaaaaatgtggggggaatcttctcccgcgtctttggataa

SEQ ID NO: 3082 - protein, 442 aa, Wolinella succinogenes
MVERYAREEMKNLWTQEAKYDAWLKVEKAAVKAWNRLGLIPDEACEKICANASFSVARIDEIEATTKHDVIAFLTSVSESLGEESRFVHYGMTSSDCIDTAVALQMRDSLSLILQDVNELMEALKKRALEHQHTLMVGRSHGIHGEPITFGLVLAIWYDEIHRHLKALQETMKVISAGKISGAMGNFAHAPLELEEYVCEELGLTPAPASNQVIQRDRYARLMSDLALLASSCEKIAIAIRHYQRTEVYEAEEYFSPGQKGSSAMPHKRNPVLTENITGLCRMIRSYAIPAMENVALWHERDISHSSVERFILPDGFITTDFMLKRLTGVIEKLVVYPENMMKNLNLTGGLVFSQRILLELPLQGVSREDAYKIVQRNAMKVWADLQQGKSALNEKGESLYLQHLLGDEELREKLSEEAIRACFDYGYYTKNVGGIFSRVFG

SEQ ID NO: 3083 - DNA, 1380 bp, Vibrio vulnificus
  CDS (1)..(1380)
atggagcttaggacaccatttatgcaaggttcaaacgtatccgtatttgattcaagcctttattctccgctgtttactcaaaagcagatgaagcaggtttggtcggatgaaaatttaatccgcacttggctgacttttgaaaccaagattgcagaggcacaagcagagttggggttaattccccactctgcagcaagcgctatcaaacaagtgtgcgatattcgccatttagattgggcgcgcttagcacaagacacacaaaccgtcggtatggccatcaaacctctggttgatcagctctcggagcaaggcaatgatgaagtaaaacaatatctgcactggggttgcaccacccaagacttgctcgataccagtcttgcgatgcgcttaaagcagacgttgcacatcgttcgtcaacagttggttgcgttaggcgatcagcttgcgtcaatggcattacaccataagcgcacggtgatggttgcaagaaccaacgcaatggacgctttgccgaccacctgggggcttcaagtcagtggttatcttcaagagatcactcggcatctcacacgccttgatgagctctatcctcgtgtgacgaccggtctctatggtggtgccgttggtaatttgtcttcaatcggctcccacgggttagcggttcggcagcgactatttgctaagctcgaattgactgaaccgaaaggattgggcaatgccagcttagataatattgttgagttaattcagttctttgccttaatccacggtaccttatgccgcatcgcgaatgatacggaactcatggggcgagcagctcttggtgaggtgtgcgaaggtgagtcgggtggggggtcaagcaccatgccccataaagccaaccccagagccgccaatatgatccagaccttatctcgaatggggtggatgtatgccagtggcgcgcccaatctgatggatcaacaagatgttcgtgccgcttcaatgcgcgtgctgaattggagcttagtgcctgaggcgtcgttggccgtttccaccgctctggagcgtggggagcgactcgttgcgaacctcatcgtcaatcaagacaaaatgcgcagtaatttttcagcgtctcggaatttcattatgtcagaggcggtaatgatgaaagcggccgaaaaagtgggacgcagcatggggtacagctgcgtcaaaatggccattgctcaagcgccagaacaaggcgatttagcgcaaatattgaaacaaaacccagaggtatccgcgatattaacggaccaagaaatcgacgccgcttgcgatcctcaacactatcttggctgtaatgatgcgttgattgatgaaacggtagagctctatcgaaaggtgattcgctaa

SEQ ID NO: 3084 - protein, 459 aa, Vibrio vulnificus
MELRTPFMQGSNVSVFDSSLYSPLFTQKQMKQVWSDENLIRTWLTFETKIAEAQAELGLIPHSAASAIKQVCDIRHLDWARLAQDTQTVGMAIKPLVDQLSEQGNDEVKQYLHWGCTTQDLLDTSLAMRLKQTLHIVRQQLVALGDQLASMALHHKRTVMVARTNAMDALPTTWGLQVSGYLQEITRHLTRLDELYPRVTTGLYGGAVGNLSSIGSHGLAVRQRLFAKLELTEPKGLGNASLDNIVELIQFFALIHGTLCRIANDTELMGRAALGEVCEGESGGGSSTMPHKANPRAANMIQTLSRMGWMYASGAPNLMDQQDVRAASMRVLNWSLVPEASLAVSTALERGERLVANLIVNQDKMRSNFSASRNFIMSEAVMMKAAEKVGRSMGYSCVKMAIAQAPEQGDLAQILKQNPEVSAILTDQEIDAACDPQHYLGCNDALIDETVELYRKVIR

SEQ ID NO: 3085 - DNA, 1344 bp, Porphyromonas gingivalis
  CDS (1)..(1344)
atgattgctttccaagccctgcaagccatctctccgatagatggccggtatcgcaacaaagtagaagtacttagtcgctatttttcagaaggatctctaattcgctatcgtgtaaaagtggaggtggagtatttcatcgctctttgcaatgaattgccttcgctgaaagatgtgtgccctccatctttagaggaagagttgcgccgtatataccaagactttagcgagaaggatgccgtacgtgtaaaggaaatagaggcggtaacgaatcatgacgtcaaggctgtggagtatttcctcaaagagcggttcgaggccatggggatacgagatgccaaagaatttatccatttcggtctgacctcgcaggatgtaaacaatacggctttcccgatgatgatacgcgaggcaatgaccgaggtttacttgcccgctttacaggagctggtggagcagcttcatgcttatgcccttcagtggaaagatgtcccgatgctggccaaaacgcatggacagccggcgtcgcccactcgcttaggaaaggaaatagaagtattcgtctatcgcttgcgcaagcagatcgacttgctgctggaagtacctcattcagccaaattcggtggtgctacgggcaatttcaatgcgcatcatgtggcttatcctgatcatgactggagcgatttcggccgtcggtttgtaacttctctcgggcttgaacgggaagaactcactacacaaatatccaactacgacaacatggcagccttatttgatgcctgctgtcgcatcaatgtgatactgatcgacctctgccgtgatttctggcagtacatttcgatggagtacttcaaacagaagatcaaggccggcgaggtcggttcttctgccatgccacataaagtgaatccgatcgactatgaaaatgccgaaggcaatctgggtattgcgaatgccatatttgagcatttgtcgcgcaaattgcctatttcccgcttgcagcgagatctgacggattccactgtacttcgtaacgtgggaactcctttggcgcattctctcatagcagtcacgagcatagccaaagggcttggcaaactgcttctcaacgaagctgctctcgatcgggatttgcagaacaactatgctgtggtggctgaggctatacaaactattcttcgtagagaagggtatcccaatccatacgaaacgttgaaggctctgacgcgtacgaatgagacggtgacagccgaatccattgcaagttttatcgaagcattggatattgatgaaaccgtgaaggaggaaatgcgccgcatatcaccttctaattacgtgggaatctga

SEQ ID NO: 3086 - protein, 447 aa, Porphyromonas gingivalis
MIAFQALQAISPIDGRYRNKVEVLSRYFSEGSLIRYRVKVEVEYFIALCNELPSLKDVCPPSLEEELRRIYQDFSEKDAVRVKEIEAVTNHDVKAVEYFLKERFEAMGIRDAKEFIHFGLTSQDVNNTAFPMMIREAMTEVYLPALQELVEQLHAYALQWKDVPMLAKTHGQPASPTRLGKEIEVFVYRLRKQIDLLLEVPHSAKFGGATGNFNAHHVAYPDHDWSDFGRRFVTSLGLEREELTTQISNYDNMAALFDACCRINVILIDLCRDFWQYISMEYFKQKIKAGEVGSSAMPHKVNPIDYENAEGNLGIANAIFEHLSRKLPISRLQRDLTDSTVLRNVGTPLAHSLIAVTSIAKGLGKLLLNEAALDRDLQNNYAVVAEAIQTILRREGYPNPYETLKALTRTNETVTAESIASFIEALDIDETVKEEMRRISPSNYVGI

SEQ ID NO: 3087 - DNA, 1371 bp, Photorhabdus luminescens
  CDS (1)..(1371)
atggaattatcctcactgactgctgtttctccgatcgatggccgttacggcgataaagtcagcgtattacgtaccatttttagtgagtttggcttactgaaattccgcgtacaggttgaagtacgttggctgcaaaaactggcagaatgtgctgaaattaaagaagttcccgcgtttgatacagacgcaaacgcttacctgaatgaaattatcgcaaatttcaatgaacaggatgcaatgcgtattaaaactatcgaacgcaccactaaccacgatgtcaaagcagtggaatattttctgaaagagaaagttgcacatattcctgcactacatcaagtttctgagtttattcactttgcctgtacttctgaagatattaacaatctagcttatgcgctgatgctacaaaccgcccgagaagaagtacttttaccccaatggcgtcagatgattgataccatcaaaaaaatggcgagtgaatatcgagacttaccactgttatctcgcactcacggccaaccagccacaccttccacggttggtaaagagtttgccaatgttgctcaccggatggaacgccagtatcgccaactggaacaagtcgaaatactcggtaaaattaatggtgccgtaggtaactataatgcccatatagccgcttacccacaggttgattggcatcagtttagtgaaacttttgtgacttcactcggcatcaaatggaatccatacacgacccaaatcgaaccccatgattatattgctgaattgttcgatactatcgcccgtttcaacacgattctgatcgattttgaccgtgacatttggggttacatcgcacttaaccatttcaaacagaaaacggttgccggtgaaatcggttcttccactatgccacacaaagtcaatccaattgattttgaaaactcggaaggcaatttggggctggcaaatgcggtatttggtcatctggcaagcaagttaccgatttcccgttggcaacgagatctgactgattcaactgtattgcgtaaccttggagttggcctgggatatgctctgatcgcttatcaatctacgatgaaaggcttaaataagttagaagtcaatgagcagcacctgctggatgagctagataaaaactgggaagtgctggctgaacctatccagacagtgatgcgtcgctatggtatcgaaaagccttatgaaaaactcaaagaacttacccgcggtaaacgcgtcaacggtgaaggaatgaaaacctttatcgatggactggatttaccggaagaagagaaaatacgattgaaagccatgacgccagcaaattatattggccgtgcaatcacactggttgatgaattgaagtag

SEQ ID NO: 3088 - protein, 456 aa, Photorhabdus luminescens
MELSSLTAVSPIDGRYGDKVSVLRTIFSEFGLLKFRVQVEVRWLQKLAECAEIKEVPAFDTDANAYLNEIIANFNEQDAMRIKTIERTTNHDVKAVEYFLKEKVAHIPALHQVSEFIHFACTSEDINNLAYALMLQTAREEVLLPQWRQMIDTIKKMASEYRDLPLLSRTHGQPATPSTVGKEFANVAHRMERQYRQLEQVEILGKINGAVGNYNAHIAAYPQVDWHQFSETFVTSLGIKWNPYTTQIEPHDYIAELFDTIARFNTILIDFDRDIWGYIALNHFKQKTVAGEIGSSTMPHKVNPIDFENSEGNLGLANAVFGHLASKLPISRWQRDLTDSTVLRNLGVGLGYALIAYQSTMKGLNKLEVNEQHLLDELDKNWEVLAEPIQTVMRRYGIEKPYEKLKELTRGKRVNGEGMKTFIDGLDLPEEEKIRLKAMTPANYIGRAITLVDELK

SEQ ID NO: 3089 - DNA, 1296 bp, Gloeobacter violaceus
  CDS (1)..(1296)
atgatcgagcgctataccctgcccgagatgggcgctctgtggactgaggagcagaagtatcgcaactggttaaaggtagaactggccgcctgcgaggcaatggtggagttgggtgagattccgcagggggcgtggcaggagatccgcaccaaggccggcttcgacgtcgggcgcatcgctgaattggaagccgaagtgcgccacgatgtgatcgcgtttttgacgagtgtcaacgagcatgtcggcccggcaggaagattcatccacctggggctcaccagttcggacgtactcgatacggccctggcgctgcagctggtgcagacgctcgatgtccttgctctaagactggaggaactgatcgccgccacgcgcgcaaaggcgcgcgagcaccgagacaccgtgatgatcggccgcacccacggcatccacgccgagcccatcaccttcggcttcaagctcgcgggttggcttgcagaactcgcccgccacgccgagcgcctgcgcgccctcagaccgcgtctggcagcgggcaagctctccggagcggtgggcacctatgccaatctcgatccgcgcgtcgaagcgcgcgcctgcgagctattgggtttggttcccgacaccgcctccacccaggtgatcagccgcgaccgccacgccgaatttgtgcaggccctggcgctgacggccgggtcgatcgaacgctttgccgtcgagatccgcaacttgcagcgcaccgacgtgctcgaagtggaggaatacttcgccgcgggccagaaaggttcctcggccatgccccacaagcgcaatccgatcgcctccgagcaactgaccgggctggcgcgcatcgtgcgctccaacgccacggcggccctggagaatatggccctctggcacgagcgcgacatctcccactcgtctgtggaacgggtgattctaccggacagtgcgatcctcgtgcactacatgctcgtcaaattcaccgctctggtcgaaaagcttgcggtctaccccgagaacatggcacgcaacctgcatcgctatggcggcgtcgtcttcagccaacgggtgctcctggcactggtagcaaaaggtctcacccgcgaggaagcctaccgcatcgtacagaccaacgctcacaaagcctggaaccgcgagggaggcgattttcgagccctgatcgaggccgatcctgaggtgcagatcctcctggccccggccgaattggcagcctgcttcgagccgaggcaccacctgaagcacttggataccatctttgcccggctggaaatctag

SEQ ID NO: 3090 - protein, 431 aa, Gloeobacter violaceus
MIERYTLPEMGALWTEEQKYRNWLKVELAACEAMVELGEIPQGAWQEIRTKAGFDVGRIAELEAEVRHDVIAFLTSVNEHVGPAGRFIHLGLTSSDVLDTALALQLVQTLDVLALRLEELIAATRAKAREHRDTVMIGRTHGIHAEPITFGFKLAGWLAELARHAERLRALRPRLAAGKLSGAVGTYANLDPRVEARACELLGLVPDTASTQVISRDRHAEFVQALALTAGSIERFAVEIRNLQRTDVLEVEEYFAAGQKGSSAMPHKRNPIASEQLTGLARIVRSNATAALENMALWHERDISHSSVERVILPDSAILVHYMLVKFTALVEKLAVYPENMARNLHRYGGVVFSQRVLLALVAKGLTREEAYRIVQTNAHKAWNREGGDFRALIEADPEVQILLAPAELAACFEPRHHLKHLDTIFARLEI

SEQ ID NO: 3091 - DNA, 1371 bp, Chromobacterium violaceum
  CDS (1)..(1371)
atgaatctgactacgttgaccgccctctctccgctggatggccgctacgccggccaggtggaaggcctgcgcaacctgttctccgaattcggcctgatgaagtgccgcgtcaaggtggagctggaatggctgaaaatgctggccgccgagccgggcatcgaagaagtcaagccgttctccgacgccaccatccgcgagatcgacgacgtgatcgccaatttcagcgtcgagcacggcgaagaggtgaaggcgatcgaagtccgcaccaaccacgacgtcaaggcgatcgagtactggctgaaggagcgcctgtcgggcaatccggaagtgatggccgccagcgagttcatccacttcgcctgcacctccgaggacatcaacaacctcagccacgcgctgatgctgaagaccgcgcgcaacaccgtgctgctgccggcgctggacgaagtgatccacaagctgcagaagctggcgcacgagttggccgacacgccgatgatgtgccgcacccacggccagccggccacgccgtcgacgatgggcaaggagctggccaacgccgtctaccgcctgaagcgccagcgcgagcagctggtgcaccaggaaatcctgggcaagattaacggcgcggtcggcaactacaacgcccacctgtccgcctacccggacatcgactgggaaagcctgtgcggccgcttcgtcaccggtctgggcatcaccttcaatccgtacaccatccagatcgagccgcacgactacatggccgagctgtaccaggtggcgatgcgcgtcaacaccatcctgatcgacctgaaccgcgacatctggggctacatctcgctgggctacttcaagcagaaggtgaagaaggacgaagtgggcagctccaccatgccgcacaaggtcaacccgatcgacttcgaaaactcagaaggcaacctgggcatggccaacgccatcatgggccacctggcggaaaaactgccgatctcccgctggcagcgcgatctgaccgactccaccgtgctgcgcaatatgggggtcggcttcggctacaccatcctgggcctgaagtcctgcctgaaaggcctgaacaagctggagatcaatccggccctgatcgcggccgagctggacgccgcctgggagctgctggccgagccggtgcagaccgtgatgcgccgctacggcatcgccaacccgtacgagcagctgaaggagctgacccgcggcaagggcggcatcacccgcgagacgctgcacgccttcatccgcggcctggagctgccggacgcggtcaaggccagcctgctggaactgaccccgtccaactacttgggcaaggccgaggaactggcgcgccgcatctga

SEQ ID NO: 3092 - protein, 456 aa, Chromobacterium violaceum
MNLTTLTALSPLDGRYAGQVEGLRNLFSEFGLMKCRVKVELEWLKMLAAEPGIEEVKPFSDATIREIDDVIANFSVEHGEEVKAIEVRTNHDVKAIEYWLKERLSGNPEVMAASEFIHFACTSEDINNLSHALMLKTARNTVLLPALDEVIHKLQKLAHELADTPMMCRTHGQPATPSTMGKELANAVYRLKRQREQLVHQEILGKINGAVGNYNAHLSAYPDIDWESLCGRFVTGLGITFNPYTIQIEPHDYMAELYQVAMRVNTILIDLNRDIWGYISLGYFKQKVKKDEVGSSTMPHKVNPIDFENSEGNLGMANAIMGHLAEKLPISRWQRDLTDSTVLRNMGVGFGYTILGLKSCLKGLNKLEINPALIAAELDAAWELLAEPVQTVMRRYGIANPYEQLKELTRGKGGITRETLHAFIRGLELPDAVKASLLELTPSNYLGKAEELARRI

SEQ ID NO: 3093 - DNA, 1422 bp, Plasmodium yoelii yoelii
  CDS (1)..(1422)
atggaaaacttaaaaaacatttctccaattgatgggagatacaaaaatagttgtaaagagatttccgaatatttctcagaatatgcattaataaaatataggatatatgttgaaatacaatggcttatttttttgaatgataaagaatttttttttaaaaagttaagtgcagaatcaattgacaaattacacaaaatagcagatataaatgatgaagatgcattaagattaaaagaaattgaaaaagaaacaaatcatgatgttaaggcagtagaatattttattaaagaaaaaataagtcaaagtaataatgaacttgataatataaaagaatatgtacattatttatgtactagtgaggatataaataatatagcatatggtatatgtataaaattatgtttacataatataataatacctcatatagaacaaataatgaatcgattaaaagagttagcatctgaatatagtcatgttgctatattatctagaacccatggtcaacctgcatctgcaacaacctttggaaaagaaatggctaactattttgatagattaaaaagacatatatctacattaaaaaatataaaaatatatggaaaatttaatggtgcagttggaaatttcaatgctcataaaatagctaataataatattgattggattagtaatataaaatattttgtagaaaaatattttaacattaattatagtttatattgtacacaaatacaagatcatgattatatttgtgaaatttcagatgcattaggaagaattaattcgacacttttagatttatcaatagatatatggttatatatatcaaataatttattaaaattaaaaaatataaaaaatgaaattggaagtagtactatgcctcataaaataaatccaattgattttgaaaatgctgaaggaaatttacatctagctaatgcactttttaaagcattcagtgcaaaattatctataagtagattacaaagagatttatctgattcaacagttttacgaaatattggaacttcatatgcatattctcttatttcatacaaatctattttaaaaggtttaggaaaaattgatataaatgaaaaagcagcatatcaagaattaaacaataattggagtactttagctgaacccgttcaaattgtcttaaaaaattataattttccaaatgcttatgaagaattaaaaaactttacacgtggaaaaaatgttgataaagaactaatgcaacaatatattaaaacaaaatcagaatttatacctccaaattctataagtcaattattaaatcttagtcctaatacatatataggatatgccgattatttggctactaatgttgataaaatagaattggataagaaacatgaaatgagcgatacctccaaaaaaacaccataa

SEQ ID NO: 3094 - protein, 473 aa, Plasmodium yoelii yoelii
MENLKNISPIDGRYKNSCKEISEYFSEYALIKYRIYVEIQWLIFLNDKEFFFKKLSAESIDKLHKIADINDEDALRLKEIEKETNHDVKAVEYFIKEKISQSNNELDNIKEYVHYLCTSEDINNIAYGICIKLCLHNIIIPHIEQIMNRLKELASEYSHVAILSRTHGQPASATTFGKEMANYFDRLKRHISTLKNIKIYGKFNGAVGNFNAHKIANNNIDWISNIKYFVEKYFNINYSLYCTQIQDHDYICEISDALGRINSTLLDLSIDIWLYISNNLLKLKNIKNEIGSSTMPHKINPIDFENAEGNLHLANALFKAFSAKLSISRLQRDLSDSTVLRNIGTSYAYSLISYKSILKGLGKIDINEKAAYQELNNNWSTLAEPVQIVLKNYNFPNAYEELKNFTRGKNVDKELMQQYIKTKSEFIPPNSISQLLNLSPNTYIGYADYLATNVDKIELDKKHEMSDTSKKTP

SEQ ID NO: 3095 - DNA, 1449 bp, Neurospora crassa
  CDS (1)..(1449)
atgtccagctacgacaagtaccagacccccctcgccacgaggtatgcgtcccaggagatgatgtccatcttctcggctcgcacccgtgcctccacctggcgtcaactctgggtctggctggccgaggccgagaaggagttgggtctcaacattcccgatgaggccattcaacagatgcgcgagcacgttactgtgagcgacaaggccttcgacgtcgcccgtgagtacgagaacaagttccgtcacgatgtcatggctcacgtccacgcctatggcgaggatgctcccgctgctgccggccacattcacttgggtgccaccagctgctacgtcaccgacaacgccgacttgatcttcatccagaaggctcttgacctcatcctccctaagctggccaaggtcatccagaacctcaaggagttcgccctcaagtacaaggacacccccaccctgggcttcacccactaccagcccgcccagctcatcaccatcggcaagcgcgcctgccagtggatccaggagctcgttatggacctcgaggacatcgagaccgtccgcgagcgcctccagttccgcggcgctcagggcaccaccggctcgcaggctaccttcctcgagctctttgagggtgacgccgacaagatcgtcgagctcaacaagatcctctgcaagaaggccggcttcccctccacctaccccatctccacgcagacctacacccgcaaggtcgacctccgcgtcgccaacgccgtgtgcgccatcggcgccaccgccgagcgcatcgcctcggacatccgccacctggccaacctcaaggagatggaggaaccctttgagaagtcgcagatcggcagctcggccatggcgtacaagcgcaaccccatgcgctccgagcgtatcgccgccctctcccgcaagctggccaacctgcccgtcaacttcagcaacaccttcaaggcgcagtggttcgagcgcacgctcgacgactcggccatccgccgcatggacatccccgagatgtttttgctggccgactcgatcctgctcgcgctcgacaacgtcaccaacggcctggtcgtctacccctccgtcgtccgcgcccacattgaccaggagctgcccttcatggccaccgagtccatcctcatgaagctcgcccagcacggcgtctcccgccaggacgcccacgaggagatccgggtcttgtcccaccaggctagcgccgtggtcaagcaggagggtggcaagaatgacttgctggagcgcatcaagaagtccgagttcttcaagcctgtttggggcgagattgacgggcttgttgaccctgccttgttcattggcaactgccccaggattgtggaggattactgcaatggtcaggttgctgagaagttgagcaggtaccaggagactttgtccaaggcggagactgctcagctttctatctag

SEQ ID NO: 3096 - protein, 482 aa, Neurospora crassa
MSSYDKYQTPLATRYASQEMMSIFSARTRASTWRQLWVWLAEAEKELGLNIPDEAIQQMREHVTVSDKAFDVAREYENKFRHDVMAHVHAYGEDAPAAAGHIHLGATSCYVTDNADLIFIQKALDLILPKLAKVIQNLKEFALKYKDTPTLGFTHYQPAQLITIGKRACQWIQELVMDLEDIETVRERLQFRGAQGTTGSQATFLELFEGDADKIVELNKILCKKAGFPSTYPISTQTYTRKVDLRVANAVCAIGATAERIASDIRHLANLKEMEEPFEKSQIGSSAMAYKRNPMRSERIAALSRKLANLPVNFSNTFKAQWFERTLDDSAIRRMDIPEMFLLADSILLALDNVTNGLVVYPSVVRAHIDQELPFMATESILMKLAQHGVSRQDAHEEIRVLSHQASAVVKQEGGKNDLLERIKKSEFFKPVWGEIDGLVDPALFIGNCPRIVEDYCNGQVAEKLSRYQETLSKAETAQLSI

SEQ ID NO: 3097 - DNA, 1296 bp, Synechococcus sp
  CDS (1)..(1296)
atgatcgagcgttacaccctgcctgaaatgggagccgtctggagtgagcaggcgaaattccagagctggctggatgtggagatcgccgccacggaagccaactgccgcctcggccgtgttccccaagacgccctggacacaatcaaagccaaggcccacttctccgtggagcggatcctcgagatcgaagcggaagtgcgccacgacgtgatcgccttcctcaccaacgtgaacgaacacgtcggtgatgccggccgtcacatccatgtgggcttgaccagcagcgatgtgttggacaccggcctggcgctgcagctgaaacagtccgtggccctgctccgcctggagttggatgccttggccgacgccctacgggcgttggcccgcgagcacaaagccaccgaaatgatcggccgttcccatgccattcatggggagccgattacctttggcttcaagatcgccggctggctggcggaaaccgaacgcaaccgcagccgcctggcgcggctggaagaagaggtggccattgggcagatcagtggggccatgggcacctacgccaacaccgacccccaggtggaagccatcacctgtgaaatcctcggactgacgccggataccgccagcagccaggtgatttcccgcgatcgccatgccgactatgtgcagaccctggccctggtgggcgcctccctcgaccgcttcgcgacggagatccgcaacttgcagcgcaccgatgtgctcgaggtggaggagaacttcgccaagggccagaagggcagctccgccatgccccacaagcgcaacccgatccgcagcgaacggatcagcggcctggcacgggtgctgcgcagctatgtagtggcagccctggaaaacgttgccctctggcacgagcgcgacatcagccacagctccaccgaacggatgatgctgccggactgttccgtcacccttcatttcatgctgcgggagatgaccagcgtggtgaagggtcttggcgtctatcccgacaacatgcgccgcaacatgaacgtctacggcggcgtggtatttagccagcgggtgctgctggccctggtgggcaccggcatgagccgagaagaggcctatcggatcgtgcagcgcaacgcccacaccgcctggaaccatgaaggcggtgatttccgcgccaacctggaagccgacgcggatgtcaccagtcggctgtcagccgatcagctggcggactgcttcagtaccgaactgcatcaggccaatctcggcgtgatctgggagcgactggggatctga

SEQ ID NO: 3098 - protein, 431 aa, Synechococcus sp
MIERYTLPEMGAVWSEQAKFQSWLDVEIAATEANCRLGRVPQDALDTIKAKAHFSVERILEIEAEVRHDVIAFLTNVNEHVGDAGRHIHVGLTSSDVLDTGLALQLKQSVALLRLELDALADALRALAREHKATEMIGRSHAIHGEPITFGFKIAGWLAETERNRSRLARLEEEVAIGQISGAMGTYANTDPQVEAITCEILGLTPDTASSQVISRDRHADYVQTLALVGASLDRFATEIRNLQRTDVLEVEENFAKGQKGSSAMPHKRNPIRSERISGLARVLRSYVVAALENVALWHERDISHSSTERMMLPDCSVTLHFMLREMTSVVKGLGVYPDNMRRNMNVYGGVVFSQRVLLALVGTGMSREEAYRIVQRNAHTAWNHEGGDFRANLEADADVTSRLSADQLADCFSTELHQANLGVIWERLGI

SEQ ID NO: 3099 - DNA, 1296 bp, Prochlorococcus marinus subsp
  CDS (1)..(1296)
atgattgaacgttacacattacccgaaatgggaagaatctggactgaaaatgcaaaattccagagttggcttaaagttgaaattgcagcatgcgaggcaaattgtactcttggaaaaatgcctgaagctgcgttaaaagaaattcgtttaaatgcaaaatttgaagaatcaagaattaaagaaatcgagaaagaagtaaaacatgatgtaattgcatttctaacaaatatcaatgaatatgttggagattccggaagatacattcatgttggaatgactagcagcgatatccttgatacaggcctctcattacagctaaaagattcctgcgaattgttattagaggaaattgaaaaactagaaaatgaggtcagatcattagcaagaaagcataaaaatactttaatgattggcagatcccatgcaattcacggagagcctatttcatttggatttaaattggcaggatggttagcagaaatattaagagataaaaaaagattattaatccttaaagaatctatttccattggacaaataagtggagcaatgggaacttacgctaatacaaacccagaaatagaaaaaattacttgcgagttgctgggtttaaaaccagatacagcaagtactcaggttatatcaagagatagacatgctgaatatgttcaaacaatagcgttaataggagcttcacttgataggtttgctactgagataaggaaccttcagagaacagatgttttagaagtcgaagaaggattttcaaaagggcaaaaaggaagctcagctatgcctcataaaagaaaccctattcgtagtgaaagggttagcggtttatctagaattttgaggagttatgttgtaacagctcttgagaatgttccgctttggcacgagagagatattagccatagttctaatgagcgtatcatgttacccgatgtatctatatgcctacattttatgcttagagaaatgaaagaaattataaataatttaaaagtttatccggacaatatgctcaaaaatttaaatatatatgggggagtaatttttagtcagaaagttttacttttacttgttgaaaagggtatgtctagggaaaaggcttatagcttggtacaaaaaagtgctcatcaagcttggaataatgagaatggtaatttcaaggaaaatattgagggggaccaagagataatgacattagtttctgagaatgatttaaaggtatgctttgacccctcaatccacctcaacaatttaaatgtaatatgggataagttaagtatttaa

SEQ ID NO: 3100 - protein, 431 aa, Prochlorococcus marinus subsp
MIERYTLPEMGRIWTENAKFQSWLKVEIAACEANCTLGKMPEAALKEIRLNAKFEESRIKEIEKEVKHDVIAFLTNINEYVGDSGRYIHVGMTSSDILDTGLSLQLKDSCELLLEEIEKLENEVRSLARKHKNTLMIGRSHAIHGEPISFGFKLAGWLAEILRDKKRLLILKESISIGQISGAMGTYANTNPEIEKITCELLGLKPDTASTQVISRDRHAEYVQTIALIGASLDRFATEIRNLQRTDVLEVEEGFSKGQKGSSAMPHKRNPIRSERVSGLSRILRSYVVTALENVPLWHERDISHSSNERIMLPDVSICLHFMLREMKEIINNLKVYPDNMLKNLNIYGGVIFSQKVLLLLVEKGMSREKAYSLVQKSAHQAWNNENGNFKENIEGDQEIMTLVSENDLKVCFDPSIHLNNLNVIWDKLSI

SEQ ID NO: 3101 - DNA, 1296 bp, Prochlorococcus marinus
  CDS (1)..(1296)
atgatcgagcgctacacactgcccgaaatgggcgagatttggaccgacagggccaagtatcaaagctggctagatgtagagatcgccgcttgtgaggccaactgtcaactggggaagatcccagcggctgaaatgcagcagattcgtgaacgcgcaaccttcgagccacagcgcatcttggagattgaggcagaggttcgccacgacgtcatcgccttcctgaccaacgttaatgaacacgtaggggatgccggccgctacatccacgtcggcatgaccagcagcgatgtgctggatacgggtctggccctgcagttaaaaaactctgtggcattgctaaaacaagaactgggcagccttcaagaagcgatccgcagcttggcagtggagcacaagggcacagtcatgatcggccgctcccatgccatccatggcgaacccatcaccttcggtttcaaactggccggttggctagcagaaacaatgcgcaatgccgagcgactggaaaggctggagagggatgtggctgtaggccagatcagtggcgccatgggcacctacgccaataccgatccaaaggttgagcagctcacatgcgagcgcctttgcctcatcccagacaccgctagtacccaggtcatctctcgcgatcgtcatgcggactatgtacagaccctggcattagtgggggcgtctctagatcgattcgcgacagagatccgcaacttgcagcgaaccgatgtactggaagtggaggagagctttgctaaaggacaaaagggaagttcggcgatgccacataaacgcaacccgattcgggctgagcggattagtggtcttgcaagggtcctacgcagctatgtcgtcgcagcactcgaaaacgtggccctctggcatgagcgtgatatcagtcacagctccactgagcgaatgatgctgccggattgctccgtcacactccacttcatgttgcgagagatgacccaagtcgtgcagggccttggtatctacccagcaaacatgcgtcgcaacatgaatatctatggcggcgtggtgttcagtcagcgggtgctattggcgcttgttgagaacggcatgagcagagaagatgcctacagtgttgtccagcgcaacgcccatgctgcgtggaataccgaagggggtaacttccgcgccaatcttgaggccgatcctgaagtatcgacccttctcaatgccaaggcgctagccgaatgcttcagcacagagctacaccaagccaacctggacgtgatctggcaacggctcggactctga

SEQ ID NO: 3102 - protein, 431 aa, Prochlorococcus marinus
MIERYTLPEMGEIWTDRAKYQSWLDVEIAACEANCQLGKIPAAEMQQIRERATFEPQRILEIEAEVRHDVIAFLTNVNEHVGDAGRYIHVGMTSSDVLDTGLALQLKNSVALLKQELGSLQEAIRSLAVEHKGTVMIGRSHAIHGEPITFGFKLAGWLAETMRNAERLERLERDVAVGQISGAMGTYANTDPKVEQLTCERLCLIPDTASTQVISRDRHADYVQTLALVGASLDRFATEIRNLQRTDVLEVEESFAKGQKGSSAMPHKRNPIRAERISGLARVLRSYVVAALENVALWHERDISHSSTERMMLPDCSVTLHFMLREMTQVVQGLGIYPANMRRNMNIYGGVVFSQRVLLALVENGMSREDAYSVVQRNAHAAWNTEGGNFRANLEADPEVSTLLNAKALAECFSTELHQANLDVIWQRLGL

SEQ ID NO: 3103 - DNA, 1419 bp, Mycobacterium bovis
  CDS (1)..(1419)
atgagcattcccaacgtgctggccacccgatacgccagcgccgagatggtcgcgatctggtcgccggaggccaaggtggtctcggagcggcggttatggctggccgtattgcgggcacaggcagagctgggggtagcggttgccgattcggtgctcgccgactacgaacgtgtggtcgacgatgtggacttggcctcgatctcagcccgggagcgggtgctgcgccacgatgtcaaggcccgcatcgaggaattcaacgcattggccggtcatgagcacgtgcacaaggggatgaccagccgcgacctgaccgagaacgtggagcaactgcagattcggcggtcgctggaagtgattttcgcccatggggtggcggcggtggcgcggctggccgagcgggcggtgagctaccgtgacctgatcatggccgggcgcagccacaacgtggccgctcaggccaccaccttgggcaagcggttcgcctcggcggcccaagagatgatgatcgcgttgaggcggttgagggagttgatcgaccgctaccccctgcgtggcatcaagggcccgatgggcaccggtcaggacatgctcgatctgctgggcggtgaccgtgcggcgctggccgatctcgagcggcgcgtcgccgacttcttgggctttgcaactgttttcaacagcgtggggcaggtgtatccgcgttcattggaccacgacgtggtttcggctctggtgcagctcggcgcggggccgtcatcactggcacacacgattcgattgatggccggccacgagctcgccaccgagggtttcgcgccgggtcaggtcggttcgtcggcgatgccgcacaagatgaacacccgcagctgcgaacgggtcaacgggctgcaggttgtgctacgcggctatgcatccatggtggccgagttagccggtgcacagtggaacgagggtgatgtgttttgctccgtggtgcgccgggttgcgttgccggacagcttctttgccgtcgacgggcagatcgagacgtttttgacggtgctggacgagttcggcgcctacccggcggtgatcggccgcgagttggatcgttatctgccgttcctggccaccactaaggtgctaatggcggccgtgcgcgcggggatgggtcgcgagtccgcgcaccggttgatctccgagcacgcggtggcgacggcgctggccatgcgagaacacggcgcggagcccgacctgctggaccggttggccgccgatccgcggctgccgctgggacgagacgctttggaggccgcgctggccgacaagaaggcatttgccggtgccgcgggtgaccaggtcgatgatgtggtcgcgatggtggacgcgctggtgagccgttacccggacgcggctaaatacacgccgggtgcaattctttag

SEQ ID NO: 3104 - protein, 472 aa, Mycobacterium bovis
MSIPNVLATRYASAEMVAIWSPEAKVVSERRLWLAVLRAQAELGVAVADSVLADYERVVDDVDLASISARERVLRHDVKARIEEFNALAGHEHVHKGMTSRDLTENVEQLQIRRSLEVIFAHGVAAVARLAERAVSYRDLIMAGRSHNVAAQATTLGKRFASAAQEMMIALRRLRELIDRYPLRGIKGPMGTGQDMLDLLGGDRAALADLERRVADFLGFATVFNSVGQVYPRSLDHDVVSALVQLGAGPSSLAHTIRLMAGHELATEGFAPGQVGSSAMPHKMNTRSCERVNGLQVVLRGYASMVAELAGAQWNEGDVFCSVVRRVALPDSFFAVDGQIETFLTVLDEFGAYPAVIGRELDRYLPFLATTKVLMAAVRAGMGRESAHRLISEHAVATALAMREHGAEPDLLDRLAADPRLPLGRDALEAALADKKAFAGAAGDQVDDVVAMVDALVSRYPDAAKYTPGAIL

SEQ ID NO: 3105 - DNA, 1296 bp, Prochlorococcus marinus
  CDS (1)..(1296)
atgatcgaacgttacacactccccgaaatgggtgcaatctggacagaacatgccaagttccaaagctggcttgaagtagagattgctgcatgccaagccaatttggaacttggcaagatccccgaaagtgcaatgaaagaaataagagataaagcccagttcagtccggaaaggattcttgaaatcgagtcagaagtccgacatgatgtcattgcttttcttacaaatttaaatgaaaacatcggagatgctggacgttttattcacattgggatgacaagtagtgatgttttagatactggcttagctttgcaattaaaatcatcagtcaagctactaaaaaaagaactaaagatacttaaggatgtaattcgctcaaaagcaaaggagcataaaaatacaatcatgattggaagatcacatgcaattcatggagaaccaataacttttggtttcaaacttgctggatggctagcagaaaccatcaggaatgaagaaaggcttgagcaattagaaaaagatatttctgttgggcaaatcagtggcgcaatgggaacctatgccaatacagacccagagatagagagaattgcttgtgctcatcttgggttgacaccagacacagcaagcacacaagttatttcaagagatagacatgcaaattatgttcaaacacttgcactaataggttcctccttagaccgatttgctactgagataagaaatcttcaaaggactgatgtccttgaagtagaagaagggttcttcaaaggacaaaaaggtagttctgctatgcctcacaaacgcaaccccatcagaagtgagcgcattagtggtctagcaagagttcttcgtagttatgtaattgctgctctagaaaatgttgccttatggcacgaaagagacataagtcatagttctacagaaagaatgatgttgcctgacacctcaatcacacttcattttatgttgagagaaatgagtgaagtcataaatgaacttgggatctacacaaaaaacatggtgaaaaatatgaatatttatggaggagttgtttttagtcaaagggttcttctagctcttgttcaaagtggcatgcaacgagaaacggcctataggctagtacaaaaacatgctcatgcggcgtggaatacagagtcaggtgactttcgaactaatcttagtttagacaagtcaatcactgatgtaatttcggcagagcaactaaacgattgctttagtacagaactacatcaattaaatctcgatgttatatgggaacgtctcgagatttag

SEQ ID NO: 3106 - protein, 431 aa, Prochlorococcus marinus
MIERYTLPEMGAIWTEHAKFQSWLEVEIAACQANLELGKIPESAMKEIRDKAQFSPERILEIESEVRHDVIAFLTNLNENIGDAGRFIHIGMTSSDVLDTGLALQLKSSVKLLKKELKILKDVIRSKAKEHKNTIMIGRSHAIHGEPITFGFKLAGWLAETIRNEERLEQLEKDISVGQISGAMGTYANTDPEIERIACAHLGLTPDTASTQVISRDRHANYVQTLALIGSSLDRFATEIRNLQRTDVLEVEEGFFKGQKGSSAMPHKRNPIRSERISGLARVLRSYVIAALENVALWHERDISHSSTERMMLPDTSITLHFMLREMSEVINELGIYTKNMVKNMNIYGGVVFSQRVLLALVQSGMQRETAYRLVQKHAHAAWNTESGDFRTNLSLDKSITDVISAEQLNDCFSTELHQLNLDVIWERLEI

SEQ ID NO: 3107 - DNA, 1332 bp, Helicobacter hepaticus
  CDS (1)..(1332)
atgatagagcgatatgcacgcgaggaaatgaaaaaactatgggatttaaatgctaaatattctgcgtggctagaggtggaaaaggcattagtgcgcgggtggaataagctagggcttatccctgatgatgattgtgacaaaatatgcaagaatgcaaagtttgatattgcgcgcattgatgaaatagaggcagttacaaagcacgatttaattgcttttactacaagtgtggctgaaagcttaggtgaggaatcgcgctgggtgcattatgggattacttcaagtgattgtattgatacggctgtggcgctgcaaatgcgagattctctaaagattattttagaggatattaagcaggtgcgtgaagtgattaaaaaaagggcgatggaacacaaaggcacacttatggtaggacgctctcacggaatccacggcgaacccattacttttgggctcgttttggcaatttggtatgatgagctaggaaggcatttaaaggctttggaatctactttggaagtcatctctgtggggcagttaagcggagcaatgggaaatctcgcacatacacctattgagctagaagaaattgtatgtaaagatttggggttaaaacccgctcctgtgagcaatcaagtcattcagcgtgatagatatgcacgattaatgagtgatttggcacttctagctagtagttgtgaaaaaattgctgttgaggtgcggcatttgcagcgcacagaagtgtatgaagcggaggaatattttgaaaaagggcaaaaaggcagtagtgcaatgccacacaagcgcaatccagtgctaagtgagaatatcaccggactttgtagaatgattcgctcttttgctctgccagcaatggaaaatgtcgccctttggcacgagcgagacattagccactcaagcgtagagcgttttatcctgcctgatagttttatcactactgattttatgcttgtgcgacttaagggattgcttgataagcttgtggtgtatcctaaaaatatgatgaaaaatcttaatttaaccggtgggcttgtgttttcacaaagaatcttattagagttgcctaaaaagggcgttagtcgtgaagatgcgtataaaatcgtgcaacgcaatgcgatgaaagtatggcaggatttacaagagggtaaagcagtggtgaatgaaaaaggagagagcttgtatttgcagtatttattagcagattctgaactagtggggtttattggtgaggcggctatcaaggaatgctttgcttatgagtattatacaaaaaatattgatgcgatttttaagagagtgtttgatgagtaa

SEQ ID NO: 3108 - protein, 443 aa, Helicobacter hepaticus
MIERYAREEMKKLWDLNAKYSAWLEVEKALVRGWNKLGLIPDDDCDKICKNAKFDIARIDEIEAVTKHDLIAFTTSVAESLGEESRWVHYGITSSDCIDTAVALQMRDSLKIILEDIKQVREVIKKRAMEHKGTLMVGRSHGIHGEPITFGLVLAIWYDELGRHLKALESTLEVISVGQLSGAMGNLAHTPIELEEIVCKDLGLKPAPVSNQVIQRDRYARLMSDLALLASSCEKIAVEVRHLQRTEVYEAEEYFEKGQKGSSAMPHKRNPVLSENITGLCRMIRSFALPAMENVALWHERDISHSSVERFILPDSFITTDFMLVRLKGLLDKLVVYPKNMMKNLNLTGGLVFSQRILLELPKKGVSREDAYKIVQRNAMKVWQDLQEGKAVVNEKGESLYLQYLLADSELVGFIGEAAIKECFAYEYYTKNIDAIFKRVFDE

SEQ ID NO: 3109 - DNA, 1368 bp, Haemophilus ducreyi
  CDS (1)..(1368)
atggaagttactgctttaacagcattatcgccgattgatggtcgttaccaagataaaacaaatgcacttcgcacaatttttagtgaatttggcttactcaaatttcgagtaactgtggaagtgcgttggttacaaaaattggcatcacatccacaaattagcgaagtttcagctttgtcgcaaaaggcaaacgattacttagatcaaattgtggcaaacttttccattgatgatgctaagcgcataaaaatgattgagcgtgaaactaatcacgatgtaaaagcagttgaatattttttgaaagaaaaatgtaatgcattagctgaattacaagcgattaatgaatttattcattttgcttgtacctcagaagatattaataacacttctcacgcattaatgttaaaaatggcacgtgaagaagtattattaccagaatggcaaaaattgattgatgcaattgttgagcttgctaaacgttatcaacatattccactactgtctcgtacacacggtcaacctgcgagcccgaccactattggtaaagaaatggcgaatgtggcttatcgtttgcgccgtcaatataaacaattacaaaatttagatattttagctaaaattaatggcgccgttggaaactataatgcacatttatcagcttatccagaaattgattggcatacctttggtcaacaatttgttgaatctttaggagttaattggaatccatataccacacaaattgaaccacacgattatattgcagagttttttgattgtgtagcacgttttaatacgattatgattgattttgatcgtgatatgtggggctatattgcgttaaatcattttaaacagcgtactgttgctggagagattggatcatcaacaatgcctcataaagtgaatccgattgactttgaaaattcagaaggtaacttgggtttagctaatgccgtgatggcgcatttaggacaaaaattgccagtttcacgttggcaacgtgatttaactgattctacagtattacgtaatcttggtgttggtttaggctattgcttaattgcctattcagccactttaaaaggcatcagcaaattagaagtgaatgaacagcatttacaagatgaattaaatcaaaattgggaagtgttagctgaacccattcagactgtgatgcgtcgctatggtattgaaaaaccatatgaaaaacttaaagaattaacacgtggtaaatgtgtaaatgaagccgttatacggcagtttattgatacgctcgccattccagaaagtgaaaaagcacgtttaaaagaaatgagcccggctacttatattggatatgcgattgagcttgtagataagttataa

SEQ ID NO: 3110 - protein, 455 aa, Haemophilus ducreyi
MEVTALTALSPIDGRYQDKTNALRTIFSEFGLLKFRVTVEVRWLQKLASHPQISEVSALSQKANDYLDQIVANFSIDDAKRIKMIERETNHDVKAVEYFLKEKCNALAELQAINEFIHFACTSEDINNTSHALMLKMAREEVLLPEWQKLIDAIVELAKRYQHIPLLSRTHGQPASPTTIGKEMANVAYRLRRQYKQLQNLDILAKINGAVGNYNAHLSAYPEIDWHTFGQQFVESLGVNWNPYTTQIEPHDYIAEFFDCVARFNTIMIDFDRDMWGYIALNHFKQRTVAGEIGSSTMPHKVNPIDFENSEGNLGLANAVMAHLGQKLPVSRWQRDLTDSTVLRNLGVGLGYCLIAYSATLKGISKLEVNEQHLQDELNQNWEVLAEPIQTVMRRYGIEKPYEKLKELTRGKCVNEAVIRQFIDTLAIPESEKARLKEMSPATYIGYAIELVDKL

SEQ ID NO: 3111 - DNA, 1386 bp, Candidatus Blochmannia floridanus
  CDS (1)..(1386)
atgaacaaattttctccattaaccgctatttctccaatcgatggacgttattatcatcaaactcatccactaagaaatatttttagtgaatttgggttattaaaatttcgcattcaaattgaaattcattggatacaaaaattatctcatacaatagaaatcacagaaatacctgtatttactgaaattgaactaaatttcttaaataacttaattacaaattttaatatcacagacgcaaaacatattaaaaaaatagaaaaaatcactaaacatgatgtaaaagcaatagaatattttttaaaagaaaaaataagtgttttacctgatttaaaaaagaaaatcaatgaatttatccattttgcatgtacttcagaagatattaataatcttgcttacggtttaatgatttctcataccaaaaatactatcatattacctatatggaaaaaaattattgatattattaaaaaaataagcatcaaatataaaaatactcctattctttccagaacacatggacaaccagctagtccttctactcttggcaaagaaacggctaatatcgcatatcgattaatacgacaatatcattacttaaaatcaatcaaaattttaggaaaaatgaatggagcagttggtaactataacgctcacattatagcgtatccaaaaataaattggagaaaatttgacgaagagtttgttacatcattaggaatttcatggaacccatatactacgcaaatagaaccacatgattacatagttgaaatctctaatcgcattattcattttaatactattttaattaaatttaatcaagatatctggggatatctttctttaaattattttcaacaagcatatagtcaatttgaaattggttcatctactatgccccataaaattaatccaataaattttgaaaattctgaaggtaatttgggtttatctaatgctatttttaatcatttttctaaaaaattaccaatatcacgttggcaacgtgatttaagtgactccaccgtactaagaaatttaggagtagctattggacattctttaattgcttatcacaatttattaaaaggtatagacaaattaatcattaatgaaaaatatttgttacaagatttaaataaaaattggataatattaagtgaagctattcaaacagtaatgaaaaaatacaacattcataattcttatgaacgtacgaaagattttatattcaacgaaaaagttaatcccgatactataaaaaaatttattgaatctctacctttaccaacatcagaaaaaacccgattgcaacatattactccatctgaatatattggattagctccggatattgccaatgatataataaaatttgaataa

SEQ ID NO: 3112 - protein, 461 aa, Candidatus Blochmannia floridanus
MNKFSPLTAISPIDGRYYHQTHPLRNIFSEFGLLKFRIQIEIHWIQKLSHTIEITEIPVFTEIELNFLNNLITNFNITDAKHIKKIEKITKHDVKAIEYFLKEKISVLPDLKKKINEFIHFACTSEDINNLAYGLMISHTKNTIILPIWKKIIDIIKKISIKYKNTPILSRTHGQPASPSTLGKETANIAYRLIRQYHYLKSIKILGKMNGAVGNYNAHIIAYPKINWRKFDEEFVTSLGISWNPYTTQIEPHDYIVEISNRIIHFNTILIKFNQDIWGYLSLNYFQQAYSQFEIGSSTMPHKINPINFENSEGNLGLSNAIFNHFSKKLPISRWQRDLSDSTVLRNLGVAIGHSLIAYHNLLKGIDKLIINEKYLLQDLNKNWIILSEAIQTVMKKYNIHNSYERTKDFIFNEKVNPDTIKKFIESLPLPTSEKTRLQHITPSEYIGLAPDIANDIIKFE

SEQ ID NO: 3113 - DNA, 1449 bp, Bordetella parapertussis
  CDS (1)..(1449)
atgccacatatgttacagagagggcgaatggtaaaatcgcccggcttacaaccgcttccttcttacaccgacatgcagattgccgaccagcttacccaacttaatgctctttcgccactggatggacgctatgcgtcgcgcgccggggcgctgcgggggctgctgtccgaggccgggttcatggcgcatcgcgtcgaggtcgaggtggcctggctcgttgcgttgtccgatgcgggcctgcccgagctgccggcgttcccggccgccgcgcgcgagcgcctggccgcgctggtgcgcaatttttccgaggccgacgccgcccgcatcaaggacatcgagcgcgtgaccaatcacgatgtcaaggcggtcgagtactggctgaaagaacaggtggccgacgatgccgaattggcgcgtgccgccgagttcatccatttcgcgtgcacctccgaagacatcaacaatacttcgcatgcgctcatgctcacgcgtgcgcgcgccgaagtcgtcgtgccgcagctcaaccaggtgctggccaagctgaacgaactggcccggacgcatgccgaccagcccatgctgtcgcgcacgcacggccagcccgccagtccgaccacgctgggcaaggagttcgccaacgtggcggcgcgcctgcagcgcgccgtggccgccatcgaggcggtcgagccgctggccaagctcaatggcgccacgggcaactacaacgcgcatctgtcggcgtacccggaaatcgactggcccgccttcagccgcaatgtgctggccggcctgggcctgacccagaaccgccataccatccagatcgaaccgcacgactggatggcggcgctgtccgacgccgtggcgcgcgccaacgtcatcgtgctggacctggaccgcgacatctggggctacgtggccctgggctacttcaagcagcgcctgaaggagggcgaggtcggctcctcgaccatgccgcacaaggtcaacccgatcgatttcgagaactccgagggcaacctgggtctggccaatgccgtgctgcgccatctgtccgagaagctgccggtttcgcgctggcagcgcgacctgaccgattcgacggtgttgcgcaacctgggcgtgggcctgggctatgcgctggtcgcctgggatgcctgcctgcgcgggctgaacaagctggaagtcaacgccgcggcgatcgacgccgacatcgatgcgtgctgggaagtgctggccgagccggtgcagacggtcatgcgccgctacggcctgccgcagccgtacgagcagctcaaggcgctcacgcgcggcaagggcattaccgaagaggccttgcgcgaattcatcggcggcctggcgctgcccgacgagcccaaggcccgcctgctggcgatgacgccgcgctcgtatatcggcctggccgcgcaactggcgcgggcggtatag

SEQ ID NO: 3114 - protein, 482 aa, Bordetella parapertussis
MPHMLQRGRMVKSPGLQPLPSYTDMQIADQLTQLNALSPLDGRYASRAGALRGLLSEAGFMAHRVEVEVAWLVALSDAGLPELPAFPAAARERLAALVRNFSEADAARIKDIERVTNHDVKAVEYWLKEQVADDAELARAAEFIHFACTSEDINNTSHALMLTRARAEVVVPQLNQVLAKLNELARTHADQPMLSRTHGQPASPTTLGKEFANVAARLQRAVAAIEAVEPLAKLNGATGNYNAHLSAYPEIDWPAFSRNVLAGLGLTQNRHTIQIEPHDWMAALSDAVARANVIVLDLDRDIWGYVALGYFKQRLKEGEVGSSTMPHKVNPIDFENSEGNLGLANAVLRHLSEKLPVSRWQRDLTDSTVLRNLGVGLGYALVAWDACLRGLNKLEVNAAAIDADIDACWEVLAEPVQTVMRRYGLPQPYEQLKALTRGKGITEEALREFIGGLALPDEPKARLLAMTPRSYIGLAAQLARAV

SEQ ID NO: 3115 - DNA, 1320 bp, uncultured Acidobacteria bacterium
  CDS (1)..(1320)
atgatcggccggtacacccaccctgacatgggtcgcatctggagcgaccagcgcaagtacgaaacctggctgcgagtagagatcgcggcatgcgacgcgatggcccgagcgggcatcgtgccgccggaggctgcccgcgacattgccgagcggggcgccttcgacatcgtccggatcgaggagatcgagcagaccacgcagcacgaagtgattgcattcaccaccgccgttggcgagcacgtcgggccgtcggcccggtggctccatttcggcctcacctcgtccgacgtcatcgacaccgcgcaggcgctgcagatgcgggacgcctgcgacctcatcctccgggggctgcaagggttgatggcggcggtcagggggcgcgccgaggagcatcgccacaccccgatgatcgggcgcacgcacggcgtgcacgccgagccgatgacgtttgggctcaagctcgccctctggttcgccgagctcgggcgcgacgtcgagcgcgtccggagggctcgcgacaccatctcggtagggaagctctccggggcggtgggcacgttcgcgcacctgccgccgtcggtggaggccgacgtctgcgcctcgctcgggttggtgccggcgccggtcgcttcgcaggtaatccagcgcgatcggcatgcggagctgctcgcaacgctcgccatcaccgcctccacgctcgagaagctggcgctcgaaatccgcgggttgcagaagacggaaatcggcgaggtcgaggagccgtttgccaagggacagaagggctcgtcggcgatgccgcacaagcgcaacccgatcgcctgcgagcagctcgtcggcctggcccgactggtgcgcgccaacgcaggcgcggcgctcgagaacaacgcgctctggcacgagcgcgacatctcgcactcgtcggtcgagcgggtgatcctgcccgacagcttcatcgcgctcgaccacatgctcagacgggcgacgcggatcgtgacgggcctcgaggtctatcccgggcgcatgaaggcgaacctcgagcgctcgcgcggggtggtcttctcgggcaccgtgctgctcgagctcgcccggcagggcgtgtcgcgggaggaggcctatctctgggtgcagcgtaacgcgatgcgctcgttcgaccaggcgttggatttcaagaccttgttgctggaagacgccgacgtgatgcgcgtcttgacccgtgagcatgtcgaacgtgcgttcgacctcacccaacagcttcgccacgtcgatcacgtgtttgaccgcgtattcgacgcggcgtcgtcagtggcacggagggaatag

SEQ ID NO: 3116 - protein, 439 aa, uncultured Acidobacteria bacterium
MIGRYTHPDMGRIWSDQRKYETWLRVEIAACDAMARAGIVPPEAARDIAERGAFDIVRIEEIEQTTQHEVIAFTTAVGEHVGPSARWLHFGLTSSDVIDTAQALQMRDACDLILRGLQGLMAAVRGRAEEHRHTPMIGRTHGVHAEPMTFGLKLALWFAELGRDVERVRRARDTISVGKLSGAVGTFAHLPPSVEADVCASLGLVPAPVASQVIQRDRHAELLATLAITASTLEKLALEIRGLQKTEIGEVEEPFAKGQKGSSAMPHKRNPIACEQLVGLARLVRANAGAALENNALWHERDISHSSVERVILPDSFIALDHMLRRATRIVTGLEVYPGRMKANLERSRGVVFSGTVLLELARQGVSREEAYLWVQRNAMRSFDQALDFKTLLLEDADVMRVLTREHVERAFDLTQQLRHVDHVFDRVFDAASSVARRE

SEQ ID NO: 3117 - DNA, 1218 bp, uncultured Acidobacteria bacterium
  CDS (1)..(1218)
atggcggatgcggggatcgtgcccgcggaggccgcgcgcgagcttcgcgccagggccgccttcgacctcgcgcgcatcgaggcgatcgaacaaaccacgcagcacgacgtgatcgcgtttacgacggccgtggccgagcacgtcggcccggcagcgcgctggctccacttcggtctcacctcgtccgacgtcgtcgacacggcccaggccatccagatgcgggaggcctgcgatctgatcgtcaaagggatcgcgggcctgatggaggccgcgcggggccgcgccgaggagcaccggcgcaccccgatgatcgggcgtacgcacggcgtacacgcggagccgatgacgttcgggctgaagctcgcgctctggtacgcggagctgcagcgtgatctcgatcgcgtcctccgcgcacgagagaccatcgcggtgggcaagatctcgggcgccgtgggcaccttcgcgcatctcgatccggcgatcgaagcgagcgtctgcgaacggctgggcctgcagccggcgccggtgtcgtcccagattattcagcgcgaccggcacgccgagctgatgtgtgcgctggcgatcgttgcggcctcgctcgagaagttcgcgctggagatccgggggctgcagaagaccgaaatcggcgaggtcgaagagccgttcggcaaagggcagaagggctcgtcggcgatgccgcacaagcgcaacccggtcggctgcgagcagatcaccggactcgcgcggctcgttcgcgccaacgccgtggcggcgctcgagaacgtcgccctgtggcacgagcgcgacatctctcattcgtcggtcgagcgcgtcatcctgcccgacagcttcatcgcgctcgatcacatgctccggcgcttcacgcgcatcgtgcgcggtatggttgtgtacccggagcggatgcaggagaacctgaatcgctcgcgcggcgtcgtcttttcggggaccgtcctgctcgagctggcgcggcggggcctctcgcgcgaggaggcatacgagtgggtccagcgcaatgccatgcggtcgttccacgagcggcaggacttcaaagcgctgctgctcgccgatccggacctgatgaaggtgctcacgcccgccgaggtggagcgggcgttcgatctcgacgatcacctgcggaacgtcgacgtgattttcgaccgggtgtttcacgccgcgcccgtgatggtcacgtcctag

SEQ ID NO: 3118 - protein, 405 aa, uncultured Acidobacteria bacterium
MADAGIVPAEAARELRARAAFDLARIEAIEQTTQHDVIAFTTAVAEHVGPAARWLHFGLTSSDVVDTAQAIQMREACDLIVKGIAGLMEAARGRAEEHRRTPMIGRTHGVHAEPMTFGLKLALWYAELQRDLDRVLRARETIAVGKISGAVGTFAHLDPAIEASVCERLGLQPAPVSSQIIQRDRHAELMCALAIVAASLEKFALEIRGLQKTEIGEVEEPFGKGQKGSSAMPHKRNPVGCEQITGLARLVRANAVAALENVALWHERDISHSSVERVILPDSFIALDHMLRRFTRIVRGMVVYPERMQENLNRSRGVVFSGTVLLELARRGLSREEAYEWVQRNAMRSFHERQDFKALLLADPDLMKVLTPAEVERAFDLDDHLRNVDVIFDRVFHAAPVMVTS

SEQ ID NO: 3119 - DNA, 1377 bp, Nitrosomonas europaea
  CDS (1)..(1377)
atggaaatctcgacacttcttgcactttctccgctggatgggcggtatcagcagaaggtggcagccttgcgaccctttttcagtgaatatgcattgattcgcaaccggattcatgtggaaattgaatggttcaaggcattgggcaatactccggccttgacaggggcgtcctctttatctaccggcgctgtcgtgcaactggatcagctcgtggagaatttttccgtaacggatgcagaagccgtcaaatcgatcgagacgcgaaccaatcatgacgtgaaggctgtggaatactggttgaaggaaaaactgaccggagatcaggagacggcggcaatttctgaattcgtgcattttgcctgtacatccgaggatatcaataatctttcacatggcctgatgctcaaacacagtcgggaccaggtcatgctccccgcgctcgatgaagtcatcaaaaggcttgctgtcctggccagagatctggcggatctcccgatgcttgctcgtacccatgggcaggcagccacccccacgaccatgggtaaggaaatggccaattttgtttatcggttacgcggggcgcgcgagcggcttgcagccgtggtcattaccggaaaaatcaatggagcagtgggtaactacaatgcgcacatgattgcttttcctgatttcgactgggaatcttttgcgcgatctttcgtcgagaagctcggcctgagtttcaatccatataccacccagatcgaaccgcatgacaccatggcagagctgttcgatgcccatgtccgtatcaatacgattcttctcgacctgaaccgcgatatctggggctatgtttcgctcggttacttcaggcagaaaaccagagctgatgaagtcggttcttccaccatgccacataaagtgaatccaatcgattttgaaaattcggaagggaatctcggtattgccaatgcgctgctcaaacatttgagtgaaaaacttcctgtctcacgctggcagcgcgatctcaccgattcgaccgtgttgcgcaatatgggtgtggcgcttggtcatactctgctggcttatgattcatgtctcaaagggctcggaaagctgcaggcggatccggcacgtctgtcggaggatttgcagaatgcctgggaagtcctggccgaaccgattcagacagtaatgcgccgttatggggtagccaatccctacgaacagctcaaggcattgacgcgcggaaaaacaggaatcgaccgtacgacacttcaacaattcatcgagcaactcgatattcctgctgccgagagagatcgcctgctgcaacttacaccctggggttatatcggcctggcagcgcacctggcaagggatatcggagactga

SEQ ID NO: 3120 - protein, 458 aa, Nitrosomonas europaea
MEISTLLALSPLDGRYQQKVAALRPFFSEYALIRNRIHVEIEWFKALGNTPALTGASSLSTGAVVQLDQLVENFSVTDAEAVKSIETRTNHDVKAVEYWLKEKLTGDQETAAISEFVHFACTSEDINNLSHGLMLKHSRDQVMLPALDEVIKRLAVLARDLADLPMLARTHGQAATPTTMGKEMANFVYRLRGARERLAAVVITGKINGAVGNYNAHMIAFPDFDWESFARSFVEKLGLSFNPYTTQIEPHDTMAELFDAHVRINTILLDLNRDIWGYVSLGYFRQKTRADEVGSSTMPHKVNPIDFENSEGNLGIANALLKHLSEKLPVSRWQRDLTDSTVLRNMGVALGHTLLAYDSCLKGLGKLQADPARLSEDLQNAWEVLAEPIQTVMRRYGVANPYEQLKALTRGKTGIDRTTLQQFIEQLDIPAAERDRLLQLTPWGYIGLAAHLARDIGD

SEQ ID NO: 3121 - DNA, 1440 bp, Streptomyces avermitilis
  CDS (1)..(1440)
atgactgcgcctgccaagccccgtatccccaacgtcctcgccggacgctacgcctccgccgagctcgccacgctatggtcccccgagcagaaggtgaagctggagcgacagctctggctcgccgtactgcgggcccagaaggacctggggatcgaggtgccggacgcggcgatcgccgactacgagcgcgtcctcgaccaggtcgacctcgcctcgatcgcggagcgcgagaaggtcacccggcatgacgtcaaggcgcggatcgaggagttcaacgacctcgccgggcacgagcacgtgcacaagggcatgacgtcccgtgacctcaccgagaacgtggagcagctgcagatccggctctcgctggagctgatgcgcgaccgcacggtgtccgtcctcgcccggctcggcaagctctcgggcgagtacgccgagctggtcatggccggccggtcgcacaatgtcgccgcgcaggccaccaccctcggcaagcgtttcgcgaccgctgccgacgagctgctcgtcgcgtacggccgcgtcgaggagctcctcggccgctacccgctgcgcggcatcaagggcccggtcggcaccgctcaggacatgctcgacctgctcggcggcgacgcggccaagctcgcggagctggagcagcggatcgcccgccacctgggcttctcccaggcgttcacctcggtcggccaggtctacccgcgctcgctcgactacgaggtcgtgaccgcgctggtgcagctggccgcggcgccttcgtcgctggcgaagacgatccggctgatggccgggcacgagctggtgaccgagggcttcaagccgggccaggtcggttcctccgcgatgccgcacaagatgaacacccgctcctgcgagcgcgtcaacggcctcatggtcatcctgcgcggctacgcctcgatgacgggcgagctggcgggcgaccagtggaacgagggcgacgtgtcctgctcggtggtgcgccgggtcgcgctgcccgacgcgttcttcgcgctcgacggtctgctggagacgttcttgacggtgctcgacgagttcggcgcgttcccggcggtcgtcgcccgtgagctggaccgctacctgccgttcctcgcgaccaccaaggtgctgatgggcgcggtgcgtgcgggtgtcggccgtgaggtcgcgcacgaggccatcaaggagaacgccgtggcctccgccctcgccatgcgcgagcagggcgccgagcgcaacgagctgctggacaagctcgccgccgacgggcgcatcccgctggaccgtgcccagctcgacgagctgatggcggacaagctgtccttcacgggcgccgccgccgaccaggtcgccgtggtcgtcggccgcatcgaggagatcgtgaagcagcaccccgaggcggcggcctacaccccgggggcgatcctctga

SEQ ID NO: 3122 - protein, 479 aa, Streptomyces avermitilis
MTAPAKPRIPNVLAGRYASAELATLWSPEQKVKLERQLWLAVLRAQKDLGIEVPDAAIADYERVLDQVDLASIAEREKVTRHDVKARIEEFNDLAGHEHVHKGMTSRDLTENVEQLQIRLSLELMRDRTVSVLARLGKLSGEYAELVMAGRSHNVAAQATTLGKRFATAADELLVAYGRVEELLGRYPLRGIKGPVGTAQDMLDLLGGDAAKLAELEQRIARHLGFSQAFTSVGQVYPRSLDYEVVTALVQLAAAPSSLAKTIRLMAGHELVTEGFKPGQVGSSAMPHKMNTRSCERVNGLMVILRGYASMTGELAGDQWNEGDVSCSVVRRVALPDAFFALDGLLETFLTVLDEFGAFPAVVARELDRYLPFLATTKVLMGAVRAGVGREVAHEAIKENAVASALAMREQGAERNELLDKLAADGRIPLDRAQLDELMADKLSFTGAAADQVAVVVGRIEEIVKQHPEAAAYTPGAIL

SEQ ID NO: 3123 - DNA, 1296 bp, Enterococcus faecalis
  CDS (1)..(1296)
atgattgatcgttatacaagacccgaaatgggcgcaatttggacagataagaaccgctacaaggcatggctagaagttgaaattttggcggatgaagcttgggcagaacttggcgaaattcctaaagaagatgtacaaaaaatccgagaaaatgcatcatttgatgttgcacgtattttagaaattgaagcagaaacacgtcatgatgttgtcgcttttactcgtgcggtttcagaaacgcttggtgaagagcgaaaatgggtacactatgggttaaccagcacagatgttgtggatactgcctatggttatctattgaaacaggcgaatgatattttacggaaagatttacaaacatttacggagattgtcggagccaaagccaaagagtataaacatacggtcatgatgggaagaacgcatggcgttcatgcagaaccgactacatttggtttgaaattagcgttgtggtattctgaaatgaaacgcaacattgaacgttttgaacatgcagccaaaggtgtcgaagcgggtaaaatcagtggagccgtaggtacctttgccaatatttcaccatttgttgaagaatatgtttgcgaacatttggggatccgtgctcaagagatttcgacacaagttttaccacgtgatttacatgcagaatatgtttctgccatggcattaattgcgacaagtattgaaaaatttgcaacagaaattcgtggtctacaaaaatcagaaacacgtgaagtagaagaattttttgcaaaaggacaaaaaggatcttcggcaatgccgcataaacggaatccaattggttctgaaaatatgactggtttggcacgtgtgattcgtggtcatgtcattactgcctttgaaaatgtgagtttatggcatgaacgagatatttctcactcgtctgctgaacggattattattccagatacgacgattttactaaattacatgttgaatcgttttggtaatattgtcaaaaacttaacggtcttcccagaaaatatgaaacgtaacatggatgcgacctatggtctaatttacagccaacgtgtcttgttaaaattgattgatcatggcatgacacgtgaagaagcgtatgatctggtccaaccaaaaacagcttacgcatgggatcatcaaacggcgttccgtccgttgctagatgcggatgaaaaaattacatctgtcttatcaaaagaagagctagatgatgcctttgattaccattatcatttaaaaaatgttgacacgatttttgaacgtgttggtttagggtag

SEQ ID NO: 3124 - protein, 431 aa, Enterococcus faecalis
MIDRYTRPEMGAIWTDKNRYKAWLEVEILADEAWAELGEIPKEDVQKIRENASFDVARILEIEAETRHDVVAFTRAVSETLGEERKWVHYGLTSTDVVDTAYGYLLKQANDILRKDLQTFTEIVGAKAKEYKHTVMMGRTHGVHAEPTTFGLKLALWYSEMKRNIERFEHAAKGVEAGKISGAVGTFANISPFVEEYVCEHLGIRAQEISTQVLPRDLHAEYVSAMALIATSIEKFATEIRGLQKSETREVEEFFAKGQKGSSAMPHKRNPIGSENMTGLARVIRGHVITAFENVSLWHERDISHSSAERIIIPDTTILLNYMLNRFGNIVKNLTVFPENMKRNMDATYGLIYSQRVLLKLIDHGMTREEAYDLVQPKTAYAWDHQTAFRPLLDADEKITSVLSKEELDDAFDYHYHLKNVDTIFERVGLG

SEQ ID NO: 3125 - DNA, 1386 bp, Coxiella burnetii
  CDS (1)..(1386)
atgaaactatcgccactaactgcattatcgccgctcgacggtcgctatcaaaacaaggtagaagcgttgcgccccattctcagcgaatatggcctaattcgctatcgggtgatagtcgagatcaaatggctgctttttttatcacaagaaaaaacgctaaccgagatcccttctttaaatgactcggatattaaaaagttagaagagattattgatcactttgatttacaagccgccgaggcggtcaaaacaattgaagcaaccaccaaccacgacgttaaagccgtcgaatattatttacaacgtcaattggaaaaagaaaaaaacctcgcgcctctcatcggttttattcatttcggatgtacttctgaagatattaataatctttcctattcgcttatgattaacgaagcccgtgaaatcgcgcttattcccatcataaaaaatatcggaatgcgatttcaaacgttagcggaaaaatatgctgaacttcctttattaagtcgcactcacggccaaccagcaacgccaacaaccctaggaaaagaattagcaaatattgttgcacgtattcatgctcaatatcatagtctcgcccaccttaaattattaggcaaaatgaacggtgccgtcggcaattttaatgcgcaccaagcagcgtatccaacttttgattggccgacgttcaacaaacgttttattcaatcgctcgggctagaagccaacgaatacacaacgcaaatcgaacctcatgatcgacttagtgaatttttacaatcgctggtccgtttaaatacgatccttatcgattgctgccgggatatttggagttatattagtctcggttatttttttcaaaaatcgaaaaaaaatgaagtgggttcttctaccatgccgcacaaagtaaacccgatcgatttcgaaaatgcggaagggaatttaggacttgctaacgccttagcgaatcacctcatcaacaaactacccatttctcgatggcaacgcgatttaaccgattccaccgtaatgcgaaacttaggttgtatattcggttatgcgcttatcgcttatgaatcacttctcaaagggttagataaaataagtgcgaacgaacaacgcattcgggaggatctcgaagcacattcggaagtgctagcagaagctttacaaacagtaatgcgtcgatacggcgtccccagggcttatgaacaactgaaagagctgacccgggataaaacgattgataaaaatcggctaaccaagtttatcgaacaattatcgcttcccaccgaagctaaaaaccatttaaaatcactgacccccagcaattacactggttttgcagcagaattagcaaaaaaaattagtacttttaaatgggattaa

SEQ ID NO: 3126 - protein, 461 aa, Coxiella burnetii
MKLSPLTALSPLDGRYQNKVEALRPILSEYGLIRYRVIVEIKWLLFLSQEKTLTEIPSLNDSDIKKLEEIIDHFDLQAAEAVKTIEATTNHDVKAVEYYLQRQLEKEKNLAPLIGFIHFGCTSEDINNLSYSLMINEAREIALIPIIKNIGMRFQTLAEKYAELPLLSRTHGQPATPTTLGKELANIVARIHAQYHSLAHLKLLGKMNGAVGNFNAHQAAYPTFDWPTFNKRFIQSLGLEANEYTTQIEPHDRLSEFLQSLVRLNTILIDCCRDIWSYISLGYFFQKSKKNEVGSSTMPHKVNPIDFENAEGNLGLANALANHLINKLPISRWQRDLTDSTVMRNLGCIFGYALIAYESLLKGLDKISANEQRIREDLEAHSEVLAEALQTVMRRYGVPRAYEQLKELTRDKTIDKNRLTKFIEQLSLPTEAKNHLKSLTPSNYTGFAAELAKKISTFKWD

SEQ ID NO: 3127 - DNA, 1446 bp, Tropheryma whipplei
  CDS (1)..(1446)
atgtcagaggatgaatatgattcactgtctcccttagatggcaggtatggcccagctgtgcgagcattgcgcggttttctgtctgagagtgcgcttattcgcgagcgtattagggttgaaatcggctgggtattttttttgtggaggaaagcggtttttggacttgcagaacccacaaaggaagatgagaggtttctttcatcgatagtgcatgatgcgcataaaaacataccgcgggtcaagaagattgaagagcggatacagcacgatgtgaaagccgtcgagatcttcctgcgagagagatttacgcagcagggtctgggcaatatagtcgagctactacatttcgcgtgcacaagtgaagacataaacaacctggcgtacgcactgaacatgaaggcagctctctcagaagtcatcctgccctcgattgatgaacttataggacacctagaaaagatgtctcagaaatatgcgggagatgcaatgctcgcgcgcacacacggacaacccgcaacaccaacaactcttggaaaggagctattggtgtttgtctaccgcctgaaaaggcaacggaaaaatctagaagatgtgcaatttcttgggaaattctctggtgcgaccgggacattttcagctcattgcgtagccgccccaaattacccgtggcaagagtgggcaaaagaatttgtgaacagttttggcctcatttataaccccattaccactcaaattgagccacatgactggcaatgcgagctgcttgagagagtggggcatatctgtcgaatcctccacaatctggcaaccgatatgtggagctatatctcattcggatattttcagcaaggctttatatcagaatctgttggctcctcaactatgccacacaaggtcaatcccatccgctttgaaaatgccgaggcaaatctggaaatggcttgcggaataatctcatgcattgttgcaagtctgtctacaagcaggcttcagcgggacttgagcgactccagtgtccagagaaatataggtgtcgccctggggcattcacttgtagcgatcgataacttgaaaagaggtcttgctggtattcgcctgaataaaaatcgcctaactgaagacctcaataacaactgggaagtaattgcggaggcggtacaaacaaccatccgcgccgaaatactggcatgtaaaagcaatgaggctaacccttatgaaaggctcaaagatttcacacgaaacaagaaaattacgaaacacactctcgatgaatttataactaacttggacctaagcgagcatgcaaaaaaacgacttttagaattaacaccaagcaaatatactggcttggcagagcgcatggtgcaggcacatagctcaggcactgggggcaccaaaaatagcattggcactgggggcaccaaaaatagctcaggtgctgggtga

SEQ ID NO: 3128 - protein, 481 aa, Tropheryma whipplei
MSEDEYDSLSPLDGRYGPAVRALRGFLSESALIRERIRVEIGWVFFLWRKAVFGLAEPTKEDERFLSSIVHDAHKNIPRVKKIEERIQHDVKAVEIFLRERFTQQGLGNIVELLHFACTSEDINNLAYALNMKAALSEVILPSIDELIGHLEKMSQKYAGDAMLARTHGQPATPTTLGKELLVFVYRLKRQRKNLEDVQFLGKFSGATGTFSAHCVAAPNYPWQEWAKEFVNSFGLIYNPITTQIEPHDWQCELLERVGHICRILHNLATDMWSYISFGYFQQGFISESVGSSTMPHKVNPIRFENAEANLEMACGIISCIVASLSTSRLQRDLSDSSVQRNIGVALGHSLVAIDNLKRGLAGIRLNKNRLTEDLNNNWEVIAEAVQTTIRAEILACKSNEANPYERLKDFTRNKKITKHTLDEFITNLDLSEHAKKRLLELTPSKYTGLAERMVQAHSSGTGGTKNSIGTGGTKNSSGAG

SEQ ID NO: 3129 - DNA, 1368 bp, Xylella fastidiosa
  CDS (1)..(1368)
atgtcacatttacccctacttgctttgtcgccactggatgggcgctatttgtctaaagtcgatacattgcggccaattttttcagaatacggcttgatcaaatccagggtgaaagtcgagattgcatggttactggcgttggccgcagaaccaaacattgtcgagttggcgccgttctccgttgccgcgcaaacacgtctgcgtgtgttagcagacggtttgaccattgagcacgccgcacgtgtgaaagagattgagcacaccaccaatcacgacgtaaaagcagtggaatatttcatcaaagagcagcttaaggacgatatagagctgcgccgcggactggagtttgtccatttcgcttgcaccagcgaggacatcaacaacctgtcctatagcttgatgttgcaacaagccagagatgacgtactgctcccgacactggacggtatcgctacacatctgcgcaccttggcccatgctcaggccgcacaaccgatgctctcacgcacccacgggcaaaccgcctcccctaccacgctgggcaaggaaatcgccaatgtggtagcccgtttggaacgccagcgccatcagatcgccacgattgcactgagcggaaagatcaacggtgctgtaggcaattacaacgcacataccatcagctatccggaggtcaattggcctgcattggcacaacgttttgttgagagcctgggcttggtcttcaacccatacaccacacaaattgagccgcacgacaccatcgccgagatcagcgacgcaatccgccgcgccaacaccattctgatcgacttggcacgcgatctttggggctatatctcgttgggttacttcaaacaaaagctcaaggaaggtgaaatcggctcctcaaccatgccgcataaagtcaatccgattgacttcgaaaatgctgaaggcaatttcggcgtggccaacgcattatttgagcatttttcgaccaagctgccgatcagtcgctggcaacgtgacctcaccgattccaccgtactacgcgcactcggcaccgcgtttggccatactcaggtggctttagattctttaaacaaagggctacacaagctcagcccaaatccagaacgcattgacgctgacctggacgcggcatgggaagtgctggccgaagcagtacagacaatcatgcgccgccacaatctacccaacccctacgagcaactgaaagcgctgacccgtggtcagggcatcaccgccgattcgatgcgcgctttcatcgaaaccctggatctaccaactgaagccaaacagcggctgcacgatttaactccaagggcttataccggtctggcgaagcagttggcactgaacatctaa

SEQ ID NO: 3130 - protein, 455 aa, Xylella fastidiosa
MSHLPLLALSPLDGRYLSKVDTLRPIFSEYGLIKSRVKVEIAWLLALAAEPNIVELAPFSVAAQTRLRVLADGLTIEHAARVKEIEHTTNHDVKAVEYFIKEQLKDDIELRRGLEFVHFACTSEDINNLSYSLMLQQARDDVLLPTLDGIATHLRTLAHAQAAQPMLSRTHGQTASPTTLGKEIANVVARLERQRHQIATIALSGKINGAVGNYNAHTISYPEVNWPALAQRFVESLGLVFNPYTTQIEPHDTIAEISDAIRRANTILIDLARDLWGYISLGYFKQKLKEGEIGSSTMPHKVNPIDFENAEGNFGVANALFEHFSTKLPISRWQRDLTDSTVLRALGTAFGHTQVALDSLNKGLHKLSPNPERIDADLDAAWEVLAEAVQTIMRRHNLPNPYEQLKALTRGQGITADSMRAFIETLDLPTEAKQRLHDLTPRAYTGLAKQLALNI

SEQ ID NO: 3131 - DNA, 1371 bp, Vibrio parahaemolyticus
  CDS (1)..(1371)
atggaactgtcagcattgactgctgtttcaccagtagacggccgctacggaagcaagacaattgcgttacgcgaaatcttcagtgaatacggtcttttaaaataccgtactatcgttgaaatccgctggctacaaaagcttgctgctactgctgaaattgcagaagtgccagcgtttagcgcagaagcaaaccaattcctagacgaccttgctgcaaacttctctgaagcagacgcactacgtatcaaagagatcgagcgcacaactaaccacgacgtaaaagcggttgagtacttcctaaaagagaaagtcgcagacgttcctgaactgcacgcagtaaacgagttcttccactttgcatgtacttctgaagacatcaacaacacatcacacgctctaatgctaaaagaagcgcgtgaaaccgttattcttccagaaatccgcaaccttattgacgctatcaaagcacttgctgttgagtaccgcgacatccctcttctatctcgtacacacggtcagccagcttctccatcaacaatgggtaaagaaatggcaaacgtggcgtaccgtatggagcgtcaatacaagcaaatcgaaaacgttgaaatcctagcgaaaatcaacggcgcggtaggtaactacaacgcgcacctatctgcttacccggaactagattggcacaagttctctgaagaattcatcactgaatctctaggcgtaacttggaacccttacacaacacaaatcgaaccacacgattacatcgctgagctattcgatgctgtggcacgtttcaacactattctgatcgatttcgaccgtgacgtttggggttacattgcactaggccacttcaagcaaaaaaccattgctggcgagatcggttcttcgacaatgccacacaaagttaacccaatcgactttgaaaactctgaaggtaacctaggtcttgcgaacgccgtgttcggtcacctagcacagaaactgcctatctctcgttggcaacgtgacctaactgactcaacggttctacgtaacctaggtgttggtgttggctacgcaatcatcgcctacacttctacgctaaaaggcatcagcaaactggaagtgaaccgtgacgcgcttcttgctgaactagacaaaaactgggaagttctagcagagccagtacaaacggtaatgcgtcgctacggtatcgagaagccatacgagaagttgaaagagttaactcgcggtaagcgcgtagacggtgaagcaatgcgtaacttcattgacggccttgagcttcctgaacacgaaaaagcacgtctaaaagagatgacgccagcgaactatatcggtcaagcaatcgagctaactgacaagctgtaa

SEQ ID NO: 3132 - protein, 456 aa, Vibrio parahaemolyticus
MELSALTAVSPVDGRYGSKTIALREIFSEYGLLKYRTIVEIRWLQKLAATAEIAEVPAFSAEANQFLDDLAANFSEADALRIKEIERTTNHDVKAVEYFLKEKVADVPELHAVNEFFHFACTSEDINNTSHALMLKEARETVILPEIRNLIDAIKALAVEYRDIPLLSRTHGQPASPSTMGKEMANVAYRMERQYKQIENVEILAKINGAVGNYNAHLSAYPELDWHKFSEEFITESLGVTWNPYTTQIEPHDYIAELFDAVARFNTILIDFDRDVWGYIALGHFKQKTIAGEIGSSTMPHKVNPIDFENSEGNLGLANAVFGHLAQKLPISRWQRDLTDSTVLRNLGVGVGYAIIAYTSTLKGISKLEVNRDALLAELDKNWEVLAEPVQTVMRRYGIEKPYEKLKELTRGKRVDGEAMRNFIDGLELPEHEKARLKEMTPANYIGQAIELTDKL

SEQ ID NO: 3133 - DNA, 1419 bp, Pseudomonas syringae
  CDS (49)..(1419)
atgtatgatgtgcgcccttttcgttgccagactgtccgagagcatcccatgcagctttcttcgctcactgcggtttcccctgttgacggccgctacgccggcaaaacccaagccttgcgccctattttcagcgaatacggcctgatccgtttccgcgtgatggttgaagtccgctggctccagcgcctggcggctcacccacagatcaccgaagttccggccttctccgcgcaagccaatgccattctcaatactctggctgaagacttttcggtggagcacgccgagcgcgtcaaggaaatcgagcgcaccaccaaccacgacgtcaaggccgtggaatacctgctcaaggaacaggctgccaagctgccggaactggagaacgtcagcgagttcattcactttgcctgcaccagcgaggacatcaacaacctgtcccatgctctgatgctacgcgaaggccgcgacaccgtgatgctgccgctgatgcgccagattgccgacgctatccgcgaactggcaatccgcttcgccgacgtgccgatgctttcgcgcacccacggccagccagcctccccaaccacgctgggcaaggaactggccaacgtggtttaccgcctggaacgccagatcacccagatcgccgcagtgcctttgctgggcaagatcaacggcgcggtcggcaactacaacgcccacctttctgcctatgccgatatcgactgggaagccaatgcacgcgccttcatcgaagacgaactgggcctgggcttcaacccctacaccacgcagattgagccgcacgactacattgccgagctgttcgacgccgttgcgcgcttcaataccatcctgatcgacttcgaccgcgatatctggggttacatctccctgggctatttcaagcagcgcaccatcgctggcgaaatcggttcgtcgaccatgccgcacaaggtcaacccgatcgacttcgaaaactccgaaggcaacctgggtatcgccaatgcgctgttccagcacctggcgagcaagctgcctgtctcccgctggcagcgcgacctgaccgactccaccgtgttgcgtaatctgggcgttggttttgcacacagcgtgattgcctacgaagccagcctcaaaggcatcagcaagctggaattgaacgagcaacgcattgctgccgatctggacgcctgctgggaagtcctggccgaaccgatccagaccgtaatgcgtcgttacaacatcgaaaacccgtatgaaaaattgaaagaactgacacgcggcaagggcatcggccctgaagcactgcaaactttcattgacggtctggatatgcctgcccaagcaaaggcagagctgaagaagctcacgccagccaattacatcggcaatgcggcagcccaggccaagcgcatctag

SEQ ID NO: 3134 - protein, 456 aa, Pseudomonas syringae
MQLSSLTAVSPVDGRYAGKTQALRPIFSEYGLIRFRVMVEVRWLQRLAAHPQITEVPAFSAQANAILNTLAEDFSVEHAERVKEIERTTNHDVKAVEYLLKEQAAKLPELENVSEFIHFACTSEDINNLSHALMLREGRDTVMLPLMRQIADAIRELAIRFADVPMLSRTHGQPASPTTLGKELANVVYRLERQITQIAAVPLLGKINGAVGNYNAHLSAYADIDWEANARAFIEDELGLGFNPYTTQIEPHDYIAELFDAVARFNTILIDFDRDIWGYISLGYFKQRTIAGEIGSSTMPHKVNPIDFENSEGNLGIANALFQHLASKLPVSRWQRDLTDSTVLRNLGVGFAHSVIAYEASLKGISKLELNEQRIAADLDACWEVLAEPIQTVMRRYNIENPYEKLKELTRGKGIGPEALQTFIDGLDMPAQAKAELKKLTPANYIGNAAAQAKRI

SEQ ID NO: 3135 - DNA, 1362 bp, Pseudomonas syringae
  CDS (1)..(1362)
atgaacagaccgagcaatcaactgtttgatgcctatttcacgcagtccgatatgcgcgacattttctcggacgaaggccgggtgcagggcatgctcgatttcgaggctgcgctggctcgggcgcaggcgcgagtcggcctgatcccgcaacaggtcgtggctgatatcgagcagagctgccgcgccgagctgttcgatttcgacgaactggccattgccataggcagcgccggcaattcggcgatcccgttggtcaaggcgctcggcaggcagattgctgcgcgcaacccgcaagccgagcgttacgtgcacatgggcgcgaccagtcaggacgtgatggacagcgggctggtgctgcaaatacgccgggcgatcgtcttgctggagcgtgaccttgcgcaactggccaaggcactggctgaacaggcgcagcgccatgctgctacgccgctggccgggcgcacctggttgcagcaggccacgccggtcacgctggggatgaaaatcgccggttggctgggcgccatcactcgccatcgccagcgcctgaacgagatcaaaccgcgcctgctgtgcctgcaattcggcggcgcgtccggcagccttgcggcgctgggcgaccgggccttcccggtggcgcaagcactggcgggtgaattacagctggaactgcccgagcagccctggcacacccagcgtgatcgtctggtggagtttgccagcgtcctgggcctgatcgccggcagcctcggcaagcttgggcgtgacgtcagcctgttgatgcagaccgaagtgggcgaggtattcgagccttccgcaccgggcaaaggtggctcttcgaccatgccgcacaagcgcaacccggtgggtgcagcggtgatgatcggcgcagccactcgggcaccggggctggttgcgacgatgctgtcggccatgccacaggagcacgagcgcagcctgggcctgtggcacgccgagtgggaaaccctgcctgagctgtgctgcctggtgtccggttcgctgcaacaggcattgcaggtgatacccggtctgcaagtagacgccgagcgcatgcgggtcaatctggaatctacccaaggcctggtgctggccgaagctgtgagtattgcgctggcccagcgtatcggccgtgacgcggcccatcatctgatcgaacaatgctgtcggcgtgcggtggagcagggcgcgcatctgcgtcaggtgctcggcgacaacccgcaggtcagcgagcaacttacttgcgccgagctggatcgcctgctcgatccggcccattaccttggccaggcccgcctgtgggtcgaacgtgccgtggctgaacacacaaggatttcccgatga

SEQ ID NO: 3136 - protein, 453 aa, Pseudomonas syringae
MNRPSNQLFDAYFTQSDMRDIFSDEGRVQGMLDFEAALARAQARVGLIPQQVVADIEQSCRAELFDFDELAIAIGSAGNSAIPLVKALGRQIAARNPQAERYVHMGATSQDVMDSGLVLQIRRAIVLLERDLAQLAKALAEQAQRHAATPLAGRTWLQQATPVTLGMKIAGWLGAITRHRQRLNEIKPRLLCLQFGGASGSLAALGDRAFPVAQALAGELQLELPEQPWHTQRDRLVEFASVLGLIAGSLGKLGRDVSLLMQTEVGEVFEPSAPGKGGSSTMPHKRNPVGAAVMIGAATRAPGLVATMLSAMPQEHERSLGLWHAEWETLPELCCLVSGSLQQALQVIPGLQVDAERMRVNLESTQGLVLAEAVSIALAQRIGRDAAHHLIEQCCRRAVEQGAHLRQVLGDNPQVSEQLTCAELDRLLDPAHYLGQARLWVERAVAEHTRISR

SEQ ID NO: 3137 - DNA, 1371 bp, Pseudomonas putida
  CDS (1)..(1371)
atgcagctttcttcgctcactgcggtttcccctgtagacggccgttatgccggcaaaacccaggccttgcgccccattttcagcgaattcggcctgatccgtttccgcgccctggtcgaagtgcgctggctgcagcgcctggccgcccacccgcaaatcggcgaagtgccggcgttctccgccgaagccaacgccctgctggacagcctggccaccgatttcaagctggagcacgccgagcgcgtcaaggaaatcgagcgcaccaccaaccacgacgtcaaggccattgaatacctcctcaaggagcaggccgccaagctgcctgagctggccaaggtcagcgagttcatccacttcgcctgcaccagcgaggacatcaacaacctgtcccacgccctgatgctgcgcgccggccgtgacgaagtgctgctgccgctgatgcgccaggtcgccgacgccatccgcgccctggcccacgcccacgccgaagtgccaatgctgtcgcgcacccacggccagccggcttcgccgaccaccctgggtaaagagctggccaacgtcgtgtaccgcctggagcgccagatcgcccaggttgccgccgtgccgctgctgggcaagatcaacggcgccgtgggcaactacaacgcccacctgtcggcctactcgcagatcgactgggaagagaacgcccgcgccttcatcgaagacgagctgggcctgcagttcaacccgtacaccacccagatcgagccgcacgactacatcgccgagctgttcgacgccatcgcccgcttcaacaccatcctgatcgacttcgaccgtgatgtgtggggctacatttcgctgggttacttcaagcagaagaccgtcgccggcgaaatcggttcgtcgaccatgccgcacaaggtcaacccgatcgacttcgaaaactccgaaggcaacctgggtatcgccaacgcgctgttccagcacctggccagcaagctgccgatctcgcgctggcagcgtgacctgaccgactccaccgtgctgcgcaacctgggcgtgggctttgcccacagcgtcatcgccttcgaggccagcctgaaaggcatcggcaagctggaagtcaacgaagctcgcatcgccgccgacctggacgcctgctgggaagtgctggccgagccgatccagaccgtgatgcgccgcttcaacatcgaaaacccctacgagaagctcaaagagctgacccgtggcaagggcatcaccccagaagcgctgctgaccttcatcgacggcctggacatgccagccgaagccaaggccgagctcaagcagctgacccccgctacctacatcggtaacgcggcagcccaggccaaacgcatctaa

SEQ ID NO: 3138 - protein, 456 aa, Pseudomonas putida
MQLSSLTAVSPVDGRYAGKTQALRPIFSEFGLIRFRALVEVRWLQRLAAHPQIGEVPAFSAEANALLDSLATDFKLEHAERVKEIERTTNHDVKAIEYLLKEQAAKLPELAKVSEFIHFACTSEDINNLSHALMLRAGRDEVLLPLMRQVADAIRALAHAHAEVPMLSRTHGQPASPTTLGKELANVVYRLERQIAQVAAVPLLGKINGAVGNYNAHLSAYSQIDWEENARAFIEDELGLQFNPYTTQIEPHDYIAELFDAIARFNTILIDFDRDVWGYISLGYFKQKTVAGEIGSSTMPHKVNPIDFENSEGNLGIANALFQHLASKLPISRWQRDLTDSTVLRNLGVGFAHSVIAFEASLKGIGKLEVNEARIAADLDACWEVLAEPIQTVMRRFNIENPYEKLKELTRGKGITPEALLTFIDGLDMPAEAKAELKQLTPATYIGNAAAQAKRI

SEQ ID NO: 3139 - DNA, 1353 bp, Pseudomonas putida
  CDS (1)..(1353)
atgagcaaccaactgttcgacgcctatttcaccgcgccggccatgcgcgagattttctccgaccgaggccgcctgcagggcatgctggatttcgaagccgcgcttgcccgagccgaagcctctgccggtttggtcccgcacagcgcggtagcggccatcgaggcggcatgccaggccgagcgctatgacgttggcgcgctggccaatgccatcgccaccgcgggcaactcggccattccgctggtgaaagcgttgggcaaggtgatcgccaccggcgtgccagaggctgagcgctatgtgcaccttggggccaccagccaggatgcgatggataccggtctggttctgcagctgcgcgatgccctcgatttgatcgaggccgacctcggcaagctggccgataccctgtcgcagcaggccttgaagcacgccgatacgcccttggtgggtcgtacctggttgcaacacgccaccccggtgaccctgggcatgaaactggccggtgtactgggtgctttgacccgccaccgtcagcgcctgcaggaactgcgcccgcgccttctggtcctgcagttcggcggtgcctcgggcagcctggcggcgctgggcagcaaggcgatgccggtggccgaagcgctggccgaacagctcaagctgaccctgcccgagcagccctggcacacccagcgcgaccgcctggtggagtttgcctcggtattgggcctggttgccggcagcctgggcaagttcggccgtgatatcagcttgctgatgcaaaccgaggcgggggaggtgtttgagccttctgcgccgggcaagggtggttcttcgaccatgccacacaagcgcaacccggtgggtgccgccgtgttgatcggtgccgcgacccgcgtgccgggcctgctgtcgacgctgttcgcagccatgcctcaggagcacgaacgcagcctgggcctatggcatgccgagtgggaaaccctgccggatatctgctgcctggtctctggcgccctgcgccaggctcaagtgattgccgagggcatggaggtggatgccgcgcgcatgcgccgtaacctcgacctgacccaaggcctggtgctggccgaagcggtgagcatcgtcctcgcccagcgtctgggtcgcgaccgtgcccaccacctgctggaacaatgctgccaacgcgcggtggccgaacagcggcacctgcgtgccgtgctgggtgacgagccgcaggtcagcgccgagctgtctggcgaagaactcgatcgcctgctcgaccctgcccattacctgggccaggcccgcgtctgggtggcgcgcgccgtgtccgaacatcaacgtttcactgcctag

SEQ ID NO: 3140 - protein, 450 aa, Pseudomonas putida
MSNQLFDAYFTAPAMREIFSDRGRLQGMLDFEAALARAEASAGLVPHSAVAAIEAACQAERYDVGALANAIATAGNSAIPLVKALGKVIATGVPEAERYVHLGATSQDAMDTGLVLQLRDALDLIEADLGKLADTLSQQALKHADTPLVGRTWLQHATPVTLGMKLAGVLGALTRHRQRLQELRPRLLVLQFGGASGSLAALGSKAMPVAEALAEQLKLTLPEQPWHTQRDRLVEFASVLGLVAGSLGKFGRDISLLMQTEAGEVFEPSAPGKGGSSTMPHKRNPVGAAVLIGAATRVPGLLSTLFAAMPQEHERSLGLWHAEWETLPDICCLVSGALRQAQVIAEGMEVDAARMRRNLDLTQGLVLAEAVSIVLAQRLGRDRAHHLLEQCCQRAVAEQRHLRAVLGDEPQVSAELSGEELDRLLDPAHYLGQARVWVARAVSEHQRFTA

SEQ ID NO: 3141 - DNA, 1299 bp, Lactobacillus plantarum
  CDS (1)..(1299)
atgattgatcgttatacgcgtcccgcgatgggcaaagtatggtcgttagaaaatcagtaccaagcatggttggaggtagagattgctgccgacgaggcctgggctgaattagggaagattccagcaagtgatgttgctaaaattcgagagaatgccaagtttgatgttgaccggatcgcggagattgaagccgtaacgcatcatgatgtggttgcttttacgcgcgatgtttccgagtcgttgggtgcagaacgtaagtgggttcactatgggctgaccagtactgacgttgtcgacacggcgcaaggttaccggttgaagcaggctaacgcgattattcgccaagacttacaagatttacgggcgacactagcacaacaagcgaaaaaatataaatatacggttgaaatggggcggacacacggcgtccacgctgaaccaaccacatttggattgaagattgcccggtggtattctgaaattaatcgggatatcgagcgttttgaacacgcggccgcaggcgttgaagcgggtaaaatcagtggggccgttgggacttttgcgaacattccaccatttgttgaagaatttgtctgcaaacaacttggattgcgcgcacaagaaatttcgacgcaagttttaccacgggacttacatgccgaatacattgctagtttggccttgattgcaacaagcgttgaagtgtttgcaaccgaaattcgtggtttgcaaaaatctgaaactcatgaagttgaagaattctttaataaaggtcagaaaggctcatcagcaatgcctcacaagcgtaatcccatcggttctgagaacgtgacggggttggcacgggttattcgcggccacatgatgaccgcctatgaagatgtgccgttgtggcatgaacgggatatttcccactcttctgcggagcggatcatcttaccagataccacgattttagtggattatatcttaactcgaatcaataagattattaggacgctgacggtgttcccagaacggatgaagcaaaacatggatgcgacttacgggttgatctacagtcaacgtgtcttgctcaagttgattgatacggggatgtctcgtgaaagtgcttatgacctcgttcaaccactgacggctaagtcatgggatgaacagttacaattcaagccacttgttgaaggtaacgccgagattcgtgaacatttggaccaggctgcgattgatgatgcgtttgactatcattaccatcttcgccacgttgatgatattttcaaacgattgggattagacgattaa

SEQ ID NO: 3142 - protein, 432 aa, Lactobacillus plantarum
MIDRYTRPAMGKVWSLENQYQAWLEVEIAADEAWAELGKIPASDVAKIRENAKFDVDRIAEIEAVTHHDVVAFTRDVSESLGAERKWVHYGLTSTDVVDTAQGYRLKQANAIIRQDLQDLRATLAQQAKKYKYTVEMGRTHGVHAEPTTFGLKIARWYSEINRDIERFEHAAAGVEAGKISGAVGTFANIPPFVEEFVCKQLGLRAQEISTQVLPRDLHAEYIASLALIATSVEVFATEIRGLQKSETHEVEEFFNKGQKGSSAMPHKRNPIGSENVTGLARVIRGHMMTAYEDVPLWHERDISHSSAERIILPDTTILVDYILTRINKIIRTLTVFPERMKQNMDATYGLIYSQRVLLKLIDTGMSRESAYDLVQPLTAKSWDEQLQFKPLVEGNAEIREHLDQAAIDDAFDYHYHLRHVDDIFKRLGLDD

SEQ ID NO: 3143 - DNA, 1362 bp, Bradyrhizobium japonicum
  CDS (1)..(1362)
atgcccgctctccacgcctcgaccaccgtgctcgactccatgctgttccgcgacgccttcggcacgcctgagatgcgcgaggtgttttccgatgtcgcgctggttgcgcgctatgccgaggtcgaggtggcgctggcgaaggcggaggccaaatgcggcgtgatcccgcaggatgccgccgaccagatcgcggcgcggaccgacgttgccgcgctcgatttcgacctgctcaggcaggagactgacatcgtcggctatccgatcctgcccttggtgcaccagatggtgaagcaatgcggcgatgccggccgttacgtgcattggggcgcgaccacgcaggacatcatggataccgccgtagtgctgcaattgcgtgccgcgctcgagatcgtcgagcgcgacatcgcggagctgcgaaagattctcgccgacctctccaggcgccatcgcgatacgccgatggcggggcgcactcatctccagcaggcgctgccggtgaccttcggctacaagaccgcgatttggctagcgatgttcgatcgccacgccgagcgtctggcgcaattgaagccgcgggtcctggtgggcgagttcgccggcgccgccggcacgctggcctcgctcggcgacaagggctttgaggtgcaggaggcgctgtgcgacgagctgaagctcggcgttcccgcctcgacctggcacgtcgcgcgcgacggctttgccgaggccgtgaacttcctcgcgctcgtcaccggctcgctcggcaagatcgcgctcgacatcatgatcatggcctcgaccgagttcgccgaggtctacgagcccttcgtcaagggccgtggcgcctcctcgaccatgccgcagaagcgcaacccgatctcctcggaactgatgctggcggcgtccaaggcggtgcgccagcacgcgggcctgatgctggatgcgatggtgcaggatttcgagcgcgccaccggcccctggcacgccgagtggatggcaatccccgaaagcttcgtgctggccgcgggggcgctgcaccaggcgaggttcgcgctcgcgggcctcatcgtcgacgaggcgaagatgaacgacaatctcgccatcagccggggcctgattgtggccgaagcggtcatgatggggctcgcgccccagatcgggcggcaggaggcgcatgacgtggtctatgacgcctgccggctcgccaacgagaaaggtttgacgctggcggacgcgctctcgtccgactcgcgcgtctctgccagaatcgaccgcgccacgatcgatgcgctcacttcaccgaaaaattacctcggccttgctcccgccatggtcgaccgggtgctgaaatcggcaacgcgttga

SEQ ID NO: 3144 - protein, 453 aa, Bradyrhizobium japonicum
MPALHASTTVLDSMLFRDAFGTPEMREVFSDVALVARYAEVEVALAKAEAKCGVIPQDAADQIAARTDVAALDFDLLRQETDIVGYPILPLVHQMVKQCGDAGRYVHWGATTQDIMDTAVVLQLRAALEIVERDIAELRKILADLSRRHRDTPMAGRTHLQQALPVTFGYKTAIWLAMFDRHAERLAQLKPRVLVGEFAGAAGTLASLGDKGFEVQEALCDELKLGVPASTWHVARDGFAEAVNFLALVTGSLGKIALDIMIMASTEFAEVYEPFVKGRGASSTMPQKRNPISSELMLAASKAVRQHAGLMLDAMVQDFERATGPWHAEWMAIPESFVLAAGALHQARFALAGLIVDEAKMNDNLAISRGLIVAEAVMMGLAPQIGRQEAHDVVYDACRLANEKGLTLADALSSDSRVSARIDRATIDALTSPKNYLGLAPAMVDRVLKSATR

SEQ ID NO: 3145 - DNA, 1308 bp, Bradyrhizobium japonicum
  CDS (1)..(1308)
atgatcccccgctatacccgtccggaaatggcctcgatctgggagccgcagacccggttcaagatctggttcgagatcgaggcgcatgcggcggacgccctggccgagctcggcaccatccccaaggaggccgccaggacggtctgggcgaaggccaagaacgccaccttcgacgtcgcccgcatcgacgagatcgagcgcgaaaccaagcacgacgtcatcgccttcctcacccacctcgccgagatcgtcggccccgaggcgcgcttcgtgcaccagggcatgacctcttccgacgtgctcgacacctgcctcaacgtccagctcacccgcgccgccgacctgctgctcgccgatctcgacaaggtgctggcggcgctgaagaagcgcgccttcgagcacaagatgacgacgaccatcggccgcagccatggcatccacgccgagcccgtgaccttcggcctcaagctcgcctatgcctacgccgaattctcgcgcgccaaggaacgcctgatcgcggcgcggaaggaggtcgcgacctgcgctatctccggtgccgtcggcaccttcgcgcagatcgatccgcgggtcgaagagcacgttgcaaaagccatgggtctcgtgcccgagccgatctcgacccaggtgatcccgcgcgaccgccacgcgatgtatttctcgacccttggcgtgatcgcctcctcggtcgagcgcatcgcggtcgagatccgccacatgcagcgcaccgaggtgctggaggccgaagagttcttctccgagggacagaagggctcttccgccatgccgcacaagcgcaacccggtgctgtccgaaaacctcaccggcctctcccgcatggtgcgcgcctatgtgacgccggccttggaaaacgtcgtgctctggcacgagcgcgacatctcgcactcctccgccgagcgcatgatgggtccggacgcgaccgtgacgctcgacttcgcgctggtgcgccttgccggcctgatcgacaagctgctggtctatcccgccaacatgcagaagaatctcgaccgcctcggcggcctcgtgcattcgcagcgcgtgctcctggcgctgacgcagaagggcgcgagccgcgaggacgcctacaagctggtgcagcgcaacgccatgccggtctggcgcggcgaaggcgacttcctccagctcctgaagcaggacgccgaggtgaagaaatatctcaccgacgccgagatcgaggagcagttcgacctcgcctatcacctcaagcacgtcgacacgatcttcaagcgcgtgttcggcgagagctga

SEQ ID NO: 3146 - protein, 435 aa, Bradyrhizobium japonicum
MIPRYTRPEMASIWEPQTRFKIWFEIEAHAADALAELGTIPKEAARTVWAKAKNATFDVARIDEIERETKHDVIAFLTHLAEIVGPEARFVHQGMTSSDVLDTCLNVQLTRAADLLLADLDKVLAALKKRAFEHKMTTTIGRSHGIHAEPVTFGLKLAYAYAEFSRAKERLIAARKEVATCAISGAVGTFAQIDPRVEEHVAKAMGLVPEPISTQVIPRDRHAMYFSTLGVIASSVERIAVEIRHMQRTEVLEAEEFFSEGQKGSSAMPHKRNPVLSENLTGLSRMVRAYVTPALENVVLWHERDISHSSAERMMGPDATVTLDFALVRLAGLIDKLLVYPANMQKNLDRLGGLVHSQRVLLALTQKGASREDAYKLVQRNAMPVWRGEGDFLQLLKQDAEVKKYLTDAEIEEQFDLAYHLKHVDTIFKRVFGES

SEQ ID NO: 3147 - DNA, 1347 bp, Bacteroides thetaiotaomicron
  CDS (1)..(1347)
atggaacttgatgtattaacggccatatctccgattgatggtcgatatagaggcaaaactaaagctttggcagcttatttctctgaatttgcactgattaaataccgtgtacaggtagaggtggaatactttatcaccttgtgcgaacttcctttgccgcagttgaaaggaatcgatagcagcgtgtttgaaactttacggaatatctaccgtaacttctcggaagcagatgcgcaacgcattaaagatatcgaaagtgtaaccaaccatgatgtaaaagccgtagaatatttcctgaaagaagaattcgataagctgggtggaatggatgactataaagaattcattcacttcggattgacttctcaagacattaataatacgtctgtgcctctttctatcaaggaagctttggataaagtctattatccgctgatcgaagaactgattgcacaactgaaaacgtatgcaacagaatgggctgaaatcccgatgcttgccaaaactcatgggcaaccggcttctccgactcgtttgggtaaggaagtgatggtattcgtttaccgcctggaacgtcagctggctatgctgaaagcatgtccgatcactgcaaaattcggtggcgctaccggaaattacaatgctcatcatgtagcatatcctcaatatgactggaaacaattcggtaatcggtttgttgcagagaaactgggactggagcgcgaagaatataccactcagatttcgaactacgataacttgtctgctgtctttgacgcgatgaaacgtatcaacaccataatggtggatatgaaccgtgacttctggcagtatatttctatggaatacttcaagcagaagatcaaagccggtgaggtaggatcaagcgcgatgccgcataaagtgaatccgatcgactttgaaaatgcggaaggtaatttgggtatcgcaacttctattctggaacacctggctgtgaaactgcctgtttcccgtttgcagcgtgacctgacagactctacggtgctccgtaatgtaggcgtgcctttcggtcatatcgtgattgctattcagagttcactgaaaggacttcgcaaactgttgctgaacgaaccggctatttaccgtgatctggacaactgctggagcgtagtggctgaggcaatccagacgattttacgccgcgaggcttacccgcatccgtatgaagcattgaaagctttgacccggaccaaccaggctattacagaaagttctattaaagagtttatcgaaggcttgaacgtaagcgaagatattaaaaaagagttaagagcaattactccgcatacatatacgggactttaa

SEQ ID NO: 3148 - protein, 448 aa, Bacteroides thetaiotaomicron
MELDVLTAISPIDGRYRGKTKALAAYFSEFALIKYRVQVEVEYFITLCELPLPQLKGIDSSVFETLRNIYRNFSEADAQRIKDIESVTNHDVKAVEYFLKEEFDKLGGMDDYKEFIHFGLTSQDINNTSVPLSIKEALDKVYYPLIEELIAQLKTYATEWAEIPMLAKTHGQPASPTRLGKEVMVFVYRLERQLAMLKACPITAKFGGATGNYNAHHVAYPQYDWKQFGNRFVAEKLGLEREEYTTQISNYDNLSAVFDAMKRINTIMVDMNRDFWQYISMEYFKQKIKAGEVGSSAMPHKVNPIDFENAEGNLGIATSILEHLAVKLPVSRLQRDLTDSTVLRNVGVPFGHIVIAIQSSLKGLRKLLLNEPAIYRDLDNCWSVVAEAIQTILRREAYPHPYEALKALTRTNQAITESSIKEFIEGLNVSEDIKKELRAITPHTYTGL

SEQ ID NO: 3149 - DNA, 1443 bp, Streptomyces coelicolor
  CDS (1)..(1443)
atgacttccgctcccgccaagccccgcatcccgaacgtcctcgccggacgctacgcctccgccgagctcgccaccctctggtcgcccgagcacaaggtgaagctcgagcggcagctctggctcgccgtgctgcgggcccagaaggacctgggcatcgaggtgcccgacgccgcgatcgccgactacgagcgcgtcctcaaccaggtcgacctggcctcgatcgccgagcgcgagaaggtcacgcggcacgacgtgaaggcgcggatcgaggagttcaacgacctcgccgggcacgagcacgtccacaagggcatgacctcccgcgacctgacggagaacgtcgagcagctccagatccggctctcgctggagctggtccgggaccgttccgtggccgtcctggcccgcctcggcaagctggccggcgagtacggcgagctggtcatggccggccgctcgcacaacgtggcggcgcaggcgacgacgctgggcaagcggttcgccagcgccgccgacgagctgctcgtggcgtacggccgggtggaggagctgctcggccgctacccgctgcgcggcatcaagggcccggtcggcaccgcccaggacatgctggacctgctcggcggtgacgcgggcaagctggcggacctggagcagcggatcgccgggcacctcggcttctcgcaggcgttcacctcggtcggccaggtgtacccgcgctccctggactacgaggtcgtcaccgcgctggtgcagctcgccgccgcgccgtcctcgctggccaagacgatccgcctgatggccgggcacgagctggtcaccgagggcttcaagcccggccaggtcggctcgtccgcgatgccgcacaagatgaacacccgttcctgcgagcgcgtcaacggcctgacggtgatcctgcgcggctacgcctcgatgaccggtgagctggcgggcgaccagtggaacgagggcgacgtgtcctgctcggtggtgcgccgggtggcgctccccgacgccttcttcgcgctggacgggctgctggagacgttcctgaccgtgctcgacgagttcggcgccttcccggccgtcgtggcccgggagctggaccgctacctgccgttcctggccaccaccaaggtgctgatgggcgcggtgcgcggcggtgtgggccgcgaggtcgcgcacgaggcgatcaaggagaacgcggtcgcctccgcgctggccatgcgcgagcagggcgccgagcgcaacgagctgctcgacaagctggccgccgacgaccgcatcccgctggaccgtgccgccctggacgcgctgatggccgacaagctctccttcaccggcgccgcggccgaccaggtcggtgtggtcgtcggccggatcgaggacatcgtcaagcggcacccgcaggccgccggttacacccccggagcgatcctctga

SEQ ID NO: 3150 - protein, 480 aa, Streptomyces coelicolor
MTSAPAKPRIPNVLAGRYASAELATLWSPEHKVKLERQLWLAVLRAQKDLGIEVPDAAIADYERVLNQVDLASIAEREKVTRHDVKARIEEFNDLAGHEHVHKGMTSRDLTENVEQLQIRLSLELVRDRSVAVLARLGKLAGEYGELVMAGRSHNVAAQATTLGKRFASAADELLVAYGRVEELLGRYPLRGIKGPVGTAQDMLDLLGGDAGKLADLEQRIAGHLGFSQAFTSVGQVYPRSLDYEVVTALVQLAAAPSSLAKTIRLMAGHELVTEGFKPGQVGSSAMPHKMNTRSCERVNGLTVILRGYASMTGELAGDQWNEGDVSCSVVRRVALPDAFFALDGLLETFLTVLDEFGAFPAVVARELDRYLPFLATTKVLMGAVRGGVGREVAHEAIKENAVASALAMREQGAERNELLDKLAADDRIPLDRAALDALMADKLSFTGAAADQVGVVVGRIEDIVKRHPQAAGYTPGAIL

SEQ ID NO: 3151 - DNA, 1296 bp, Staphylococcus epidermidis
  CDS (1)..(1296)
atgatagaacgttattcaagagatgaaatgtctagtatttggacggatcaaaatcgctatgaagcatggttagaagtagagattctagcgtgtgaagcatggagtgagttaggttatattcctaaagaagatgtaaaaaaaattcgtgaaaatgccaaagtaaatgttgaacgcgctaaagaaattgaacaagaaacacgacacgatgtagttgcatttacacgccaagtttctgaaactttaggtgatgaacgtaagtgggtacattatggattaacttccactgatgtagttgacactgccttaagttatgtaattaaacaggcaaacgaaatccttgaaaaagatttagaaagatttatagatgtattagctgccaaagctaaaaaatatcaatatacattgatgatggggcgtacacatggagttcatgctgagcctacaacttttggcgtaaaaatggctctttggtatactgaaatgaaacgtaatcttaagcgttttaaagaagtgcgtaaagaaatagaagtagggaaaatgagtggagcagtaggaacatttgccaatattccacccgaaattgaggcttacgtatgtgaacatttaggaatagacactgcagctgtttctactcaaacattacaaagagatcgtcatgcttattacattgctacattagcactaattgctacatcaatggaaaaatttgcagtagaaattcgtaatttacaaaaaactgaaactagagaagtcgaagaggcatttgcaaaaggacaaaaaggatcatcagcaatgccacataaaagaaatccaatcggttctgaaaatattacaggtatatctcgtgtgattcgaggatatattactactgcatacgagaatatacctttatggcatgaaagagatatctctcattcttctgcagaacgtatcatgttaccagatgttacaattgctctagattatgcacttaatcgatttacgaatattgttgatcgactaacagtttatgaagataatatgagaaataatattgataaaacgtatggtttaatcttctcacaacgcgtactactagcattaattaataaaggcatggtacgtgaagaagcttatgataaagttcaacctaaagcaatggaatcttgggaaacaaaaacaccatttagagagctaattgaacaagattcatctataactgacgttctatcaagtgaagaattagatgattgcttcgatcctaagcatcatcttaatcaggtcgacactatattcgcgcgtgctggtttatcttag

SEQ ID NO: 3152 - protein, 431 aa, Staphylococcus epidermidis
MIERYSRDEMSSIWTDQNRYEAWLEVEILACEAWSELGYIPKEDVKKIRENAKVNVERAKEIEQETRHDVVAFTRQVSETLGDERKWVHYGLTSTDVVDTALSYVIKQANEILEKDLERFIDVLAAKAKKYQYTLMMGRTHGVHAEPTTFGVKMALWYTEMKRNLKRFKEVRKEIEVGKMSGAVGTFANIPPEIEAYVCEHLGIDTAAVSTQTLQRDRHAYYIATLALIATSMEKFAVEIRNLQKTETREVEEAFAKGQKGSSAMPHKRNPIGSENITGISRVIRGYITTAYENIPLWHERDISHSSAERIMLPDVTIALDYALNRFTNIVDRLTVYEDNMRNNIDKTYGLIFSQRVLLALINKGMVREEAYDKVQPKAMESWETKTPFRELIEQDSSITDVLSSEELDDCFDPKHHLNQVDTIFARAGLS

SEQ ID NO: 3153 - DNA, 1395 bp, Wigglesworthia glossinidia brevipalpis
  CDS (1)..(1395)
atgaaattatctcatttaactgcaatttctcctgtagatggtagatattttgaatatgttaaatcacttagaaatatttttagcgaatttagtttgttaaaatatagattaattattgaaatagaatggtttaaaaaaatctctgaatgtgaaaaaattaatgatattgaacctctaatttctgaagaaaaaatttttttaaataacattttaaataattttagcttgaaagatgctatagaaataaaaaatattgagcgtaaaactaatcatgatattaaagcagtagagtattttttaaagaaaaaattttctttaatgaaaagtttagatgaaaaaaaagaatttatacattttgcatgtacatctgaagatataaataatctttcatatgctttgatgataatcaaaacaagaaatgaaataataattccaatttggtataaaataattaaaaatattgtttctttttctaaaaaatataaaaattttccaataatatctagaactcacggtcagcctgcaactccatctacattaggaaaagaattttgtaacttttcttatagattgataagacaatttaatcaattaaaaaaaattaaaattcttggtaaaataaatggaactgttggaaattataatgctcattttatttcttaccctaatgttgattggattaattttagcaaagaatttgtaaatagtcttggaatagaactaaatttgtttactactcagattgagcctcatgattatatatcagaaatattgcattgtttttctagatttaataatattttaataaattttaacagagacatatgggggtatttatctattaatttttttaagaacaaatataataaaggtaaaattggatcttctgttatgcctcacaaaataaatccaatagattttgaaaattctgaaggaaatttagaattatctaatgctattttaaatcatttatctaataaattatcaatatctagatggcaaagagatttgactgattctacttctttaagaaatataggattagcgataagctattcttttattgcatataaaaaatttttaaatggaatttcaaatttagaaattaataaatttaatataaaatctgatttaagatctcattgggaagttctttcagaacctatccaaactttgatgcgcaggaataaaattaaaaattcttatgagttagtaaaagattttttaatcaaaaaagatctagatcctgaaactttgaaaagttttgtagaaaatttgaaaattaaaaatagtgataaaaatattttaaaaaatattacacctgaaaaatatattggtttatcaactttgttagttgattgtatagaaaaatattttaataatatcgataaataa

SEQ ID NO: 3154 - protein, 464 aa, Wigglesworthia glossinidia brevipalpis
MKLSHLTAISPVDGRYFEYVKSLRNIFSEFSLLKYRLIIEIEWFKKISECEKINDIEPLISEEKIFLNNILNNFSLKDAIEIKNIERKTNHDIKAVEYFLKKKFSLMKSLDEKKEFIHFACTSEDINNLSYALMIIKTRNEIIIPIWYKIIKNIVSFSKKYKNFPIISRTHGQPATPSTLGKEFCNFSYRLIRQFNQLKKIKILGKINGTVGNYNAHFISYPNVDWINFSKEFVNSLGIELNLFTTQIEPHDYISEILHCFSRFNNILINFNRDIWGYLSINFFKNKYNKGKIGSSVMPHKINPIDFENSEGNLELSNAILNHLSNKLSISRWQRDLTDSTSLRNIGLAISYSFIAYKKFLNGISNLEINKFNIKSDLRSHWEVLSEPIQTLMRRNKIKNSYELVKDFLIKKDLDPETLKSFVENLKIKNSDKNILKNITPEKYIGLSTLLVDCIEKYFNNIDK

SEQ ID NO: 3155 - DNA, 1296 bp, Synechococcus elongatus
  CDS (1)..(1296)
atgatcgaacgctatacccttgccccaatggggaatctctggacagatgcctacaaattcaaaacatggctcgatgttgagattgcggtctgcgaagcccaagccgaactggggtatattccggccgcggccgttgccgagatcaaagccaaggccaagtttgacccccaacgggtacaggaaattgaagcggaggtgaagcacgacgtcattgctttcctcaccaacgttaacgagtatgtcggcgatgcggggcgctatattcaccttggcttgacgagctccgatgttctcgacaccggtttagcgctgcaattggtggccagtctagggctgattcaacagcagttggagcatctcatgcaggcggtccgccaccgtgcccaagaacatcgctataccgtgatggtgggacgcagccatggcattcacgctgaacccattacctttggcttcaaactggcgggttggttagcggaactgctgcgccatcgcgatcgcctgtgccagttacagcgtacagtggcagtgggcaaaatctccggggcagtgggcacctatgccaatgtggatccgcgcgtagaggcgatcgcctgtcaaaaactgggactgcaacccgataccgcttccacccaggtcatttcccgcgatcgccatgcagattatgtgcagacccttgccctcctaggggccagtctggagcgctttgccgttgaaattcgcaatctgcagcgcaccgatgtcctggaagtcgaggaatttttctcgaagggtcaaaaaggctcctccgctatgccccacaaacgcaatcccattcgttccgagcggctgacgggtctggcgcgggtgctgcgggccaatgccttggctgccctagaaaatgttgccctttggcatgagcgggatatttcccacagtgcagtggaacgggtcattttgcccgacagctcgattctcacccactttatgctggtggaaatgactgacttggtgcaaacgctgcaggtttatcccgagaatatgcgccgcaatatgaattgctacggcggtgtcatctttagtcagcgggtgctgttggccttggtggaaaaaggcctcagccgcgaagcggcctatgcccttgtgcagaaacatgcccatgccgcttggaatcaaccccagggggactttgccgccaacctcaaggcagaccctgaaattcagcggtatctcagccctgaggaattagaggcctgctttaacccagagcaccacctgcggcatttggaggaaatttaccagcgcttgggcatctag

SEQ ID NO: 3156 - protein, 431 aa, Synechococcus elongatus
MIERYTLAPMGNLWTDAYKFKTWLDVEIAVCEAQAELGYIPAAAVAEIKAKAKFDPQRVQEIEAEVKHDVIAFLTNVNEYVGDAGRYIHLGLTSSDVLDTGLALQLVASLGLIQQQLEHLMQAVRHRAQEHRYTVMVGRSHGIHAEPITFGFKLAGWLAELLRHRDRLCQLQRTVAVGKISGAVGTYANVDPRVEAIACQKLGLQPDTASTQVISRDRHADYVQTLALLGASLERFAVEIRNLQRTDVLEVEEFFSKGQKGSSAMPHKRNPIRSERLTGLARVLRANALAALENVALWHERDISHSAVERVILPDSSILTHFMLVEMTDLVQTLQVYPENMRRNMNCYGGVIFSQRVLLALVEKGLSREAAYALVQKHAHAAWNQPQGDFAANLKADPEIQRYLSPEELEACFNPEHHLRHLEEIYQRLGI

SEQ ID NO: 3157 - DNA, 1299 bp, Streptococcus agalactiae
  CDS (1)..(1299)
atgatcgaacgttattcacgccctgagatggcggcaatttggacagaggaaaataaataccgtgcttggttggaggtcgagattttggctgacgaggcatgggctgagttgggtgagattcctaaggaggatgtggctaagattcgtgagaaggcggattttgacattgaccgcattcttgagattgagcaggacacgcgtcacgatgtggtggctttcactcgtgcggtttctgagacgcttggtgaggagcgcaagtgggtgcactacggtttgacgtcgactgacgtggtggacactgcctacggttacctctacaagcaggctaacgatattatccgtcgtgaccttgagaatttcacaaatattgtggctgataaggctaaggagcacaagttcaccatcatgatgggtcgtacccacggtgttcacgctgagccaacgactttcggtcttaagttggcgacctggtacagcgagatgaaacgtaatattgagcgttttgaacatgctgccgcaggtgtggaagctggtaagatttcaggtgccgttggtaactttgctaacattcctccatttgtggaacaatatgtttgtgacaaattgggcatccgtccgcaagagatttcaacacaggttcttccacgtgacctccacgcagaatattttgcagtgcttgcaagcattgcaacttctatcgaacgtatggcgacagagattcgtggtctgcaaaaatcagaacaacgtgaagttgaagaattctttgccaaaggtcagaaaggtagctctgctatgcctcacaaacgcaacccaatcggttcagagaacatgactgggctagcgcgcgtgattcgtggtcacatggtgacggcttatgagaacgtggcactttggcacgagcgtgatatttcgcactcatctgctgagcgtatcatcacacctgacacaacgatcttgattgactacatgctcaaccgttttggcaatatcgttaagaacttgactgtcttcccggaaaatatgatgcgcaatatggaatcaacttttggtttgatttatagtcaacgtgttatgctcaaattgattgaaaaaggaatgacacgagaagaagcttatgacttagttcaacctaagacagcttattcctgggacaatcaagtggatttcaaaccacttttagaagaagacaccaaagttacctcttgtcttacacaggaagaaattgatgaactatttaatccgatttattacacaaaacgtgttgatgatatttttgaaagactaggattagaaaaatag

SEQ ID NO: 3158 - protein, 432 aa, Streptococcus agalactiae
MIERYSRPEMAAIWTEENKYRAWLEVEILADEAWAELGEIPKEDVAKIREKADFDIDRILEIEQDTRHDVVAFTRAVSETLGEERKWVHYGLTSTDVVDTAYGYLYKQANDIIRRDLENFTNIVADKAKEHKFTIMMGRTHGVHAEPTTFGLKLATWYSEMKRNIERFEHAAAGVEAGKISGAVGNFANIPPFVEQYVCDKLGIRPQEISTQVLPRDLHAEYFAVLASIATSIERMATEIRGLQKSEQREVEEFFAKGQKGSSAMPHKRNPIGSENMTGLARVIRGHMVTAYENVALWHERDISHSSAERIITPDTTILIDYMLNRFGNIVKNLTVFPENMMRNMESTFGLIYSQRVMLKLIEKGMTREEAYDLVQPKTAYSWDNQVDFKPLLEEDTKVTSCLTQEEIDELFNPIYYTKRVDDIFERLGLEK

SEQ ID NO: 3159 - DNA, 1299 bp, Streptococcus agalactiae
  CDS (1)..(1299)
atgttagaacgttattcacgccctgagatggcggcaatttggacagaagaaaataaatatcgtgcttggttggaggttgagattttggctgacgaggcatgggctgagttgggtgaaattcctaaggaggatgtgactaagattcgtgagaaggcggattttgacattgaccgcattcttgagattgagcaggacacgcgtcacgatgtggtggctttcactcgtgcggtttctgagacgcttggtgaggagcgcaagtgggtgcactacggtttgacgtcgactgacgtggtggacactgcctacggttacctctacaagcaggctaacgacattatccgtcgtgaccttgagaatttcacaaatatcgtggctgagaaagctaaggagcacaagttcaccatcatgatgggtcgtacccacggtgttcacgctgagccaacgactttcggtcttaagttggcaacttggtacagtgagatgaaacgtaatattgagcgttttgaacatgctgccgcaggagtggaagctggtaagatttcaggtgctgttggtaactttgccaacatcccaccttttgtggaagaatatgtctgtgacaaattaggcatccatccgcaagaaatttcaacacaggttcttccacgtgatctccacgcagaatattttgcagtgcttgcaagtattgcaacatctatcgaacgtatggcgacagagattcgtggtctgcaaaaatcagaacaacgtgaagttgaagagttctttgccaaaggtcagaaaggtagctctgctatgcctcacaaacgcaacccaatcggttcagagaacatgacagggctagcgcgcgtaattcgtggtcacatggtgacggcttatgagaacgtggcactttggcacgagcgtgatatttcgcactcatcagctgagcgtatcatcacaccagacacaactatcttgattgactacatgctcaaccgttttggcaatatcgttaagaacttgactgtcttcccagaaaatatgatgcgcaatatggaatcaacttttggtttgatttatagtcaacgtgttatgctcaaattgattgaaaaaggaatgacacgagaagaagcttatgacttagttcaacctaagacagcttattcctgggacaatcaagtggatttcaaaccacttttagaagaagacaccaaagttacctcttgtcttacacaggaagaacttgatgaactatttaatccgatttattacacaaaacgtgttgatgatatttttgaaaggttaggattagaaaaataa

SEQ ID NO: 3160 - protein, 432 aa, Streptococcus agalactiae
MLERYSRPEMAAIWTEENKYRAWLEVEILADEAWAELGEIPKEDVTKIREKADFDIDRILEIEQDTRHDVVAFTRAVSETLGEERKWVHYGLTSTDVVDTAYGYLYKQANDIIRRDLENFTNIVAEKAKEHKFTIMMGRTHGVHAEPTTFGLKLATWYSEMKRNIERFEHAAAGVEAGKISGAVGNFANIPPFVEEYVCDKLGIHPQEISTQVLPRDLHAEYFAVLASIATSIERMATEIRGLQKSEQREVEEFFAKGQKGSSAMPHKRNPIGSENMTGLARVIRGHMVTAYENVALWHERDISHSSAERIITPDTTILIDYMLNRFGNIVKNLTVFPENMMRNMESTFGLIYSQRVMLKLIEKGMTREEAYDLVQPKTAYSWDNQVDFKPLLEEDTKVTSCLTQEELDELFNPIYYTKRVDDIFERLGLEK

SEQ ID NO: 3161 - DNA, 1371 bp, Shewanella oneidensis
  CDS (1)..(1371)
atggatctttccgcactaactgctatctctccggtagacggccgttacggtagtaaaacagcgtcattgcgagggattttcagcgagttcggtcttactaagtaccgtgttcaagttgaaatcaactggttaaagttactcgccgattgccctgaaatcactgaagtgccgccattaagcgagtcagcgatcgcgcttctcgatgccattaaagacaatttcagtgagcaagatgcgctgcgtgtgaaagccattgaaagcaccaccaaccacgacgtgaaagcggttgaatatttcatcaaagaaaaaatcgctgctaatgtagaattagccgctgtaggtgaatttgttcactttgcctgtacttctgaagatatcaacaacttaagccatggcttaatgttaactgaagctcgcgagcaagtggttctgccttattgcaatgaactgctcagcgcaatcaaaaaactggccgttgaataccgctcagtacctttgatgtcacgtacccacggtcagccagcctcgccttctacgcttggtaaagaaatggcgaacgtggcggtgcgtttggagcgtcaaatcaagcaaatcgcagctgttgaaatcatggggaaaattaacggcgccgtgggtaactacaacgcgcacatatcagcatacccagaagtgaactggcatgcactgtctgaacgatttgtgacaagccttggcctgcactggaacgcatatactactcaaatcgaaccgcatgattacattgcagagctcttcgatgcgattgcgcgtttcaacactattctgctcgatttcgaccgtgacgtttggggctatattgccttaggtcactttaagcaacgtaccattgccggtgaaattggctcctcaaccatgccgcacaaggtcaaccctatcgactttgaaaactcagagggtaacttaggtattgccaatgcgctgatgcaacatttagccgctaaactgcccgtttcaagatggcaacgcgacttaaccgattctactgtactgcgtaacttaggcgtgggtattgcccactcgctgatcgcctaccaagccaccttgaaaggtattagtaagttacaagtgaatgaagagcatttacgtgccgagcttgatcaaaactgggaagtattggccgagccagtacaaacagtaatgcgccgctatggcattgaaaagccatacgagaagttaaaagaattgacacgcggtaaacgcattgatgctaagcaacttgccgagtttatcgacggtttagccctgccagaagacgtgaaggctgagctaaagaagatgacgccagccaactatattggccgtgctgaagccttcgtcgacgagcttaactaa

SEQ ID NO: 3162 - protein, 456 aa, Shewanella oneidensis
MDLSALTAISPVDGRYGSKTASLRGIFSEFGLTKYRVQVEINWLKLLADCPEITEVPPLSESAIALLDAIKDNFSEQDALRVKAIESTTNHDVKAVEYFIKEKIAANVELAAVGEFVHFACTSEDINNLSHGLMLTEAREQVVLPYCNELLSAIKKLAVEYRSVPLMSRTHGQPASPSTLGKEMANVAVRLERQIKQIAAVEIMGKINGAVGNYNAHISAYPEVNWHALSERFVTSLGLHWNAYTTQIEPHDYIAELFDAIARFNTILLDFDRDVWGYIALGHFKQRTIAGEIGSSTMPHKVNPIDFENSEGNLGIANALMQHLAAKLPVSRWQRDLTDSTVLRNLGVGIAHSLIAYQATLKGISKLQVNEEHLRAELDQNWEVLAEPVQTVMRRYGIEKPYEKLKELTRGKRIDAKQLAEFIDGLALPEDVKAELKKMTPANYIGRAEAFVDELN

SEQ ID NO: 3163 - DNA, 1296 bp, Oceanobacillus iheyensis
  CDS (1)..(1296)
atgattgaacgttatacaagagaagaaatgggtagtatttggacggaagagaataaattcaaagcgtggttagaggttgaaatactagcttgcgaagcatggagcgagttaggtgttatcccgaaagaagatgtaaagaaattaagagaaaatgcttcttttgatatgaaccgcatttatgaaattgaagaagaaacacgacatgatgtagtggcatttacacgtgctgtatccgagacattaggggaagagcgtaaatgggtacattatggtttaacatcgactgacgttgtagatacagcattatcttatattttaaaacaagcaaacgatattctacgtaaagacttaaatcaatttgttgaaattctgaaagaaaaagcaatagagcataaacatacggtaatgatgggacgcacacatggtgttcatgcagaaccaacaacattcggattgaaaatggcattatggtatgaagaaatgaaacgaaatgtagagcgttttgaactggctgcgaagaacatcgaatttggtaagatttctggtgcagtgggtacttatgcaaatatcgatccatttgtggaacagtatgtgtgtgaaaaattaggtacttctccagctcctgtgtccacacaaacattacaacgtgatcgtcatgctgcatatttatcggctcttgcattaattgcaacgtcgatcgaaaagttcgcaacagaaattcgtggattgcagaaaacagaaacacgtgaagtagaagagcgatttgcgaaaggtcagaaaggctcgtctgcaatgccgcataaacgtaatccaatcggatcagaaaatatgactggtatggctcgtgtgattcgaggatatatggtaacagcctatgaaaatgtggctttatggcatgaacgtgatatttctcattcatcagcagagagagtaatcttaccagacgcgactattgctttaaattatatgttaaatcgttttggtaatatcgtaaaaaacttaacggtgttcccagagaatatgaagcgtaatattgatcgcacacatggggttattttctcccaaagagtgttgctttcattaattgataaaggcatggctcgtgaggaagcatatgacattgtacaaccaaaagcaatggatgcttgggaaacagagacacatttcaaacagttggtagaaagtgatgaccgaattactggaaagctaacgcaagcagagattgatgattgttttgattatacgtatcacttgaagaatgtcgatcaaatctttacaaaaatcggtatttcctag

SEQ ID NO: 3164 - protein, 431 aa, Oceanobacillus iheyensis
MIERYTREEMGSIWTEENKFKAWLEVEILACEAWSELGVIPKEDVKKLRENASFDMNRIYEIEEETRHDVVAFTRAVSETLGEERKWVHYGLTSTDVVDTALSYILKQANDILRKDLNQFVEILKEKAIEHKHTVMMGRTHGVHAEPTTFGLKMALWYEEMKRNVERFELAAKNIEFGKISGAVGTYANIDPFVEQYVCEKLGTSPAPVSTQTLQRDRHAAYLSALALIATSIEKFATEIRGLQKTETREVEERFAKGQKGSSAMPHKRNPIGSENMTGMARVIRGYMVTAYENVALWHERDISHSSAERVILPDATIALNYMLNRFGNIVKNLTVFPENMKRNIDRTHGVIFSQRVLLSLIDKGMAREEAYDIVQPKAMDAWETETHFKQLVESDDRITGKLTQAEIDDCFDYTYHLKNVDQIFTKIGIS

SEQ ID NO: 3165 - DNA, 1299 bp, Mycoplasma penetrans
  CDS (1)..(1299): transl_table=4
atgattaaaagatatgaagttcctataatttctaaaatttgatcagatgaaaataaatttaacacttgattgaaaattgaaaagtgtgtaattaactatttttatgtgagtaaaaaaattgatgaacaaacatttaatttattaaatgaaaaaatgtcttttgatttaaatgaaatttatgaaattgaaaaaaacactaaacatgatgttattgcttttttaagagcaatatctttaaacataaaagaagacagtgttaagaagtgaattcattatggtttaacttcaacagatgttgtagatactgcaaatgcagtgatgcttaaagaaacaaatttgttaattattgaagcaattaaaaacttaatgaaggaactaaaaaagaaagcttttaaatataaagatttagttcaaataggtagaactcatgggatccatggagaacctactagttttggttataaatttgcaatttgatatgatgaattaaatagaaacttagaaagattaaatcttgctagaaaagaagttgaggttggaaagattagtggtgctgttggtacatttgcaaacactggattaaaacttcaagattatgtttgtaagaaactaaagattaattcatcgaatgcttctactcaaattattcaaagagataatcatgcattttattttgcaactcttgcagtgattgcaagtacagttgaaaaaattgcaactgaattaagacacttatcaagaactgaagtttctgaagttagtgaattttttgatattaatcaaaaaggtagctctgcaatgccacataagaaaaatcctattagtttagaaaatatctgtgggctttctagaatgattaaagcatatagtaatgttgcattagaaaataatgacctttgacatgagcgtgatatttctcattcttcaaatgaaagaattatgtttttagatgctacaacacttacttattatgtaattgaaagattaactaaagtaattgcaaatcttaatgtatatgtaaaaaatattcaaaagaatttgaaactaactaatggtttaatttactctcaagcattgttattaaagttattggaaaatgaaaatctttctagagaatttgtatatgatgaaattcaaaaaatagcattgttgtgttttaacaataatttagattttaaaagtgaaattttaaaatctaaattggctgatggattaactgaaaaagatattaattttatttttgatgaaaaacatcatttaaaatatatcaatgatatttataaaaggatttttagataa

SEQ ID NO: 3166 - protein, 432 aa, Mycoplasma penetrans
MIKRYEVPIISKIWSDENKFNTWLKIEKCVINYFYVSKKIDEQTFNLLNEKMSFDLNEIYEIEKNTKHDVIAFLRAISLNIKEDSVKKWIHYGLTSTDVVDTANAVMLKETNLLIIEAIKNLMKELKKKAFKYKDLVQIGRTHGIHGEPTSFGYKFAIWYDELNRNLERLNLARKEVEVGKISGAVGTFANTGLKLQDYVCKKLKINSSNASTQIIQRDNHAFYFATLAVIASTVEKIATELRHLSRTEVSEVSEFFDINQKGSSAMPHKKNPISLENICGLSRMIKAYSNVALENNDLWHERDISHSSNERIMFLDATTLTYYVIERLTKVIANLNVYVKNIQKNLKLTNGLIYSQALLLKLLENENLSREFVYDEIQKIALLCFNNNLDFKSEILKSKLADGLTEKDINFIFDEKHHLKYINDIYKRIFR

SEQ ID NO: 3167 - DNA, 1431 bp, Corynebacterium efficiens
  CDS (1)..(1431)
atggctgataagaagaagattgcaaacgtcctgtccaaccgttacgcctccgcggagctgtccaacctctggagcgccgaagagaagatcatcatggagcgccagctgtggatcgccgtgatgaaagcccagcaggatctgggtgtggagatccccgccgaggcgatcaccgcctacgaagcagtgatcgaccaggttgacctggcctccatcgccgaccgtgaacgcgtcacccgccatgatgtcaaggcccgcatcgaggagttcaacgccctcgccggccatgagcacatccacaagggcatgacctcccgtgacctcaccgagaacgtcgagcagctccagatccaccgctcgctggaactggtgcgcaacaaggccatcgccgtggtcgccgcgatcggcaaccgtgccgcccagtaccagagcctggtcatggccggtcgctcccacaacgtcgccgcgcaggctaccaccctgggtaagcgtttcgccaccgccgccgatgagatgctggtggccatcgagcgcaccgatgacctgctcggacgctacccactgcgtggcatcaagggccccatgggcaccgcacaggacatgctggatctcatggacggcgatgagtcccgcctgtccgaactggagaaccgcatcgcctcccacctcggttttgaccgcgtcttcgactccgtcggccaggtctacccgcgttccctcgacttcgatgccgtctcggcgctggtgcagctgggtgcgggcccgtcatcgctgtcccacaccatccgcctcatggccggcaccgagaccgtcacggagggcttcaaggaggggcaggtcggttcctccgccatgccacacaagatgaacgcccgttcctgcgagcgcgtcggtggcctccaggtgatcctgcgcggttacctgaccatggttgccgacctgtccggccagcagtggaacgagggggatgtgttctgctccgtcatccgccgcgtggcgctgccggatgccttcttcgccctggacggcatgttcgaaaccttcctcaccgtcctcgacgagttcggtgccttccccgccatgatcgagcgtgagctcgagcgttacctgccgttcctggccaccacccgcatcctcatggccgctgtccgcgcgggcgtgggccgtgagaccgcccatgaggtgatcaaggaaaacgcggttgccgttgcgctgaacatgcgtgaaaacggtggcgggcaggatctgatccagcgcctggccgccgatgagcgcctgccgatggatgaggctgccctcaccgaggcgctcgcggatcgccacgccttcatcggggctgccgagtctcaggttgcgcgcgtcctggatcgcatccaggtgcttgtcgacgcccaccccgacgccgctgcctaccgtccgggtgagatcctctag

SEQ ID NO: 3168 - protein, 476 aa, Corynebacterium efficiens
MADKKKIANVLSNRYASAELSNLWSAEEKIIMERQLWIAVMKAQQDLGVEIPAEAITAYEAVIDQVDLASIADRERVTRHDVKARIEEFNALAGHEHIHKGMTSRDLTENVEQLQIHRSLELVRNKAIAVVAAIGNRAAQYQSLVMAGRSHNVAAQATTLGKRFATAADEMLVAIERTDDLLGRYPLRGIKGPMGTAQDMLDLMDGDESRLSELENRIASHLGFDRVFDSVGQVYPRSLDFDAVSALVQLGAGPSSLSHTIRLMAGTETVTEGFKEGQVGSSAMPHKMNARSCERVGGLQVILRGYLTMVADLSGQQWNEGDVFCSVIRRVALPDAFFALDGMFETFLTVLDEFGAFPAMIERELERYLPFLATTRILMAAVRAGVGRETAHEVIKENAVAVALNMRENGGGQDLIQRLAADERLPMDEAALTEALADRHAFIGAAESQVARVLDRIQVLVDAHPDAAAYRPGEIL

SEQ ID NO: 3169 - DNA, 1302 bp, Brucella suis
  CDS (1)..(1302)
atgatcccgcgctattcccggccagaaatggtcgccatctggtcgcccgaaacgaagttccgcatctggttcgagatcgaagcctatgcctgcgaggcgctggctgaactgggcgtcatcccgaaggaagcggccaggaccatctgggaaaagggcagcgtggcgaaattcgacgtcgcccgcatcgacgaaatcgaagccgtcaccaagcatgacgtgatcgcattcctcacgcatctggccgaatttatcggccctgacagccgtttcgtccatcagggcatgacgtcatcggacgtgctcgacaccacgctcaatgtccagcttgtgcgcgctgccgacctgctgctcgctgatctggaccgcgtgctggaagccctgaagaaacgtgctttcgagcacaaggacacggtgcgcatcggccgcagccacggcattcatgccgaaccgaccacgatgggcctcactttcgcgcgtttctatgccgaaatgtcgcgcaatcgcgctcgtctcgttgccgcgcgcgcggaaatcgccacgggcgcaatctcgggtgccgtcggcactttcgccaatatcgacccgcgcgtggaagaatatgtctgcgccaagctcggccttgaagcagagcccgtttcgacacaggtgatcccgcgcgaccgccacgccatgtttttcgcaacgctcggcgtcattgcatcctcgatggaaaacatcgccatcgaaattcgccatatgcagcgcacggaagttctggaagcggaagaattcttctcgccgggccagaagggttcgtcggccatgccgcacaagcgcaatccggtgctgaccgaaaacctgaccggccttgcccgtctggtgcgcatgtcggtcacgcctgcgatggaaaatgtcgctctgtggcacgaacgcgatatttcgcattcgagcgttgagcgcgctattggaccggacacgaccatcacgctcgatttcgcgctcaaccgtctggccggcgtgatcgagaagctggtgatctatccggacaacatgctcaaaaacatgaacaagttccgcggtctggtgcattcgcagcgcgtattgttggccctaacgcaggccggtgtgtcgcgtgaagacgcctatcgtctcgtgcagcgcaacgccatgaaggtctgggaacagggcgctgatttcctcgaagaattgctggccgacacggaagtgcgcgctgcactttccgaagagcagatccgcgagaagttcgatctcggctaccacaccaagcatgtggatacgattttcaagcgcgtcttcggctga

SEQ ID NO: 3170 - protein, 433 aa, Brucella suis
MIPRYSRPEMVAIWSPETKFRIWFEIEAYACEALAELGVIPKEAARTIWEKGSVAKFDVARIDEIEAVTKHDVIAFLTHLAEFIGPDSRFVHQGMTSSDVLDTTLNVQLVRAADLLLADLDRVLEALKKRAFEHKDTVRIGRSHGIHAEPTTMGLTFARFYAEMSRNRARLVAARAEIATGAISGAVGTFANIDPRVEEYVCAKLGLEAEPVSTQVIPRDRHAMFFATLGVIASSMENIAIEIRHMQRTEVLEAEEFFSPGQKGSSAMPHKRNPVLTENLTGLARLVRMSVTPAMENVALWHERDISHSSVERAIGPDTTITLDFALNRLAGVIEKLVIYPDNMLKNMNKFRGLVHSQRVLLALTQAGVSREDAYRLVQRNAMKVWEQGADFLEELLADTEVRAALSEEQIREKFDLGYHTKHVDTIFKRVFG

SEQ ID NO: 3171 - DNA, 1446 bp, Bifidobacterium longum
  CDS (1)..(1446)
atggaggttatgaagcttaccgatatttcccccgcaatcgcattgaccccgctcgacggccgttatcacaaggccaccgccccgctcgtcgaatacatgagcgaacctgccctgaaccgcgaacgcatgcgtgtcgaagtcgaatggatgattcttctggccaacggctttgagggcaacggcaaccagccgatcgttgacggcgtcaagccgttcactgccgaagagcaggccttcctgcgcgccattcccgaggacttcggcgccgaaggcatcaagcagcacgccgctcatgaggccatcacccaccacgatgtgaaggccgtggagtactacatcgatgatcagatcgacaaggctccggccgagctgaccaacatcaacgacgagctgaagaccctcgtacacttcgcctgcacgtccgaagacatcaacaacctctccatcgcccgttgcgtcaagaacgcgatggaaaacgtgtggaccccggagttcaagcgcatcatcgaccacctcgccggcaaggccgaggaattcaaggatatgccgctgctctctctcacccacggccagccggccacgccgaccacgctcggcaaggagctcgccgtctacgtctaccgtctgaaccgtcagctcaagcacatcgaaaaccaggagtacctgggcaagatcaacggcgcgaccggcacgttcggtgcccacttggccgcatgcccggatgtcgactggatcgctgtctcccgcgaattcgtcaccaaccgcatgggcctgacctggaacccgctgaccacgcagatcgaaagccacgactggcaggccgagctgtactccaccgtctcccacgccaaccgcatcatgcacaacctgtgtgtggacgtgtggatgtacatctcccgtggagtgttcgcccaggtgccggtcaagggtgccactggttcctccaccatgccgcacaaggtcaacccgattcgtttcgagaacgccgaagccaacttcgaaatcagctgctcgctgcttgacaccctctccgccacgctggtggaatcccgttggcagcgcgatctgaccgattcgaccacccagcgcaacatcggttccgcgctcggctactccttgctcgccctgaccaacctcatgggcggccttgagtccatccacccgaacacccacgtcatcgagcgtgagcttgatgagaactgggaggtgcttggcgagccgatccaaaccgccatgcgcgcctgcgagctcaagggcctgccgggcatggacaagccgtacgagaaggtcaaggggcttatgcgcggccgcaccatcaacaaggaacaggtcgagcagttcatcgaccagcagtccttcgacccggaaaccgccgctcgcttgaaggctctgacccccgccacctacaccggtgtggccagccagctcgtcgctttcggccgctga

SEQ ID NO: 3172 - protein, 481 aa, Bifidobacterium longum
MEVMKLTDISPAIALTPLDGRYHKATAPLVEYMSEPALNRERMRVEVEWMILLANGFEGNGNQPIVDGVKPFTAEEQAFLRAIPEDFGAEGIKQHAAHEAITHHDVKAVEYYIDDQIDKAPAELTNINDELKTLVHFACTSEDINNLSIARCVKNAMENVWTPEFKRIIDHLAGKAEEFKDMPLLSLTHGQPATPTTLGKELAVYVYRLNRQLKHIENQEYLGKINGATGTFGAHLAACPDVDWIAVSREFVTNRMGLTWNPLTTQIESHDWQAELYSTVSHANRIMHNLCVDVWMYISRGVFAQVPVKGATGSSTMPHKVNPIRFENAEANFEISCSLLDTLSATLVESRWQRDLTDSTTQRNIGSALGYSLLALTNLMGGLESIHPNTHVIERELDENWEVLGEPIQTAMRACELKGLPGMDKPYEKVKGLMRGRTINKEQVEQFIDQQSFDPETAARLKALTPATYTGVASQLVAFGR

SEQ ID NO: 3173 - DNA, 1305 bp, Chlorobium tepidum
  CDS (1)..(1305)
atgataccacgttactcgccgaaagacatctcggcaatctggagcgatgaagccaaattcgaacgctggctgcaactcgaaatcgctgccgtcgaggcacgcatggaagccggcatcgttccggcggacgcccttgcgaccattaaagaaaaagccaggttcaacgtcgaagagattcttatcattgaaaacgagacgaagcacgacgtcattgcctttctaaccaacgtcgccggctacgtcggccccgaatcacgttacatccacgagggtctcacctcttcggacgtggtcgatacctgcctggcgatgcagatgcgcgatgcgggcaagatcatcgtggctgacatcgagtcgcttatcgaggtgctcggcaaaaaggccgtcgaacacaaatacacccttcagatgggccgcacgcacggcattcacgccgagccgaccacgttcggcctgaagctgttgctctggtacgaggagatgaagcgcaacctcgaacgcatgaagcgcgcgctcgaaaccgtctcggtcggtaaaatttccggcgcggtcggcacctaccagcatctgtcaccggacatcgaggccgccgtctgccagaagcttggcctgaagccctcgtcgatctcgacgcagattctccagcgcgaccgacacgccgaatacgccacgacgctcgccatcgtcgcctcgtccatcgagaagttctcgaccgaactgcgccacctgcaacgcaccgaggttcgcgaaaccgaggagtttttcagcaagggccagaaaggcagctccgccatgccgcacaagcgcaacccgatcacctttgagcgcctcaccggcttggctcgcgtggtgcgctccaactccatcgccgccatggagaacgtcgccctctggcacgaacgcgacatttcgcactcctcggtcgagcgcgtcatcatgcccgactcgaccatcgcgctggtttatatgctgcgcaccttccgtgattcgatcgagaccttgctcgtctatccggagcgcatgaagcaaaacttcgacacctcctacggcctgaccctctcgcagacgctgctgctcgccctcaccggcaagggactcacccgtgaagacgcctaccgcctcgtgcagcgcaacgccatgaaaagctgggaggagaaaatccagctcaaggagctggtgattcacgacccggaaatcctcgaacacatcagcgcagaagagatcaaccagctcttcagcccggagacaattcaggacaagctcaaaaacagcgtggatattattttcaagcgcaacgggctgtga

SEQ ID NO: 3174 - protein, 434 aa, Chlorobium tepidum
MIPRYSPKDISAIWSDEAKFERWLQLEIAAVEARMEAGIVPADALATIKEKARFNVEEILIIENETKHDVIAFLTNVAGYVGPESRYIHEGLTSSDVVDTCLAMQMRDAGKIIVADIESLIEVLGKKAVEHKYTLQMGRTHGIHAEPTTFGLKLLLWYEEMKRNLERMKRALETVSVGKISGAVGTYQHLSPDIEAAVCQKLGLKPSSISTQILQRDRHAEYATTLAIVASSIEKFSTELRHLQRTEVRETEEFFSKGQKGSSAMPHKRNPITFERLTGLARVVRSNSIAAMENVALWHERDISHSSVERVIMPDSTIALVYMLRTFRDSIETLLVYPERMKQNFDTSYGLTLSQTLLLALTGKGLTREDAYRLVQRNAMKSWEEKIQLKELVIHDPEILEHISAEEINQLFSPETIQDKLKNSVDIIFKRNGL

SEQ ID NO: 3175 - DNA, 1431 bp, Corynebacterium glutamicum
  CDS (1)..(1431)
atggctgataaaaagaagatcgcaaacgtcctgtcgaaccgttacgcctccgcggaactttctaacctgtggagtgccgaagagaagatcatcatggagcgccagctctggatcgccgtgatgaaagcccagaaagatttgggagttgagatccctgccgaggcaattgaatcctatgaagcagtgatcgaccaggttgatttggcaagcatcgccgatcgtgagcgcgtcacccgccacgatgtgaaggcccgcatcgaagaattcaatgcactggctggccatgagcacatccacaagggcatgacctcccgcgacctcaccgaaaatgttgaacagctgcagatccaccgctcccttgagctggtccgcaacaagggcattgcagttgttgcagctatcggatcccgcgcagcgcagtaccaaagcctggtcatggctggccgttcccacaacgtggcagcgcaggcaactaccttgggcaagcgtttcgcaaccgcagctgatgaaatgctcgtggcacttgagcgcgtcaccgaactgctcaaccgctacccacttcgcggaatcaagggcccaatgggaaccgcccaagacatgcttgacctcatggaaggcgacgaggctcgtctctccgatctggaaacccgcatcgcagcacacctcggctttgatcgcgtcttcgactccgtcggccaggtctacccacgttcccttgacttcgatgcagtatctgctctggttcagcttggctccggcccatcatcgctgtcccacaccattcgtctcatggccggcaccgaaactgttaccgaaggttttaaggaaggccaggtcggttcctctgcaatgcctcacaagatgaacgctcgctcctgtgagcgcgtgggcggcctgcaggttattcttcgcggatacctcaccatggttgctgatctttccggccagcagtggaacgaaggcgatgtcttctgctccgtgatccgccgcgttgcactgccagacgcattcttcgcgattgacggaatgtttgaaactttcctgacagtcctggatgaattcggtgcattccctgccatgatcgagcgcgaacttgagcgttacctgccattcctggcaactacccgtatcctcatggccgctgtccgcgcaggcgttggccgcgaaaccgcacacgaagtaatcaaggaaaacgctgtcgcggttgccctcaacatgcgcgaaaatggcggtgaccaggaccttatccagcgcctcgctgctgatgagcgcctcccaatgagcgaagctgaccttgaggcagcgctggctgaccgccacgccttcatcggtgccgctgagtcccaggtctcccgtgtgctcgaccgcattcaggtgcttgtcgacgcccaccccggcgccgcagactaccgaccaggtgagattctttag

SEQ ID NO: 3176 - protein, 476 aa, Corynebacterium glutamicum
MADKKKIANVLSNRYASAELSNLWSAEEKIIMERQLWIAVMKAQKDLGVEIPAEAIESYEAVIDQVDLASIADRERVTRHDVKARIEEFNALAGHEHIHKGMTSRDLTENVEQLQIHRSLELVRNKGIAVVAAIGSRAAQYQSLVMAGRSHNVAAQATTLGKRFATAADEMLVALERVTELLNRYPLRGIKGPMGTAQDMLDLMEGDEARLSDLETRIAAHLGFDRVFDSVGQVYPRSLDFDAVSALVQLGSGPSSLSHTIRLMAGTETVTEGFKEGQVGSSAMPHKMNARSCERVGGLQVILRGYLTMVADLSGQQWNEGDVFCSVIRRVALPDAFFAIDGMFETFLTVLDEFGAFPAMIERELERYLPFLATTRILMAAVRAGVGRETAHEVIKENAVAVALNMRENGGDQDLIQRLAADERLPMSEADLEAALADRHAFIGAAESQVSRVLDRIQVLVDAHPGAADYRPGEIL

SEQ ID NO: 3177 - DNA, 1119 bp, Corynebacterium glutamicum
  CDS (1)..(1119)
atgaaaccccattttttggactctaaattgacccgatctttatactccgaccttgctggtagtggagaacacctcagcagcctttccgacgagactttcctaaagaatcttcttgtcgtggaggccgctttggcggttgcagctgcccccgagcacgcagcaatggcgaaggccaccattgattcttatcagttggatgtggaggagctttcccgtcgcgcagccgagggcggtaatccgctcattccgctggtcactgacctcaaggccatcaatccggcaggcatccacattggcgcaacgagccaggacatcattgattctgcgttaatgctgtgcatgaaggaaggggtgggggaggtcgtcgacaagcttaaaaagcttgcgcgagatttggccgagctcaccgcggagcataaagcaaccccgatcatggggcgcacgttggggcagatcgcgacgccgacgacgttcggcgcgctgaccggcggctggctggttgcggtggacaatgcggcacgcgccctggaggcgctggagtttccggtgtcgtatggcggtgccagcggaaatatgacggcggtgcacccgcgtggcttcgagattcaggcgaagctggccgaggagttgggcctttttgatccgcagtgggtgtggcattccgatcgcacgccgatcactgcgatcgcgtcggcgctggcaacggccgctggtgtggtacgcaaaattgctggtgacgtggtgttttactcacaaaccgaggtcggcgagttgcgggagaaatcccccggcggcagctccgcgatgccccacaaagccaatccggccgctgcgattgcgtgcgacggttacgcgcgccgggcacctggccttcttgcaacgcttttcgacgccctcgactgccgtttgcagcgcggcaccggcagctggcacgcggagtgggcaacgctgcgcgagttggctgctgtcactcactcagcagtgagcagggctgcaaccagcatcgatggcatcaccgtcaacgttgatgtgatggcaagtcgcgtcaatggaccaaccgggcacgccgaagatttggcggagcgggcactagaaatttatggaaaaggacgcagttag

SEQ ID NO: 3178 - protein, 372 aa, Corynebacterium glutamicum
MKPHFLDSKLTRSLYSDLAGSGEHLSSLSDETFLKNLLVVEAALAVAAAPEHAAMAKATIDSYQLDVEELSRRAAEGGNPLIPLVTDLKAINPAGIHIGATSQDIIDSALMLCMKEGVGEVVDKLKKLARDLAELTAEHKATPIMGRTLGQIATPTTFGALTGGWLVAVDNAARALEALEFPVSYGGASGNMTAVHPRGFEIQAKLAEELGLFDPQWVWHSDRTPITAIASALATAAGVVRKIAGDVVFYSQTEVGELREKSPGGSSAMPHKANPAAAIACDGYARRAPGLLATLFDALDCRLQRGTGSWHAEWATLRELAAVTHSAVSRAATSIDGITVNVDVMASRVNGPTGHAEDLAERALEIYGKGRS

SEQ ID NO: 3179 - DNA, 1254 bp, Corynebacterium glutamicum
  CDS (1)..(1254)
atggctgcggagagagcactctcaactgctcaagcccgccatggtgtgatcactgaagacgatgctgcacagatcaaccaggcggcagtcctttccaacattgaccgcgagaagctgtgggaagatgccaaaaatgtcggctaccccatccttggcttggtaagacaaatcgccagtcaccttccagaaggccccaacgggcgagtccactacggcgccacgacccaagtcatcatggacactggactggtgttgcaaatgactgcctctttgaacgcccttgataaacagatcgtgcgtctggggaatgcactggcagcacgggctgaagagcacaaagacaccgtgatgccgggacgcacccatgctcagcaggcaattcccactacatttggagcaaccctcgctacctttttggatcaaatccgcaggcagagggaacgacttgaggaagcactcgagcgcgtgcgagtcatttcgctgtttggtgctggtggaaacaacgcagcacaaggcgaacaagcggcaacggttcgtgcagagatggcccgcctgttggatctgaaggacccggtggtgtcatggcatgtggaacgcgatgtgcttggggacttcggatgggtgtgctcaacgctgtgtggatcgatggcaaaatttggccgaaacatcgtggatctttcccgaactgaaatcggagaagtttttgagccttacaactcccatcggggtgcatcttccatgatgcctcagaaagtcaacccgatttcttccgagctcatgattggtatttcagtggtggcgggtgccttgacctcgactttgccacggcttcaggaatcgggacatgaacgagcagcaggagagtggcagggagaatggcttgtcattccaacgttggccaatctagctggcgctgcactcgatgaagccattgtggtggctgaaggaatgcgagtggatacagatcgtatgtcctcgaacttggcttttgctggtggattgatcatggcggaagctcagatgattcaactagctccagctctggggcgtgagaaagctcatgacttggtttatgaagcatccacaaagactcgtgaagagcacaccacgctggcagaagaactgccgataattgcagttcaacatggggtcgaagacctgttgcctaagaattttgcgcagcctgcagactacgtcggcgaagcacaatccatggtgaatgcagctgtcgccgcctggaatgcccaactttag

SEQ ID NO: 3180 - protein, 417 aa, Corynebacterium glutamicum
MAAERALSTAQARHGVITEDDAAQINQAAVLSNIDREKLWEDAKNVGYPILGLVRQIASHLPEGPNGRVHYGATTQVIMDTGLVLQMTASLNALDKQIVRLGNALAARAEEHKDTVMPGRTHAQQAIPTTFGATLATFLDQIRRQRERLEEALERVRVISLFGAGGNNAAQGEQAATVRAEMARLLDLKDPVVSWHVERDVLGDFGWVCSTLCGSMAKFGRNIVDLSRTEIGEVFEPYNSHRGASSMMPQKVNPISSELMIGISVVAGALTSTLPRLQESGHERAAGEWQGEWLVIPTLANLAGAALDEAIVVAEGMRVDTDRMSSNLAFAGGLIMAEAQMIQLAPALGREKAHDLVYEASTKTREEHTTLAEELPIIAVQHGVEDLLPKNFAQPADYVGEAQSMVNAAVAAWNAQL

SEQ ID NO: 3181 - DNA, 1293 bp, Streptococcus pyogenes
  CDS (1)..(1293)
atgatcgaacgttattcacgccctgagatggcggcaatttggacagaggaaaataaataccgtgcttggttggaggttgagattttggctgacgaggcatgggctgagttgggtgagattcctaaggaggatgtggctaagattcgtgagaaggcggattttgacattgaccgcattcttgagattgagcaggacacacgtcacgatgtggtggctttcactcgtgcggtttctgaaacgcttggtgaggagcgcaagtgggtgcactacggtttgacgtcaactgacgtggtggacactgcctacggttacctctacaagcaagctaacgacattatccgtcgcgatcttgagaagttcaccaatatcgtggcagacaaggcgcgtgagcacaaaatgaccatcatgatgggtcgtacccacggtgttcacgccgagccaacgactttcggtcttaagttggcgacttggtacagcgagatgaaacgtaatattgagcgttttgaacatgctgccgcaggtgtggaagctggtaagatttcaggtgccgttggtaactttgctaatatccctccatttgtggaacaatatgtctgttacaaattaggcattcgtccacaagagatttcaacacaagttcttccacgtgacctccacgcagaatattttgcagtgcttgcaagtattgcaacttctatcgaacgtatggcgacagagattcgaggtctgcaaaagtcagaacaacgggaagttgaagaattctttgccaaaggtcagaaaggtagctctgctatgcctcacaaacgcaacccaatcggttcagagaacatgacagggctagcgcgcgtgattcgtggtcacatggtgacagcttatgagaacgtgtcactttggcatgagcgtgatatttcacactcatcagctgagcgtatcatcacacctgacacaactatcttgattgactacatgctcaaccgctttggcaatatcgttaagaacttgactgtcttcccggaaaatatgatgcgcaatatggaatcaacttttggtttgatttatagtcaacgtgttatgctcaaattgattgaaaaaggaatgacacgagaagaagcttatgacttagttcaacctaagacagcttattcctgggacaatcaagtggatttcaaaccacttttagaagaagacaccaaagttacctcttgtcttacacaagaagaaattgatgaactatttaatccgatttattacacaaaacgtgttgatgatatttttaagcgtttagggatttaa

SEQ ID NO: 3182 - protein, 430 aa, Streptococcus pyogenes
MIERYSRPEMAAIWTEENKYRAWLEVEILADEAWAELGEIPKEDVAKIREKADFDIDRILEIEQDTRHDVVAFTRAVSETLGEERKWVHYGLTSTDVVDTAYGYLYKQANDIIRRDLEKFTNIVADKAREHKMTIMMGRTHGVHAEPTTFGLKLATWYSEMKRNIERFEHAAAGVEAGKISGAVGNFANIPPFVEQYVCYKLGIRPQEISTQVLPRDLHAEYFAVLASIATSIERMATEIRGLQKSEQREVEEFFAKGQKGSSAMPHKRNPIGSENMTGLARVIRGHMVTAYENVSLWHERDISHSSAERIITPDTTILIDYMLNRFGNIVKNLTVFPENMMRNMESTFGLIYSQRVMLKLIEKGMTREEAYDLVQPKTAYSWDNQVDFKPLLEEDTKVTSCLTQEEIDELFNPIYYTKRVDDIFKRLGI

SEQ ID NO: 3183 - DNA, 1368 bp, Xanthomonas campestris
  CDS (1)..(1368)
atgtcggattccgccctgctcgccctgtccccactcgatggccgctacgcctccaaggtggacgcgctgcgcccgatcttttccgaatacggcctgatcaaggcgcgggtgaaagtggagatcgagtggctgctggcactggccgccgagccgggcatcgccgaactgccggccttctcggccgccgccacgcagcgcttgcgcgccctggccgagcagttcagcgtgacgcacgccgcacgcgtcaaggagatcgaacgcaccaccaaccatgacgtcaaggcggtggagtacttcatcaaggaacagctcaaggacgacgccgagctgggcccggcgctggaattcgtgcatttcgcatgcaccagcgaagacatcaacaacctcagttacggcctgatgctggagcaggcacgccgcgaggtgctgctgcccaccctggacggcgtcgccgcctcgctgcgcacgcttgcgcacgctcaggccgcgcagccgatgctctcgcgcacgcatggccagaccgcctcgcccaccacgctcggcaaggagatcgccaacgtggtggcgcggctggagcgccagcgcaagcagatcgccgcggtcgagctgaccggcaagatcaatggcgcggtgggcaactacaacgcacacgtggcgtcctacccgtcggtggactggccgcagttcgcgcaacgctttgtcgaaggcttggggctggtcttcaacccctacaccacgcagatcgagccgcacgacaacgtggccgaaatcggcgatgccacccgccgcgccaacaccatcctcatcgacctggcacgtgacatctggggctacatttcgctcggctatttcaagcaaaaattgaaagaaggcgaagtcggttcctcgaccatgccgcacaaggtcaacccgatcgacttcgagaacgccgaaggcaatttcggcgtcgccaatgcgctgttcgagcatttcagcgccaagttgccgatcagccgctggcagcgcgacctcaccgactccaccgtgctgcgcgccctcggcaccgcgttcggccatacgcaagtagcgctcgactcgctggccaagggcctgggcaagctgaccgtcaattccgagcgcctggatgccgatctggacgccgcctgggaagtactggccgaggccgtgcagacggtgatgcgccgccatggcctgcccaatccctacgagcaactcaaggcactgacccgcggccagggcatcaccgccgcctcgatgcaggcgtttgtggaaagcctgcaactgcccgaaaaggacaagcagcgcttgcgtgcgttgacgcccggtgcttataccggtctggccgagcaattggcgcgcgccatctga

SEQ ID NO: 3184 - protein, 455 aa, Xanthomonas campestris
MSDSALLALSPLDGRYASKVDALRPIFSEYGLIKARVKVEIEWLLALAAEPGIAELPAFSAAATQRLRALAEQFSVTHAARVKEIERTTNHDVKAVEYFIKEQLKDDAELGPALEFVHFACTSEDINNLSYGLMLEQARREVLLPTLDGVAASLRTLAHAQAAQPMLSRTHGQTASPTTLGKEIANVVARLERQRKQIAAVELTGKINGAVGNYNAHVASYPSVDWPQFAQRFVEGLGLVFNPYTTQIEPHDNVAEIGDATRRANTILIDLARDIWGYISLGYFKQKLKEGEVGSSTMPHKVNPIDFENAEGNFGVANALFEHFSAKLPISRWQRDLTDSTVLRALGTAFGHTQVALDSLAKGLGKLTVNSERLDADLDAAWEVLAEAVQTVMRRHGLPNPYEQLKALTRGQGITAASMQAFVESLQLPEKDKQRLRALTPGAYTGLAEQLARAI

SEQ ID NO: 3185 - DNA, 1368 bp, Xanthomonas axonopodis
  CDS (1)..(1368)
atgtcggattccgctctgctcgccctgtccccgctcgacggccgctacgcctccaaagtggatgcgctgcgcccgatcttctccgaatacggcctgatcaaggcgcgggtcaaggtcgaaatcgaatggctgctggcactggccgccgagccgggcatcgccgaactggcgccgttctcgccggctgccacgcagcggctgcgcgccctggccgacgatttcggcgtggcccatgccgcgcgggtcaaggaaatcgagcgcaccaccaaccatgacgtcaaggcggtggagtacttcatcaaggagcagctcaaggacgatgccgaactcggcccggcgctggaattcgtgcactttgcctgcaccagcgaagacatcaacaacctgagctacgggctgatgctggagcaggcacgccgtcaggtgttgctgcccagcctggatggtattaccgccgcgctgcgcaccctcgcccacgcccaggccgcccagccgatgctctcgcgcacccacggccagaccgcctcgcccaccacgctgggcaaggaaatcgccaacgtggtcgcgcgcctggagcgccagcgcaagcagatcgccgcggtcgaactgaccggcaagatcaacggcgcggtcggtaattacaacgcgcacctggtgtcgtacccggacctggactggtcggcgttcgcacagcgtttcgtggaaagcctgggcctggtgttcaacccctacaccacccagatcgagccgcacgacaatgtggccgaaatcggcgatgccagccgccgcgccaacaccatcctgatcgacctggcgcgcgacatctggggctatatctcgctgggctatttcaagcagaagctgaaagagggcgaagttggctcctcgaccatgccgcataaggtcaaccccatcgacttcgaaaatgccgagggcaatttcggcatcgccaacgcgctgttcgaacatttctccgccaagttgccgatcagccgctggcagcgcgacctcaccgattccaccgtgctgcgcgcactcggcaccgcgttcggccatacccaggtcgcgctggattcgctggccaagggcctgggcaagctcaccgtcaaccccgagcggctggatgccgacctggatgcggcctgggaagtgctggccgaagccgtgcagacggtcatgcgccgccacggcctgccgaacccctacgaacaactcaaggcgctgacccgcggccagggcatcaccgccgcctcgatgcaggccttcgtggaaagtctgcaactgccggaacaagacaagcagcgcctgcgcgcgctcaccccgggcgcctacaccgggctggccgagcagctggcgcgcgcgatctga

SEQ ID NO: 3186 - protein, 455 aa, Xanthomonas axonopodis
MSDSALLALSPLDGRYASKVDALRPIFSEYGLIKARVKVEIEWLLALAAEPGIAELAPFSPAATQRLRALADDFGVAHAARVKEIERTTNHDVKAVEYFIKEQLKDDAELGPALEFVHFACTSEDINNLSYGLMLEQARRQVLLPSLDGITAALRTLAHAQAAQPMLSRTHGQTASPTTLGKEIANVVARLERQRKQIAAVELTGKINGAVGNYNAHLVSYPDLDWSAFAQRFVESLGLVFNPYTTQIEPHDNVAEIGDASRRANTILIDLARDIWGYISLGYFKQKLKEGEVGSSTMPHKVNPIDFENAEGNFGIANALFEHFSAKLPISRWQRDLTDSTVLRALGTAFGHTQVALDSLAKGLGKLTVNPERLDADLDAAWEVLAEAVQTVMRRHGLPNPYEQLKALTRGQGITAASMQAFVESLQLPEQDKQRLRALTPGAYTGLAEQLARAI

SEQ ID NO: 3187 - DNA, 1359 bp, Methanosarcina mazei
  CDS (1)..(1359)
atggtgattgatatggctattcatcctatagaataccggtacggtacagcagaaatgaaatatgtgtggagtcaggaaaacagacttgctaagatcttgcagaccgaggcagctcttgcccgggcagaagcggatatggggcttattcccgcagaagcggctgaaattatattcgaaagcattgcctctgtaaaagccgagagagtcgatgaaatagaatccgagatccaccatgacatgatggctgtcgttgttgcaatttcagagatgtgcagggatgacgcaggaaaatgggttcacttcggagccacttcaaacgatattcttgataccgcaacagctctccagattaaagacgcaattgatattctggaagacaaactcaaaacccttctaaaagttctggtaaaccaggctgaagcccacaaaaatactgtctgctgcggaaggactcacgggcagataggtgttccaaccacttacggtcttcgttttgcaatctgggcttctgaaatctcaaggcatcttgaccgcctgtacgaactgactccaagagctactgtggggcagatgaccggcgctgtaggcactcaggcagcttttggaaaatcgggaatccttattcagaaacttacaatgcaacacctcggaatcggggctgttgatgtctcaaaccagattatccagagggacagacatgccgagtttgttatgtggatggcaaatgtagttacaacactggacaagatcgggatcgaaatcaggactcttcaacgcagtgagatcgccgagatagaggaaagtttcgggaaaaagcaggtaggttcatccaccatgcctcacaagcgtaatcctatcaagtccgaacagatctgcgggctcgcccgaatagtaagggcaatggttgagcctgaactccttaacaacacactatgggacgagagggacctcacgaattcttcaagtgaacggattgtcttccctgaagcctgtatacttaccgatcatatcattaaactcgggatcagcgttcttgaaaacctcaggttctatcctgaaaatatccgcaggaaccttgattccttaaatggtctgaatatgggcgaggctgttatgatagaacttgcaaaaagaggtgtcggcaggcaggaagcccacgaacttgtccggactgcagctatgagagctcatgatacagggcagcatttcaaacaggttcttctggatactccttccgtttcaaaatatctgagtgcaggagatattgagaaccttgtaaaccctgacaaatatatagggacagcagtggaacaggtagaagggctcgttataaagcttcgagaagcctattcactctga

SEQ ID NO: 3188 - protein, 452 aa, Methanosarcina mazei
MVIDMAIHPIEYRYGTAEMKYVWSQENRLAKILQTEAALARAEADMGLIPAEAAEIIFESIASVKAERVDEIESEIHHDMMAVVVAISEMCRDDAGKWVHFGATSNDILDTATALQIKDAIDILEDKLKTLLKVLVNQAEAHKNTVCCGRTHGQIGVPTTYGLRFAIWASEISRHLDRLYELTPRATVGQMTGAVGTQAAFGKSGILIQKLTMQHLGIGAVDVSNQIIQRDRHAEFVMWMANVVTTLDKIGIEIRTLQRSEIAEIEESFGKKQVGSSTMPHKRNPIKSEQICGLARIVRAMVEPELLNNTLWDERDLTNSSSERIVFPEACILTDHIIKLGISVLENLRFYPENIRRNLDSLNGLNMGEAVMIELAKRGVGRQEAHELVRTAAMRAHDTGQHFKQVLLDTPSVSKYLSAGDIENLVNPDKYIGTAVEQVEGLVIKLREAYSL

SEQ ID NO: 3189 - DNA, 1356 bp, Methanosarcina acetivorans
  CDS (1)..(1356)
atgatcgatgtggcaattcatccgatagaataccggtacggtacagcagaaatgaaatacgtatggagtcaggaaaacagactagctaagatcttgcagaccgaggcagcccttgctctggcagaagcggatatgggacttatcccggcagaagcggctgagattatctccgaatgcgttccctccgtaaaggcggaaagagttgacgaaatcgaagccgagatccaccacgacatgatggctgttgttgttgcgatttctgagaagtgcagggaagatgcgggaaagtgggtccatttcggcgccacttcaaacgacatccttgacacagcaaccgcgctccagataaaggacgcaatcgaccttctggaagataaactcaaaatcctgctcagggtgctggtaaaccaggcagaagcccataagaacactgtttgctgtgggaggacacacgggcagataggcgttcccacaacatacgggctccgttttgcaatctgggcttccgagatttcaagacaccttgaccgcctttacgagctgactccgagagctaccgtggggcagatgaccggggctgtcggaactcaggcagcttttgggaagtccggaatcctgatccagaaacttacgatgcagcacctcggaatcggggctgtggatgtctcaaaccagataatccagagagacaggcatgccgaatttgtgatgtggatggcaaatactgttacgaccctggacaagatcggcatcgaaatcaggaatctgcagcgcagtgaaatcgccgagattgaggaaagtttcgggaaaaagcaggtgggttcgtctaccatgccccacaagcggaacccgatcaagtccgagcagatctgcgggcttgcgaggatcgtaagggcaatggttgaacctgaactccttaacaacaccctctgggacgaacgggaccttacaaattcttcctgcgagagagtcgtcttcccggaagcctgtgtgcttacggaccatatccttaaacttgggatccgtgtgcttgagaatctcaggttctatcccgaaaatatccgcaggaacctggacctgctaagaggcctgaacatgggcgaagctgtaatgatcgaacttgcaaaaaggggtgtaggcaggcaggaagcccatgagcttgtcaggacttcggctatggaagcccatgagacggggcagcacttcaaacaggtacttctggatactccttccgtttcaaggtacttgagtgtagaagatatcgaaaaactcgtaaatcccgataagtatataggaacagctgtagaacaggtcgaagcgctcgttgtaagacttcgtgaagcttattccctctga

SEQ ID NO: 3190 - protein, 451 aa, Methanosarcina acetivorans
MIDVAIHPIEYRYGTAEMKYVWSQENRLAKILQTEAALALAEADMGLIPAEAAEIISECVPSVKAERVDEIEAEIHHDMMAVVVAISEKCREDAGKWVHFGATSNDILDTATALQIKDAIDLLEDKLKILLRVLVNQAEAHKNTVCCGRTHGQIGVPTTYGLRFAIWASEISRHLDRLYELTPRATVGQMTGAVGTQAAFGKSGILIQKLTMQHLGIGAVDVSNQIIQRDRHAEFVMWMANTVTTLDKIGIEIRNLQRSEIAEIEESFGKKQVGSSTMPHKRNPIKSEQICGLARIVRAMVEPELLNNTLWDERDLTNSSCERVVFPEACVLTDHILKLGIRVLENLRFYPENIRRNLDLLRGLNMGEAVMIELAKRGVGRQEAHELVRTSAMEAHETGQHFKQVLLDTPSVSRYLSVEDIEKLVNPDKYIGTAVEQVEALVVRLREAYSL

SEQ ID NO: 3191 - DNA, 1419 bp, Methanopyrus kandleri
  CDS (1)..(1419)
atgcccgttcatccgatcgagtcacggtacggatcggacgagctccgccgggtgttctcggaagagaacaaagtggcgaagatgctcgaggttgaggcggccctggtacgggcgctctccgaggtgttcgacttcgtaccggaggaggccgcggacgaggtggaacgcgtcgtcgaggagatcaccggcgacgaggaagagctacgacggttcgtggaacgcgtcaaggagatcgaggcggagatcaaacacgacgtgatggccctggtgaaggcgctatcggagcggtgcgaggttggcggggactacgtgcacctgggcgctaccagcaacgacgtgatagacaccgcgcacgcgttggtactgcgggaagcactgtcgataatctaccgcaggctgcaccgtctagcggaagtgctggcggagaaggccgaggagtacgccgacctcccgatggtgggtcgcacgcacggtcagcacgcggttcccacgacgctcggtatgaagttcgcgatctgggcacgcgaggtcgtgaggcacctgaagcgactccgggagtgcgcgaaccgggtactggtggggcagctgtccggtgccgtcggaacgatggcggcgctgggcgagaagggtcctgaggtgcagcgtcgggtgatggaactgctgaacctcaggccggtgaccgtgtccaaccaggtcattcagcgggaccgctacgcggagttgatcgcactgctcgcgctgatcggctcgacgctggataagatcggccgcgagatcaggaacctccagcggacggagatccgggaggtcgaggaaccgttcgaccccgagaagcaggtcggatcctcgacgatgccacacaagcggaatccgatccgttccgagcgggtgtgtagcctggcgagggtactgcggtcaaacgtgcagatagcgctcgagaacgtgccgctcgaacacgagcgggacctcacgaactccgcgagcgagcgggtgatcctccccgaacagttcctgctgctggacgaaatgctgcggctgacgatccacaacttggagggattacgcgtttacgaggagaacatacgggagaacctgcggctgacgaaggggcttaatatggcggaggcactgatggtcgaactggtcaagcgaggaatagggcgacaggaggcgcacgagctcgtgagacggctcgcgatgagggcttgggaggaaggacgtgacttcgcggaagtagttaaggaggaagagcgcgtccgtgagctgttcggagaagaagagttagatgaggtgttggaccccgagaagtacttgggcgtggctcccgacctggcgcgtgaggccgccgagaagacccgacgcgacctggaggagatcgatcgcgagatgaaggaggtgttgggtgtcggtgcgggataa

SEQ ID NO: 3192 - protein, 472 aa, Methanopyrus kandleri
MPVHPIESRYGSDELRRVFSEENKVAKMLEVEAALVRALSEVFDFVPEEAADEVERVVEEITGDEEELRRFVERVKEIEAEIKHDVMALVKALSERCEVGGDYVHLGATSNDVIDTAHALVLREALSIIYRRLHRLAEVLAEKAEEYADLPMVGRTHGQHAVPTTLGMKFAIWAREVVRHLKRLRECANRVLVGQLSGAVGTMAALGEKGPEVQRRVMELLNLRPVTVSNQVIQRDRYAELIALLALIGSTLDKIGREIRNLQRTEIREVEEPFDPEKQVGSSTMPHKRNPIRSERVCSLARVLRSNVQIALENVPLEHERDLTNSASERVILPEQFLLLDEMLRLTIHNLEGLRVYEENIRENLRLTKGLNMAEALMVELVKRGIGRQEAHELVRRLAMRAWEEGRDFAEVVKEEERVRELFGEEELDEVLDPEKYLGVAPDLAREAAEKTRRDLEEIDREMKEVLGVGAG

SEQ ID NO: 3193 - DNA, 1353 bp, Pyrococcus furiosus
  CDS (1)..(1353)
atggcgattcacccaattgattatcgctatggtagcgaggagatgaagaggatatgggatgaggagaataagttgcaaaagctacttgacgtggaggccgcacttgctagggctcatgctaaggtaggaaatatcccagaggaaagtgcaagggtgatttcagagagggccaacaccaagtgggtaaagcttgagagggttaaagagatagaggccgagattcatcacgacataatggccgtggttaaggccttaagcgaagtttgcggtgagcatgggaagtacgttcacctgggagcgacttccaacgacatcatcgatactgcaaacgcccttctaataaaggaaagccttgagatcgtggagagagacctaaaggaactcaggtcaatattgaaaaagttagctaaggagcatatagatacagtttgcattggaagaactcatggacagcatgcaatcccaacaacatacggaatgaaatttgccttgtggttggacgagattcagaggcacatcgagaggttgtaccaattaaaggagagagttttagttggaaagatgagaggagctgtgggaactgcagcctcatttggagaaaaggcctttgaaatagagaggctagttatggaagacttgggattaaagccggcaagaataacaaatcaaataatccagagagatgtttatgccgagcttatgttcttcttggcattggtagcttcaactttggacaagatgggattagagataagaaaccttcagagaacggaaattcttgaggttagtgagccctttggagagaagcaggttggttcttcaacaatgccacacaagaggaatccaataaggactgagaaagtctgtggattggccagggttctttactcaaacgttattccagccctcttaaacaatccattgtggcatgagagagatttgacgaactcttcagttgagagggtaatcctcccagagagctttatattgcttgacgaaatgttgaaaacaatgaaaaaggttctttcgggattggagttcttccccgagaatattaagagaaacctatatctaacgaagaatttgataatggctgaaccattaatgctcaagcttgcggagaaaggaatgggaaggcaggaggcacatgagctagttaggcaaatatccatgaaggcctttaaggagaacagagatctcttggaagtggcaaaggagaatgaggaagttagaaaatatttaacagagaaagattttgaatctttgaagccagaaaactacataggaaaggccagagaaatagtagagaatgttatagcttatgttgaagaaatggaggctaaaggtctttaa

SEQ ID NO: 3194 - protein, 450 aa, Pyrococcus furiosus
MAIHPIDYRYGSEEMKRIWDEENKLQKLLDVEAALARAHAKVGNIPEESARVISERANTKWVKLERVKEIEAEIHHDIMAVVKALSEVCGEHGKYVHLGATSNDIIDTANALLIKESLEIVERDLKELRSILKKLAKEHIDTVCIGRTHGQHAIPTTYGMKFALWLDEIQRHIERLYQLKERVLVGKMRGAVGTAASFGEKAFEIERLVMEDLGLKPARITNQIIQRDVYAELMFFLALVASTLDKMGLEIRNLQRTEILEVSEPFGEKQVGSSTMPHKRNPIRTEKVCGLARVLYSNVIPALLNNPLWHERDLTNSSVERVILPESFILLDEMLKTMKKVLSGLEFFPENIKRNLYLTKNLIMAEPLMLKLAEKGMGRQEAHELVRQISMKAFKENRDLLEVAKENEEVRKYLTEKDFESLKPENYIGKAREIVENVIAYVEEMEAKGL

SEQ ID NO: 3195 - DNA, 1778 bp, Vigna unguiculata
  CDS (6)..(1619)
ctttcatggagttcgcggcactctctagcgctgcccaacttgggagcttcaaccctcttagaaccaaacttcaaagttcagcacaacacaaccctcttcaattttcctatgcttctttcccttcttcctttcccagagtttgctcctgcaaagccatcctcagcacccacacacccacctccacccacaaaatgtttggactccaatcagatgattttgaactctctgctttgacggcgttgtccccattggatggtcgttattggggcaaagtcaaggaactgtctccttatttgagtgaatctgccttaatctactttcgggttcttgttgagataaaatggttgctgcagctgtctgtgattcctgaaattgttgaggttcccagtttcagtgagagtgccaagactttcctacaaagcctgattgatgactttagtattgatgatgccttggaggttaaaaacattgagagggtcacaaatcatgatgtcaaagcggtggagtacttcttgaaacagaaatgtcaatccaatgctgaagtggctaaggtgcttgagtttttccactttgcttgcacatctgaggatataaataatcttgcccatgccttgatgctgaaggaatcaatcaattctgtaatgtttcctgtcatggataaaataatcaaagctttgtgtgacatggctaaagataatgcacatgttccaatgctttctaggactcatgggcagccagcttcaccaactactttgggcaaggaactggctatctttgctgtaagattaagcagagaaaggaaggatctatctcagattgagatattggggaaatttgctggtgcagttggaaattacaacgcacatgttgttgcatatcccaatgttaactggcctcaggttgccgaacagtttgtacattctcttggattaagttttaatccttacgttgctcagattgaaacccatgactacatggcaaagctttttcagtcgctcattcggttcaataatatattaattgactttgatagagatgtatggggctatatatctttgagctactttaagcagattactaaggctggggaaattgggtcatcaactatgcctcacaaagttaatcctattgattttgagaacagtgaaggtaatctaggtgtagctaatggagttctgtctcatctgagcatgaagttgccgatttcacgttggcagagggacttgactgattcaactgtcataaggaacatccctataggtatcggtcattctcttcttgcctacaaaagcacacttcaaggaatggggaagcttcaggttaatgaagctcgcttgagggaagacttgaaccagtgctgggaggtgcttgctgaaccaatacagactgttatgcgaagatatggtgttcccgagccttatgagaagctaaaagaactaaccagagggagagccgttaacaaagagagcataagagacttcattgaaggcttagatattccagaagaagcaaagacgaatctgttgaagttaacacctgacacttatgttggagcagctgttgaattggccagaacagtagaaaatgtggtgaacattgtgaatggatcgaatatttagtaaacaagtgatcgaagcagttttctgatttgtcaattagtttatgagactcttgggaagacaattttgcatcctcgccgtccattcacaccatgtggttattattagttgatatatgaagtctaaaataagatgttccatttgaaaaaaaaaaaaaaa

SEQ ID NO: 3196 - protein, 537 aa, Vigna unguiculata
MEFAALSSAAQLGSFNPLRTKLQSSAQHNPLQFSYASFPSSFPRVCSCKAILSTHTPTSTHKMFGLQSDDFELSALTALSPLDGRYWGKVKELSPYLSESALIYFRVLVEIKWLLQLSVIPEIVEVPSFSESAKTFLQSLIDDFSIDDALEVKNIERVTNHDVKAVEYFLKQKCQSNAEVAKVLEFFHFACTSEDINNLAHALMLKESINSVMFPVMDKIIKALCDMAKDNAHVPMLSRTHGQPASPTTLGKELAIFAVRLSRERKDLSQIEILGKFAGAVGNYNAHVVAYPNVNWPQVAEQFVHSLGLSFNPYVAQIETHDYMAKLFQSLIRFNNILIDFDRDVWGYISLSYFKQITKAGEIGSSTMPHKVNPIDFENSEGNLGVANGVLSHLSMKLPISRWQRDLTDSTVIRNIPIGIGHSLLAYKSTLQGMGKLQVNEARLREDLNQCWEVLAEPIQTVMRRYGVPEPYEKLKELTRGRAVNKESIRDFIEGLDIPEEAKTNLLKLTPDTYVGAAVELARTVENVVNIVNGSNI

SEQ ID NO: 3197 - DNA, 1678 bp, Schistosoma mansoni
  CDS (22)..(1464)
agaatctgttttatactccaaatggatgaattcgaggaatacagaaatccacttactaagcgatatgcaagccgtgaaatggtgtgcaatttcggtgaaaaacgaaaagtaatcctctggcgccaactgtggatatggctagcagaaacacaaaaagagcttggattcgatatcacagacgaacagattaatgaaatgaaaagtcaaagagattcagtggatttcgggactgccgcagctgaagaaaaggctcgacgacatgacgttatggcgcatgtatatacttttgctttagcttgtccaaaagctgcaccaatcattcacctcggtgcaacatcttgttttgttggtgataatgccgatttaattatgcttaaggatggtttaaatatacttttaccgaaggttgctaggtgtattgaccggttagctaaaaaagctatgttgcacaaaagtttaatatgtctcgctcgcacccatttgcaacccgctcaacctactacaatgggccgtagaatatgtatgtggatacaagatttgttattagatttagaaaatctagaaaggttgaagaaccacacaatccgttttcgtggtgctaagggtgcagtgggaactcaagcatcttttatggatttattccaaggtgatcatcaaaaggttatcaagttggacgaaatcttaaccaaaaagtctggattccaacgttcttggtgtgtaactggtcaaacttatccaagaaaagtggacattgaaatcactaacgcattgtcgaatataggtgcaactgtccataaaatatgcaccgacatacgactactgagtacttttcacgaagttgaggaaccttttgaaaccaaacagatcggttcaagtgcaatgccatataaacgtaatcctattcgatcagaaagagcatgttctttagcacgttatctaatgcatatatcgacttccatggtttctacagtatctgttcagtggctcgaacgttcactagatgactcagctattcgtataattgtcctcccagaagcttttcttgcagccgatgcatgtcttactttactacaaaatatagctgaaggattaatagtatacccgatggtaatggaagctaatttaaattctgaacttcctttcctcgttgttgaacgtattttagtcaaaatggtgtctgaaggcgcagccaaccgtcaagaatgccatgaacgccttcgtaagcatagtcatgaagctgctgcagaaattaaactaaagggtttaaaaaatagtctcatggataagttgctcaacgattattattttgccccgatacattcgttacttccaaccgtattagatccatcttatatgatcggtcgtgctgttgaacaggtggaagtattcctaaacactgaagttgatccagcaattcactcatacaaagattgtttagcattgaacagcaatataacaatttgacatgacaactttatagatcatcaaatcgtagttaacttttacttcagtcgatttctcttgatatgtttgaatagttaacttttgttatggggttgtactgcaatttttcagttcttttaattttaatattgctctgattttcccttttttctataatatcctttaatttgatctaatgtttatgtgatatctataaaattaatttttaatgttc

SEQ ID NO: 3198 - protein, 480 aa, Schistosoma mansoni
MDEFEEYRNPLTKRYASREMVCNFGEKRKVILWRQLWIWLAETQKELGFDITDEQINEMKSQRDSVDFGTAAAEEKARRHDVMAHVYTFALACPKAAPIIHLGATSCFVGDNADLIMLKDGLNILLPKVARCIDRLAKKAMLHKSLICLARTHLQPAQPTTMGRRICMWIQDLLLDLENLERLKNHTIRFRGAKGAVGTQASFMDLFQGDHQKVIKLDEILTKKSGFQRSWCVTGQTYPRKVDIEITNALSNIGATVHKICTDIRLLSTFHEVEEPFETKQIGSSAMPYKRNPIRSERACSLARYLMHISTSMVSTVSVQWLERSLDDSAIRIIVLPEAFLAADACLTLLQNIAEGLIVYPMVMEANLNSELPFLVVERILVKMVSEGAANRQECHERLRKHSHEAAAEIKLKGLKNSLMDKLLNDYYFAPIHSLLPTVLDPSYMIGRAVEQVEVFLNTEVDPAIHSYKDCLALNSNITI

SEQ ID NO: 3199 - DNA, 1395 bp, Plasmodium vivax
  CDS (1)..(1395)
atggagcacctgaagaacatctcgcccatcgacgggcggtacaaaaaggcgtgcggcgaactgtcggcgttcttctccgagcacgcgttgataaagcaccggatcatcgtcgaggtgcggtggcttctcttcctcaacgaggaggagctcttcttcgaaaaggtgaccgaccactcggtggaggtgctgaaccagattgccacaaacataacggacagcgacattgcaagagtgaaagcgatagaggaggaaaccaaccacgacgtaaaggcagtagaatattttgtgaaggaaaaattgaaaaactcaaaaagggaagacctcctaaagataaaagaatacgtacactacctctgcacaagtgaagatattaacaatgtagcttatgccacctgtctgaaggcatgcctaaacgatgtagtaatcccctgcttggaaaaaataatgctcaagctgaaggacctagctgtggagtactcccatgtgccgctactctcaaggacacatggccaacctgcatcttccaccacattcggaaaagaaatggctaatttctacgcgaggatacaccaccatgtgggggtcattagaagagtgaaggtatgtgcaaagtttaacggagctgtggggaatttcaatgcgcataaagtggccagcaaagacaccgactgggtgaataccattggattatttttaaaaaagcatttcaacttaacatacagcatatattgcacgcagatacaagaccatgattacatatgcgagctgtgtgatggtctggctagagcaaacggtactctgattgacctctgcgtagatatctggttatacatttctaataatttactaaagctcaaggtgaaggagaaggaagtcgggagcagcaccatgccacataaggtcaacccaattgactttgaaaatgcagaggggaacttacacatcgccaatgctttcttcaaactgtttagctctaaattgcctaccagcaggttgcagagggatctctcggactctactgtgttgcgcaatattggaagctcccttgcctattgcctcatcgcctacaaatcggtgctaaagggacttaacataattgatattgacaggaggaacctagaggaggaacttaaccaaaactggtccactttagcagaacccattcagattgtgatgaagcggcacaactatgtagatgcgtatgaggagcttaagcaattcactagggggaaagttatcgaccagaaaattatgcaagaatttattaaaacaaaatgtgccttcctcccccaggatgtcgtggaccagctgttggagttaactcccgcgacgtatactgggtatgccgactacttggccaagaatgtggagcggctatctggggagcgagactga

SEQ ID NO: 3200 - protein, 464 aa, Plasmodium vivax
MEHLKNISPIDGRYKKACGELSAFFSEHALIKHRIIVEVRWLLFLNEEELFFEKVTDHSVEVLNQIATNITDSDIARVKAIEEETNHDVKAVEYFVKEKLKNSKREDLLKIKEYVHYLCTSEDINNVAYATCLKACLNDVVIPCLEKIMLKLKDLAVEYSHVPLLSRTHGQPASSTTFGKEMANFYARIHHHVGVIRRVKVCAKFNGAVGNFNAHKVASKDTDWVNTIGLFLKKHFNLTYSIYCTQIQDHDYICELCDGLARANGTLIDLCVDIWLYISNNLLKLKVKEKEVGSSTMPHKVNPIDFENAEGNLHIANAFFKLFSSKLPTSRLQRDLSDSTVLRNIGSSLAYCLIAYKSVLKGLNIIDIDRRNLEEELNQNWSTLAEPIQIVMKRHNYVDAYEELKQFTRGKVIDQKIMQEFIKTKCAFLPQDVVDQLLELTPATYTGYADYLAKNVERLSGERD

SEQ ID NO: 3201 - DNA, 1374 bp, Plasmodium berghei
  CDS (1)..(1374)
atggaaaacttaaaaaacatttctccaattgatgggagatataaacatagttgtaaagaaattgccgaatatttctcagaatatgctttaataaaatataggatatatgcagaaatacaatggcttgtttttttgaatgaaaaaggttttttttttaaacagttaagtgtacaagcaattgacgagttacaaaaaatagcaaatataaatgacgaagatgcattaagattaaaacaaattgaaaaagaaacaaatcatgatgttaaagcagtagaatattttattaaagaaaaaataagtcaaaataatggtgaacttgttaatataaaagagtatgtacattatttatgtactagtgaagatataaataatatagcatatggtatatgcataaaatcgtgtttaaataatataataatacctcatatagaacaaataatgaatcgattaaaagagttagcatctgaatacagtcatgttgctatattatcgagaacccatggtcaacctgcatctgcaacaacctttggaaaagaaatggctaactattttgatagattaaaaagacatgtatctacattaaaaaacataaaaatatatggaaaatttaatggtgcagttggcaattttaatgctcataaaatagctaataataatattgattgggttaataatataaaatattttgtagaaaaatattttcatattaattatagtttatattgtacacaaatacaagaccatgattatatatgtgaaatttcagatgcattaggaagaattaattccacacttttagatttatcaatagatatatggttatatatatcaaataatttattaaaattaaaacatataaaaaatgaaataggaagcagtactatgcctcataaaataaacccaattgattttgaaaacgctgaaggaaatttacatctagctaatgcactttttaaagcattcagtgcaaaacttcctataagtagattacaaagagatttatccgattcaacagttttacgaaatattgggacttcatatgcatattcccttatttcttataaatcgattttaaaaggtttaggaaaaattgatattaatgaaaaagcagcatatcaagagttaaataataattggagtactttagctgagcctgttcaaattgttttaaaaaactataattttccaaatgcttatgaagaattaaaaaactttacacgtggaaagactattgataaagaactaatgcagcaatatattaaaacaaaatctcaattcatacccccaaattctatgaatcaattgttagatcttagccctaatacatatataggatatgctgattatttagctagtaatgttgataaaatataa

SEQ ID NO: 3202 - protein, 457 aa, Plasmodium berghei
MENLKNISPIDGRYKHSCKEIAEYFSEYALIKYRIYAEIQWLVFLNEKGFFFKQLSVQAIDELQKIANINDEDALRLKQIEKETNHDVKAVEYFIKEKISQNNGELVNIKEYVHYLCTSEDINNIAYGICIKSCLNNIIIPHIEQIMNRLKELASEYSHVAILSRTHGQPASATTFGKEMANYFDRLKRHVSTLKNIKIYGKFNGAVGNFNAHKIANNNIDWVNNIKYFVEKYFHINYSLYCTQIQDHDYICEISDALGRINSTLLDLSIDIWLYISNNLLKLKHIKNEIGSSTMPHKINPIDFENAEGNLHLANALFKAFSAKLPISRLQRDLSDSTVLRNIGTSYAYSLISYKSILKGLGKIDINEKAAYQELNNNWSTLAEPVQIVLKNYNFPNAYEELKNFTRGKTIDKELMQQYIKTKSQFIPPNSMNQLLDLSPNTYIGYADYLASNVDKI

SEQ ID NO: 3203 - DNA, 1374 bp, Ralstonia solanacearum
  CDS (1)..(1374)
atgtcgtcgctttccgccctgaccgccctgtctcccatcgatggccgctatgccgccaaggccgatccgctgcgcgagtggctgtccgaagccgccttcatgcgccaccgcgtcaaggtggaggtgcactggctgatcgcgctgtcgcaggcgggcctggcggagattccgcgcttttcggccgatgccgagcgcgcgctgctggccctggtcgaccactttgccgaggccgatgccgcccgcatcaaggaaatcgaagccgtcaccaaccacgacgtgaaggcggtcgagtactggctcaaggagcgtgtcaagggcaacgccgagctggaagccgccagcgagttcatccacttcgcctgcacgtcggaagacatcaacaacacctcgcacggcatgatgctcaagggcgcgcgcgacaccgtgatcgtgccgacgctgcgccgcgtgcaggcccgcctggtcgagctcgcccacgccaatgccgatgtgccgatgctctcgcgcacccacggccagccggccagcccgaccacgctgggcaaggaaatggccaacgtcgccgcgcgcctggaccgcgccatccgccgcatcgaagctgtcgagctgctgggcaagatgaacggcgcggtgggcaactacaacgcgcacctgtcggcctacccggatgcggactgggaagccttctccaagagcgtgatcgagacccgcctgggcctgacgttcaatccgtacaccatccagatcgagccgcacgactacatggccgagctgttcgatgccgtggcgcgcgccaacaccatcatcctggacctggaccgcgacgtctggggctacatctcgcagggctacttcaagcagaagaccaaggccggcgagatcggctcgtcgaccatgccgcacaaggtcaacccgatcgatttcgagaactccgaaggcaacgtcggcctggccaacgcggtgctgcgccacctgtcggaaaagctgccggtctcccgctggcagcgcgacctgaccgattcgaccgtgctgcgcaatatcggtgtggcgttcggctacagcctgctggcctacgacgcctgcctgcgcggcctgggcaagctggaaaccaacccggcccgcctggccgaagacctggatgcctgctgggaagtgctggccgagccggtgcagaccgtgatgcgccgctacggtatcgccaacccgtacgagcagctcaaggaactgacgcgcggcaagggcatttcgcgcgaggcgctgcgcgaattcatcgggaccctggcgattcccgaggctgcccgccagcagctgctggacatgacgccgggcagctatgtcggcaaggcggtggagctggcccgccggatcgcctga

SEQ ID NO: 3204 - protein, 457 aa, Ralstonia solanacearum
MSSLSALTALSPIDGRYAAKADPLREWLSEAAFMRHRVKVEVHWLIALSQAGLAEIPRFSADAERALLALVDHFAEADAARIKEIEAVTNHDVKAVEYWLKERVKGNAELEAASEFIHFACTSEDINNTSHGMMLKGARDTVIVPTLRRVQARLVELAHANADVPMLSRTHGQPASPTTLGKEMANVAARLDRAIRRIEAVELLGKMNGAVGNYNAHLSAYPDADWEAFSKSVIETRLGLTFNPYTIQIEPHDYMAELFDAVARANTIILDLDRDVWGYISQGYFKQKTKAGEIGSSTMPHKVNPIDFENSEGNVGLANAVLRHLSEKLPVSRWQRDLTDSTVLRNIGVAFGYSLLAYDACLRGLGKLETNPARLAEDLDACWEVLAEPVQTVMRRYGIANPYEQLKELTRGKGISREALREFIGTLAIPEAARQQLLDMTPGSYVGKAVELARRIA

SEQ ID NO: 3205 - DNA, 1362 bp, Ralstonia solanacearum
  CDS (1)..(1362)
atgattaccgcactgctcgatcgtaccttctccacaccggccatgctggcggtgtggtccgacgcggccaccgtgcgcgcgatgctcgacgtggaggccgcgctggcgcaggccgagggcgaggtcggcgtgatcccggcgcaagccgtggcgcccatccgcgcggtgtgcgccagggcgacgctggacctggaggcgctcggcgcggccgcggccggcgcgggcaacctcgcgattccgctggtcaaacagctgaccgccgccgtcgcgcagcacgacgaactcgccgcgcgctatgtgcactggggcgcgaccagtcaggacatcatcgataccggcctgatgctgcaatggcggcaggcggccgcgctgctcgacgccgatctgcggcaactggccgacgcgctggccgcgctggctcgcgtgcatcgcgatacgccgatggtcgcgcgcacctggctgcagcaggcgctgccgaccaccttcggccgcaaggtggccggctggctggaggcggtgcatcgcgcgcaggaccgcctggccgcgctgcgcgcgcatgtgcccgcgctgcagttcggcggcgcggccggcacgctggcgagcctcggcacgcaaggccgggccgtggcgcaggctttggcgcaggcgctcgatctgccgctgcccgcggcgtcgtggcatggcgagcaggaccgcatcgccgacatcggcgccgcgctggctttgctgaccggcacgcttggccacatggcgcgcgacctgtcgctgatgatgcagaccgaggtgggcgaggtggccgagccggcgggtgcaggcaagggcggctcatccaccatgccgcacaagcgcaacccggtcggctgtgccaccgtgctggcggcggccacgcgcatgccggggctggcggcgaccctgctggccgcgctgccgcaggagcacgagcgcgcgctcggcggctggcaggcgcaatgggccacgctgcgcgagatggcgtgcctcgccgccggcgcgctggaccgcatgcgcgagctcatcgccgggctgaacgtcgacgccgcgcggatgcgcgccaacctcgacctgacgcgcggcctgatcctggccgaagcggtgatgctcgccctgggcgccgacctgggccgcctgcaggcgcaccacgtggtggaggccgccagccgcctggctgtccggcagcaccggacgctgcgcgacgtgctggccgaagacgccgacgtgctgcgcgcctggggcgatgcggcgccgcagcggctggacgcgctgctcgatcccgcccactacctcggcgacgcggcggccgccgtcgaccgcgtgctggcggaacacgaccgtcgccgcgcctga

SEQ ID NO: 3206 - protein, 453 aa, Ralstonia solanacearum
MITALLDRTFSTPAMLAVWSDAATVRAMLDVEAALAQAEGEVGVIPAQAVAPIRAVCARATLDLEALGAAAAGAGNLAIPLVKQLTAAVAQHDELAARYVHWGATSQDIIDTGLMLQWRQAAALLDADLRQLADALAALARVHRDTPMVARTWLQQALPTTFGRKVAGWLEAVHRAQDRLAALRAHVPALQFGGAAGTLASLGTQGRAVAQALAQALDLPLPAASWHGEQDRIADIGAALALLTGTLGHMARDLSLMMQTEVGEVAEPAGAGKGGSSTMPHKRNPVGCATVLAAATRMPGLAATLLAALPQEHERALGGWQAQWATLREMACLAAGALDRMRELIAGLNVDAARMRANLDLTRGLILAEAVMLALGADLGRLQAHHVVEAASRLAVRQHRTLRDVLAEDADVLRAWGDAAPQRLDALLDPAHYLGDAAAAVDRVLAEHDRRRA

SEQ ID NO: 3207 - DNA, 1212 bp, Pyrobaculum aerophilum
  CDS (1)..(1212)
atgcacgtatcgccttttgactggcgctacggctctgaggaaatacggcgcttgttcactaacgaggctattataaacgcctatttagaggttgaaagggcgctcgtctgcgccttagaggagctgggcgttgcggagcggggctgttgtgaaaaggtaaacaaggcgtctgtaagcgccgatgaggtgtatagactagaaagagagacagggcatgatattttaagcctcgtgcttttgctagagcagaaaagcggctgtaggtatgtacactacggcgcaacgtctaacgacattattgacacggcgtgggccctcctcatacggagggctttggcggcggtgaaagaaaaggcacgcgccgtcggcgaccagctggccagcatggccaggaaatataaaacgctggaaatggtggggagaacccacggccagtgggctgagccaattacactgggctttaaatttgccaattactactacgagttatatattgcctgcaggcagttggcgctggcggaggagttcatcagggcgaaaataggaggggcagtgggcacaatggcctcgtggggggagcttgggctggaggtcaggaggagagttgcggagaggctgggcctcccccatcacgtaattactacccaagtggccccgcgcgagagcttcgccgtcttggcctcggcgctggccctaatggccgccgtttttgagcgcctcgccgtggagataagagagctgtcccggcctgaaataggcgaggtagtagagaggggcggggggtcctccgccatgccccacaaagcaaaccctaccgcgtctgagcgcatcgtcagcctggctagatacgtgagggcgttgacgcacgtcgcgtttgaaaacgtggctctgtggcacgaacgagatctcacgaattccgccaacgagagagtctggatacccgaagccctcctcgccctagatgaaatactcactagcgccctgagagttttgaaaaacgtgtacatagacgaggagaggattacggagaacctccaaaaggcgctcccctacatcctcactgagttccatatgaacagaatgattaaagagggggccagccgcgcggaggcctacaaaaaggccaaagaggtaaaggcgttaacatttgagtaccaaaagtggcccgtggagaggctaatagaggatgcgttgtcacttaaattatgctga

SEQ ID NO: 3208 - protein, 403 aa, Pyrobaculum aerophilum
MHVSPFDWRYGSEEIRRLFTNEAIINAYLEVERALVCALEELGVAERGCCEKVNKASVSADEVYRLERETGHDILSLVLLLEQKSGCRYVHYGATSNDIIDTAWALLIRRALAAVKEKARAVGDQLASMARKYKTLEMVGRTHGQWAEPITLGFKFANYYYELYIACRQLALAEEFIRAKIGGAVGTMASWGELGLEVRRRVAERLGLPHHVITTQVAPRESFAVLASALALMAAVFERLAVEIRELSRPEIGEVVERGGGSSAMPHKANPTASERIVSLARYVRALTHVAFENVALWHERDLTNSANERVWIPEALLALDEILTSALRVLKNVYIDEERITENLQKALPYILTEFHMNRMIKEGASRAEAYKKAKEVKALTFEYQKWPVERLIEDALSLKLC

SEQ ID NO: 3209 - DNA, 1308 bp, Rhizobium meliloti
  CDS (1)..(1308)
atgatctcccgttactcccggccggaaatggtggccatctggtcgccggaaaccaagttccgcatctggttcgagatcgaggcgcatgcctgcgacgccttggccgaaatcggcgtgatccccaaggaagctgcaaagaccatatgggaaaagggcggcgcggcaaccttcgacgtcgcccgcatcgatgagatcgaagccgtcaccaagcacgatgtcatcgccttcctcacccatcttgcggaattcgtcggccccgacagccgcttcatccatcagggcatgacctcttccgacgtgctggacacctgcttcaacattcagctcgtccgcgccaccgatctcctgcttgccgatctcgataagctgctcgaagcgctgaagcggcgtgccttcgagcacaaggacacggtgaccatcggtcgttcgcacggcatccacgccgagccgacgaccttcggcgtcaagctcgcgctcgcctatgcggagttcgaccgctgcaagcaacgccttctcgctgcccgcgaggagattgcgacctgtgccatttccggagcggtcggcaccttcgccaacatcgatccgcgcgtcgaggaacacgtggcagaggcgctcggcctcaagcctgaacccgtctcgacccaggtgatcccgcgcgatcgccacgcgatgtatttcgccacactcggcgtcgtcgcctcctcgatcgagcgccttgcgaccgagatccggcatttgcagcgcaccgaggttctggaagcggaggaatatttctctccgggccagaagggctcttccgccatgccgcacaagcgcaatccggtcctgacggaaaacctgaccggcctctcccgaatggtccgcgccttcgtcgttccggccatggaaaacgtcgcgctgtggcacgaacgcgatatctcgcactcgtcggtcgagcggatgatcggtccggatgcgacggttacgctcgatttcgcgctcgcccgcctgaccggcgtcatcgacaagcttctcgtctacccggacaacatgctgaagaatatgaacaagttccgcgggcttgttcattcgcagcgtgtccttctcgccctcacccaggccggagtgtcgcgcgaggacgcctaccgcctcgtacaacgcaacgccatgaaggtctgggaacagggcaaggacttcctcgaagaactgctcgccgacacggaagtccgtgcggctctttccgaagaggacattcgggagaaattcgacctcggctaccataccaagcatgtcgacacgatcttccggcgggttttcggttccgtctag

SEQ ID NO: 3210 - protein, 435 aa, Rhizobium meliloti
MISRYSRPEMVAIWSPETKFRIWFEIEAHACDALAEIGVIPKEAAKTIWEKGGAATFDVARIDEIEAVTKHDVIAFLTHLAEFVGPDSRFIHQGMTSSDVLDTCFNIQLVRATDLLLADLDKLLEALKRRAFEHKDTVTIGRSHGIHAEPTTFGVKLALAYAEFDRCKQRLLAAREEIATCAISGAVGTFANIDPRVEEHVAEALGLKPEPVSTQVIPRDRHAMYFATLGVVASSIERLATEIRHLQRTEVLEAEEYFSPGQKGSSAMPHKRNPVLTENLTGLSRMVRAFVVPAMENVALWHERDISHSSVERMIGPDATVTLDFALARLTGVIDKLLVYPDNMLKNMNKFRGLVHSQRVLLALTQAGVSREDAYRLVQRNAMKVWEQGKDFLEELLADTEVRAALSEEDIREKFDLGYHTKHVDTIFRRVFGSV

SEQ ID NO: 3211 - DNA, 2264 bp, Synechococcus sp
  CDS (647)..(1915)
catgccagcggcgtgcaattggcccgactgagcagaagcggttgagtagtagacagcggaccagagaccagtaaggcgatcgccaacagcgctgacatgagaccgttcctcaagttcgacaagctaactgctctcactgtagaggccgatcgccggcgcggcagcgggtagggaaatccaccctagttgctgttgagaacagccctcgacgaaatgagaagattacgaaatgcaaggaacaagcttagaaaattctgggagagatcaggccgtaatgctctcgctggcaaaatacgaagcaagtttcttgtggccagagaaaatttcagttctggctctgtcccggtcctagcttcagtgaggaggatcccatggagcaagcgttcggtaacctctacgaaatctttgggcgccagttggtgcgcctcaaggatcagcccgaagacatgcccgactttgtcttggaatattgccacggcgatcgctgctgggtgcgacagaggcctggggtagaaccatcaatctcgggattcagcgatcgcagatcatcggtttggattagatctcggcgctcggccaaagccgtaagataggaaggctgtatccgtcgacaccggctttgatcgagcgttatacgctgcctgccatgggcggcctttggactgacacctacaaactcaaaacctggctgcaggttgaaattgccgtttgcgaggctcaggcagagctcggctatatccccgccgatgccgtggaaacgatcaaggcgaaggccaatttcgatccggcgcgggtgctggagattgagcaagaagttcgccacgacgtcatcgcctttttgaccaacgtcaacgaatatgttggcgatgccggtcgctacattcaccttggcatgaccagctcggatgtgctggacactggtctggcgctgcagatggtggccagtgtcgatctgctcttggctgaaaccgagaatttaattcaggcgattcgctggcaggcgcagcaacaccgcgaaacggtgatgattggccgctcccacggcattcatgctgagccgatcacctttggcttcaagctcgccggttggctggcagagatgctgcgcaaccgcgatcgcttggtgcaggtccgtcagtcagtggcagtcggcaagatttccggtgcggtcggtacctacgccaacatcgagccgcgcgtcgaagctctgacctgtcaaaaactaggtctggagccggatacggcttcgacccaagtggtcagccgcgatcgccatgcggagtatgtccaggtccttgccttagtcgccgcttctttagagcgcttctccgtcgagatccgcaacctgcagcgatcggatgtgctggaggttgaagaattttttgccaagggtcaaaaaggctcctcagccatgccccacaagcgcaacccgattcgctccgagcgaatcagcggtctagcgcgggtgattcggggctatgccgtggcagcgctggaaaacgtggcactctggcacgagcgggatatctcccacagctccgtggagcggatgatgctacccgactgctcagcgacgctgcacttcatgctggtggaaatgaccgagctggtgaaaaccctgcaggtctatcccgagaacatgacccgcaacctcaaccgctacggcggcgtggttttcagtcagcgcgtactgttggccttggttgacaagggactcagccgcgaggaagcctaccgaattgtccaaagcaatgcccacagcgcttggaatcatgaaggcggcaacttccgcgccctgattgaagccgatccgactgttcaggctcacctcagcgccgccgagattgaagactgctttgctgctcaacatcatctgcgtcatttggatgatgtctatcagcgcctcaacatctaacgcgagttaaggctgcaatttccacaaggcacagggccaccgtcagatgttctccaacatggttttaaagttggcagcagcactgagtggtcttgtgctgattttatttgtgggctttcatctcaccacaaatctgttgctatggcggggagcagaggctctcgatcgcgcggcgatcgcactccataatcaggtctggctccccgctgctgaagcgatcgttctgacagcgatcgcggttcattttctgaccgtcttgatcctggcttggcgtaaccgtcaggctcgcgggcctcaagcctacgcccaatggcaaagcaagcaaaccagttggttgcgctgggcagcg

SEQ ID NO: 3212 - protein, 422 aa, Synechococcus sp
MGGLWTDTYKLKTWLQVEIAVCEAQAELGYIPADAVETIKAKANFDPARVLEIEQEVRHDVIAFLTNVNEYVGDAGRYIHLGMTSSDVLDTGLALQMVASVDLLLAETENLIQAIRWQAQQHRETVMIGRSHGIHAEPITFGFKLAGWLAEMLRNRDRLVQVRQSVAVGKISGAVGTYANIEPRVEALTCQKLGLEPDTASTQVVSRDRHAEYVQVLALVAASLERFSVEIRNLQRSDVLEVEEFFAKGQKGSSAMPHKRNPIRSERISGLARVIRGYAVAALENVALWHERDISHSSVERMMLPDCSATLHFMLVEMTELVKTLQVYPENMTRNLNRYGGVVFSQRVLLALVDKGLSREEAYRIVQSNAHSAWNHEGGNFRALIEADPTVQAHLSAAEIEDCFAAQHHLRHLDDVYQRLNI

SEQ ID NO: 3213 - DNA, 2314 bp, Drosophila melanogaster
  CDS (82)..(1527)
ctcttcccttgtgattacgcactattggcccagtgtttttgtgatttatagtccataatctcctacatagtatacccaaaaatggctagcaactacgagggctacaagtcgccgctgagcacccggtacgccagcaaagagatgcagttcctcttcagtgaccagaacaagttctccacctggcgccggttgtgggtgtggctggcgaaggcggagagcaggctgggactagagatcagcgatgcccagattgccgagatggagctccagatcagcaacatcgactttgaggcggccgccgccgaggagcgacttacgcgccacgacgtaatggcccacgtccatgtctttgccaaacagtgtccctctgctgcgccggtgatccatttgggagcaacctcgtgctatgtgggcgacaacactgatctgattgtactgagggacgctcttaaactgctccttccacgagtcgccagcgtgatagctcgtctaagccagtttgcccagagctacaaggatcagcccacgttgggattcacccatctccagcctgcgcagttgaccacggttggcaagcgggcgtgcctgtggatccaggatctgatcatggacgaacgcgcgctgtcccgctgtttagaggacctgcgcttccgtggagtcaagggaattactggtacccaggcctcgttcctgcaacttttcaatggggatggcgagaaggtgaagcagctggatcagttggtcaccgaactggctggcttcaagaaggcctatgcggtaaccggtcaaacatactcccgaaaggtggatgtggagatcgtggccgcgcttgccagtctcggcaccaccatccacaagatgtgctccgatctgcgcatcctcgcttctcgcaaagagctggaggagcccttcgagagcactcagattggctcctcggccatgccgtacaagaggaaccctatgcgctcggagcgttgttgcgccctggcccgtcacctcatcaccttgttcagcagtgctgctaatacacatgccactcagtggctggaacgcactctggatgactctgccaacaggaggttgaccctatccgaggccttcctggctgcagatgccgccctgcttactctgctgaacatctcgcagggactggtcgtttacccaaaggtgattgaacggcacatttcccaagagctgccgttcatgtccacagagaacataatcatggccatggtgaaggcgggaggagatcgccaggtgtgccacgagaagattcgcgtgctgtcccaggaggccggagcccaggtgaagcagcatggcaaggacaacgacctcgtggttcgagtgcgaaaggatccctacttttcgcccatcctggagcaactggacaccatactggatgccaaaacctttactggacgtgccagcgaccaagtgggcgagttcgtcaaggaggaagtggaacccgtgctggcacgctactccgaagccctgaagaacgttcaagacgtcaaactgaacatctagatctagcccattatgttgccctgttttaatcactgaatttgattttgtaaaatacacacacacacacattcgcacccaatcaactgcgtcagccactggatgcagtcgacgttatcaccttttagactcattgggtcgatggcaagcagacccccggcgtgatttgtctttctgtttttgtatttttgccagcttatttacaattaaaggctaaaatcgaaaaacaaaaccacaagcctcgaatcgaactcgagtcgacgttcttgatccgagtaaacatatacacatatttgccgcctgtgcctttcccgttcgccactcgggctgacatatcacgactccaatgctgccacggcacagtgggtcttcgggtctcatgccgcttgctttacttttaattatattatactacatataaaacataacagtgctgagaattttcttagcgagcgcatttcttaaacagttgctactggctttaagcagccgaatatcttatgcttttgatcttgtttccataattaagattgtttttaatgaaaaatgaaatatcatatcacaataaaagtatacgagcccataaaagtaagtgtacgaagtgtactggtttgctaaccagcaatgtctcgctgttgctaaatggattatcacatttaattgactgcattcagatcagatcagattgcaatgggtttattaactcaacggttgaactatgtaaatgaatatgaaatataatataaatattaagtcgtataggtcaaaaactaaaaaaaaaaaaaaaaaa

SEQ ID NO: 3214 - protein, 481 aa, Drosophila melanogaster
MASNYEGYKSPLSTRYASKEMQFLFSDQNKFSTWRRLWVWLAKAESRLGLEISDAQIAEMELQISNIDFEAAAAEERLTRHDVMAHVHVFAKQCPSAAPVIHLGATSCYVGDNTDLIVLRDALKLLLPRVASVIARLSQFAQSYKDQPTLGFTHLQPAQLTTVGKRACLWIQDLIMDERALSRCLEDLRFRGVKGITGTQASFLQLFNGDGEKVKQLDQLVTELAGFKKAYAVTGQTYSRKVDVEIVAALASLGTTIHKMCSDLRILASRKELEEPFESTQIGSSAMPYKRNPMRSERCCALARHLITLFSSAANTHATQWLERTLDDSANRRLTLSEAFLAADAALLTLLNISQGLVVYPKVIERHISQELPFMSTENIIMAMVKAGGDRQVCHEKIRVLSQEAGAQVKQHGKDNDLVVRVRKDPYFSPILEQLDTILDAKTFTGRASDQVGEFVKEEVEPVLARYSEALKNVQDVKLNI

SEQ ID NO: 3215 - DNA, 2203 bp, Pichia angusta
  CDS (716)..(2203)
aggatctgtcccgacgatgtttatggctccttggaagcagattttgtttcggctatgcagcagaaaagtatctctttacacaagggcagagttgtcaagctagagccacgaagcagtgaggatggacgactgggcagggcaattcttgacgacggcaccgcgatcgagctcgatgtgctctacacgattccaccttcaaccatcaacaataaggagattattaccaagctgggcgttgaattggacgagatgggacttattaaagtctctccccagcagaagacgaacgtggagggcgtttttgcaatcggtgacaacactacccgcatgagagcactggcctttgtagttggccagggtatgcttgcagcatcctccatttgtcatgaaatcctacacgagcgctggaacgcgtaagttagtggtccctttaagatatcggagtgagatttttcagtgtctagtctaactttaatttttcttgttatttgattgtcgttcatcgagttgaagagattttaaggaaatgaaaatgtccctccatataaaatgatccttccagcatccaaagcgtagacgaagctatcagccctgtggactgatttgtaagagaaatggcacccccttgtcctatatctcgcacctatagtgccccctcgtagcacccccaccttgtgccccacagttaccttttggaccggaatacatttccaatatgcagagtcaaattaatttaattaatttttatttttctaccatgtccaacgacacctatgccaccccgctgtcgtcgcggtacgcgtccaaggagatgtcgcagatcttctctctgcggaacaggttctccacgtggagaaagctgtggtacaacttggcaattgccgagaaatcgctggggctttctgtcgtcaccgatgaagctatcgagcagatgtccaagcacctcgaaatcacggacgaggaaatcgaggccgccaaaaaggaggaggccattgtcagacacgacgtgatggcccacgtccacgttttcggcgaaacctgtcctgctgctgccggaatcatccatttgggagccacctcgtgctacgttacagataacgcggatctgatttttctcagggacgcgtacgacgttttgatccccaaacttgtgaatgttatcaacagactggccaaatttgctctggaccacaaagacctgccagtgcttggctggactcatttccagcccgcccagctgacgactgtcgggaaaagagcaactctgtggctccaagagctgctctgggacctcagaaacatgcagcgtgccagaaatgacatcggactgcgcggagtcaagggaactaccggtacccaggcctctttcctgtctcttttccacggagaccatgacaaggtcgaggccttggacgaaaaggtggtggagctactaggattcgagtacgcgtacccttgcacggggcagacctactcacgtaaaatcgacatcgacgccctgcacccactatcgtctttgggcgcctcgtgtcacaagatggccaccgatataagattgctggccaacctaaaagaaatggaagagccgtttgaaaaaagccagatcgggtcgtctgccatggcctacaaaaggaacccgatgaggtgcgagcgtgtgtgttcgctgtcgcgtcacttgggttcgttgtaccaggacgcattccagacggcgtccgtgcagtggtttgagagaacgctggacgactctgccatcagaagaatctcaattccagaggcttttctgacggcagacattttgctttcgacgctgctgaatattacttccggcctcgtggtgtacccgaaagtgattgagcgccgtattaaggcagaactgcccttcatggcgaccgagaacatcatcatggcgatggtggagcagggtgcttcgcggcaggagtgccacgaggagatccgcgtgctctcgcaccaggcatcggcagtggtcaagcaggaaggcggcgacaacgacttgattgagagaattaagagcacagactacttcaagcctatttggtcgcaattggacaaattactcgacccgtccacttttgttggtcgtgccccacaacaaactgaaaaattcgtaaacgtcactgttgcaaacgcactggaaccataccggtcgcttatcaacgaggagcacgttcaattggccgtctag

SEQ ID NO: 3216 - protein, 495 aa, Pichia angusta
MQSQINLINFYFSTMSNDTYATPLSSRYASKEMSQIFSLRNRFSTWRKLWYNLAIAEKSLGLSVVTDEAIEQMSKHLEITDEEIEAAKKEEAIVRHDVMAHVHVFGETCPAAAGIIHLGATSCYVTDNADLIFLRDAYDVLIPKLVNVINRLAKFALDHKDLPVLGWTHFQPAQLTTVGKRATLWLQELLWDLRNMQRARNDIGLRGVKGTTGTQASFLSLFHGDHDKVEALDEKVVELLGFEYAYPCTGQTYSRKIDIDALHPLSSLGASCHKMATDIRLLANLKEMEEPFEKSQIGSSAMAYKRNPMRCERVCSLSRHLGSLYQDAFQTASVQWFERTLDDSAIRRISIPEAFLTADILLSTLLNITSGLVVYPKVIERRIKAELPFMATENIIMAMVEQGASRQECHEEIRVLSHQASAVVKQEGGDNDLIERIKSTDYFKPIWSQLDKLLDPSTFVGRAPQQTEKFVNVTVANALEPYRSLINEEHVQLAV

SEQ ID NO: 3217 - DNA, 1353 bp, Sulfolobus tokodaii
  CDS (1)..(1353)
atggaaaattcagtttgtgtattagactggagatacggaagcaaagagatgagagaattattccaaagagctacaattcttaaaagaatggctacagtagaagtagcgttactttatgctttatcaaagataggtttagtaagagaagaggatgtactggttgtgcaaaaaaacatagacaaaataaatataagcagagtagaagaattagagaagaaattaggacatgatgttatggcattaactgtgcatttagctgaattatctggcgaatctggtaaatttattcattttggtgctacaagttatgacatagtagatacagctaatgtattaatttttagggatgccataaatataataaagaaaaaattaaaaaatataataataatattaatggaatatgctgaaaaataccaagaacttgtaatggtaggtagaacacatgggcaacacgcgttaccaataacgctgggttttaaatttgcaaattacgtttatgagtttactcgttcgttagagaggcttaacgatacaagcaaaagattacttaaaataaaaatggctggggcagtaggcacaatggcaggttggaaagataaaggtttagagatagaaaaatatgtttcagaatacttaggattacctcctcatgaaatctctactcagatagctcctcgtgacggatatactgagttagtctcagatcttgcaattttagcgtctcagcttgacagatttgccttagaaataagggagctaatgagacctgaaattttagagttagctgaaggttctgcagaatcaagagtaggaagtagtactatgcctcataaggagaatccagtaactgcggaaaaaatcagtggattagccaaggtattgaggggctttgtaatatctgagctagaaaatatacctttatggcatgaaagagatctaactaacagctcatctgaaaggataattctttctcactcttttcttataatggatgagatgttagagagtatggaagctcttttaagaaatctaagagtttacccagaaaatatgagaaagaacctagaactcactaaaggtcttattatggctgaaagcttaatgattaatcttacattagcaaatgttccaaggcatatagctcatgaacttgttatgaaagtatctagagaagcagaaagagaagggaaatcattgcttgaagctgctttagacaatgaggaaatagttaaaatactaggtaaggagaaaataatagaagcattaaatccgtatagctatttaggagaatacaagaaattaataagtagagcattatcatatgcaaagaatgttattgaacagacgtaa

SEQ ID NO: 3218 - protein, 450 aa, Sulfolobus tokodaii
MENSVCVLDWRYGSKEMRELFQRATILKRMATVEVALLYALSKIGLVREEDVLVVQKNIDKINISRVEELEKKLGHDVMALTVHLAELSGESGKFIHFGATSYDIVDTANVLIFRDAINIIKKKLKNIIIILMEYAEKYQELVMVGRTHGQHALPITLGFKFANYVYEFTRSLERLNDTSKRLLKIKMAGAVGTMAGWKDKGLEIEKYVSEYLGLPPHEISTQIAPRDGYTELVSDLAILASQLDRFALEIRELMRPEILELAEGSAESRVGSSTMPHKENPVTAEKISGLAKVLRGFVISELENIPLWHERDLTNSSSERIILSHSFLIMDEMLESMEALLRNLRVYPENMRKNLELTKGLIMAESLMINLTLANVPRHIAHELVMKVSREAEREGKSLLEAALDNEEIVKILGKEKIIEALNPYSYLGEYKKLISRALSYAKNVIEQT

SEQ ID NO: 3219 - DNA, 1347 bp, Thermoplasma volcanium
  CDS (1)..(1347)
atggtagtctccccattagagtatagatacggcagggaacagataaagagaatatttgacgatgaaaaccgcctctactatatgcttaaagtagaggcagcaatatcaaaggcagaagcggaatatggtattataccgcccgaggccgccgaagatattgggaaagtagtcgcagaccgcatagtacagctgcagagagtaagagaaatagaagcagagataaagcacgatgtaatggctatggtgaaagcgttatcagaaaaatgcaaagttggcgccagttacgtacattacggcgtcacatctaacgacgtaaacgatacggcaacagcactgcaaatgcatgatttcttttctttcctgaagcaggatatagaagatattatggagacactcatcgaattgacgttaagatataaatcgagcccaatgatgggtaggacgcatggccagcacgcttcaccaatcactatcggcctaaaatttgccgtttacctttcagagttttcaaggcactatgatcgtatgattgaaatgtcaaaaagagctttcgctggcaaagtgctcgggccggtaggaacaggtgctgccctaggccccaaagcccttgatatacagaatagagttatggagatactgggtatatacgcagaagagggcccaacacagatagtaaatagagaccgatacatagaatatctatccgtaataaacgggatctctgtaacattagaaaagataggtacagagataaggaacctgcagaggccagagatagatgagatgtccgaatattttgatgtggagaggcaggtcggttctagttcaatgcccagcaaggtgaacccaataaattctgaaaatgtagttagtttatcgaggcttataagatccatgataataccggaatacgaggctggcgttacatggcacgaaagggatctgacgaacagcgctctggaaaggtttacgataccatattcttcgatacttgtggattatatccttgttaagatgaactcaatcctatctagccttattattaaggaggataagattaggaaaaatcttgaaatggatgacagcatattttctgagagcttggtagctgctcttactcaggccggcatgccaaggcaggacgcacacgaattcataaggagatgttcaatgaaagcaagatctgaaggcaagacactgaaacatgtagtcgtagaagagggcataaccaattatataagaagagatgagctagatcgcctgatggatcctgcaaacttcattggttccgcaccagaaatatgtgatatagtggtaaataatgcaaggaggaggctgatcaactga

SEQ ID NO: 3220 - protein, 448 aa, Thermoplasma volcanium
MVVSPLEYRYGREQIKRIFDDENRLYYMLKVEAAISKAEAEYGIIPPEAAEDIGKVVADRIVQLQRVREIEAEIKHDVMAMVKALSEKCKVGASYVHYGVTSNDVNDTATALQMHDFFSFLKQDIEDIMETLIELTLRYKSSPMMGRTHGQHASPITIGLKFAVYLSEFSRHYDRMIEMSKRAFAGKVLGPVGTGAALGPKALDIQNRVMEILGIYAEEGPTQIVNRDRYIEYLSVINGISVTLEKIGTEIRNLQRPEIDEMSEYFDVERQVGSSSMPSKVNPINSENVVSLSRLIRSMIIPEYEAGVTWHERDLTNSALERFTIPYSSILVDYILVKMNSILSSLIIKEDKIRKNLEMDDSIFSESLVAALTQAGMPRQDAHEFIRRCSMKARSEGKTLKHVVVEEGITNYIRRDELDRLMDPANFIGSAPEICDIVVNNARRRLIN

SEQ ID NO: 3221 - DNA, 1308 bp, Rhizobium loti
  CDS (1)..(1308)
atgatccctcgctattcccggccggaaatggtcgccatctggtcgcccgaaacccggtttcgcatctggttcgaaatcgaggcccatgcctgcgacgcgctggccgaactcggcgtcatcccgaaggaagcggcaaagaccatctgggaaaagggcggggccgcgaaattcgacgtcgagaagatcgacgagatcgaacgcgtcaccaagcatgacgtcatcgcgttcctcacacatcttgccgaattcgtcggaccggatgcgcgtttcatccaccagggcatgacgtcttcggatgtgctggacacctgctttgccgtccagcttacccgcgccagcgacattctgctcgcagacattgacggcctgcttgccgcgctcaagcgccgcgccttcgaacacaaggacaccgttaccatcggccgcagccacggcatccatgccgagccgacaaccttcggcatcaagctggcgcaggcctatgccgaattctcgcgctgccgcgagcggctggtgcacgcacgcgaagacatcgccacctgcgccatatcaggggcggtcggcaccttcgccaacatcgaaccctatgtcgaggagcatgtcgcggcaaagctcgggctgaagccggagccggtgtcgacgcaagtgatcccgcgcgaccgccacgccatgttctttgccacgctcggcgtcatcgcctcgtcgatggagcggctggcgaccgagatccggcacctgcagcgcaccgaggtgctggaagcggaagagtatttttcgccgggccagaaaggctcgtcggcaatgccgcacaagcgcaatccggtgctgacggaaaacctcaccggccttgcccgcatggtgcgctccatggcgctgccggcgatggaggatgtggcgctctggcacgagcgcgacatctcgcactcctccgtcgagcgcatgattggtccggacgccacggtgacgctggatttcgcgctgtcacgcctgaccggcgtcgtcgacaagctggtcgtctatcccgagaacatgctgaggaacatgaacaagttccgcggcctggtgcattcgcagcgcgtcatgctggcgctgacgcaggccggcctgtcgcgcgaggactcctaccggctggtgcagcgcaacgccatgaaggtgtgggaacaaggcgctgattttcttgaggaacttttggcggacaaggaagtcaccgccgccttgccggaggcggaaatccgtgagaaattcgacctgggctaccacaccaagcatgtcgacacgatcttcaggcgggtgttcggggaggcttga

SEQ ID NO: 3222 - protein, 435 aa, Rhizobium loti
MIPRYSRPEMVAIWSPETRFRIWFEIEAHACDALAELGVIPKEAAKTIWEKGGAAKFDVEKIDEIERVTKHDVIAFLTHLAEFVGPDARFIHQGMTSSDVLDTCFAVQLTRASDILLADIDGLLAALKRRAFEHKDTVTIGRSHGIHAEPTTFGIKLAQAYAEFSRCRERLVHAREDIATCAISGAVGTFANIEPYVEEHVAAKLGLKPEPVSTQVIPRDRHAMFFATLGVIASSMERLATEIRHLQRTEVLEAEEYFSPGQKGSSAMPHKRNPVLTENLTGLARMVRSMALPAMEDVALWHERDISHSSVERMIGPDATVTLDFALSRLTGVVDKLVVYPENMLRNMNKFRGLVHSQRVMLALTQAGLSREDSYRLVQRNAMKVWEQGADFLEELLADKEVTAALPEAEIREKFDLGYHTKHVDTIFRRVFGEA

SEQ ID NO: 3223 - DNA, 1293 bp, Streptococcus pyogenes
  CDS (1)..(1293)
atgctagaacgttattcacgccctgagatggcggcaatttggacagaggaaaataaataccatgcttggttggaggtcgagattttggctgacgaggcatgggctgagttgggtgagattcctaaggaggatgtggctaagattcgtgagaaggcggattttgacattgaccgcattcttgaaattgagcaggacacgcgtcacgatgtggtggctttcacgcgtgcggtttctgaaacgcttggtgaggagcgcaagtgggtgcactacggtttgacctcgactgacgtggtggacactgcctatggttacctctacaagcaagctaacgacattatccgtcgcgatcttgagaatttcaccaatatcgtggcagacaaggcgcgtgagcacaaaatgaccatcatgatgggtcgtacccacggtgttcacgccgagccaacgactttcggtcttaagttggcgacttggtacagcgagatgaaacgtaatattgagcgttttgaacatgctgccgcaggtgtggaagctggtaagatttcaggtgccgttggtaactttgccaacatcccaccttttgtggaagaatatgtctgtgacaaattaggcattcgtccgcaagaaatttcaacacaagttcttccacgtgaccttcacgcagaatattttgcagtgcttgcaagtattgcaacttctatcgaacgtatggcgacagagattcgaggtctgcaaaagtcagaacaacgtgaagttgaagaattctttgccaaaggtcagaaaggtagctctgctatgcctcacaaacgcaacccaatcggttcagagaacatgacagggctagcgcgcgtgattcgtggtcacatggtgacagcttatgagaacgtgtcactttggcatgagcgtgacatttcgcactcatcagctgagcgtatcatcacacctgacacaactatcttgattgactacatgctcaaccgctttggtaatatcgttaagaacttgactgtcttcccggaaaatatgatgcgcaatatggaatcaacttttggtttgatttatagtcaacgtgttatgctcaaattgattgaaaaaggaatgacacgagaagaagcttatgacttagttcaacctaagacagcttattcctgggacaatcaagtggatttcaaaccacttttagaagaagacaccaaagttacctcttgtcttacacaagaagaaattgatgaactatttaatccgatttattacacaaaacgtgttgatgatatttttaagcgtttagggatttag

SEQ ID NO: 3224 - protein, 430 aa, Streptococcus pyogenes
MLERYSRPEMAAIWTEENKYHAWLEVEILADEAWAELGEIPKEDVAKIREKADFDIDRILEIEQDTRHDVVAFTRAVSETLGEERKWVHYGLTSTDVVDTAYGYLYKQANDIIRRDLENFTNIVADKAREHKMTIMMGRTHGVHAEPTTFGLKLATWYSEMKRNIERFEHAAAGVEAGKISGAVGNFANIPPFVEEYVCDKLGIRPQEISTQVLPRDLHAEYFAVLASIATSIERMATEIRGLQKSEQREVEEFFAKGQKGSSAMPHKRNPIGSENMTGLARVIRGHMVTAYENVSLWHERDISHSSAERIITPDTTILIDYMLNRFGNIVKNLTVFPENMMRNMESTFGLIYSQRVMLKLIEKGMTREEAYDLVQPKTAYSWDNQVDFKPLLEEDTKVTSCLTQEEIDELFNPIYYTKRVDDIFKRLGI

SEQ ID NO: 3225 - DNA, 1368 bp, Pasteurella multocida
  CDS (1)..(1368)
atgcaacttaatgcattaactgcactttccccgattgatggtcgttatcaagacaaagtgagttcactacgttcaatttttagtgaatttggcttgttaaaatttcgtgtgacagtggaagtgcgctggttacaaaaattagctgccaccgatcaaattcaagaagtttctttattatctcaagaggcaaacgattacttgaatcacatcgttgaaaatttcagtgtgcaagatgccgaacgtattaaagaaattgaacgcacgacgaaccacgatgtgaaagcagtggaatatttcttaaaagaaaaaagtgaagctttaccagaattagccaaaatcagtgaatttattcacttcgcttgtacctcagaagacattaacaatctttcgcatgcattaatgctaaaaacggcacgtgaagaggtgattcttccagaatggcaaaacttaattgcggatatcagcgcacttgctaatgaatataaaactattccgttactgtctcgtacacatggtcaacctgcatcaccttctactattgggaaagaaatggcaaacgtggtgtatcgcttacaacgccagtttaaacaattacagcagattgacattttaggtaaaatcaatggtgcggtaggtaactataatgcccatttatcagcgtatcctgatattgattggcatcaattcagtgaagagtttgtgacgtcattaggtttaacttggaacccatataccacacaaattgaaccacatgactacattgctgaatttttcgataatgtggcgcgctttaatactattattatcgattttgaccgtgacttatggggatatattgcgttaaatcatttcaaacaacgtaccattgccggtgaaattggatcttcaaccatgccacataaagtcaatccaatcgactttgaaaattcagagggaaatcttggtttagccaatgcagtcatggcacatttaggcgcaaaattaccggtttctcgctggcaacgtgatttaacggattccaccgtattacgtaacttaggtgtgggattaggctattgtttaattgcgtacgcggcgacacgtaaaggtatcagtaaattagaagtgaacgagcagcatttacgtgatgagttggatcaaaactgggaagtccttgccgaacctatccaaacagtgatgcgtcgttatggtattgaaaagccgtatgagaaattaaaagcgttaacccgtggtaagcgtgtggatgcagaagcgatgcgtgaatttatcgaaacattagatattccagcgcaagaaaaaatccgtttacaacaaatgacgcctgcaacctatattggtgccgcggtggaattagtggaaaaactgtaa

SEQ ID NO: 3226 - protein, 455 aa, Pasteurella multocida
MQLNALTALSPIDGRYQDKVSSLRSIFSEFGLLKFRVTVEVRWLQKLAATDQIQEVSLLSQEANDYLNHIVENFSVQDAERIKEIERTTNHDVKAVEYFLKEKSEALPELAKISEFIHFACTSEDINNLSHALMLKTAREEVILPEWQNLIADISALANEYKTIPLLSRTHGQPASPSTIGKEMANVVYRLQRQFKQLQQIDILGKINGAVGNYNAHLSAYPDIDWHQFSEEFVTSLGLTWNPYTTQIEPHDYIAEFFDNVARFNTIIIDFDRDLWGYIALNHFKQRTIAGEIGSSTMPHKVNPIDFENSEGNLGLANAVMAHLGAKLPVSRWQRDLTDSTVLRNLGVGLGYCLIAYAATRKGISKLEVNEQHLRDELDQNWEVLAEPIQTVMRRYGIEKPYEKLKALTRGKRVDAEAMREFIETLDIPAQEKIRLQQMTPATYIGAAVELVEKL

SEQ ID NO: 3227 - DNA, 1368 bp, Thermoplasma acidophilum
  CDS (1)..(1368)
atggtagtctcgcccatagaatacaggtatggcagaagacaagtcaagaaaatattcgatgatgaaacacgcctaaattacatgcttaaggttgaagccgcaatagcgaaggcagaatccgagcttggtataataccgcaagatgcctacaatgagatccagagagcggtagattccggatcaataactctggacgaggtcaggcaggttgaggatgagataaaacatgacgttatggccgttgtccgggttctttcaaaatattccggatcagggtctaagtatgtacacttcggtgtcacatcaaacgatataaacgataccgcaactgcacttcagctgcatgatttctcttctatctacagatcgaaccttgtatcattcatggaaacacttgtaggcctcgcatctaaatatcgcgatcttccaatgatgggtaggactcatggccagcatgcctcgccgataacccttggcctgaagtttgcggtctatcttgcggagatgataaggcatctcgaccggtgggatgagatggctggcagagcatttgccgggaaggtgctgggtcctgtcggtactggagcagctctgggagaaatggcactggatgttcagaagagggtcatggacatactgggtatatatccggaggacggcgcaacgcagatcgtcaacagggatcgttacatagagtatctctccgtcataaatggtatatcggtgacgctggaaaagatagctaccgagataaggaatcttcaaagaccagagatagatgaactctccgaatactttgactttgaaaagcaggtcggctcaagctccatgccaagcaaggtaaatccaataaattccgaaaacgtggtgagcctctcacgcttcataagatccttgataatatctgagtacgaggccggtgttacatggcatgaacgggatctcaccaatagtgcatctgaacgctttgttataccgtacgcgagcatactgatagattatgctactgatcgattaaacggtgttctgaaaaccctcatcgtcaaggaggacaatatacgcaggaatctggaaaacgatgacagcatctactctgaaagtatagtaacgatactgactgagcgcggtatggcaaggcaggacgcacatgaatttgtccgaagatcggccatgaatgcaaggagcaagggtatgagcttcaggcagggcctgctagagaatggcattgaaagatatctcagcaaagccgatcttgacagggcgatggatccggccaacttcataggattggcaccgatcatatgtgatacgatagtaaagaaggcgaaagagaggatcgggatgaaagatggagagcaagcttcctga

SEQ ID NO: 3228 - protein, 455 aa, Thermoplasma acidophilum
MVVSPIEYRYGRRQVKKIFDDETRLNYMLKVEAAIAKAESELGIIPQDAYNEIQRAVDSGSITLDEVRQVEDEIKHDVMAVVRVLSKYSGSGSKYVHFGVTSNDINDTATALQLHDFSSIYRSNLVSFMETLVGLASKYRDLPMMGRTHGQHASPITLGLKFAVYLAEMIRHLDRWDEMAGRAFAGKVLGPVGTGAALGEMALDVQKRVMDILGIYPEDGATQIVNRDRYIEYLSVINGISVTLEKIATEIRNLQRPEIDELSEYFDFEKQVGSSSMPSKVNPINSENVVSLSRFIRSLIISEYEAGVTWHERDLTNSASERFVIPYASILIDYATDRLNGVLKTLIVKEDNIRRNLENDDSIYSESIVTILTERGMARQDAHEFVRRSAMNARSKGMSFRQGLLENGIERYLSKADLDRAMDPANFIGLAPIICDTIVKKAKERIGMKDGEQAS

SEQ ID NO: 3229 - DNA, 1440 bp, Leishmania major
  CDS (1)..(1440)
atgtcactgccttcggcacaagaagcggcggcgccatctgtgaccacgacggcacacaaggcccctgcggagatcagtcaagacaaccccctctactcgctctctcctctcgatggtcgctacaagcgtgacacggccgcgctgcgcgcctacttctccgaatacgcgttattcaagtatcgcgtgcaggtggaggtgctgtacttccaagcgctgtgcaaggaggtgccggtgatcacgcagcttcgcggcgtcacagatgcgcagctggagaagctgcgggcaaccaccttcgagaacttcacagtggacgatgcccggatgataaaggacattgaggcggtcacgaaccacgatatcaaggcagtggagtactacctgaaggacaagatgtctgcctgcggcctcgaggccgaaaaggagttcatccactttgggctaacgtcgcaggacatcaacaacacctcgattccgatgctcctgcgcgacgctctgcaccaccactacatcccaacgctggatcagctgatcgcgcacctcaagagcaagctgcctgagtgggatgtcccgatgctggcccggacgcacggccaaccggcgagcccgacgaacttggcgaaggaattcatggtgtggattgagcggctggaagagcagcggacgatgctgctgagcatcccaaacacaggcaagttcggcggcgctaccggcaacttcaacgcgcacctctgtgcgtaccctggcgtaaactggctggagtttggggagctcttcctgagcaagtaccttggccttcgccgccagcgctacacaactcagatcgagcactacgacaacctcgccgccatctgcgatgcgtgcgcgcggctgcacacaatcttgatggacctggccaaggacgtgtggcagtacatttcactcggctactttgatcagaaggtgaaggcgggcgaagtcggcagcagcgcgatgccgcataaggtgaacccgatcgacttcgagaacgctgagggcaacctgggcatgagcaacgccgtcctcggttttctttcagcgaagttgcccatctcccgtctgcagcgcgacctcacagacagcacggtgctgcgcaacctcggcgttccgcttagccacgccctcatcgcgtttgcctccctgcaacgcggcatcggcaagctccttctcaacaaggacgtcatcgccgcggacctagagggcaattgggctgtcgtggcggagggcatccagaccgtgctgcgccgggagggctacccgaagccgtacgaggcgctcaaggacctgacgcgcggcaacgcgcatgttacggaggagacggtgcaccgcttcatccagcagctcgagggcatcacagaggaggtgcggcaggagctgctcgccattacgcccttcacgtacgtgggctacacggcgcgtccctga

SEQ ID NO: 3230 - protein, 479 aa, Leishmania major
MSLPSAQEAAAPSVTTTAHKAPAEISQDNPLYSLSPLDGRYKRDTAALRAYFSEYALFKYRVQVEVLYFQALCKEVPVITQLRGVTDAQLEKLRATTFENFTVDDARMIKDIEAVTNHDIKAVEYYLKDKMSACGLEAEKEFIHFGLTSQDINNTSIPMLLRDALHHHYIPTLDQLIAHLKSKLPEWDVPMLARTHGQPASPTNLAKEFMVWIERLEEQRTMLLSIPNTGKFGGATGNFNAHLCAYPGVNWLEFGELFLSKYLGLRRQRYTTQIEHYDNLAAICDACARLHTILMDLAKDVWQYISLGYFDQKVKAGEVGSSAMPHKVNPIDFENAEGNLGMSNAVLGFLSAKLPISRLQRDLTDSTVLRNLGVPLSHALIAFASLQRGIGKLLLNKDVIAADLEGNWAVVAEGIQTVLRREGYPKPYEALKDLTRGNAHVTEETVHRFIQQLEGITEEVRQELLAITPFTYVGYTARP

SEQ ID NO: 3231 - DNA, 1356 bp, Bradyrhizobium japonicum
  CDS (1)..(1356)
atgagcacagccctctcccccctgcttgcgccgatgctgtcgagcgccgccatgcgcgccgcctgcgacgaccggtcaacgctccagaacatgctcgattttgaggcagccttggcgcgcgccgaagccgccaccggcgtgattcccgcggccgccgtgggcccgatcgaaaccgcctgcaaggcggctacctttgacatcgccgcgctggccgaggccgcgacacggtccggcaatctcgcgattcccctggtcaaggcgctgaccgccaacgtcgcgaaggccgatgcggaggccgcacgctacgtgcattggggcgcgaccagccaggacgtcatcgacaccgcgaccatgctcacgctgcgcgccgccatcgacgcgctggatgccgacctcagccgcgccatcaagggttttgccgcactggcgcgcaatcatcgcaacaccgcaatggtggcgcggacctggctccagcacgcgctgccgatgccgttcggactcaaggccgccgaatatgccgcaagtcttgcccgcgcccgctgccgcctcaggcggctctcccgcgacggcctcgcgctgcaattcggcggcgcggccggcacgctcgcggccctcggcgacaaggggctcgtcgtcgcggagcgactggcgcaagagctcaacctgccgctgccggaagcaccctggcacacccatcgcgaccgcatcgcggaagccgcatcggcccttgcgattctcgccggaagctgcggcaagatcgcgcgcgacgtctcgctgatgatgcagaccgatgtcgccgaggcgttcgagccggccggcgaaggccgcggcggctcctcgaccatgccgcacaagcgcaaccctgtcgcagccgcaagcgcgctgggatgtgccaccatggccccgcagctcgccgcgacgatttttgccgcgcaggtacaggaccacgagcgcagcgccggcccctggcatgcggaatggccgacgctgcctcaactgatgctggtcacttcgggcgcgctcgccgccatcgtcgacatcgccgagggcctggacgtcgatgccgcgcgcatgcgcagcaatctcgatgcgacgcacgggctgatcatggccgaggcggtcacctttgcgctggccgagaggatcggcaagagcgatgcgcatcatctcatcgaggccgcgagcaagcgcgcggtcgccgagaagaagcatctgcgcgaggttctcgcggccgattcgcaggtcacagcgcatctttcgccggaaaaaattgcggcattgttcgagccgatggcctatcaaggggcttcccaagccatgatcgaccggctgctcgacagcctcgagcgagattga

SEQ ID NO: 3232 - protein, 451 aa, Bradyrhizobium japonicum
MSTALSPLLAPMLSSAAMRAACDDRSTLQNMLDFEAALARAEAATGVIPAAAVGPIETACKAATFDIAALAEAATRSGNLAIPLVKALTANVAKADAEAARYVHWGATSQDVIDTATMLTLRAAIDALDADLSRAIKGFAALARNHRNTAMVARTWLQHALPMPFGLKAAEYAASLARARCRLRRLSRDGLALQFGGAAGTLAALGDKGLVVAERLAQELNLPLPEAPWHTHRDRIAEAASALAILAGSCGKIARDVSLMMQTDVAEAFEPAGEGRGGSSTMPHKRNPVAAASALGCATMAPQLAATIFAAQVQDHERSAGPWHAEWPTLPQLMLVTSGALAAIVDIAEGLDVDAARMRSNLDATHGLIMAEAVTFALAERIGKSDAHHLIEAASKRAVAEKKHLREVLAADSQVTAHLSPEKIAALFEPMAYQGASQAMIDRLLDSLERD

SEQ ID NO: 3233 - DNA, 1383 bp, Buchnera aphidicola
  CDS (1)..(1383)
atgattgcatctccattatttgccatttctccaatagatgggcgctatagtagtaaagtaattaaattgcgtaatatttttagcgaatatgcttttttaaagtttagagtaacaattgaattactttggttaaaaaaaatatctttattacaggaatttaaaatagtttataataaagatgttttaaattgtttagatagaattattgataattttagtaaaaaagatgcgttagaaataaaaattttagaaaaaaaaactaatcatgacgttaaatcaatagaatattttttgcaaaaaaaaatttttaaatgtttaggcaatcatgatattttaggactagtacattttggttgtacttcagaagatattaacaatttggcttatgctctaatgctaaaagtgtctcgacgagatataattctacctttatggaataaaattatatttgaaataaaaaaaatagcattattacatcataatgtacctatgttatctcggactcatggtcaaccggccactccttcaactattggaaaagaattaattaattttgcctatagattagaacgtcagttaaagcagtttaagaatatagaaattttaggaaaaataaatggttcaactggaaattacaatgcacttcatttttctcattctagtgtggattggcataaaattagtcaagaatttgtgacttcacttggattgttttggaacccatatactactcaaatagaacctcatgattttatttcagaattttttagttgtttagcacgagttaatactattttaattaatttcaatagagatatttggggatatatttcattacaatattttaatcaaacacccaaattagacgagattggatcttctgtcatgccacataaaattaatccaattgattttgaaaactctgaaggtaatttagggttgtcaaatgcgataattagtcatttaatagaaaaattgccaatttctcgttggcaaagagacttaagtgattctacagttcttaggaatgttggtacggtaatagcttactctataattgcttatgattcaattattttaggattaaaaaaattaaaagtaaacacttctagattgttgcaagacttaaatcatcattgggaaatactagcagaacctattcaaaccgtaatgagaaaatatggaattaatgatacttataatgaattaaaaaacataactagaggaaaacgagtaacttctgatattattttaaaatatgtcaatagtttgaaaattcctaggaatgaaaaggaaaaattacttcaattaactccagaaaactatttaggtttatcctctaaattagttaaaatttttaataattcttcagaacttaaataa

SEQ ID NO: 3234 - protein, 460 aa, Buchnera aphidicola
MIASPLFAISPIDGRYSSKVIKLRNIFSEYAFLKFRVTIELLWLKKISLLQEFKIVYNKDVLNCLDRIIDNFSKKDALEIKILEKKTNHDVKSIEYFLQKKIFKCLGNHDILGLVHFGCTSEDINNLAYALMLKVSRRDIILPLWNKIIFEIKKIALLHHNVPMLSRTHGQPATPSTIGKELINFAYRLERQLKQFKNIEILGKINGSTGNYNALHFSHSSVDWHKISQEFVTSLGLFWNPYTTQIEPHDFISEFFSCLARVNTILINFNRDIWGYISLQYFNQTPKLDEIGSSVMPHKINPIDFENSEGNLGLSNAIISHLIEKLPISRWQRDLSDSTVLRNVGTVIAYSIIAYDSIILGLKKLKVNTSRLLQDLNHHWEILAEPIQTVMRKYGINDTYNELKNITRGKRVTSDIILKYVNSLKIPRNEKEKLLQLTPENYLGLSSKLVKIFNNSSELK

SEQ ID NO: 3235 - DNA, 1371 bp, Haemophilus influenzae
  CDS (1)..(1371)
atgcaactctctacactgaccgcactttcccctcttgatggtcgttatcaagataaagtaacgccattacgtgctatttttagcgaattcgggttaatgaaattccgtgtagctgtggaagttcgttggttacaaaaattagcttcaacggcagacattaccgaagtaccgccattttctacgcaagcaaatgcttttttagatggaattgtggctaattttaatgaggccgatgctgcgcgtattaaagaaattgaacgcacaactaatcacgatgtgaaagccgttgagtattttctgaaagagaaaattcaaaacgaagtggaactagtgaaggtttctgaatttattcacttcgcttgcacctcagaagatattaacaatctctctcacgcattaatgttaagcaccgctcgtgacgaagtgattttaccagaatggcaaaaactgattgatgaaattactcgtcttgcagaagaatataaaacgattccattactttctcgcacacatggccagccagcttcaccaagcaccgtgggcaaagaaatggcgaatgtcgtttaccgcctaaaacgtcaatttaaacaactccaaaatgcggaaatcttaggtaaaatcaatggtgcagtaggtaactacaatgcgcatttatcggcatatcctaatattgattggcataaattcagcgaagaatttgtcacttcattaggtattcaatggaatccttataccacacaaattgagccgcacgattacatcactgaattttttgatgctgtagttcgctttaataccattatcattgattttgatcgtgatttatggggatacattgcattaaatcactttaaacaacgaacgattgcaggcgaaattggttcttctaccatgccacacaaagtcaatccaattgattttgaaaactcagaaggcaatctaggattagccaatgcagtgatgacccatttaggtcaaaaattaccaatttctcgctggcagcgtgacttaacagattcaactgtattacgtaatttaggcgtaggattaggttattgtttgatcgcttatgcttcaacacgcaaaggcatcagtaaacttgaagtaaatcaaccgcacttattagaagaactcaatcaaaactgggaagttttggctgaaccaattcaaaccgtaatgcgccgctatggaatagaaaaaccttacgaaaaattaaaagaattaacgcgaggtaaacgagtgacagaacaggctatgcgtgaatttattgataagttggatattccacaagaagaaaaattacgtttacaaaaattaacacctgctacttatattggggctgcagtggaattagtagaaaaactatcatag

SEQ ID NO: 3236 - protein, 456 aa, Haemophilus influenzae
MQLSTLTALSPLDGRYQDKVTPLRAIFSEFGLMKFRVAVEVRWLQKLASTADITEVPPFSTQANAFLDGIVANFNEADAARIKEIERTTNHDVKAVEYFLKEKIQNEVELVKVSEFIHFACTSEDINNLSHALMLSTARDEVILPEWQKLIDEITRLAEEYKTIPLLSRTHGQPASPSTVGKEMANVVYRLKRQFKQLQNAEILGKINGAVGNYNAHLSAYPNIDWHKFSEEFVTSLGIQWNPYTTQIEPHDYITEFFDAVVRFNTIIIDFDRDLWGYIALNHFKQRTIAGEIGSSTMPHKVNPIDFENSEGNLGLANAVMTHLGQKLPISRWQRDLTDSTVLRNLGVGLGYCLIAYASTRKGISKLEVNQPHLLEELNQNWEVLAEPIQTVMRRYGIEKPYEKLKELTRGKRVTEQAMREFIDKLDIPQEEKLRLQKLTPATYIGAAVELVEKLS

SEQ ID NO: 3237 - DNA, 1299 bp, Streptococcus mutans
  CDS (1)..(1299)
atgatcaaccgttattcacgccctgagatggcgaacatttggagtgaagaaaacaagtaccgtgcttggttggaagtggaaattttggctgacgaggcttgggctgagttgggtgagattcctaaggaagatgtggccaagattcgcgagaaggcggattttgatattgaccgcattttggagattgagcagcaaacgcgtcacgatgtggtagcctttacccgtgcggtttctgagacgttgggtgaggagcgcaagtgggtacactttgggctgacctcaacagacgtggtggacacggcctacggctacctatacaagcaggctaacgccatcattcgtaaggacttggataatttcctcagtatcatcgctgataaggccaaagaacacaagtttaccatcatgatggggcgcacgcacggtgtccatgcggagccaacaacttttggtctcaagctggcgacttggtacagtgaaatgaagcgtaatattgagcgttttgaacatgctgccgctggtgtggaagctgggaaaatctctggtgctgttgggaactttgccaacattccgccctttgtggaaaaatatgtctgtgacaaattaggcattcgtgctcaggaaatttcaactcaagtcttaccgcgtgatttgcatgctgaatattttgccgtgctagccagcattgccacatcaatcgagcgcatggcgactgaaatccgtggtctgcaaaaatccgaacagcgtgaagtagaagagttctttgccaaggggcaaaaaggcagctctgctatgccccataaacgcaaccctatcggctctgaaaatatgacggggcttgcgcgtgtgattcgcggacacatggtgacggcctatgaaaatgtgtccctctggcacgaacgcgatatttcccactcatcagctgagcgcattatcgcgcctgatacgaccattctcattgactacatgctcaatcgctttggcaatatcgtgaaaaacttgaccgtcttcccagaaaatatgaagcgcaacatgggctctacctttggtctcattttcagccagcgtgctatgctgaccttaattgaaaaaggcatgacccgcgagcaggcttacgaccttgttcagcctaagactgcgcagtcttgggacaaccaagtggacttcaaaccgttgctggaagcagatccagagatcacgtctcgcttgagccaagaagaaatcgacgaaatctttaatccagtctactacaccaagcgtgtggatgaaatctttgaccggattggattgggagactag

SEQ ID NO: 3238 - protein, 432 aa, Streptococcus mutans
MINRYSRPEMANIWSEENKYRAWLEVEILADEAWAELGEIPKEDVAKIREKADFDIDRILEIEQQTRHDVVAFTRAVSETLGEERKWVHFGLTSTDVVDTAYGYLYKQANAIIRKDLDNFLSIIADKAKEHKFTIMMGRTHGVHAEPTTFGLKLATWYSEMKRNIERFEHAAAGVEAGKISGAVGNFANIPPFVEKYVCDKLGIRAQEISTQVLPRDLHAEYFAVLASIATSIERMATEIRGLQKSEQREVEEFFAKGQKGSSAMPHKRNPIGSENMTGLARVIRGHMVTAYENVSLWHERDISHSSAERIIAPDTTILIDYMLNRFGNIVKNLTVFPENMKRNMGSTFGLIFSQRAMLTLIEKGMTREQAYDLVQPKTAQSWDNQVDFKPLLEADPEITSRLSQEEIDEIFNPVYYTKRVDEIFDRIGLGD

SEQ ID NO: 3239 - DNA, 23 bp, artificial sequence
  primer
atggaattatcctcactgaccgc

SEQ ID NO: 3240 - DNA, 25 bp, artificial sequence
  primer
ttatttcagctcatcaaccatcgtg

SEQ ID NO: 3241 - DNA, 1563 bp, Escherichia coli K12
  CDS (1)..(1563)
atgcaaacacaaaaaccgactctcgaactgctaacctgcgaaggcgcttatcgcgacaatcccaccgcgctttttcaccagttgtgtggggatcgtccggcaacgctgctgctggaatccgcagatatcgacagcaaagatgatttaaaaagcctgctgctggtagacagtgcgctgcgcattacagctttaggtgacactgtcacaatccaggcactttccggcaacggcgaagccctcctggcactactggataacgccctgcctgcgggtgtggaaagtgaacaatcaccaaactgccgtgtgctgcgcttcccccctgtcagtccactgctggatgaagacgcccgcttatgctccctttcggtttttgacgctttccgtttattgcagaatctgttgaatgtaccgaaggaagaacgagaagccatgttcttcggcggcctgttctcttatgaccttgtggcgggatttgaagatttaccgcaactgtcagcggaaaataactgccctgatttctgtttttatctcgctgaaacgctgatggtgattgaccatcagaaaaaaagcacccgtattcaggccagcctgtttgctccgaatgaagaagaaaaacaacgtctcactgctcgcctgaacgaactacgtcagcaactgaccgaagccgcgccgccgctgccagtggtttccgtgccgcatatgcgttgtgaatgtaatcagagcgatgaagagttcggtggcgtagtgcgtttgttgcaaaaagcgattcgcgctggagaaattttccaggtggtgccatctcgccgtttctctctgccctgcccgtcaccgctggcggcctattacgtgctgaaaaagagtaatcccagcccgtacatgttttttatgcaggataatgatttcaccctatttggcgcgtcgccggaaagctcgctcaagtatgatgccaccagccgccagattgagatctacccgattgccggaacacgcccacgcggtcgtcgcgccgatggttcactggacagagatctcgacagccgtattgaactggaaatgcgtaccgatcataaagagctgtctgaacatctgatgctggttgatctcgcccgtaatgatctggcacgcatttgcacccccggcagccgctacgtcgccgatctcaccaaagttgaccgttattcctatgtgatgcacctcgtctctcgcgtagtcggcgaactgcgtcacgatcttgacgccctgcacgcttatcgcgcctgtatgaatatggggacgttaagcggtgcgccgaaagtacgcgctatgcagttaattgccgaggcggaaggtcgtcgccgcggcagctacggcggcgcggtaggttatttcaccgcgcatggcgatctcgacacctgcattgtgatccgctcggcgctggtggaaaacggtatcgccaccgtgcaagcgggtgctggtgtagtccttgattctgttccgcagtcggaagccgacgaaacccgtaacaaagcccgcgctgtactgcgcgctattgccaccgcgcatcatgcacaggagactttctga

SEQ ID NO: 3242 - protein, 520 aa, Escherichia coli K12
MQTQKPTLELLTCEGAYRDNPTALFHQLCGDRPATLLLESADIDSKDDLKSLLLVDSALRITALGDTVTIQALSGNGEALLALLDNALPAGVESEQSPNCRVLRFPPVSPLLDEDARLCSLSVFDAFRLLQNLLNVPKEEREAMFFGGLFSYDLVAGFEDLPQLSAENNCPDFCFYLAETLMVIDHQKKSTRIQASLFAPNEEEKQRLTARLNELRQQLTEAAPPLPVVSVPHMRCECNQSDEEFGGVVRLLQKAIRAGEIFQVVPSRRFSLPCPSPLAAYYVLKKSNPSPYMFFMQDNDFTLFGASPESSLKYDATSRQIEIYPIAGTRPRGRRADGSLDRDLDSRIELEMRTDHKELSEHLMLVDLARNDLARICTPGSRYVADLTKVDRYSYVMHLVSRVVGELRHDLDALHAYRACMNMGTLSGAPKVRAMQLIAEAEGRRRGSYGGAVGYFTAHGDLDTCIVIRSALVENGIATVQAGAGVVLDSVPQSEADETRNKARAVLRAIATAHHAQETF

SEQ ID NO: 3243 - DNA, 2984 bp, Rhizobium meliloti
  CDS (638)..(2827)
aacgaggacgagggcacgcggctgcgaacggtcgcgccattcaaggcgatcatcggcggcggctacagccaggaaaccttcggtgtcgatgtctcgacgacggtccgcagccatgccggacgataacgacagcgaaaccttcgatgcccccggctacggtctcgtggatatgaccgggtggtggacgcccgaaagcttcaagggattgagggtagaggccggggtctataacatcttcgacaagaagtatttcaacgcgctcggcgtacgtggcgtcgacctcgcctcatcgtccgctcagccgcgcgacttcgattccgaaccgggacgcacgttcaaagtctcgttgacgcaacgcttctgatcattcagcaagttccgacggtgtaaaggcggctcgtgttagccgccttttctcactctcttcctcttttttcccgcttgcgcgccagcgcaagccgcgctaacacttccgcccatggcaaacacgcagaacatttcgatctggtggtgggctcgctgaggcggccttgaccagtcatgcgtgattgagagatggagccgcccggagatttcgaggcggcttttttcgtattcgggccgcgtggaaagaccgggcttttacggagcgagacgaatggcagcggtaattctggaagacggcgcggagagttataccacgaagggtggcatcgtcgtcacccgcaggcggcgtgaggcatcctacagcgacgcgatcgccggttatgtcgaccggctggacgaacgccgcggcgcggtcttttcctcgaactacgaatatcccggccgctatacccgctgggacactgcggtggtcgacccgccgcttgccatctcctccttcggtcgctcgctctggatcgaagcctataacgaacgcggcgaagtgctgctggcgctgatcgccgaggatctgaagtccgttgccgacatcacgctcggctcacttgccgcccgccgcctcgacctcaccatcaacgagcccgatcgtgtcttcaccgaggaagagcggtcgaagatgccgacggtctttacggttcttcgcgcggtgacgaacctcttccactcggaggaggactcgaacctcggcctctatggcgccttcggctacgacctcgccttccagttcgatgcgatcgaactgaagctttcgcgtccggacgaccagcgcgacatggttctctttctgccggacgagatccttgtggtcgatcactatgcggccaaggcctggatcgaccgctacgatttcgccagggagaacctttcgaccgagggcaaggcagcggacattgctcccgagccgttccgcagcgtcgacagcatcccgccgcacggggatcaccgcccgggcgaatatgccgagctcgtcgtcaaggcgaaggaaagcttccgtcgcggcgatcttttcgaagtggtgccggggcagaaattctacgagcgctgcgaaagccgcccgtccgagatttccaaccggctgaaggcgatcaatccgtcgccctattccttcttcatcaatctcggcaaccaggaatatctcgtcggtgcttcgccggagatgttcgtgcgcgtttccggccggcgcatcgagacctgcccgatctccggtacgatcaagcgcggcgacgatccgatcgccgacagcgagcagatcctgaagctcttgaactcgaagaaggacgagtccgagctcaccatgtgctcggacgtcgaccgcaacgacaagagccgggtctgcgtgccgggctcggtcaaggtgatcggccggcgtcagatcgagatgtattcgcggctgatccacacggtcgatcacatcgaggggcgcctgcgcgacgatatggacgccttcgacgggttcctcagccacgcctgggcggtgaccgttaccggcgcgccaaagctctgggccatgcgcttcatcgagagccacgagaagagcccgcgtgcctggtatggcggcgcgatcggcatggtcggcttcaacggcgacatgaataccgggctgaccttgcgtaccatccgcatcaaggacgggatcgccgaggtgagggcgggtgcgacgctcctctatgattccaatccggaagaagaagaagccgaaaccgaactgaaggcctctgccatgattgcagccatccgcgacgcgaaatccgcaaacagcgccaaatccgcgcgcgatgtcgccgccgtcggcgccggagtcagcatcctgctcgtcgatcacgaggacagcttcgtccataccctcgcgaactacttccgccagaccggcgcgtccgtcaccaccgtgcgcacgccggtggccgaggaaatcttcgaccgggtcaagccggacctcgtcgtgctttcgcccggtcccggcaccccgaaggacttcgactgcaaggcgacgatcaagaaggcgcgggcgcgggacctgccgatcttcggcgtctgcctggggctgcaggcgctcgcggaggcctatggcggcgaccttcgtcaactggcgatcccgatgcatgggaagccctcgcgcatccgcgtgctcgaacccggcatcgtcttctccggcctcggcaaggaggtgacggtcgggcgctatcattcgattttcgccgatccgtccaacctgccgcgcgaattcgtgatcacggccgaaagcgaagatggtacgatcatgggcatcgaacacagcaaggagccggtggcggccgtgcagttccatccggaatcgatcatgacgctgggcggcgacgccggcatgcggatgatcgagaacgtggttgcccatctcgccaagcgggcgaagaccaaggcagcctgacctcctgcgcgtcggctggaccggctcgaggcattcgaccgtttgacaagcggcccgtgatcgcccatatggcgcccatgatccgcctgcgcgaaaacccgcgcgggcggttttgcatttgaatggccttgcatctgcaactcgtttgcatctgcag

SEQ ID NO: 3244 - protein, 729 aa, Rhizobium meliloti
MAAVILEDGAESYTTKGGIVVTRRRREASYSDAIAGYVDRLDERRGAVFSSNYEYPGRYTRWDTAVVDPPLAISSFGRSLWIEAYNERGEVLLALIAEDLKSVADITLGSLAARRLDLTINEPDRVFTEEERSKMPTVFTVLRAVTNLFHSEEDSNLGLYGAFGYDLAFQFDAIELKLSRPDDQRDMVLFLPDEILVVDHYAAKAWIDRYDFARENLSTEGKAADIAPEPFRSVDSIPPHGDHRPGEYAELVVKAKESFRRGDLFEVVPGQKFYERCESRPSEISNRLKAINPSPYSFFINLGNQEYLVGASPEMFVRVSGRRIETCPISGTIKRGDDPIADSEQILKLLNSKKDESELTMCSDVDRNDKSRVCVPGSVKVIGRRQIEMYSRLIHTVDHIEGRLRDDMDAFDGFLSHAWAVTVTGAPKLWAMRFIESHEKSPRAWYGGAIGMVGFNGDMNTGLTLRTIRIKDGIAEVRAGATLLYDSNPEEEEAETELKASAMIAAIRDAKSANSAKSARDVAAVGAGVSILLVDHEDSFVHTLANYFRQTGASVTTVRTPVAEEIFDRVKPDLVVLSPGPGTPKDFDCKATIKKARARDLPIFGVCLGLQALAEAYGGDLRQLAIPMHGKPSRIRVLEPGIVFSGLGKEVTVGRYHSIFADPSNLPREFVITAESEDGTIMGIEHSKEPVAAVQFHPESIMTLGGDAGMRMIENVVAHLAKRAKTKAA

SEQ ID NO: 3245 - DNA, 1365 bp, Salmonella typhimurium
  CDS (1)..(1365)
atgatgaagacgttatctcccactgttatcaccttaccctggcgtccggacgccgctgaacactattttgcgcccgtaaaccatttgccctgggcgatgctgctgcattcaggtgatgctattcatccctataaccgttttgatattctggtcgccgatcctgtcaccacactgaccacgcgcgcgcaggaaaccacggtatgtactgcgcgcacgactaccgtcactctcgacgatccgttacacgttttgcagactcaactggaggcgctgccttttcatcctcagcctgaccctgacttaccctttcagggcggcgcgctgggtctgtttggttatgatttagggcggcgtttcgaaattttgcccgatactgccgcgcgcgatatcgctttacccgatatggcgattggcctttacgactgggcgctgattgtcgatcaccaaaaacaggtggtgtcgctgataagctatcacgatgcagacgcccgatatcgctggctcaccagccagcgcgcgccgacccgcacgcccttcaggcttacctcagcctggcaatccaatatgacgcgttgcgagtatggcgagaagtttcgtcaggtgcaggcctggctgcacagcggggactgctatcaggtcaatctttcccagcgttttcaggcgagctacgagggtgatgaatggcaggctttcgaacgccttaaccgcgccaatcgcgccccgttcagcgcctttcttcgtttacatgacggcgccatattgagcctttctcccgagcgttttatccaactggagaatggtcatatccagacgcgcccgatcaaaggtacgcttccacggcttaacgatccgcaggcggatcgtcagcaggcgcagaaactggctaattcaatgaaagatcgcgctgaaaatttgatgattgtcgatttgatgcgtaacgatattggccgggtcgccgtaccaggttcggtgaaagtgccggaactgttcgtcgtcgaaccatttcctgccgttcaccatctggttagcaccattaccgcccgtttaccggactcgcttcatgctaccgacctgctgcgcgcggctttccccggcggctccattaccggcgcgcctaaagtgcgggcaatggaaattatcgacgaactggagccgcagcgacgcaacgcctggtgcggtagcatcggttatctgagtttctgcggcaagatggataccagtattactatccgcaccgtcacggcaacgcagggccaactctattgctcagccggcggcggtatcgtggccgatagcaacgaagaagcggaatatcaggaaacttttgataaagttaatcgtatcctgcacccactggagaactaa

SEQ ID NO: 3246 - protein, 454 aa, Salmonella typhimurium
MMKTLSPTVITLPWRPDAAEHYFAPVNHLPWAMLLHSGDAIHPYNRFDILVADPVTTLTTRAQETTVCTARTTTVTLDDPLHVLQTQLEALPFHPQPDPDLPFQGGALGLFGYDLGRRFEILPDTAARDIALPDMAIGLYDWALIVDHQKQVVSLISYHDADARYRWLTSQRAPTRTPFRLTSAWQSNMTRCEYGEKFRQVQAWLHSGDCYQVNLSQRFQASYEGDEWQAFERLNRANRAPFSAFLRLHDGAILSLSPERFIQLENGHIQTRPIKGTLPRLNDPQADRQQAQKLANSMKDRAENLMIVDLMRNDIGRVAVPGSVKVPELFVVEPFPAVHHLVSTITARLPDSLHATDLLRAAFPGGSITGAPKVRAMEIIDELEPQRRNAWCGSIGYLSFCGKMDTSITIRTVTATQGQLYCSAGGGIVADSNEEAEYQETFDKVNRILHPLEN

SEQ ID NO: 3247 - DNA, 1413 bp, Bacillus subtilis
  CDS (1)..(1413)
atggcacaacgcagaccggcaggcaaaaaaataccttttcaaaaagactcattcttacaacaatttgagaaacttgcgcaatcccggaaacatcatgtacttctcgaaagtgcaagaggcggcagatatagtatagccggtcttgatccaattgcgactgtgaaaggaaaagacggaataactacaattaagcatggtgatgagatgctgtttaaagaaggtgatccattacgggccttccacagctggtttaaaacactggaaacagaaacgaatcatgagttccctgactttcaaggcggggcaatcgggtttctcagctatgattacgcacggtacattgaaaattttaaaatgctctcattagatgatttagaaacaccagatatttattttcttgtttttgatgatatagcagtttatgaccatcaagaagagtctctatggctgattactcatgttaatggttctgatcaggaaacagcggatgtgaagctatctgagttagagcagatgtggttgactgagcttcccgctgtcacttcgcgagagatgaagcctgaaacagctggttctttcgcggcgccatttaccgaggatgggttctcacaagctgtagagaaaatcaaacaatacattgccagcggagatgtgtttcaagtcaatctatcaataaggcagtcacagtcactgtctgtccacccatatcaaatttacaaaaccttgagagaagtaaatccttctccttatatggcgtatttagaaacacctgatttccaaatcatttgcggatcgcctgaactgcttgtcagcaaaaagggcaagctattagagacgagaccgattgcgggcacccgttccagagggaaaacaaatgaagaagacgaggcgcttgcaaacgaattgatacacaatgaaaaagaacgcgcggaacatgtcatgctggttgatcttgagcgaaatgatctgggaagagtatcacgttacgggtctgtgcgcgtaaatgaattcatggcaattgaaaaatactcgcatgtgatgcacattgtgtctaatgtccaaggtgaactgcaggatgggtatgatgctgtagatattattcatgctgtgtttcccggaggaaccattactggtgcaccgaaagtaagaacgatggaaattatagaagaacttgagccgacacgccgagggctttatactggatctataggatggtttggatataatcacgatctgcagtttaatatcgtcattcgaaccatttatgcaaccggagggcaggcatttatgcagtccggtgcaggagttgtgattgattctgttccgaagcacgaatacaaggaatcattcaaaaaagcttttgcgatgcaaagagcattagagctgagcgaagaagagacaaaaattagatga

SEQ ID NO: 3248 - protein, 470 aa, Bacillus subtilis
MAQRRPAGKKIPFQKDSFLQQFEKLAQSRKHHVLLESARGGRYSIAGLDPIATVKGKDGITTIKHGDEMLFKEGDPLRAFHSWFKTLETETNHEFPDFQGGAIGFLSYDYARYIENFKMLSLDDLETPDIYFLVFDDIAVYDHQEESLWLITHVNGSDQETADVKLSELEQMWLTELPAVTSREMKPETAGSFAAPFTEDGFSQAVEKIKQYIASGDVFQVNLSIRQSQSLSVHPYQIYKTLREVNPSPYMAYLETPDFQIICGSPELLVSKKGKLLETRPIAGTRSRGKTNEEDEALANELIHNEKERAEHVMLVDLERNDLGRVSRYGSVRVNEFMAIEKYSHVMHIVSNVQGELQDGYDAVDIIHAVFPGGTITGAPKVRTMEIIEELEPTRRGLYTGSIGWFGYNHDLQFNIVIRTIYATGGQAFMQSGAGVVIDSVPKHEYKESFKKAFAMQRALELSEEETKIR

SEQ ID NO: 3249 - DNA, 1449 bp, Spirochaeta aurantia
  CDS (1)..(1449)
atgtttctatttgtagaaacaatccgaccccagcaacgaggagagtctcttttggaaaccgtcatcaaggtcgtccccggcgaacgcttcactccctacggcctggccctcaaactcggcgcccgggtggtgctcgagtcgtcgtcctcgaagaagggacgagaccggtactcgctcctgctcctccaggaagcctttcgggtggcccaggagggcaccgaggtctacttcgtgaaagacggccgtcggtcgaaggtgaaggccaaccacagggacatcctcgacgtgctcatgtacttcgcccgccaacactccgacccgggccaggacttcccgtttcccgccggtggagtggggtacctgagcttcgagttctgccggtactgcgacaccatccacctgaatcccgccaagcccgaccccctcgagttgcccgacgccctgttcctgtttggccacgtgttcctcatctacgaccattacaccgacctgatctacctcgtcggcctcaactacaaagaagcctccatcgacctcgaggccgccctggccgcggtcgaggcgagggtgaacgacggcgactggtcggccctggggtcggtgggtgccccctacgacgccgaggttctgccccaggactacgaccccgacgagacctacaaggccaacgtcggcgccatgcgccaagaggtcatcgccggaaacctcctccagggcgtgcccagccggcggctcctcgtgaagaccgaaatgcccgccatcgaggcctaccggaggctgcggtcgtccaacccctcgccgtacatgttctacctcgactttggagactaccagctctttcgcgccagccccgaactgcacgtgaaggtgaagggcggcaccgccgagatccgccccatcgccggcacccgacgccggggggccaccgacgccgaagaccgggccctcgaggccgaactcttggccgacgtgaaggagagggccgagcacctcatgctcgtcgacctcgcgcgcaacgacctgggacgcatctgccaacccggcaccgtccaggtgaaggacagctacttcatcgagcgctacagccacgtcatgcacatcgtcagctcggtggaaggccgactcaaggacgacaagaccggcatcgacgccctcagggcctcgttccccgccggaaccgtttcgggggcccccaagatccgggccatcgaagtcatcgaccgactcgaacccgtccagaggcgcttctactcgggcgtcgtcggccacctcagccccgacggcagcctcgacacctgcatcgccatccggtcggccctcaagaagggcgacaccatggtgctccaggccgggggcggcatcgtcttcgactccaaccccgaccgcgagctcgaagagacctacgaaaagatgagggccacggcccgaagcctgggactggagatctag

SEQ ID NO: 3250 - protein, 482 aa, Spirochaeta aurantia
MFLFVETIRPQQRGESLLETVIKVVPGERFTPYGLALKLGARVVLESSSSKKGRDRYSLLLLQEAFRVAQEGTEVYFVKDGRRSKVKANHRDILDVLMYFARQHSDPGQDFPFPAGGVGYLSFEFCRYCDTIHLNPAKPDPLELPDALFLFGHVFLIYDHYTDLIYLVGLNYKEASIDLEAALAAVEARVNDGDWSALGSVGAPYDAEVLPQDYDPDETYKANVGAMRQEVIAGNLLQGVPSRRLLVKTEMPAIEAYRRLRSSNPSPYMFYLDFGDYQLFRASPELHVKVKGGTAEIRPIAGTRRRGATDAEDRALEAELLADVKERAEHLMLVDLARNDLGRICQPGTVQVKDSYFIERYSHVMHIVSSVEGRLKDDKTGIDALRASFPAGTVSGAPKIRAIEVIDRLEPVQRRFYSGVVGHLSPDGSLDTCIAIRSALKKGDTMVLQAGGGIVFDSNPDRELEETYEKMRATARSLGLEI

SEQ ID NO: 3251 - DNA, 1389 bp, Methanobacterium thermoautotrophicum
  CDS (1)..(1389)
atgggagtgaatgtttttaaaattataaacctggaaaaacccagaaaagaaaaactggaattccgagaaccctttgaagtattcaaaagtatctattctgaatatgagtcttcattccttcttgagtccatggaaagtgacactggacttgcaaggtactccttcattggatttgaacctgagatgataataagggcccgtgaaggggtcattgagattgatgatggcgattccagggaggagtttgattcaaaaaacccattcgaggacctcaggggattcctgaagatggaaaaaaactccggaggattctgcgggggactcgtgggttacatatcctatcaggccgcaaggttctttgacacaatcaggctcagtgaaggtgatttccccgacttcgaatttggactcttccttgatggtatcatgttcaaccacctgacaggggaatgcagctacatcagccgccacggcaacagactacctgatatatcccctctccttggggatgaggtccccacagggaccctgggatacaggagggaaagaacactcctctcaaagaggaggtacatggacatggtccttgaggccaaggagagaataagggagggtgaaatatttcaggcagtgctctccagtgccacagattacaggctgaggggagacaggctcgcattctatgaatccctcaggaggataaacccctcaccatacatgtaccaccttaaactgggtgaacgggagataaccggctcaagccccgagatgcttgtcagggttgaagatagaaggattgaaacatttcccattgcaggaacacgccctcgtggaaggacagaagaggaggacggggtgatagcatctgatcttttatctgatgaaaaggaacaacttgcagagcacctcatgctggttgacctggcccggaacgatatagggcgggtatcggagttcggatcggtggaggtacctgaatacatgaccataaagaggttctcccatgtgcagcacatactctcccatgtaacaggtaaactgagggatggaatggacgcagttgatgcactgggagctgtttttcctgcaggcacagtgagcggcgcaccaaagataagggcaatggagataatagagtcccttgaaggtgttccaagaaatgcctatgcaggcgcactaggctacctctcactcaatggaaacgcggacttcgcaataaccataaggtcaatggtatgccaggggaaaacagggagaatccaggcgggagcaggaatagtgcatgactccatccctgagatggaatatctggagtgccagaataaggcgagggcccttctaaaatcaatggagatggcaggtgaacaagttgatccttataatcgataa

SEQ ID NO: 3252 - protein, 462 aa, Methanobacterium thermoautotrophicum
MGVNVFKIINLEKPRKEKLEFREPFEVFKSIYSEYESSFLLESMESDTGLARYSFIGFEPEMIIRAREGVIEIDDGDSREEFDSKNPFEDLRGFLKMEKNSGGFCGGLVGYISYQAARFFDTIRLSEGDFPDFEFGLFLDGIMFNHLTGECSYISRHGNRLPDISPLLGDEVPTGTLGYRRERTLLSKRRYMDMVLEAKERIREGEIFQAVLSSATDYRLRGDRLAFYESLRRINPSPYMYHLKLGEREITGSSPEMLVRVEDRRIETFPIAGTRPRGRTEEEDGVIASDLLSDEKEQLAEHLMLVDLARNDIGRVSEFGSVEVPEYMTIKRFSHVQHILSHVTGKLRDGMDAVDALGAVFPAGTVSGAPKIRAMEIIESLEGVPRNAYAGALGYLSLNGNADFAITIRSMVCQGKTGRIQAGAGIVHDSIPEMEYLECQNKARALLKSMEMAGEQVDPYNR

SEQ ID NO: 3253 - DNA, 1572 bp, Haloferax volcanii
  CDS (1)..(1572)
atgacggcccccgacaccgaccgcgaggagttcgtctccctcgccggcgacgcggacggaccggtcgtgacccacctcgtggccgacctcgacgtgtccgtggacccgctggccgcgtacacgacgctcgcggaccgcagcgactacggcttcctcctggagagcgccgagaaggtctcctcgagcaacccgcaggcgcgttctccgcgcccgcgcacggccgccgactcccacgcgcgcttctcgttcgtcggctacgaccccgaagcggtcgtgacggtcggtcccgacggcgtcgacgtgaccgacctcggcggccccgccgcggagttcgtcggcgcgggcgacggcgacgtgctcgattccctgcgcggcgcgctccccgacctcccgcgcgtcaacttccccgagacggacgcagacgtcaccggcgggctggtcggcttcctcgcctacgaggccgtctacgacctctggctcgacgaggtcggccgcgagcgccccgacacggacgacccggacgccgagttcgtcctcacgacccggaccctctcgttcgaccaccgcgaggacgccgtccgcctcgtctgtacccccgtcgtctcgcccgacgacgaccccggcgaggtgtacgacggcgtcgtcgccgaggccgagcgcgtcgcggaaaagctccgcgcggcggacgaccccgcccccggcggcttcgagcggaccggcgaggacgccggctcccgcgaggagtacgaggccgcggtcaggaagacgaaagaacacgtccgcgacggcgacatctatcagggcgtcatctcgcgcacccggaagctccgcgggcaggtcgacccggtcggtctgtacgcctcgctgcgcgaggtgaacccctcgccgtacatgttcctgctccggcacggcgaccggcgcgtcgtcggcgcgagccccgaaacgctcgtctccgtcaggggcgaccgcgtcgtcgtcaaccccatcgcggggacgtgccagcgcgggtccggcccggttgaggaccgccgcctcgccggcgaactcctcgcggacgcgaaagagcgcgccgagcacacgatgctcgtcgacctcggccgcaacgacgtgcgccgggtctcgacgcccgggagcgtccgcgtcgaggacttcatgagcatcatcaagtacagccacgtccagcacatcgaatcgaccgtctcggggacgctcgacgccgacgccgacgccttcgacgccacgcgagcgacgttccccgcggggacgctcaccggcgcgccgaaggtccgcgcgatggagattatcgacgacctcgaagccgagccccgtggcgtctacggcggcggcgtcggctactactcgtggaccggcgacgccgacgtggcaatcgtcatccgaaccgcgacggtcgactccggcggcgcggacgacgccatcaccgtccgcgcgggtgccggcatcgtcgccgactccgacccgaccgcggagtacgaggagacggaacagaagatgggcggggtgctcgacgccgtccgccgcatcgagtacgggaccgaggaggcgtcgcaatga

SEQ ID NO: 3254 - protein, 523 aa, Haloferax volcanii
MTAPDTDREEFVSLAGDADGPVVTHLVADLDVSVDPLAAYTTLADRSDYGFLLESAEKVSSSNPQARSPRPRTAADSHARFSFVGYDPEAVVTVGPDGVDVTDLGGPAAEFVGAGDGDVLDSLRGALPDLPRVNFPETDADVTGGLVGFLAYEAVYDLWLDEVGRERPDTDDPDAEFVLTTRTLSFDHREDAVRLVCTPVVSPDDDPGEVYDGVVAEAERVAEKLRAADDPAPGGFERTGEDAGSREEYEAAVRKTKEHVRDGDIYQGVISRTRKLRGQVDPVGLYASLREVNPSPYMFLLRHGDRRVVGASPETLVSVRGDRVVVNPIAGTCQRGSGPVEDRRLAGELLADAKERAEHTMLVDLGRNDVRRVSTPGSVRVEDFMSIIKYSHVQHIESTVSGTLDADADAFDATRATFPAGTLTGAPKVRAMEIIDDLEAEPRGVYGGGVGYYSWTGDADVAIVIRTATVDSGGADDAITVRAGAGIVADSDPTAEYEETEQKMGGVLDAVRRIEYGTEEASQ

SEQ ID NO: 3255 - DNA, 1305 bp, Pyrococcus abyssi
  CDS (1)..(1305)
atgcacgtcaagaagctagagcgcgttgaaccgataaagctgtacagcgtaataagagaattcgaaaacccctttatattcacgataatagggaaagatagtaaagaggctaagctaacctacatctcagcatcaccagaatttaccgttgagatatctggaaagggaacattcctcgacggtaagaaagtatcaaatgaaacgaatccctttctatctttaaaatccttcaacatggactccgcaagtggaagtggatttcttggaggattcatggggtacatagcatacgatgcagttcacaattatatcgaggggagcatagaggaaccatcagttttcgggtactatccatgggtttttatttacaatcacgggaagggagaattacgcttttactacttaagggatccatcctttgatccagagacgatagttgaaagggcgaaaagagaagaactcaagttcgagaatggtggtgccgagataataaggaccgatgccaacagggaagagttcatggagatggttgagaagggaaaagagtacatctttgcaggagatgtattccaagttgtgctttcaagggagtacgtgcttaggagtgacgtcgatccagtggagctatatcgaaagctcatctcgataaacccatctccttacaccttcatcctagaattcaagaagatattagttggagcatcaccagaaactatgggatcagttgaggggaggacagttaggataaatcccatagctggcaccgctccaagggggaaaactccagaggaagatgaggagataagaaggagactcctaagcgacgagaaggagagggccgaacatgttatgctagtggatttagctaggaatgacgtaaggaaggtttcaaagcccggaagcgtgaagctcgttagatttttcgatgtaataaagtacagccacgtccagcatattgagagtgaggttataggagagctagctgacgataaagatatgttcgatgcaatagaagcatcatttccagccggaaccctaactggagcccccaagataagggccatggaaataatagacgagcttgagaagagcaggaggagagtttacggtggagccataggatacttctcaataacagggtacgccgactttgcgatagcgataaggatggcagaaatagagggtagaaaagcccatgttagggctggggctggcattgtagctgattcaatccccgagaaggaattttacgaaacggagaataagatgaaggctgttctcaaggcattcggggtgattcaatga

SEQ ID NO: 3256 - protein, 434 aa, Pyrococcus abyssi
MHVKKLERVEPIKLYSVIREFENPFIFTIIGKDSKEAKLTYISASPEFTVEISGKGTFLDGKKVSNETNPFLSLKSFNMDSASGSGFLGGFMGYIAYDAVHNYIEGSIEEPSVFGYYPWVFIYNHGKGELRFYYLRDPSFDPETIVERAKREELKFENGGAEIIRTDANREEFMEMVEKGKEYIFAGDVFQVVLSREYVLRSDVDPVELYRKLISINPSPYTFILEFKKILVGASPETMGSVEGRTVRINPIAGTAPRGKTPEEDEEIRRRLLSDEKERAEHVMLVDLARNDVRKVSKPGSVKLVRFFDVIKYSHVQHIESEVIGELADDKDMFDAIEASFPAGTLTGAPKIRAMEIIDELEKSRRRVYGGAIGYFSITGYADFAIAIRMAEIEGRKAHVRAGAGIVADSIPEKEFYETENKMKAVLKAFGVIQ

SEQ ID NO: 3257 - DNA, 1572 bp, Vibrio cholerae
  CDS (1)..(1572)
atgaataaggccatcaacataaagaaaaccgcgccgcttgaggtgctacacagtgaattgccttatacgcaagatcctacggctttatttcatgctctttgcgctgggcgcagcgactgcctactactggaatctgcagaaatcgactccaagcaaaatttgaagagccttctgttagtggatgctgccgtgcgcattgtgtgtgaaggccatcaagtgacctatcatgcgctcagtgcaaacggccaagcgctgctcaacatcattcatagcaacctcactgatcggattccttgcaaagtagagaaagcgaaacttaccctcaccttctctacaccctgtgatacgttggatgaagactcacgattgcgcgaagcgtcttctttcgatgcgctacgtttagtgcagcacagttttgatctcactgaccacggtaaatttgcgctgtttttaggtggcttatttgcctacgatttagtggctaactttgaaccgctcggtgaagcacctgccgacaatcaatgccctgattacgtattttatgtagcagaaactctgatggtgattgatcatcagcgtgaaacttgccaactgcaagccacccaattccaaccgggcgatgcgctgcacagccaactcaaaagccggatgcgtgaaattcgtgcgcaagtgaatcaaaaattgcctttgccgagtgcgcaatctttatctgatgtggaagtgaccaccaatattagcgatgcagcattttgcgatatcgtgcgtgacctcaagcagtacgtggtcaaaggcgatgtgttccaagttgtgccttcgcgccgttttcgcttaccttgcccttcaccactcgcagcttatcaacggctgaaacagagtaacccaagcccttacatgttctacatgcaagatgaacgctttaccctgtttggcgcatcccccgaaagcgcactcaagtatgaaatgcacaccaaccaagtggaaatctacccgattgcagggactcgccgccgcggtaagcgcgccgatggcagcatcgattttgacctcgatagccgcattgagcttgaactgcgcaccgataaaaaagagaacgccgaacacatgatgctggttgacttagcacgcaacgatgtcgcgcgcattagccaagccggtactcgccatgtcgctgacttgctgcaagtagatcgctacagccatgtgatgcacttggtgtcgcgcgtggtgggtcagttacgtgaagatctggatgcgctgcatgcttatcaagcttgcatgaacatgggcacgctgactggcgcaccgaaaattcgcgcgatgcagttaatccgcgatgtggaacaagcgcgtcgcggcagctacggcggcgcggtgggttatctcacgggtgaaggcgatttggatacctgtatcgtgatccgttctgcttatgtggaaaacggcatcgcccaagtccaagctggcgcgggtgtcgtttacgactccgacccacaagccgaagccgatgaaacgcgcggcaaggcgcaagcggtaatctccgctattttatatgctcatcaagggaaggaatga

SEQ ID NO: 3258 - protein, 523 aa, Vibrio cholerae
MNKAINIKKTAPLEVLHSELPYTQDPTALFHALCAGRSDCLLLESAEIDSKQNLKSLLLVDAAVRIVCEGHQVTYHALSANGQALLNIIHSNLTDRIPCKVEKAKLTLTFSTPCDTLDEDSRLREASSFDALRLVQHSFDLTDHGKFALFLGGLFAYDLVANFEPLGEAPADNQCPDYVFYVAETLMVIDHQRETCQLQATQFQPGDALHSQLKSRMREIRAQVNQKLPLPSAQSLSDVEVTTNISDAAFCDIVRDLKQYVVKGDVFQVVPSRRFRLPCPSPLAAYQRLKQSNPSPYMFYMQDERFTLFGASPESALKYEMHTNQVEIYPIAGTRRRGKRADGSIDFDLDSRIELELRTDKKENAEHMMLVDLARNDVARISQAGTRHVADLLQVDRYSHVMHLVSRVVGQLREDLDALHAYQACMNMGTLTGAPKIRAMQLIRDVEQARRGSYGGAVGYLTGEGDLDTCIVIRSAYVENGIAQVQAGAGVVYDSDPQAEADETRGKAQAVISAILYAHQGKE

SEQ ID NO: 3259 - DNA, 1359 bp, Xylella fastidiosa
  CDS (1)..(1359)
atgacactcattcgatttctgcgtatggatcccgatttattgtccatgcacaggttggcaccggagcgttatccggcgctttttgaatctactgcttctggtactcagcagagtcgctgggatgtgttgttgcatacagatggtcgtttcttccgtttggattccgatggtgtaacacgcgatgctcagggcagggcgctgtccggagactttttgcaggtattggatgcagtgtggagcactgagtacgtgctgcgtgatacgtgtgaggatgctcctccattccgtggtggttgggctttacttcttgactatgaactagctgggcaggttgagccagtgttgaaattgccggtgcgtactgatggtttgcctatggcgttagcgttgcgttgtccggcagcggtattacgtgaccgccacagtggtgtttttttgattgtcgctgagctggggaatgagcatttactggacgtgattgaggcggatttggctgctcttgccttgttgccgccattgccggtttggcgatcgccagtggccgtcactgaggatgagccgtcgcagtttattgccaatgcagagcgtgtgctggattaccttcgtgagggagacgtgttccaggcaaatatctcacgcctttgggaagctcgctttaccactgcacttgatccagcagcgttatacatgcgtttgcgtgtagccaatcctgcgcctttctcgggattgtttgtggctcatggccgagctgtggtgagctcctcaccagagcggttgatttcggtgcaaggagcgcgcattcagacgcgtccgattgctggtacccggccacgttttgtcggtgacgatgacgcagcacgcatccgcgaactggtgaatcaccctaaggagcgtgctgagcatgtgatgttgattgacttagagcgtaacgatttagggagagtgtgtgtgcctgggaccgttgaggtcgatgagttgatgacggtggaaagctatgcgcatgtccatcatatcgtcagtaatgtgcgtggctggttgcctacgggcaggaccccaggggagatcattcgtgccgtgtttccgggggggaccattactggttgtccgaaggtgcgttgcatgcagatcattgcccagctcgaacaggtggcacgcggtgcctacactggtgcctttggatggctcaattgtgatggtgatttggacctgaacattttaatccgcactgctgagattgacggtgtgactgtacgtttccgtaacggtgccggcatcgtgatcaattcactgcctgagcgtgagctggatgagacccgtgccaaggccactggcgtactgcgcgccctgcatgtcatctga

SEQ ID NO: 3260 - protein, 452 aa, Xylella fastidiosa
MTLIRFLRMDPDLLSMHRLAPERYPALFESTASGTQQSRWDVLLHTDGRFFRLDSDGVTRDAQGRALSGDFLQVLDAVWSTEYVLRDTCEDAPPFRGGWALLLDYELAGQVEPVLKLPVRTDGLPMALALRCPAAVLRDRHSGVFLIVAELGNEHLLDVIEADLAALALLPPLPVWRSPVAVTEDEPSQFIANAERVLDYLREGDVFQANISRLWEARFTTALDPAALYMRLRVANPAPFSGLFVAHGRAVVSSSPERLISVQGARIQTRPIAGTRPRFVGDDDAARIRELVNHPKERAEHVMLIDLERNDLGRVCVPGTVEVDELMTVESYAHVHHIVSNVRGWLPTGRTPGEIIRAVFPGGTITGCPKVRCMQIIAQLEQVARGAYTGAFGWLNCDGDLDLNILIRTAEIDGVTVRFRNGAGIVINSLPERELDETRAKATGVLRALHVI

SEQ ID NO: 3261 - DNA, 1464 bp, Xylella fastidiosa
  CDS (1)..(1464)
atgcagtttcagcgtcaagttgccgaagggtgtacccgcattccagtggtgcgtgaagtccagtctgatttggatactccgctttcggtctatctaaaatttgccgatgctccatatacctatttgtttgagtcggtggaaggtggggagcattttgcgaggtattcgatcattgggttgccggcacgccgtgtctatacctttcatgggcataccctggtggtgagtgagttcggtaaggtgttggaaacgcgtcaagtcgccgatccgcttgccgaagttgagctgttgcgtgcgcagtatgtagtgccgcaattagaagggttgccaggttttacaggcggcttagtggggtggttcggctttgaatgtatccagtacatcgaacctcgcttcatggaaggtaaaaaacgtgatgaacttggtacgccagatattctgctgatgctttcggaagaattggcggtgttcgacagcctcaagggccgattatatttgatcgttcatgcggatcctgcgcaaccacacgcttacgctcgtgcagtggaacgtttggatgtgttgatctaccgtctgcggcaaggtggggtggattatccgcattcacatatttcggaagtgattaacgaggaagattttcactcttctttgacccgtgagcagtatcacgctgtggtgcgtcaggcgcaggagtatgtgcgttcgggtgatatttttcaggttgtaccaagtcagcgcctgtgtacgcagtttcatgcacgtccgattgatgtatatcgggcgttgcgcacgctgaatccgtcgccttatatgtatttcattgatattggtgctactcaggtggttggttcatcaccggagatattggcgcgattgcagggggatgtggtcacggtgcgtccgattgccggcacacgcccgcgaggtgcgactccggagcatgacaaacggttggaaatggagttgttagccgatccaaaagagcgtgctgaacacgtgatgctgattgatttgggtcgcaatgatatcggacgtgttgtcgaggcggggagtgtacaagtcaaggagtcgtttgtaatcgagcgttatagtcatgtcatgcatattgtcagtgaggtcaccggtatcttgaagccgggtttgaactacgttgatgtgttacgtgcaacgttccctgcgggtactgtgtccggcgcgccaaagatccgtgcattggagattatccgtgagttggaaccagtgtgtcgcaacgtatattccggtgcagtgggttacattggctggcatggagatgctgatactgcaatcgcgattcgtactgcggtgattcaaaacggttgcctgtacgtgcaggctggtggtggtgtggtgtatgactcggatccagatttggagtggcaggaaaccatgaacaaggcgcgtgcattatttagggctgtggcgcaggcggccagagggttgtga

SEQ ID NO: 3262 - protein, 487 aa, Xylella fastidiosa
MQFQRQVAEGCTRIPVVREVQSDLDTPLSVYLKFADAPYTYLFESVEGGEHFARYSIIGLPARRVYTFHGHTLVVSEFGKVLETRQVADPLAEVELLRAQYVVPQLEGLPGFTGGLVGWFGFECIQYIEPRFMEGKKRDELGTPDILLMLSEELAVFDSLKGRLYLIVHADPAQPHAYARAVERLDVLIYRLRQGGVDYPHSHISEVINEEDFHSSLTREQYHAVVRQAQEYVRSGDIFQVVPSQRLCTQFHARPIDVYRALRTLNPSPYMYFIDIGATQVVGSSPEILARLQGDVVTVRPIAGTRPRGATPEHDKRLEMELLADPKERAEHVMLIDLGRNDIGRVVEAGSVQVKESFVIERYSHVMHIVSEVTGILKPGLNYVDVLRATFPAGTVSGAPKIRALEIIRELEPVCRNVYSGAVGYIGWHGDADTAIAIRTAVIQNGCLYVQAGGGVVYDSDPDLEWQETMNKARALFRAVAQAARGL

SEQ ID NO: 3263 - DNA, 2760 bp, Arabidopsis thaliana (mouse-ear cress)
  CDS (7)..(2760)
atgaacatgaatttttcgttttgttcaacatcttctgagttatcatatccaagtgagaatgttctgagattttctgttgcaagtcggctgttttctcctaaatggaagaaaagtttcattagtttaccttgtcgtagtaaaactacgaggaaggttttggcgtcaagccgttatgtgccagggaaattggaagatttgtcggttgttaagaagagtttaccgagaagagaacctgtggagaagcttggttttgtgaggactttgttgattgataattatgatagttatacattcaatatatatcaggctctgagtactattaatggagtgcctcctgtcgttattcggaatgatgagtggacgtgggaagaagcttaccattacttatatgaagatgttgcttttgataatattgttatatcgcctggacctggttcgcctatgtgtccagctgatataggaatatgtcttcgtcttttgcttgaatgccgtgatatcccaattctaggcgtctgccttggccaccaggcactaggttatgtccatggagctcatgtggtgcatgccccggaaccagtccatggacggttgagtgggattgaacatgatgggaacatattgttttctgatattccatccgggagaaactctgattttaaggttgttagataccattcactgatcatagataaggaatcactaccaaaggaacttgtaccaatagcgtggacgatttatgatgacactggctctttctctgagaagaattcctgtgttcctgtgaataacactgggagcccacttgggaacggatctgtcattcctgtttcagaaaagttagaaaatcgaagtcattggccttcgtcccatgttaatgggaaacaagatagacacattctcatgggcatcatgcattcttcttttccccattatggtttacagtttcatccagaaagtattgctactacctatggtagtcagttatttaaaaatttcaaggacataactgtgaattattggagtcggtgcaaatctacatccctgcgtcgaagaaacataaatgacactgcaaacatgcaggtgcctgatgctactcaattgctgaaagaactttctagaactagatgtacaggaaatggttctagctattttgggaaccctaagtctctgttttctgccaagacaaatggtgtagacgtctttgatatggtggattcatcatatccaaaaccacatacaaaattgctgaggttgaaatggaagaagcatgaacgtcttgcgcataaagttggtggagtaagaaatatatttatggaactctttggcaagaatagaggaaatgatactttttggctggatacttcttctagtgacaaggctagaggacgattttctttcatgggcggtaaaggtggatctctctggaagcaattgacatttagtttatctgatcaaagtgaggttacatcaaaacatgcgggacatcttctgattgaagattctcagagttctactgagaaacaattcttggaagaaggctttcttgattttctccgtaaggagctttcatctatctcttatgatgagaaggacttcgaagagttgccttttgatttttgcggtggatacgtaggttgtattgggtatgatattaaagtggaatgtggaatgccaattaatcgtcacaaatccaacgctccagatgcatgtttcttctttgcggataatgttgtcgccattgatcatcaactcgatgacgtttatatattatcgctttacgaagagggaactgcagaaacctctttcctgaatgatactgaagagaagctcattagcttgatgggtttgtccacaagaaagttggaggatcaaactcttccagttatagattcatctcaatccaaaacaagttttgttcctgacaaatcccgagagcagtatatcaacgatgttcagagctgtatgaagtatatcaaagacggggagagctacgagctttgtctcactactcaaaacagaaggaaaataggaaatgctgatcctttgggactttatctccacctgagagagaggaatccagcaccatatgcagcatttctcaacttctcaaatgcaaatctgtctttatgctcttcgtcccctgaaaggtttcttaagctggacagaaatggaatgcttgaagcaaagccgattaagggtactatagctcgtggctccacgcctgaagaagatgaatttcttaaattgcaattgaaactcagtgagaagaatcaagccgagaatctgatgattgttgaccttctaaggaatgatctcggtcgtgtctgtgagcctggctcagtccatgtacctaacctcatggatgtagaatcatacacaacagtacatacaatggtgagcacgatccgtggactgaaaaaaacagatattagtccagtggaatgtgtaagagctgctttccctggcggttcaatgactggtgccccaaaactaagatctgttgagattctcgattctctagagaactgttcgagaggcctttactctggctcaatcgggtatttctcgtataatggtacgtttgatctgaatattgtgataagaacagtaataatacatgaagatgaagcttccattggagcaggaggagctattgttgcattatcaagtccagaagatgagtttgaggaaatgattcttaagactagagctcctgctaatgcagtcatggagttttgtagtgatcagaggagacaatag

SEQ ID NO: 3264 - protein, 917 aa, Arabidopsis thaliana (mouse-ear cress)
MNFSFCSTSSELSYPSENVLRFSVASRLFSPKWKKSFISLPCRSKTTRKVLASSRYVPGKLEDLSVVKKSLPRREPVEKLGFVRTLLIDNYDSYTFNIYQALSTINGVPPVVIRNDEWTWEEAYHYLYEDVAFDNIVISPGPGSPMCPADIGICLRLLLECRDIPILGVCLGHQALGYVHGAHVVHAPEPVHGRLSGIEHDGNILFSDIPSGRNSDFKVVRYHSLIIDKESLPKELVPIAWTIYDDTGSFSEKNSCVPVNNTGSPLGNGSVIPVSEKLENRSHWPSSHVNGKQDRHILMGIMHSSFPHYGLQFHPESIATTYGSQLFKNFKDITVNYWSRCKSTSLRRRNINDTANMQVPDATQLLKELSRTRCTGNGSSYFGNPKSLFSAKTNGVDVFDMVDSSYPKPHTKLLRLKWKKHERLAHKVGGVRNIFMELFGKNRGNDTFWLDTSSSDKARGRFSFMGGKGGSLWKQLTFSLSDQSEVTSKHAGHLLIEDSQSSTEKQFLEEGFLDFLRKELSSISYDEKDFEELPFDFCGGYVGCIGYDIKVECGMPINRHKSNAPDACFFFADNVVAIDHQLDDVYILSLYEEGTAETSFLNDTEEKLISLMGLSTRKLEDQTLPVIDSSQSKTSFVPDKSREQYINDVQSCMKYIKDGESYELCLTTQNRRKIGNADPLGLYLHLRERNPAPYAAFLNFSNANLSLCSSSPERFLKLDRNGMLEAKPIKGTIARGSTPEEDEFLKLQLKLSEKNQAENLMIVDLLRNDLGRVCEPGSVHVPNLMDVESYTTVHTMVSTIRGLKKTDISPVECVRAAFPGGSMTGAPKLRSVEILDSLENCSRGLYSGSIGYFSYNGTFDLNIVIRTVIIHEDEASIGAGGAIVALSSPEDEFEEMILKTRAPANAVMEFCSDQRRQ

SEQ ID NO: 3265 - DNA, 1722 bp, Streptococcus pneumoniae
  CDS (1)..(1722)
atgcatagaaaaacagtgattgattttaggactttgggggagagatatacctttacccagcctattaaagagttgaaaacgagaaatgtagaagaagtggcagatttgctggcacaagtggaaagctaccaagagcaaggttattatgtggtggggtatgtcagctacgaggctgcacctgcttttgaggaaaaattagcagttcacaaggatcccctactgggagagtacctgctttactttactgttcatgatatcgtagaaacttcccctattcctctgacttatgaggatattgatttgccctcaaattggcaggaagtaacgtctgcagcagactatgaaaaggccattgcccaaattcaccatcatttacggcagggagatacctatcaggtcaactacaccgtccaacttaagcaaaagttaaatgccaatccttttgccatctacaatcgtatggtggtagagcaggaggcgggctacaatgcctatgtggaacatgacgagatgacagtgatttccatgagcccagagctcttttttgagcaaaatgatcgcgagttgacaacacgaccaatgaaggggacgactcagcgtggggtaactgaccaagaagatcttgaacaggccagttggttggaacaggatcccaaaaatcgctctgaaaatatgatgattgtggacctcttgcgcaatgatatgaaccgtatttctgaagttgggagcgagcacgtggagcgtctgtgtcaggtagagcagtattcaactgtttggcagatgacttcgaccatcaagagtcagttgcgagaggatgtggaccttgttgaaatcttccgctcactctttccttgtggttccataacgggtgcaccgaaaattgcgacaatggagattatcaaggacttggagcctcaaccgcgtggagtctactgtggaacgattggtctcttgcttccaaatggacgacggatttttaatgtggccattcgtaccattcaacttcacaaaggtcaagccatttatggagttggcggagggattacttgggatagcacatgggaatctgaataccgagaggttcatcaaaaggcagcagttctctatcgtaaacaagctcgcttccaattaattacaactggaaaaatcagccaaaaacaactgatgtttgaagaacaacatctggaaaggctgagaaaagctagtcgttattttgcttttccttttgatgcagaagacttgggacacaagattgaggaagagtgtcaggattgtgaagctaatcgagattaccgcttgcgaatcagccttagcaaatctggagagatagaagtcaatcgtcaagtattaacccctctcagtacaagcttttgtcaggcccaagtctgtcttcaggaagctgctttgaatcaatcctttacctactttaaaaccactcaccgaccgcatttgagcctaggagaacaagagaagatttaccacaataagtcaggagaactgcttgaaacctctataggaaatttggttctgaaaatcgctggaaaactctacacaccgcctatccgacttggaatcttgccaggaatttaccgtcagcatttgctagaaacaggacaggtagaagagaaagtcttgaccttggcagatttaacccaagcagaagctatttacggctgtaatgcagtgagaggcttgtatgaattaagccttgaggagaactag

SEQ ID NO: 3266 - protein, 573 aa, Streptococcus pneumoniae
MHRKTVIDFRTLGERYTFTQPIKELKTRNVEEVADLLAQVESYQEQGYYVVGYVSYEAAPAFEEKLAVHKDPLLGEYLLYFTVHDIVETSPIPLTYEDIDLPSNWQEVTSAADYEKAIAQIHHHLRQGDTYQVNYTVQLKQKLNANPFAIYNRMVVEQEAGYNAYVEHDEMTVISMSPELFFEQNDRELTTRPMKGTTQRGVTDQEDLEQASWLEQDPKNRSENMMIVDLLRNDMNRISEVGSEHVERLCQVEQYSTVWQMTSTIKSQLREDVDLVEIFRSLFPCGSITGAPKIATMEIIKDLEPQPRGVYCGTIGLLLPNGRRIFNVAIRTIQLHKGQAIYGVGGGITWDSTWESEYREVHQKAAVLYRKQARFQLITTGKISQKQLMFEEQHLERLRKASRYFAFPFDAEDLGHKIEEECQDCEANRDYRLRISLSKSGEIEVNRQVLTPLSTSFCQAQVCLQEAALNQSFTYFKTTHRPHLSLGEQEKIYHNKSGELLETSIGNLVLKIAGKLYTPPIRLGILPGIYRQHLLETGQVEEKVLTLADLTQAEAIYGCNAVRGLYELSLEEN

SEQ ID NO: 3267 - DNA, 1362 bp, Streptococcus pneumoniae
  CDS (1)..(1362)
atggaacgaatcattcatggagatgtcttatcaccaatcttggcttatatgcgcttaaaggggcaacataaggttattttagagagtattccgagagacaaggaaacagctcgtttttctatcctagcctataatccagtttttgagattaagtttgaaaatggggttctctatcaaaatggtcaagtgattgatcgggatcccttggatttcctttatgaagtgattcataagagtcagcaccactcagagctaccttttggtggtggagccattggttttgtgggttacgatatgatttcgctttatgaagaaattggtcaaatccctgaggatacaattgggacgccagacatgcatttctttgtctatgagagctatatggtctttgaccacaagaaggagaagatacatgtcatagaggatgcactttatagtgagcgcagtcaagaggccttggaaaaatccttgaaccaagtgcttgaggaattacgcattcctgctccaaatgaatttgaagatttggatctatctccgttagacttcaaaccgcatatcgctccacataagtttgagggaatggtagaaacagctcgtgacttgattcgtaacggagatatgttccaatgtgtactcagccagcgtttttcagcagaagttactggaaatccatttgacttctacagaaatctccgcgtgactaatccttctaattacctttatttctatgattttggggattatcaaatcatcggagctagtccagaaagtttggtttctgtcaaaaatggcatcgtgacaaccaatccgattgcagggacgcgaccaagaggggctacggatgaagaagacaaggccttggcgactgacctcctctctgatgagaaggaaacagcagaacatcgaatgttggtagacttggggcgtaacgatattggccgcatctctgaaacgaccagtgtccaagtcactaagtatatggaagtggagctcttccgctacgtcatgcatttgaccagcgtagtcaaggggcgtttgcttccagaactcactgccatggatgccttgaaagcaacgcttcctgctggaaccgtttctggagcaccaaagattcgagcgatgagacgtatctatgaactggaaacggaaaaacggggagtatacgctggggcaatcggctacttgtctgcgacgggtgatatggatttggccatcgccatccgaaccatgattctcaaaaatcaaagagcctatgtgcaggctggggcagggattgtctacgactctatcgcccaaaacgaataccaagaaaccattaacaaagcaaaatctatgactagaattggagaactaagaccatag

SEQ ID NO: 3268 - protein, 453 aa, Streptococcus pneumoniae
MERIIHGDVLSPILAYMRLKGQHKVILESIPRDKETARFSILAYNPVFEIKFENGVLYQNGQVIDRDPLDFLYEVIHKSQHHSELPFGGGAIGFVGYDMISLYEEIGQIPEDTIGTPDMHFFVYESYMVFDHKKEKIHVIEDALYSERSQEALEKSLNQVLEELRIPAPNEFEDLDLSPLDFKPHIAPHKFEGMVETARDLIRNGDMFQCVLSQRFSAEVTGNPFDFYRNLRVTNPSNYLYFYDFGDYQIIGASPESLVSVKNGIVTTNPIAGTRPRGATDEEDKALATDLLSDEKETAEHRMLVDLGRNDIGRISETTSVQVTKYMEVELFRYVMHLTSVVKGRLLPELTAMDALKATLPAGTVSGAPKIRAMRRIYELETEKRGVYAGAIGYLSATGDMDLAIAIRTMILKNQRAYVQAGAGIVYDSIAQNEYQETINKAKSMTRIGELRP

SEQ ID NO: 3269 - DNA, 1428 bp, Clostridium acetobutylicum
  CDS (1)..(1428)
atgtacaatatttcagaagaacagtttaatgataacaaaaagttaaaaaaagcatttcaagttatttacgaggaaaatggagatgagataactccaatatcattattttataatctagaagggaaaaacaagttcttgcttgagagtaacttattttcggaatctaaaggaagatattctttcataggagctaatccttatgcaataataaaaggatttagtaacaatactgaaattattaggaatggctatgtaaaaaaagtagaagataaattccttaaggttgcaagaaagcttactgaggaaggaaagattgaaaagagtaaatatcctttttgtggtggaggagtagggtatgtaggctacgacataataaagcaatacgaaaaaatacccagcttaaatgaagatgatttaaaaataccagatgctattctcatgttttataaaaaaattatctgctatgaccatgtgaaaaacagtattgtatacatctataatgtgtttagagaagatgataaatcctacaaagaaatcaaacaagaactttttgaattgagtgaaatttcaaaaaaaactagagaaatgcacaagcttccggaaagtcataatccagctaatataagttctaattttacaaaggatgaattttgcaaaatggtaaaaaaagctcaggaatatatagttaagggtgatatttttcaaatggttccttctcaaaggtttgtaatggatatagatgaaagaccgtttaatgtgtacagaaggcttagaggcaaaaatccatccccatatcttttctatatagactttaatgattttcaggttacaggttcatcgcccgagagtttggtatgtgtgtttaaggatagggtaataacaaatccaatagcgggaacaagacctagaggaaaaaatgaacaagaggatattaagcttaagagcgagcttataaatgatgagaaggaaatagcggaacattcaatgcttttagacctggctagaaacgatatagggaaaataagtgagtttggcacagttactgtggataagtttatggaagtggaattgtattcacatgttatgcacatagtgtctaaggtttctggaaggcttaaaaaagaatacgattgctttgaagctttaaaatcatgtcttccagctggtacagtgtcaggagcgcctaaaataagagctatggagataatagacgaattagagaacacaaagagaggctgttatgcaggtgcagtcgggtatttttcttatgacggaaacatggatacatgtattgctataagaactcttgtcataaaagaaggtaaagcatatgcacaggcaggcggtggagttgtgtatgattccatccctgaaaatgagtacgaagagagtatgaataaatcccaaattcttaaggaagtgatataa

SEQ ID NO: 3270 - protein, 475 aa, Clostridium acetobutylicum
MYNISEEQFNDNKKLKKAFQVIYEENGDEITPISLFYNLEGKNKFLLESNLFSESKGRYSFIGANPYAIIKGFSNNTEIIRNGYVKKVEDKFLKVARKLTEEGKIEKSKYPFCGGGVGYVGYDIIKQYEKIPSLNEDDLKIPDAILMFYKKIICYDHVKNSIVYIYNVFREDDKSYKEIKQELFELSEISKKTREMHKLPESHNPANISSNFTKDEFCKMVKKAQEYIVKGDIFQMVPSQRFVMDIDERPFNVYRRLRGKNPSPYLFYIDFNDFQVTGSSPESLVCVFKDRVITNPIAGTRPRGKNEQEDIKLKSELINDEKEIAEHSMLLDLARNDIGKISEFGTVTVDKFMEVELYSHVMHIVSKVSGRLKKEYDCFEALKSCLPAGTVSGAPKIRAMEIIDELENTKRGCYAGAVGYFSYDGNMDTCIAIRTLVIKEGKAYAQAGGGVVYDSIPENEYEESMNKSQILKEVI

SEQ ID NO: 3271 - DNA, 1566 bp, Yersinia pestis
  CDS (1)..(1566)
atgatgcaaacatcacgtcctactttacagttactcaccgctagcgcctgttaccgcgatgacccgacagcgctgtttcatcaattatgtggtgcccgccccgcgaccctgttgcttgagtctgcagaagttgacaacaaacagaatctgaaaagcctgttggtcatcgacagtgccttgcgtatcacggcattagggcaaaccgtcactctcgaagcattgacccgtaatggggcttctttattaccactgctggatgccagtctgcccactgaagtcgatattcaggttcgtccgaatggccgagagttaactttcccgttaataaatgaagtccaggatgaggattcacgcttacagtccttatctgtttttgatgctttacgtcaattattaacactggttaataccccacttgccgagcgtgaggccctgtttttgggcggtttgttcgcttacgatttagtcgctggttttgaaaatttgcctccgttgcgtcaggatcaacgctgccctgacttctgtttctatttagccgagacattgctggttttggatcatcagcatcgttcaactcgcttgcaggccagcctgttcacgccagacagttcagagtatcagcgcctggcgacccgtttagagcaactcagccaccagttacaacaagcgccacaccccattcctgccacctccgtgccagagatggcgttacagtgtaaccaatcagatgaagagtattgcaacgttgtcagtgaattgcaggtagcaatccgtgaaggtgagattttccaggtggtcccatcccgccgttttacgctgccctgcccatcaccgctggcggcctatcagacactgaaagaccataatcccagcccctacatgtttttcatgcaagacaatgatttttctctgtttggtgcatcacctgagagcgcactgaaatacgatgccagcaaccgtcaaattgagatttacccgattgcgggtactcgtccacgcggtcgtcgtcctaatggagaactcgatcgtgatttagacagccgtatcgagttggaaatgcgtactgaccataaagagatggcagaacatttaatgttggtggatctggctcgtaacgatctagcgcgtatttgcgaacccggtagccgctatgttgcagatttaaccaaagttgaccgttactcctttgtcatgcatctggtgtcccgcgtgattggcactctgcgtcaagatttagatgtgctgcatgcttatcaagcgtgtatgaacatgggtacgctaagcggtgcgcccaaagtacgggccatgcaattgattgccagtaatgaaggctcacgccgtggcagctacggcggtgcagtgggctacttcactgctcacggtgatttggatacctgcattgtgattcgttctgcctacgtagaggacggcatcgccaccgtacaagcgggtgcaggggtggttttggactcagttccacaagcagaagctgatgaaactcggaataaagccagagccgtactgcgcgccattgccactgcccatcatgccaaggagattttctaa

SEQ ID NO: 3272 - protein, 521 aa, Yersinia pestis
MMQTSRPTLQLLTASACYRDDPTALFHQLCGARPATLLLESAEVDNKQNLKSLLVIDSALRITALGQTVTLEALTRNGASLLPLLDASLPTEVDIQVRPNGRELTFPLINEVQDEDSRLQSLSVFDALRQLLTLVNTPLAEREALFLGGLFAYDLVAGFENLPPLRQDQRCPDFCFYLAETLLVLDHQHRSTRLQASLFTPDSSEYQRLATRLEQLSHQLQQAPHPIPATSVPEMALQCNQSDEEYCNVVSELQVAIREGEIFQVVPSRRFTLPCPSPLAAYQTLKDHNPSPYMFFMQDNDFSLFGASPESALKYDASNRQIEIYPIAGTRPRGRRPNGELDRDLDSRIELEMRTDHKEMAEHLMLVDLARNDLARICEPGSRYVADLTKVDRYSFVMHLVSRVIGTLRQDLDVLHAYQACMNMGTLSGAPKVRAMQLIASNEGSRRGSYGGAVGYFTAHGDLDTCIVIRSAYVEDGIATVQAGAGVVLDSVPQAEADETRNKARAVLRAIATAHHAKEIF

SEQ ID NO: 3273 - DNA, 2148 bp, Nostoc sp. PCC 7120
  CDS (1)..(2148)
atgcgcgtatctcgtagcacaaccgaggtgaagatggacactgcactagatgaaattctctttcacctaaatcaagtacgtggaggtttgttaaccagtagttacgaatatccagggcgatacaaaagatgggcgattggattcattaatcccccattacaactgacaacaagagagaacgcatttaccatctcttcactcaatcctcgcggacaggtgctactaccaaccttgttccagcatctatcagcccagtcgcaactacaacaaatcagcctcaatcatgactacatcacaggtgaaattcgacccacaaaacagttattcacagaagaacaacggagtaaacaaccgtcagcctttacagtcatccgcgaaattctccagatttttgcgagtgatgaagacgagcatttagggttatatggtgcatttggttacgacttagtatttcaatttgaaccaattccccaaaaaattgctcgtcccgcagaccaacgggatttagtcctgtatctacccgatgaactcatagttgtagattactatctacaaaaagcatatcgtcaccagtatgaatttgccacagaacatggcaacaccgagcatcttccacggacaggccagtccatcgactaccagggtaaacatcttctaccaaaccaaactgctgaccatcaaccaggagaatatgccaacctagttgagcaagcactcgactacttccgccggggtgacttatttgaagtagttcctagtcaaaacttttttacagcctgtgaacaatcacccagtcaactattccagaccttaaggcaaattaatcctagtccttatggatttctgttgaatttgggtggtgaatatctcataggtgcatcaccagaaatgtttgtgcgagttgatggtaggcgagtggaaacctgtcccattagtggcactattagacggggagaagatgctttaggcgacgctgtacaaattcgtcagttgcttaactcccataaagatgaagccgagttaacaatgtgtactgacgtagaccgcaacgataaatcgcggatttgtgaacccggttcagtcagggtgattggtcgtcgccagattgaactgtacagccacctcattcatacagtagaccatgtagaagggatactgaggccggaatttgacgctttagatgccttcttgagtcatacttgggcagttacagtcacaggcgcacccaaacgagccgccatgcagttcatcgaacagcatgaacgcagcgcccgtcgttggtatgggggagcagttggttatttaggctttaatggtaacttgaataccggattaaccttgcggacaattcgtttacaagactccatcgccgaagtgcgagttggtgcaacagtcctttacgactccattccgtcagccgaagaagaggaaacaattactaaagcgactgcattatttgagaccattcgccgtcataccactgccaataaaactcaaggaaacgatagtcatcgccctggggatatcgcccacaataagcgtatcctcctcatcgactacgaagattcatttgttcacacattagccaattacatccgcaccaccggcgcaaccgtcaccaccctacgtcatggttttgctgaatcatattttgatgcagaacgcccagacttagtggtattgtctcccggccctggtagacccagtgacttccgagttccccaaacggttgcagccttggtaggtcgagaaatccccatttttggcgtttgtctgggattacaaggcatagtggaagcttttggcggagaattaggcgtgcttgattatccccaacacggtaaacccgcacggatttcagtgactgcacctgattctgtgctgtttcaaaatttaccagcatccttcatcgtgggtagataccattccttatttgcccaaccccaaactatacccggtgaactcaaagtcacagcgatttctgaggacaatgtaattatggcaattgaacaccaaacactacctatagccgccgtccaatttcatccagagtcaatcatgaccctagcaggagaagttggtcagacaatcattaaaaatgtggtgcagacatatacccaaactttagaaacatcaatttactcttag

SEQ ID NO: 3274 - protein, 715 aa, Nostoc sp. PCC 7120
MRVSRSTTEVKMDTALDEILFHLNQVRGGLLTSSYEYPGRYKRWAIGFINPPLQLTTRENAFTISSLNPRGQVLLPTLFQHLSAQSQLQQISLNHDYITGEIRPTKQLFTEEQRSKQPSAFTVIREILQIFASDEDEHLGLYGAFGYDLVFQFEPIPQKIARPADQRDLVLYLPDELIVVDYYLQKAYRHQYEFATEHGNTEHLPRTGQSIDYQGKHLLPNQTADHQPGEYANLVEQALDYFRRGDLFEVVPSQNFFTACEQSPSQLFQTLRQINPSPYGFLLNLGGEYLIGASPEMFVRVDGRRVETCPISGTIRRGEDALGDAVQIRQLLNSHKDEAELTMCTDVDRNDKSRICEPGSVRVIGRRQIELYSHLIHTVDHVEGILRPEFDALDAFLSHTWAVTVTGAPKRAAMQFIEQHERSARRWYGGAVGYLGFNGNLNTGLTLRTIRLQDSIAEVRVGATVLYDSIPSAEEEETITKATALFETIRRHTTANKTQGNDSHRPGDIAHNKRILLIDYEDSFVHTLANYIRTTGATVTTLRHGFAESYFDAERPDLVVLSPGPGRPSDFRVPQTVAALVGREIPIFGVCLGLQGIVEAFGGELGVLDYPQHGKPARISVTAPDSVLFQNLPASFIVGRYHSLFAQPQTIPGELKVTAISEDNVIMAIEHQTLPIAAVQFHPESIMTLAGEVGQTIIKNVVQTYTQTLETSIYS

SEQ ID NO: 3275 - DNA, 1377 bp, Yersinia pestis
  CDS (1)..(1377)
atgtgtgagaaatttttaaccgtcaaagagttaccttatcaccctgatgccctgcttcaacaattcaccccacttgccaaccaagcttgggcgatgttgttgcactcaggatttgctcaacacccccatagtcgctttgatatcttggtcgctgatccaaaaataacgctgacaactcatggggataaaacggttattgtcagtgatcaggggcaggaaacctccctcgcggatcccttctctttgctgcagcagcaactggataaattcgccccagcgatgcctgctcaccctgatctgccgtttcagggcggagcgttagggctatttggttacgacttaggccgccgagttgaaaaattgcctgaactggcggcgcacgatatcgccttgccggatatggccattggcctgtatgactgggcgctcattgctgaccactctcggcagaagctcacgctggtatcccttggcgatgccgaacagcgcttgcattggctgcatcagcaaacaaccgatgagaacctcgtccccttcaaactcacggttccatggcaggcagatatgtcacgggagcagtacggcgaaaaattccgccaaattcaagcgtatctgcgtagcggtgactgttaccaaatcaatctggcacaaagattcagcgcagagtatcagggggatgaatggcaagcatttctgtcactgagtcgtagcaatcaagcccccttttcagcttttattcgcttacccgacaacgccatattgagtgtttcaccagaacgtttcttgtggttggagaatcatcaggttcaaacccggccgattaaaggtacgctaccccgtttggccgatcctgagcaggatcgccagcaagctgagcgattggcgaattcagccaaagatcaggctgaaaatctcatgattgtggacttactgcgtaacgatattggccgtgtcgcacgtccgggtagcgtccgcgtaccagagctgtttgtggtggagccttttcctgcggtgcaccacttagtcagtacaattaccgcaatacttcccccagaatgttcgccgaccgaattactgcgcgcctgtttccccggcgggtcaattactggtgcccccaaggtccgagcaatggaaattattgaacaactcgaaccctatcgacgcaatgcttattgcggtaacattggctacataagttgctgcggcaccatggataccaatattactatccgtaccctgatgacagagaacggtaagatatattgttctgccggaggggggattgtcgccgacagccaagagcaagctgaatatcaagaaacgttcgataaggtcgcccgtattttaccgcaactgggggagtgtgttatttcgtga

SEQ ID NO: 3276 - protein, 458 aa, Yersinia pestis
MCEKFLTVKELPYHPDALLQQFTPLANQAWAMLLHSGFAQHPHSRFDILVADPKITLTTHGDKTVIVSDQGQETSLADPFSLLQQQLDKFAPAMPAHPDLPFQGGALGLFGYDLGRRVEKLPELAAHDIALPDMAIGLYDWALIADHSRQKLTLVSLGDAEQRLHWLHQQTTDENLVPFKLTVPWQADMSREQYGEKFRQIQAYLRSGDCYQINLAQRFSAEYQGDEWQAFLSLSRSNQAPFSAFIRLPDNAILSVSPERFLWLENHQVQTRPIKGTLPRLADPEQDRQQAERLANSAKDQAENLMIVDLLRNDIGRVARPGSVRVPELFVVEPFPAVHHLVSTITAILPPECSPTELLRACFPGGSITGAPKVRAMEIIEQLEPYRRNAYCGNIGYISCCGTMDTNITIRTLMTENGKIYCSAGGGIVADSQEQAEYQETFDKVARILPQLGECVIS

SEQ ID NO: 3277 - DNA, 2145 bp, Nostoc sp. PCC 7120
  CDS (1)..(2145)
atggccgatatcaaaacattaattattgacaactacgactcttatacttttaatctctaccagatgattgctgaagtcaacggagagttgccccttgttattcataatgacaaattagattggtatgaattaaaacaacttgtttttgataatatagtcatttctcctgggcctggtcgtcctgaaaaccctaaagatttcggtatttgtcaacagatactacaaaactatttagatgttcccttgcttggtgtttgtcttggtcaccaaggaattggtcattattatggtggtaaggtcatccacgcaccagaacctaaacatggtcgattgagtcatgtttatcataatggtggtgatttattccaagaaattcctacaccttttcaagttgtccgctatcattctttgctggttgcggaagaattgcccagttgtttagaaaaagtagcctggactgaagacgggttggtaatggggttgcgtcatcgtcatttgccattgtggggggtgcagtttcacccagaatctatctgtagtgagtatggatataaattgctggaaaacttccaagccattacggaaggattcatccgccaaaatggtagacatcgccccaaattagaaagcaaaagtttctctatttctcctaactcacctattccagcgccatcccaagaatttactgtttgtagccaaaaactagattattaccttgatacagaacagacatttgttcatctttttggtgaagatcctcatgctttttggcttgatagtagccttgtagaaccaggattatcccgtttctcttttatgggaggaagcggggggataaacagtttactcgtttcttactgcacccaatctcaagaattgacgattacacaatcgggtaaggtgacacgcactcaagagagtatttttgactatctcaaacgcgaaattaatcgtcgccgttgcccatctgatgagctaccttttgattttaactgtggttttgtgggctactttggttatgaactgaaggcaaaatccgggtctgggttagagcatccctcattatttcccgatgctatcttgattttaagcgatcgcctgattgcttttgaccaccaagagcaaaccacttacttagtttacctcgcccctgtgggtgaaacagcaccagcccaagcctggtttgaactaactgaaaaacgtctgcggacactcccgcctcttcctcccctcgttcctagtactacatctcaccccgttactttccgtttaagtcggtcataccagacatataaagatgatatttctagatgtctcaaagaaattcgtgagggggaaacttaccaagtttgcctgactaatcgattatgcacagacacaattgctgatccattggaattttatcgccgattacgccaagttaatccggctccctactctgcttttctacggtttggtgagatggcgatcgcctgttcttccccggagcgatttctgcaaattgaccgtcaaggctgggtagaaaccaagccgatcaagggaactgtacgccggggagagactcccgaagaagattttttactccgggaaagtttgcgtagcagcgaaaaagagcgatccgaaaacttaatgattgttgatttattacgcaacgatttagggcgagtttgccaagtcgggagtatccatgttcccaaattaatggatgtagaaagttatgcaacggtgcatcaacttgtcagcactatccgtggtttattatcccccgacatggacgcaaccgactgcattcgtctggcatttccgggcggctcgatgacaggtgcgcctaaactgagaacgatggagattattgatcaacttgagcaagaggcgcggggagtttattcaggggcgatcggttttttgggtgtaaacggtacagccgacttgaatattgtcatccgtaccgccgtactgacaccaaatcaaacttctattggtatagggggtgggattgtcgcactctctgatgtggaaatggaatttcaagaaactatcctcaaagctaatgcgctaattcaggcgatgctcttgactgttcacggagaatatcatcctagtctttaccgtattttaggaatgcccacagaggttttctgttga

SEQ ID NO: 3278 - protein, 714 aa, Nostoc sp. PCC 7120
MADIKTLIIDNYDSYTFNLYQMIAEVNGELPLVIHNDKLDWYELKQLVFDNIVISPGPGRPENPKDFGICQQILQNYLDVPLLGVCLGHQGIGHYYGGKVIHAPEPKHGRLSHVYHNGGDLFQEIPTPFQVVRYHSLLVAEELPSCLEKVAWTEDGLVMGLRHRHLPLWGVQFHPESICSEYGYKLLENFQAITEGFIRQNGRHRPKLESKSFSISPNSPIPAPSQEFTVCSQKLDYYLDTEQTFVHLFGEDPHAFWLDSSLVEPGLSRFSFMGGSGGINSLLVSYCTQSQELTITQSGKVTRTQESIFDYLKREINRRRCPSDELPFDFNCGFVGYFGYELKAKSGSGLEHPSLFPDAILILSDRLIAFDHQEQTTYLVYLAPVGETAPAQAWFELTEKRLRTLPPLPPLVPSTTSHPVTFRLSRSYQTYKDDISRCLKEIREGETYQVCLTNRLCTDTIADPLEFYRRLRQVNPAPYSAFLRFGEMAIACSSPERFLQIDRQGWVETKPIKGTVRRGETPEEDFLLRESLRSSEKERSENLMIVDLLRNDLGRVCQVGSIHVPKLMDVESYATVHQLVSTIRGLLSPDMDATDCIRLAFPGGSMTGAPKLRTMEIIDQLEQEARGVYSGAIGFLGVNGTADLNIVIRTAVLTPNQTSIGIGGGIVALSDVEMEFQETILKANALIQAMLLTVHGEYHPSLYRILGMPTEVFC

SEQ ID NO: 3279 - DNA, 2208 bp, Nostoc sp. PCC 7120
  CDS (1)..(2208)
atgattgccgattcccacagctacagaactaatggtaacgtgcgtgtctctcgctccatcacacaagttaaaatggagacagctttagaagagattcttttctacttaaactctcagcgtggtggattgctgactagtagctatgaatatccaggaagatataaaagatgggcaattggttttgttaatccacctgtagaattatccacaagcggaaatacttttactctcacagcattaaatgagcgtggctatgtacttttaccagtgatctttgagtgtttatcaaaatcagaacaactccagaaactcactgaacatcatcataaaattactggattagttaaatctacaccagaattttttgccgaagaagaacgtagtaaacaaccttctacatttacggttattcgggaaatactacatatcttctctagtcaagaagacgaacatttaggattatatggtgcgtttggttatgacttagttttccaatttgagcaaataacccaatgcttagaacgtccacaagaccaacgagatttagttctatatttacccgacgaattgatagttgtagactactatcaacaacaagcatttcggctagagtatgacttcatcacagcgcatggtagtacttatgatttgccccgcacgggagaatctgttgattatcgaggtcaatgtttaacacctcctcaaaatgctgaccataaaataggtgagtatgccaaactagtagaatttgcccttgattatttccgtcggggtgacttatttgaagtggttcccagtcagaattttttcacagcttgcgaagcaccaccaagccaactatttgaaactttaaaacaaataaatcctagtccctatggatttatttttaatcttggtggagaatacatcattggcgcttcaccagaaatgtttgtacgggtggaaggtaggcgtgtagaaacttgtcctattagtggcactattactagagggcatgatgctatagatgatgctgtgcagattcgtcagttactcaactcccacaaagacgaagcagagttgactatgtgtactgacgtagaccgtaacgataagtctcgcatctgtgaacccggttcagtcaaggtgattggtcgccggcaaattgaattatatagccacttaattcatacggtagaccatgtagaaggcattctccgaccagagtttgatgctttagatgctttcctcagtcacacttgggctgttacagtcacaggcgcaccgaaaagggctgctattcaattcatcgaaaagaacgaacgcagcgtcagacgttggtatggtggcgcggttgggtatttgaattttaacgggaatttaaatactgggttaattttaaggacaatcagattgcaagactcaattgctgaagtgcgagttggtgctactctactgtatgactccataccccaagcagaagaacaagaaaccatcactaaagctgcggctgcttttgaaacgattcggcgtgctaaacaaatagacccacagattgaagaatctagtactagaaagttaagcaaatatcttcccgatggacaatcaggtaaacacatcttactaattgaccatgaagactcatttgttcataccctagctaactacatccgttccactggtgcaactgtcaccacactgcgtcacggcttctcagaatccctatttgatacagaacgcccagacttagtagtattatctcctggccccggtagaccgagtgaatttaaagtacaggaaaccgtcgccgcctgcgtccgtcgccaaatacctctgtttggtgtctgtttaggactgcaaggtattgtggaagctttcggtggagaattgggagtattgaattatccccaacatggtaaatcttcgcggatttttgttacagcacccgattctgtgatgtttcaagatttgcccgaatcttttacagtcgggagatatcattcattatttgcactatcacaacgcttaccaaaagaactgaaggtgacagcgatttctgatgatgaggtgattatggcgattgaacatcagacactacctatcgccgccgtccagtttcatccagaatcaatcatgactctagctggagaagttggtttaatgatgatcaaaaatgtggtgcaaaaatatacacaaagtcaacagtcaacagttcccatctatgactaa

SEQ ID NO: 3280 - protein, 735 aa, Nostoc sp. PCC 7120
MIADSHSYRTNGNVRVSRSITQVKMETALEEILFYLNSQRGGLLTSSYEYPGRYKRWAIGFVNPPVELSTSGNTFTLTALNERGYVLLPVIFECLSKSEQLQKLTEHHHKITGLVKSTPEFFAEEERSKQPSTFTVIREILHIFSSQEDEHLGLYGAFGYDLVFQFEQITQCLERPQDQRDLVLYLPDELIVVDYYQQQAFRLEYDFITAHGSTYDLPRTGESVDYRGQCLTPPQNADHKIGEYAKLVEFALDYFRRGDLFEVVPSQNFFTACEAPPSQLFETLKQINPSPYGFIFNLGGEYIIGASPEMFVRVEGRRVETCPISGTITRGHDAIDDAVQIRQLLNSHKDEAELTMCTDVDRNDKSRICEPGSVKVIGRRQIELYSHLIHTVDHVEGILRPEFDALDAFLSHTWAVTVTGAPKRAAIQFIEKNERSVRRWYGGAVGYLNFNGNLNTGLILRTIRLQDSIAEVRVGATLLYDSIPQAEEQETITKAAAAFETIRRAKQIDPQIEESSTRKLSKYLPDGQSGKHILLIDHEDSFVHTLANYIRSTGATVTTLRHGFSESLFDTERPDLVVLSPGPGRPSEFKVQETVAACVRRQIPLFGVCLGLQGIVEAFGGELGVLNYPQHGKSSRIFVTAPDSVMFQDLPESFTVGRYHSLFALSQRLPKELKVTAISDDEVIMAIEHQTLPIAAVQFHPESIMTLAGEVGLMMIKNVVQKYTQSQQSTVPIYD

SEQ ID NO: 3281 - DNA, 1515 bp, Nostoc sp. PCC 7120
  CDS (1)..(1515)
atgattttccccaatttctccgaattttctcagctagctttgcaaggtaattttgtgccggtgtatcaggaatgggtggcagacctagatacacctgtttccgcttggtacaaagtttgcgctggagagccttatagctttttgctggaatcggtagaaggtggggaaaagattgggcgttatagtttactggggtgtgatcctttatgggttttggaagctaggggtgagacgaccactcagacaaaccgtgatggctcccaagttgtatttacaggcgatccatttacagctctagccgattgcctagcaccgtataaaccagtcaagttaccccaactaccaccaggaattggcggtttgtttggtttttggggttatgaattaattcgctggattgaaccgcgtgtaccagtgcatccccaagatgagcgcaacattcctgatggattgtggatgcaggtagaccatttgttaatatttgaccaggtaaagcggaaaatatgggcgatcgcctatgctgatttacgtgatccaaatgtagatttaaaagcggcgtatcagcaagcgtgcgatcgcgtcacccaaatggtgagcaaactatccttgcccctatcgccccaaaaaaccatattagaatggacacccccaggcagccaaaaagtgggggaaatacaagaatataccagcaacttcactcgaccggaattttgcgccagtgtccaaaaagccaaagagtacatcaaagcgggtgatatctttcaagtagttatttctcaacgcctttctacccaatacaccggcgatcccttctccctgtaccgttccctgcgtcagataaatccctcgccttacatggcgtactttaacttccaagactggcaaatcatcggttctagtcctgaagtgatggtgaaagcggaactggatgcagatggtgaagcaatagccacagttcgtcctattgccgggactcgtccacggggtaagacaaccaaagaagatgcagaattagccgcagatttactccaagaccccaaagaaatcgctgaacacgtcatgctggtggatttaggacgcaacgatttaggccgtgtttgtgccagtgggactgtaaaagttgatgaattaatggtggtggaacgctactctcatgtaatgcacattgtgagtaatgttgtggggaaattagccgcaaataaaaacgcctgggatttattaaaagcctgttttcccgccggcacagttagcggcgcaccgaaaattagggcgatggaaattattaatgagttagaacccagccgccggggtgtgtattctggggtgtatggatattatgattttgaaggacaattaaatagtgcgatcgctattcggacgatggtagtcagagatcaaaccgtaacagtgcaagctggtgcgggtttggtggctgattctgagccagagaaagaatatgaggaaactttaaataaagctagaggacttctcttggcgattcgctgtttacggtag

SEQ ID NO: 3282 - protein, 504 aa, Nostoc sp. PCC 7120
MIFPNFSEFSQLALQGNFVPVYQEWVADLDTPVSAWYKVCAGEPYSFLLESVEGGEKIGRYSLLGCDPLWVLEARGETTTQTNRDGSQVVFTGDPFTALADCLAPYKPVKLPQLPPGIGGLFGFWGYELIRWIEPRVPVHPQDERNIPDGLWMQVDHLLIFDQVKRKIWAIAYADLRDPNVDLKAAYQQACDRVTQMVSKLSLPLSPQKTILEWTPPGSQKVGEIQEYTSNFTRPEFCASVQKAKEYIKAGDIFQVVISQRLSTQYTGDPFSLYRSLRQINPSPYMAYFNFQDWQIIGSSPEVMVKAELDADGEAIATVRPIAGTRPRGKTTKEDAELAADLLQDPKEIAEHVMLVDLGRNDLGRVCASGTVKVDELMVVERYSHVMHIVSNVVGKLAANKNAWDLLKACFPAGTVSGAPKIRAMEIINELEPSRRGVYSGVYGYYDFEGQLNSAIAIRTMVVRDQTVTVQAGAGLVADSEPEKEYEETLNKARGLLLAIRCLR

SEQ ID NO: 3283 - DNA, 1362 bp, Escherichia coli
  CDS (1)..(1362)
atgaagacgttatctcccgctgtgattactttactctggcgtcaggacgccgctgaattttatttctcccgcttaagccacctgccgtgggcgatgcttttacactccggctatgccgatcatccgtatagccgctttgatattgtggtcgccgagccgatttgcactttaaccactttcggtaaagaaaccgttgttagtgaaagcgaaaaacgcacaacgaccactgatgacccgctacaggtgctccagcaggtgctggatcgcgcagacattcgcccaacgcataacgaagatttgccatttcagggcggcgcactggggttgtttggctacgatctgggccgccgttttgagtcactgccagaaattgcggaacaagatatcgttctgccggatatggcagtgggtatctacgattgggcgctcattgtcgaccaccagcgtcatacagtttctttgctgagtcataatgatgtcaatgcccgtcgggcctggctggaaagccagcaattctcgccgcaggaagatttcacgctcacttccgactggcaatccaatatgacccgcgagcagtacggcgaaaaatttcgccaggtacaggaatatctgcacagcggtgattgctatcaggtgaatctcgcccaacgttttcatgcgacctattctggcgatgaatggcaggcattccttcagcttaatcaggccaaccgcgcgccatttagcgcttttttacgtcttgaacagggtgcaattttaagcctttcgccagagcggtttattctttgtgataatagtgaaatccagacccgcccgattaaaggcacgctaccacgcctgcccgatcctcaggaagatagcaaacaagcagtaaaactggcgaactcagcgaaagatcgtgccgaaaatctgatgattgtcgatttaatgcgtaatgatatcggtcgtgttgccgtagcaggttcggtaaaagtaccagagctgttcgtggtggaacccttccctgccgtgcatcatctggtcagcaccataacggcgcaactaccagaacagttacacgccagcgatctgctgcgcgcagcttttcctggtggctcaataaccggggctccgaaagtacgggctatggaaattatcgacgaactggaaccgcagcgacgcaatgcctggtgcggcagcattggctatttgagcttttgcggcaacatggataccagtattactatccgcacgctgactgccattaacggacaaattttctgctctgcgggcggtggaattgtcgccgatagccaggaagaagcggaatatcaggaaacttttgataaagttaatcgtatcctgaagcaactggagaagtaa

SEQ ID NO: 3284 - protein, 453 aa, Escherichia coli
MKTLSPAVITLLWRQDAAEFYFSRLSHLPWAMLLHSGYADHPYSRFDIVVAEPICTLTTFGKETVVSESEKRTTTTDDPLQVLQQVLDRADIRPTHNEDLPFQGGALGLFGYDLGRRFESLPEIAEQDIVLPDMAVGIYDWALIVDHQRHTVSLLSHNDVNARRAWLESQQFSPQEDFTLTSDWQSNMTREQYGEKFRQVQEYLHSGDCYQVNLAQRFHATYSGDEWQAFLQLNQANRAPFSAFLRLEQGAILSLSPERFILCDNSEIQTRPIKGTLPRLPDPQEDSKQAVKLANSAKDRAENLMIVDLMRNDIGRVAVAGSVKVPELFVVEPFPAVHHLVSTITAQLPEQLHASDLLRAAFPGGSITGAPKVRAMEIIDELEPQRRNAWCGSIGYLSFCGNMDTSITIRTLTAINGQIFCSAGGGIVADSQEEAEYQETFDKVNRILKQLEK

SEQ ID NO: 3285 - DNA, 2190 bp, Agrobacterium tumefaciens
  CDS (1)..(2190)
atggtaacgatcattcaggatgacggagcggagacctacgagacgaaaggcggcatccaggtcagccgaaagcgccggcccaccgattatgccaacgccatcgataattacatcgaaaagcttgattcccatcgcggcgcggttttttcgtccaactatgaatatccgggccgttacacccgctgggatacggccatcgtcgatccgccgctcggcatttcctgttttggccgcaagatgtggatcgaagcctataatggccgcggcgaagtgctgctcgatttcattacggaaaagctgaaggcgacacccgatctcaccctcggcgcttcctcgacccgccggctcgatcttaccgtcaacgaaccggaccgtgtcttcaccgaagaagaacgctcgaaaatcccgacggtcttcaccgctctcagagccatcgtcgacctcttctattcgagcgcggattcggccatcggcctgttcggtgccttcggttacgatctcgccttccagttcgacgcgatcaagctttcgctggcgcgtccggaagaccagcgtgacatggtgctgtttctgcccgatgaaatcctcgtcgttgatcactattccgccaaggcctggatcgaccgttacgatttcgagaaggacggcatgacgacggacggcaaatcctccgacattacccccgatcccttcaagaccaccgataccatcccgcccaagggcgatcaccgtcccggcgaatattccgagcttgtggtgaaggccaaggaaagcttccgccgcggcgacctgttcgaggtcgttcccggccagaaattcatggagcgttgcgaaagcaatccgtcggcgatttcccgccgcctgaaggcgatcaacccgtcgccctattccttcttcatcaatctcggcgatcaggaatatctggtcggcgcctcgccggaaatgttcgtgcgcgtctccggccgtcgcatcgagacctgcccgatatcaggcaccatcaagcgcggcgacgatccgattgccgacagcgagcagattttgaaactgctcaactcgaaaaaggacgaatccgaactgaccatgtgctcggacgtggaccgcaacgacaagagccgcgtctgcgagccgggttcggtgaaggtcattggccgccgccagatcgagatgtattcacgcctcatccacaccgtcgatcacatcgaaggccgcctgcgcgacgatatggacgcctttgacggtttcctcagccacgcctgggccgtcaccgtcaccggtgcaccaaagctgtgggccatgcgcttcatcgaaggtcatgaaaagagcccgcgcgcctggtatggcggtgcgatcggcatggtcggcttcaacggcgacatgaataccggcctgacgctgcgcaccatccggatcaaggacggtattgccgaagtgcgcgccggcgcgaccctgctcaatgattccaacccgcaggaagaagaagccgaaaccgaactgaaggcctccgccatgatatcagccattcgtgacgcaaaaggcaccaactctgccgccaccaagcgtgatgccgccaaagtcggcaccggcgtcaagatcctgctcgtcgaccacgaagacagcttcgtgcacacgctggcgaattatttccgccagacgggcgcgacggtctcgaccgtcagatcaccggtcgcagccgacgtgttcgatcgcttccagccggacctcgttgtcctgtcgcccggacccggcagcccgacggatttcgactgcaaggcaacgatcaaggccgcccgcgcccgcgatctgccgatcttcggcgtttgcctcggtctgcaggcattggcagaagcctatggcggcgagctgcgccagcttgctgtgcccatgcacggcaagccttcgcgcatccgcgtgctggaacccggcctcgtcttctccggtctcggcaaggaagtcacggtcggtcgttaccattcgatcttcgccgatcccgccaccctgccgcgtgatttcatcatcaccgcagaaagcgaggacggcacgatcatgggcatcgaacacgccaaggaaccggtggccgccgttcagttccacccggaatcgatcatgacgctcggacaggacgcgggcatgcggatgatcgagaatgtcgtggtgcatctgacccgcaaggcgaagaccaaggccgcgtga

SEQ ID NO: 3286 - protein, 729 aa, Agrobacterium tumefaciens
MVTIIQDDGAETYETKGGIQVSRKRRPTDYANAIDNYIEKLDSHRGAVFSSNYEYPGRYTRWDTAIVDPPLGISCFGRKMWIEAYNGRGEVLLDFITEKLKATPDLTLGASSTRRLDLTVNEPDRVFTEEERSKIPTVFTALRAIVDLFYSSADSAIGLFGAFGYDLAFQFDAIKLSLARPEDQRDMVLFLPDEILVVDHYSAKAWIDRYDFEKDGMTTDGKSSDITPDPFKTTDTIPPKGDHRPGEYSELVVKAKESFRRGDLFEVVPGQKFMERCESNPSAISRRLKAINPSPYSFFINLGDQEYLVGASPEMFVRVSGRRIETCPISGTIKRGDDPIADSEQILKLLNSKKDESELTMCSDVDRNDKSRVCEPGSVKVIGRRQIEMYSRLIHTVDHIEGRLRDDMDAFDGFLSHAWAVTVTGAPKLWAMRFIEGHEKSPRAWYGGAIGMVGFNGDMNTGLTLRTIRIKDGIAEVRAGATLLNDSNPQEEEAETELKASAMISAIRDAKGTNSAATKRDAAKVGTGVKILLVDHEDSFVHTLANYFRQTGATVSTVRSPVAADVFDRFQPDLVVLSPGPGSPTDFDCKATIKAARARDLPIFGVCLGLQALAEAYGGELRQLAVPMHGKPSRIRVLEPGLVFSGLGKEVTVGRYHSIFADPATLPRDFIITAESEDGTIMGIEHAKEPVAAVQFHPESIMTLGQDAGMRMIENVVVHLTRKAKTKAA

SEQ ID NO: 3287 - DNA, 1365 bp, Listeria monocytogenes
  CDS (1)..(1365)
atgaggaaaatgaaaaaaatggatgcagatacattaaccgcaattttggcgtttcaaagactttctggtacaggtaaaagcttacttgaaggtgcggcgaaagatgcggaggctggacgttattcgatcattgccattaatcctgtacatgaaattaaagtatatcaacatgattattatatagacggaacacatcaagttgtagcagatcccttaaaagaaattgaattatttattgaaaaagcaagagaagatgaacttgaattgccacttgattcaggtgcaattggctatgttggatatgacgttattgcgctttatgaagatttaggcgaaattccagtagaaactagggatataccagatattcgtttttatgtatatgaaagttttgtcattatggaccatcaagcggaagaacttattttagtgcaagataattgttactcaggcagaagtgaagcagacttggataaggcgcttgagtcgatgcttaccgaacttactacaccgaaaaaagacgagcataaggctgttcatgttccaaaaatgtcatataagagcaactatacgaaagatgaatacatggggctagtgaaaaaagcaaaaacatatatccaagagggcgacttctttcaaatagttctctctcaacgattagaagcagattttactgtgaagccatttgattactatcggaaattacgattgttaaatccttctccgtatctatatttcattgattttggtgatacggtgctaattggctcttctccagaaagtttaattaaaacgaaagggcggacggtgattacaaatcctatcgcaggaactagacggcgcggggcaacgaaacaagaagatgaactacttgcttcggaattgttatcggatgaaaaagaattggcagagcaccggatgttggttgacttagggcgaaatgatattgggaaaattgcagaaactggatcagttcatgttcctgtttaccttactattgaaagataccgtttcttaatgcatttagtttcagtagtagaaggaaccttaaaaactggacttactgcaatcgatgctctccgctcgacgctacctgccgggactgttagtggagcaccgaaaataagagccatggagcgaatctatgaatgggaaaatgtaaaacgtggtccatatgctggtgcggttggttatttaactaaaaatggtgattcggatttcgcactttcgattagaacgatggtacttcataacggaaaagcttatgttcaagccggtgcgggaattgtctatgattccgatccagaaagcgaatacttagaaacattacaaaaagcgaaggcacttttggaggtgggagaatga

SEQ ID NO: 3288 - protein, 454 aa, Listeria monocytogenes
MRKMKKMDADTLTAILAFQRLSGTGKSLLEGAAKDAEAGRYSIIAINPVHEIKVYQHDYYIDGTHQVVADPLKEIELFIEKAREDELELPLDSGAIGYVGYDVIALYEDLGEIPVETRDIPDIRFYVYESFVIMDHQAEELILVQDNCYSGRSEADLDKALESMLTELTTPKKDEHKAVHVPKMSYKSNYTKDEYMGLVKKAKTYIQEGDFFQIVLSQRLEADFTVKPFDYYRKLRLLNPSPYLYFIDFGDTVLIGSSPESLIKTKGRTVITNPIAGTRRRGATKQEDELLASELLSDEKELAEHRMLVDLGRNDIGKIAETGSVHVPVYLTIERYRFLMHLVSVVEGTLKTGLTAIDALRSTLPAGTVSGAPKIRAMERIYEWENVKRGPYAGAVGYLTKNGDSDFALSIRTMVLHNGKAYVQAGAGIVYDSDPESEYLETLQKAKALLEVGE

SEQ ID NO: 3289 - DNA, 1365 bp, Listeria innocua
  CDS (1)..(1365)
atgagaaaaatgaaaagaatggatgcagatacattaaccgcgattttagcctttcaacgtctttccggaacaggcaaaagcttacttgaaggagctgcaaaagatgcagaggcagggagatattctattattgctatcaatcctgtacatgaaattaaagtatatcaacatgaatattatatagacggggcacttcaaatagtgacagaccctttaaaagaaattgaactatttattgaaaaagcaaaggcggaggaagaaagcttgcctttagattcaggggcaattggttatgttggttatgacgttattgcactttatgaaaatttaggtgacattccagtcgaaacgcgggacatgccagatattcgtttttatatatatgaaagttttatcatcatggatcatcaagcggaagaacttattttagtgcaagataattgctactctgggagaagtgaagcagagctggatgaggcacttgaagcgatgtttttagaacttacaacaccaaaaaaagatgaacacaaagcagttcaagttccgaaaatgacttacaaaagtaattatacaaaagaggagtatatgaacttagtcaaaaaagcgaaaacctatattcaagatggcgatttctttcaaatagtactttctcagcggttagaggcagattttacagtggagccgtttgattattaccgaaaattacgattgttaaatccttcgccttatctctttttcattgattttggcgatacggtcttaattggttcttcaccagagagtttaattaaaacgaaagggcggactgttacgacaaatccaattgctggtacaaggcgtcgcggggcaacaaaacaagaagatgaaatgctggcagcggaattattatccgatgaaaaagaacttgcagagcacagaatgttagtggatttaggacgtaatgatattggaaaaattgcagaaacgggttcggttcatgtaccagtatatctaacaatcgaacgttaccgattcttgatgcatttagtttccgttgtcgaaggtacattaaaaccaggattaagtgcgatggatgctcttcggtcgacgctgccggctggtacagttagcggagcaccaaaaataagagccatggagcgaatctatgaatgggaaaatgtaaaacgtggaccatatgctggtgcggtaggttacttaacgaaaaatggtgattctgattttgctctttcgattagaacgatggtactccatgatggaaaagcttatgtgcaagctggtgcgggaattgtttatgattcagaacctgagagtgaatacttggaaacaatacaaaaagcgaaagcccttttggaggtgggagaatga

SEQ ID NO: 3290 - protein, 454 aa, Listeria innocua
MRKMKRMDADTLTAILAFQRLSGTGKSLLEGAAKDAEAGRYSIIAINPVHEIKVYQHEYYIDGALQIVTDPLKEIELFIEKAKAEEESLPLDSGAIGYVGYDVIALYENLGDIPVETRDMPDIRFYIYESFIIMDHQAEELILVQDNCYSGRSEAELDEALEAMFLELTTPKKDEHKAVQVPKMTYKSNYTKEEYMNLVKKAKTYIQDGDFFQIVLSQRLEADFTVEPFDYYRKLRLLNPSPYLFFIDFGDTVLIGSSPESLIKTKGRTVTTNPIAGTRRRGATKQEDEMLAAELLSDEKELAEHRMLVDLGRNDIGKIAETGSVHVPVYLTIERYRFLMHLVSVVEGTLKPGLSAMDALRSTLPAGTVSGAPKIRAMERIYEWENVKRGPYAGAVGYLTKNGDSDFALSIRTMVLHDGKAYVQAGAGIVYDSEPESEYLETIQKAKALLEVGE

SEQ ID NO: 3291 - DNA, 1869 bp, Klebsiella pneumoniae
  CDS (151)..(1506)
gaattcgttccactgctttttgctgctgctcgtggctcagcgaaggtaaacctgcaaacatgactgactcctgctacattgtggggcgtaattatttcacgccgtccgcgcgtataccagcggacgtaacgatcaggattgaagaagacgatgttgtcccccgcaatgatttccctgccctggcgcccggatgccgctgaatactattttagcccgttaagttcccagccctgggcgatgctgctgcattccggttttgccgaacatgcgcataaccgttttgacatcattgtcgcccagccgcgcgccacgctggtgactcacggtcaactaaccaccctacgcgaaggggaaaccgtctcaacctccgccgccgatccgcttacgctggtgcatcagcagctggcgcactgtaacctgcagccgcagcctcatccgcatctgccgtttctcggcggcgcgctgggactgttcggctacgatttgggtcgtcgttttgaacatctgccggcgcgggccgacgcggatatcgaactgccggatatggcggtaggtatttatgactgggcgttaatcgtcgatcatcagcgccgggaggtatcgttattcagctatgacgatccgcaggcgcgcctggcgtggctggaagcacagactgcgcctgtcgctgcaacctttaccctgacctcagcgtggcgcgctaatatgagccgcgaggagtatggcgagaagttccgccagattcaggcttatctgcacagcggcgactgctatcaggtcaacctggcgcagcggtttacggcgacgtatcgcggggatgagtggcaggccttccgtcagcttaaccgcgccaatcgcgcgccgttcagcgcctttattcgcctggatgaaggggccgtattaagcctgtcgcccgagcgttttattcagctccggcaaggcgacattcagacccggcccatcaaggggacattacccaggctggccgaccctgagcaggacgcgctgcagcagcaaaagctggcgaactcgccaaaagaccgcgccgaaaatctgatgatcgtcgatttaatgcgtaacgatattggccgggttgcggaacccggtagcgttcgcgttcctgagctgtttgtggtggagcccttccccgccgtgcatcatctggtgagcaccgtcaccgccaggctgcccgctcatctgcacgccgccgacctgctgcgcgcggcctttcccggcggctcaatcaccggcgcgccgaaggtcagagcgatggagatcatcgatgaactggaaccgcagcggcgcaacgcgtggtgcggcagcatcggctatctcagcttctgcggcaacatggatagcagtatcactatccgtacgctgacggcctggcagggacacctctactgctccgccggcggcggaattgtggccgatagcgaagaggcagcggaatatcaggaaacttttgataaagttaatcgtatcctgcatcaactggagagctagaacatggcggacagcgccctcgaacttgacgatttcctctcgcgttttcagcttctgcgtccgcagccccacgcgccaccgctcaaccagcgccaggccgcggtgctggtaccgatagttcgccgcccgcagccggggctgctgctgacccagcgttcgccgctgatgcgcaagcatgcgggtcaggtggccttccccggcggcgcggtagataacagcgatgcaacgctaatcgccgccgcgctgcgtgaagcgcaggaagaggtggcgatcccgccggagtcggttgaggtgattggcgttctgccgccggtcgatagcgtgaccggctttcaggttactccggtggtagggattatccca

SEQ ID NO: 3292 - protein, 451 aa, Klebsiella pneumoniae
MLSPAMISLPWRPDAAEYYFSPLSSQPWAMLLHSGFAEHAHNRFDIIVAQPRATLVTHGQLTTLREGETVSTSAADPLTLVHQQLAHCNLQPQPHPHLPFLGGALGLFGYDLGRRFEHLPARADADIELPDMAVGIYDWALIVDHQRREVSLFSYDDPQARLAWLEAQTAPVAATFTLTSAWRANMSREEYGEKFRQIQAYLHSGDCYQVNLAQRFTATYRGDEWQAFRQLNRANRAPFSAFIRLDEGAVLSLSPERFIQLRQGDIQTRPIKGTLPRLADPEQDALQQQKLANSPKDRAENLMIVDLMRNDIGRVAEPGSVRVPELFVVEPFPAVHHLVSTVTARLPAHLHAADLLRAAFPGGSITGAPKVRAMEIIDELEPQRRNAWCGSIGYLSFCGNMDSSITIRTLTAWQGHLYCSAGGGIVADSEEAAEYQETFDKVNRILHQLES

SEQ ID NO: 3293 - DNA, 1389 bp, Leptospira biflexa
  CDS (1)..(1389)
atgagccaaacacttccgaaaatcaaaatccccaaaaaacccaattacaattctttagctttggcggaaggaatcgaattttgggaactctttcgggtcattgaggcgaaatacgaaaattgttttttgttagaatcagcaggagacaatcaatacgattctcgttactctgtgattggattccaaccatctcatctcattctcggagaacctggtattttggaaattgatgggaaaaaataccctgttgaaaatccttattttgctttaagagaacttactgattataattcgcttagtattagttatgcgggtggttttgttggttatcttggttatcaaagtatgcaattctttgagccaaaactccaactaaaaccacatcctgattttccagcgatgattttcggattgtatttggatggacttatttatgataaatttactggggaactcatttattttgataatggaactaatcgtatccatgaagtgaaccaaatcttagaacagctaaaaaaagaaaattcacaaaaaccaaaagcaacggtctccttagtaaaggctggattatctaaggaagttcataaacaaatggtggaagaagctttagaagaagtaaaagcaggaaacacctttcaatgccaaattggatttgaagaaatttaccaagtggatggaaatccattggctatttatgaaacattacgagaaatcaatccatctcctcatatgtattacgtaaatttggaactcgtaaccattttaggtgcaagtccgagttcgttgtttaggttgcgacaaggggaaatggaatcgtttcctttagctggaaccaccaaacgaggagttgatgcaaaagaagacactctccttgctcgtaaactattaacggatcctaaagaaatcgcagagcataatatgttaattgatcttcaccgaaatgatgtagggcgagtggcaaagtttggtacagtaaaagtgcgtaggcgttttgatgtaaaaagattttcccatgtacaacatatttctagtgaagtggtcgggattctttcttcaaaagaagatatgttttctgggcttgcttcttcgtttccacgaggaaccttatcaggtgctcccaaaattgaatccgattcgaaaatcatagagcgaattgaaaaatcgccaagaggtccctatgggggagctgttggaagttttggtttaaatggagattgtacttttgccattccaattcgtagtttttttgtgaatggaaagaaaggatttgtacgcgcttcgggtgggattgtttttggattcatagaaccagaggatgaataccaagaaattatcaataaaatggcctccgttcgaaaagccttagatttgcataaaggtccttag

SEQ ID NO: 3294 - protein, 462 aa, Leptospira biflexa
MSQTLPKIKIPKKPNYNSLALAEGIEFWELFRVIEAKYENCFLLESAGDNQYDSRYSVIGFQPSHLILGEPGILEIDGKKYPVENPYFALRELTDYNSLSISYAGGFVGYLGYQSMQFFEPKLQLKPHPDFPAMIFGLYLDGLIYDKFTGELIYFDNGTNRIHEVNQILEQLKKENSQKPKATVSLVKAGLSKEVHKQMVEEALEEVKAGNTFQCQIGFEEIYQVDGNPLAIYETLREINPSPHMYYVNLELVTILGASPSSLFRLRQGEMESFPLAGTTKRGVDAKEDTLLARKLLTDPKEIAEHNMLIDLHRNDVGRVAKFGTVKVRRRFDVKRFSHVQHISSEVVGILSSKEDMFSGLASSFPRGTLSGAPKIESDSKIIERIEKSPRGPYGGAVGSFGLNGDCTFAIPIRSFFVNGKKGFVRASGGIVFGFIEPEDEYQEIINKMASVRKALDLHKGP

SEQ ID NO: 3295 - DNA, 1425 bp, Methanococcus jannaschii
  CDS (1)..(1425)
atgataattaaaaaaataaaaatggatgtttgtccattagatgtttatgagcaaattaggggagagaatacatttttgttagaatcagctgaaggagttccaaaggtggcaagatactcaatcttaggaaaagctgaaggaaaagtaatatttaaaaatggaaagctgaaagttgaaagctttacagaatttggagataaagctaaagatttagaagggaaatacgaatgtcccttagacgctttaagagaggttagaaatgaatatcttaaatacattgatatatctaacattgagccaataccaagatttaaggggggtttagttgggtatttaagctatgatattatcagatactggatagatttatcaaatatcaacccaaagccaataaatgatttaaaatttccagatgcagagttctttattgttaaggactttatttcatttgatttaaaagagaaagtaattaatttaatagcagaggatgatgaaggtattagagaacttgaaagaattataaaaaatgcaaaaattggaaataatgacaataaagaagaaaaaactacagaaaataaggacttaaaaataaaatctaacatgagcaaagaggaatttattgaggcggttaaaaaagctaaggaatacatttttgctggagatatcttccaagtggttttatcaagaaggatagagatagatttagataacttagaccacttgaaaatttacaaaaaagttagagagataaatccttccccatacatgtattacttagattttggagacagaaagattataggttcatcaccagagattttggtaaggacagattataaagataataaaaggctggttataacaagacctatagctggaacaattaggaggggtaagacagaagaagaagataaagagttagagaaaaagctgttaagtgatgagaaagagagggcagagcatgttatgcttgtagatttagcaaggaatgatattggaaaaatatcaaaatttggaactgttgaagttactgatttcatgattattgagaaatactcccatgttcagcatatagtaagtaatgttgttggggagttaaaagacaattatgattcattcttagctgtaaaagctaccttcccagcgggaactttaagtggagcaccaaaggtcagagcgatggagattattgaagagcttgaaaaaacttggagaggaccttatggtgggggagttggctatttcggatgggatgatttaatggatttggctataacaatcagaacctttgtaatctcgaaaaataagggatatattcaagttggtgctggaattgtagctgattcaatcccagaaaatgaatgggaagagacagagagaaagggaatggctaacgttaagacgattgagagtttattgaaatga

SEQ ID NO: 3296 - protein, 474 aa, Methanococcus jannaschii
MIIKKIKMDVCPLDVYEQIRGENTFLLESAEGVPKVARYSILGKAEGKVIFKNGKLKVESFTEFGDKAKDLEGKYECPLDALREVRNEYLKYIDISNIEPIPRFKGGLVGYLSYDIIRYWIDLSNINPKPINDLKFPDAEFFIVKDFISFDLKEKVINLIAEDDEGIRELERIIKNAKIGNNDNKEEKTTENKDLKIKSNMSKEEFIEAVKKAKEYIFAGDIFQVVLSRRIEIDLDNLDHLKIYKKVREINPSPYMYYLDFGDRKIIGSSPEILVRTDYKDNKRLVITRPIAGTIRRGKTEEEDKELEKKLLSDEKERAEHVMLVDLARNDIGKISKFGTVEVTDFMIIEKYSHVQHIVSNVVGELKDNYDSFLAVKATFPAGTLSGAPKVRAMEIIEELEKTWRGPYGGGVGYFGWDDLMDLAITIRTFVISKNKGYIQVGAGIVADSIPENEWEETERKGMANVKTIESLLK

SEQ ID NO: 3297 - DNA, 1503 bp, Helicobacter pylori
  CDS (1)..(1503)
atgatcagtctcatagaaaaagccccttacattccctaccccctagctctttatgaaaaattagagcaaccacacaccttgctttttgaaagcgctgagattgagagcaaagcacacaccaaatcccttttaatggctaaagcctgtttgaagctcatttgcaaccacaacatcgtaactatcactagcctgacgcctaatggcggggcatttttgcaaaaattgagcgcgttttttaaaacgcccatacaagacaatgccctaattttaacctacaccaaaaataaaaaaacgcaagatgagtttttaaaactctttgagcctagcccttttgacgctttaagggggctttttaaaagcgttaaaacaaaacccaaacacccctttacgcttttaagcgcgggtgttttttcttttgaaatgctcaatttttttgaagatttgcctcacttaaaagcgaaagacaacacagtgcatgactttattttttatctcgcgcaaaatttgatcatcatagaccataaagaaaaaagcgttgaaatcttgggggcgtgttttgatgagcgctttaaaacagagatagcccaagaattacaagacttaaaagagttggctaaaagcatcaaaagcgactttgtccctaaaaaatccaagcaaagtagagaagttagcgctaattgtagcgatagcgagtttgaaaaaagagtgctatccttacaagaagaaatcaaaaaaggcgagatttttcaagcggtgttgtcgcgcagcttttatatggagtgcttggagggtttgagcgcgtattaccatttaaagctaactaatcctagcccctatatgttctatatcaaagacagcgatttcattctttttggggcaagccctgagagcgctttaaagtacaacgctttaaccaacacggctgaaatttatcccattgctggcacccgtttaaggggtaaggacaaacaggggaatattgattacgatttggatagtaaaatggaatttgatttgcaacacgactataaagaaagggctgaacacatcatgctagtggatttagccagaaacgacatggccagagtttcaaaaaaacgctattgcgacaagcttttaaaagtggataagtattccaatgtcatgcatttagtctcaagggttgtgggggaattgaaaaaagggtgcgatagtttgcatgcctacaggagctttatgaacgccggcacgcttagcggggcgcctaaaatctctgcgatcaggctcatttaccaattagaaaaccaaaggagaggctcttatggggggagcgtggggtatttaaatagcgagggttctatggattcttgcatcaccatccgttcatgttttgtcaaaaacaatagggccgtgatccaagcaggagccggtattgtgctagacagcgtgccacaaaacgaagcgaatgaaacaagagccaaagcgcaagcccttattgatgcgatcaggaaaacaagcttatga

SEQ ID NO: 3298 - protein, 500 aa, Helicobacter pylori
MISLIEKAPYIPYPLALYEKLEQPHTLLFESAEIESKAHTKSLLMAKACLKLICNHNIVTITSLTPNGGAFLQKLSAFFKTPIQDNALILTYTKNKKTQDEFLKLFEPSPFDALRGLFKSVKTKPKHPFTLLSAGVFSFEMLNFFEDLPHLKAKDNTVHDFIFYLAQNLIIIDHKEKSVEILGACFDERFKTEIAQELQDLKELAKSIKSDFVPKKSKQSREVSANCSDSEFEKRVLSLQEEIKKGEIFQAVLSRSFYMECLEGLSAYYHLKLTNPSPYMFYIKDSDFILFGASPESALKYNALTNTAEIYPIAGTRLRGKDKQGNIDYDLDSKMEFDLQHDYKERAEHIMLVDLARNDMARVSKKRYCDKLLKVDKYSNVMHLVSRVVGELKKGCDSLHAYRSFMNAGTLSGAPKISAIRLIYQLENQRRGSYGGSVGYLNSEGSMDSCITIRSCFVKNNRAVIQAGAGIVLDSVPQNEANETRAKAQALIDAIRKTSL

SEQ ID NO: 3299 - DNA, 1236 bp, Archaeoglobus fulgidus
  CDS (1)..(1236)
atgcaaaagcacgagtatgtaaacccggtgaagctctactcagccataagagacgagaaatttccgttcattctcgaatccgcggagaagagcggcagggcgagatacacatacatatccttcaaccccctctacacggtaagggtcggcagcagaaccagggttgatggggaggttatttcaaaaatctcggaccccttcgatgcgctgaatgagattcacgttaagggattgcttgtcggctacgttgcctacgaggcggtgaagaactatattggcaagaagccccaaaccccgtcggtttttggctgctacgatggttacttcgtttacgaccactacctgagaaagctcttcagcgtaaacgttgagaacgcggataagattgtcgagagggcgaagagggtagaggttgagcaagtgagggggaattcggaggtcctgagggccggaagcagggagaagtttgagaagatggtggagagagggaaggagcagattttcgagggcgaggtttaccagattgtgctttcaagggagtatgttgttgatacggatttgagccctttccagatgtatctgaatttgagggagacgaatccgagcccctacatgttcctgcttgagttcgacagggccctgatcggctcaagcccggagacgatgggaagggttgagggaaacagcttcataatcaacccgattgccggaaccgccaggagggaggcgggaagggagaaagagattgctgaaaagctcctcagcgatgagaaggagagggctgagcacgtcatgcttgttgacctagccagaaacgacgtgaggaaggtttgcagagcagggagcgttagagtttcgaggttcatggaggttgtggagtatccgagcgttctgcacatcgaaagcgaggttgttggagagctgaaggcgggagtgacgcacttcgacgctatgaaagccacctttcccgcaggaaccgttaccggagcgccgaaactgagggcgattgagctcatagacgaaattgagggggattgcagaggggtttacgctggtgctgttggctacttcagcgagaatgtttctgatctggccattgcaatcaggatgattgagttcgacggaaaggcgaggataagggcaggtgcggggatagttgcggactccgttcctgaaagggagtttttcgagacggaaaacaagatagcgagggttttgagggcggttgggctatga

SEQ ID NO: 3300 - protein, 411 aa, Archaeoglobus fulgidus
MQKHEYVNPVKLYSAIRDEKFPFILESAEKSGRARYTYISFNPLYTVRVGSRTRVDGEVISKISDPFDALNEIHVKGLLVGYVAYEAVKNYIGKKPQTPSVFGCYDGYFVYDHYLRKLFSVNVENADKIVERAKRVEVEQVRGNSEVLRAGSREKFEKMVERGKEQIFEGEVYQIVLSREYVVDTDLSPFQMYLNLRETNPSPYMFLLEFDRALIGSSPETMGRVEGNSFIINPIAGTARREAGREKEIAEKLLSDEKERAEHVMLVDLARNDVRKVCRAGSVRVSRFMEVVEYPSVLHIESEVVGELKAGVTHFDAMKATFPAGTVTGAPKLRAIELIDEIEGDCRGVYAGAVGYFSENVSDLAIAIRMIEFDGKARIRAGAGIVADSVPEREFFETENKIARVLRAVGL

SEQ ID NO: 3301 - DNA, 954 bp, Aeropyrum pernix
  CDS (1)..(954)
atgacagccttctcccctgaatatgttgtagtctacgatcacgcagggggaagggtgtcggtttgcccaggtgacaccccccttccggcgccggcgagtaggaaagagagtttctcggcggaaggccctacctatgagacctccaggaaagggttcgaagctatggtcgctgacgcgttggagaggatcagggctggagaggctttccaggtagtgttatccagggttgagaggtatagggtctgggggagcctgtttagcgcgtatgagaggctcgccgatgccaaccctagtccctacctatactacgctaggctgggcggcagggttatcatagggagtagcccggagctcctggtcaagctggaggcgggcagagttgagactcacccgatagctggtaccaggcctcgcggctcaacgcccattgaggacatcgagttagaagtagagttgttgaacgacgagaaggagagggcagagcatgtgatgcttgttgacctggctaggaacgatataacccgtgtatcgatccctggaaccgtacaggtaacaagcttcatggatatcgagagatacgagactgtaatgcatatagtaagcagggttgaaggagtgacaaggcccagcaccacattcgtcgaagcccttaaagccctccaccctgcaggcacggttagcggagcgccaaagcctagggccatggaaattatagccgaactagaggaagaggccaggggcccctacgcaggagccataggagtagcgggttctagcgcgggcgaggcggccatagtgctgaggagcgcctggctcctagatgacggggagaccttggaagctagagctggcgccgggatagtctatgatagcaagcccgagagagagtacatggagactgtccagaaactcggaagcctaaagagggctctgggggtggatatgtgtggctga

SEQ ID NO: 3302 - protein, 317 aa, Aeropyrum pernix
MTAFSPEYVVVYDHAGGRVSVCPGDTPLPAPASRKESFSAEGPTYETSRKGFEAMVADALERIRAGEAFQVVLSRVERYRVWGSLFSAYERLADANPSPYLYYARLGGRVIIGSSPELLVKLEAGRVETHPIAGTRPRGSTPIEDIELEVELLNDEKERAEHVMLVDLARNDITRVSIPGTVQVTSFMDIERYETVMHIVSRVEGVTRPSTTFVEALKALHPAGTVSGAPKPRAMEIIAELEEEARGPYAGAIGVAGSSAGEAAIVLRSAWLLDDGETLEARAGAGIVYDSKPEREYMETVQKLGSLKRALGVDMCG

SEQ ID NO: 3303 - DNA, 1377 bp, Vibrio cholerae
  CDS (1)..(1377)
atgaataacaaccaaactttgtcaattgaacacaaaaaattaacttatcaccctgatattgctaaacaatttttcacatccattgagcagcaaccttgggcaatgctgctgcgctctgcgtctaccacccatatggatagccgctttgatattctggtcgccaatcctttcgccactttagtgacttttggtgatgaaactgaaattcacgcccagaacggcgtgacattgtcacgagaagatccttttgcgcttcttgctgacatccaagagcagtatcttcctcaagtgactgatgagtcggagttaccttttgttggcggtgctctggggtatttttcctatgatttaggacgccgagtcgaagtcctccctagcttagcagaacaagatattgctatgcccgatatggccgtgggcatctattcttgggcgctcgtggtcgatcaccaacagcacaccgcgcaattggtcggacaaaatgttgaagacgcttggggttggttaaaccaacaagaggcgataaagccaagcgaagtaactgactttgctctcacatcgccttggcgatccaatatgagctataccgcctatcaagataaatttgctcgtgtacaggactatttacgctcgggagactgttaccagatcaacctcgcgcagcgttttcaggctcactacactggtagtgaatggcaagcgtatttgaagctggaaaaaggtaatcaagcgcccttctccgcctttttgcgtttgccacaaggcgcaattttgagtgtttctccagaacgttttctgcaagtttgtgatcgagtgattgaaaccaaaccgatcaaaggcacacgtccacgccatgccgacaagcaacaagatgccctactcaagcaagatttagtcagcgcagaaaaagatcaggccgagaatttaatgattgtcgatctgctgcgtaatgatattggtcgtgtggcaaagccgggtagcgtgcatgtacctaagttgtttgatgtcgaaagctttcccgccgtgcaccatctggtgagcacgattcgcgcaacactggatgagcaataccaagccgccgatctgttacgcgcctgttttcccggcggttcgattacgggagcgcccaaagtgcgggcaatggaaatcattgaggagctcgagccgcatcgccgtagcgcttattgtggctcaattggctatctcagccgtcatggaaaaatggataccagcatcacgatccgcactttagtggcctatcagcagcagctttacgcttgggcgggtggcggcttggtggctgacagcgaaggcgctgcggagtatcaagaaacgctagataagttaagccgaattcttccaaccctagaatcctaa

SEQ ID NO: 3304 - protein, 458 aa, Vibrio cholerae
MNNNQTLSIEHKKLTYHPDIAKQFFTSIEQQPWAMLLRSASTTHMDSRFDILVANPFATLVTFGDETEIHAQNGVTLSREDPFALLADIQEQYLPQVTDESELPFVGGALGYFSYDLGRRVEVLPSLAEQDIAMPDMAVGIYSWALVVDHQQHTAQLVGQNVEDAWGWLNQQEAIKPSEVTDFALTSPWRSNMSYTAYQDKFARVQDYLRSGDCYQINLAQRFQAHYTGSEWQAYLKLEKGNQAPFSAFLRLPQGAILSVSPERFLQVCDRVIETKPIKGTRPRHADKQQDALLKQDLVSAEKDQAENLMIVDLLRNDIGRVAKPGSVHVPKLFDVESFPAVHHLVSTIRATLDEQYQAADLLRACFPGGSITGAPKVRAMEIIEELEPHRRSAYCGSIGYLSRHGKMDTSITIRTLVAYQQQLYAWAGGGLVADSEGAAEYQETLDKLSRILPTLES

SEQ ID NO: 3305 - DNA, 1497 bp, Xylella fastidiosa
  CDS (1)..(1497)
atgattaaaatactaacaactactacagatgtacctctagatggaagtgatctaagagaaaatgcctttttaatctatcgaaaactgttaaaaaattttgatagcgatcaattgatgcttttagagtctttggggataaattcggttgactctcgagtttcgatggtaggcataaacccgatcattactgttaatgtaaaaaataagacgatatcaatacacagcaatcctatcttactaaaagaattaaatatagctgacagtatcgcttcacttcagacaacaacattatcactgtccgtctatcaactcgtcgataaaaagatggtatggcaattcctaaaggaatttgagaaaaacttttctcaagtaccgacgcatcaatgcggaattatggctttctcctgcttttcttatgaaaccatccattacatagagacaattccagaaactgaactcaacgatcaagatgaccatgatataactttaatactttaccaatcacaattagtaattgaacaaaacaaggctgaacttatcacctattctttccctggtgttgaggatttttacgttgcgaatattattgatgcaatcacatgcatgactgatgttgaacaagtacaagataaaaatattgattttgaagtaatacaagaaacaacacgtcatgactaccttgataaagtaagaaaagcattacaccatgttactgtcggagatatttaccaagtacaaataggacagaagatccaagtaaaagcagagaccacaccgcttgatgtctatcggcgattacggatattaaatccttcaccctacatgtatttatttagtataaacggtcagacagtcattggcgccagccctgagttatttttgcgcatcagtacggatgaagaaattctcatgcgtccgattgctggcacattaggaaaaagagagggacgcactcttcatcatgcaacacaacatttgcaagctgacaacaaggaagttgctgagcacatgatgttagttgatttatgtcgtaatgatatatatcgcgtctgtactccagaatcactcaaagtttcaggcgtattggagattgaagaatactcgcatgtatatcatatggtttcgacaaccaaagcaatgttaaaacaaggactcgacaaatacgatgtgatgatcgcatcgtttccagcgggaaccatgactggagcaccgaaggttcgggccatggaaatcatctcagagcttgaggatagccagcgcggtaaatatgccggtgcgctcggcatcctaggcattggatccaactatatcaatactgcactttgtatccgctctactgtcttaaaaaaccaagtctataccttgcgcgcatctgcagggattgtttccgactctcaagaacagtctgagtacttagaaacacttcacaaaatgggatctatatttaaagcaattactggggaagaaatttcatgccatatcgagtcatcgtcgtag

SEQ ID NO: 3306 - protein, 498 aa, Xylella fastidiosa
MIKILTTTTDVPLDGSDLRENAFLIYRKLLKNFDSDQLMLLESLGINSVDSRVSMVGINPIITVNVKNKTISIHSNPILLKELNIADSIASLQTTTLSLSVYQLVDKKMVWQFLKEFEKNFSQVPTHQCGIMAFSCFSYETIHYIETIPETELNDQDDHDITLILYQSQLVIEQNKAELITYSFPGVEDFYVANIIDAITCMTDVEQVQDKNIDFEVIQETTRHDYLDKVRKALHHVTVGDIYQVQIGQKIQVKAETTPLDVYRRLRILNPSPYMYLFSINGQTVIGASPELFLRISTDEEILMRPIAGTLGKREGRTLHHATQHLQADNKEVAEHMMLVDLCRNDIYRVCTPESLKVSGVLEIEEYSHVYHMVSTTKAMLKQGLDKYDVMIASFPAGTMTGAPKVRAMEIISELEDSQRGKYAGALGILGIGSNYINTALCIRSTVLKNQVYTLRASAGIVSDSQEQSEYLETLHKMGSIFKAITGEEISCHIESSS

SEQ ID NO: 3307 - DNA, 1362 bp, Pseudomonas aeruginosa
  CDS (1)..(1362)
atgcccagttgtcatgttcaccccctgccctaccatagcgacccaagctgtctctttgccatcatccatgaggcgcccggtgcggtgatgctcgattcgggtcgccccatcgctacccgtggacgctatgaccttatgagcgcctggccattggcagaactggcgccgctgcccgacgaatcggccaaccgcttcttcgcccgcctacgcgaagcggccggaagcctgggccccgcgcagctgccagcgccgtacgaactgcccttcgccggcggtctgctgggctatttatcctacgacctgggtcggcgcatcgagcgcatcggcgaacacgcccgcgatgacctgggcctgccgctggcctccgtcggcctgtatgcctgggcgctgatcagcgaccaccaggccggcaccagccaactggtattccacccgcgattggacgagcgcgaacgccagcgcctgatcgccctgttcagcgaggaagcgcaaggcacggccggcaacttcaagcttctgggaaaattccgacggagcatcagcgcatccgactatcggcaggcgatccgccgcatccaggactacatccaggcaggcgactgctaccaggtgaactatagccagcgcttccaggccgcttgcagcggctcgccgtggccggcctatcgcgccctgcgcgaggcctgcccgacgccgttctccggctacctgcgactggccgacggcgcgatcctcagcctgtcgccggagcgcttcctcaagctcggcaagggcaaggtggaaacccggccgatcaagggcacccgcccgcgcggcaagacccccgaggaggacatggcgctggcggcgtcgctgctggccagccccaaggaccgcgcggaaaacctgatgatcgtcgacctgctgcgcaacgacatcggacgcagttgccaacctggcagcgtacgggtaccggagctgtttgccctggaaagctatcccaacgtgcatcacctggtgagcagcgtcaccggcgaactggcgccgggcaaggacgccctcgacctgctggaaggcagcttccccggcggctcgatcaccggcgcgccgaagattcgcgccatgcagatcatcgacgagctggaaccgagccgacgcggcatctactgcggcagcctgttctacctcgacgtgcgcggcgagatggacagctcgatcgccatccgcaccctgctggtcagggacggccaggtcagttgctggggcggcggcggcatcgtcgccgactcgcactgggaggacgagtaccaggaaaccctggacaaggtccgggtgctgctggaaaccctggaaggaatggccgggacagcgtccccggaatag

SEQ ID NO: 3308 - protein, 453 aa, Pseudomonas aeruginosa
MPSCHVHPLPYHSDPSCLFAIIHEAPGAVMLDSGRPIATRGRYDLMSAWPLAELAPLPDESANRFFARLREAAGSLGPAQLPAPYELPFAGGLLGYLSYDLGRRIERIGEHARDDLGLPLASVGLYAWALISDHQAGTSQLVFHPRLDERERQRLIALFSEEAQGTAGNFKLLGKFRRSISASDYRQAIRRIQDYIQAGDCYQVNYSQRFQAACSGSPWPAYRALREACPTPFSGYLRLADGAILSLSPERFLKLGKGKVETRPIKGTRPRGKTPEEDMALAASLLASPKDRAENLMIVDLLRNDIGRSCQPGSVRVPELFALESYPNVHHLVSSVTGELAPGKDALDLLEGSFPGGSITGAPKIRAMQIIDELEPSRRGIYCGSLFYLDVRGEMDSSIAIRTLLVRDGQVSCWGGGGIVADSHWEDEYQETLDKVRVLLETLEGMAGTASPE

SEQ ID NO: 3309 - DNA, 1461 bp, Bacillus halodurans
  CDS (1)..(1461)
atggcaggagtgaggttgttgcagcaaggaaagcaagagacgaaacgaacggtttgcgccacttcctttccgatggaggagagccagttttttcgccgctataaaaagcaatcaagggatcgggagcggcacgtattgttggagagcggtaggggtggacgatacagcatggtcggacttgagccggtcatggttcttgaaggcaagaaagatacattaatcgttacgacagaaaatgaagtcgtgaaacggcaaggagctttattagatttaatgcgcgacgcacttgcctcgtatcaagcggaaacgttaccaggtgctcccccatttcagggaggtgcgattggctttttcagttatgaccttgtccgtgaaattgagcggttgccaactatcgctcaagatgacttgaatcttccggacttatattttcttatttttgatgatgtgtttatttatgatcatgaaaaaaaggttgcgtggatctttgttcatggggacgccagtgaacaagacttatcggagcaaaagctaagacattacgaagcgacatggaagcagccggtcagcttggacgaagaagttgcaacctcttatttggaaacagaaggggagaaggtccattcatttagcgaagagacgttcgcaaaagctgtagagagagtgcgagagtacattgcggcaggggatgtgttccaagtgaacttatccgttcgcgaaggacgccctttaaggacaactccattatcgatttatgaggcgttacgtcagatcaatccttcgccctatatgagttatttgcacaccccagatttccagcttgttagcggttctccagagttgttaatcaaaaaagatagccggaagttaagcactcgtccgattgccggtacccgttctcgcggggcaacggctgatgaggatgaagctctcgttcagacattattgtcaaatgaaaaagagcgggccgaacatgtgatgctcgtcgatttagagcgaaacgacctcgggcgtgtaagtgaatacggttcggttgaagtgaacgagcttatggttgtggaaaaatactcccatgtcatgcacattgtttccaacgtacgaggggtgttaaaagaggggcttgatgcatttgatgcgatccgcgctacgttcccaggcgggacgataacgggtgcgcctaaagtacgaacgatggaaatcattgaagagctagagccggttcgtagaggaatttatacgggttcaattggctggattggttataatggtgatatggaactgaacattgtcattcgcacaatgttgtgtaaagatgagatggcgtatgttcaagcgggagcgggtgtggtcattgactccaatcctcgctatgaatataaggaatcattgaagaaagcaaaagcattatggcgggcgtacgaccagagtatagacgagcaaaagcaaagaatagaaaagtag

SEQ ID NO: 3310 - protein, 486 aa, Bacillus halodurans
MAGVRLLQQGKQETKRTVCATSFPMEESQFFRRYKKQSRDRERHVLLESGRGGRYSMVGLEPVMVLEGKKDTLIVTTENEVVKRQGALLDLMRDALASYQAETLPGAPPFQGGAIGFFSYDLVREIERLPTIAQDDLNLPDLYFLIFDDVFIYDHEKKVAWIFVHGDASEQDLSEQKLRHYEATWKQPVSLDEEVATSYLETEGEKVHSFSEETFAKAVERVREYIAAGDVFQVNLSVREGRPLRTTPLSIYEALRQINPSPYMSYLHTPDFQLVSGSPELLIKKDSRKLSTRPIAGTRSRGATADEDEALVQTLLSNEKERAEHVMLVDLERNDLGRVSEYGSVEVNELMVVEKYSHVMHIVSNVRGVLKEGLDAFDAIRATFPGGTITGAPKVRTMEIIEELEPVRRGIYTGSIGWIGYNGDMELNIVIRTMLCKDEMAYVQAGAGVVIDSNPRYEYKESLKKAKALWRAYDQSIDEQKQRIEK

SEQ ID NO: 3311 - DNA, 1467 bp, Halobacterium sp. NRC-1
  CDS (1)..(1467)
atgcctgactcggcggcgcttgcgaccgaccccgcggcgttccgcgacgccgccggcgacgccacagcaccgacgcgtgccgtagtcgaggcgcgcctgccggtcaccgacccgttcgcggcgtaccggcgcgcccgcggcgacgccccgtcgttccactacgagaccaccggcggcagcgacggctggggctacttcggcgtcgatccggcgtcgatgctgcgggccgacggcgcgggcgcgctcgacaccgtccaggccgccgtcggcgcgcgcctcgctcgggtcggctgcgacgtcccacaccccggcggcctgttcggctggctcagctacgacatcgcccgcgaactcgaagcgatccctgacaccaccaccgacgcgcgcgggctgccccgcctccaactcggcgtctaccccacgatcgcggcgtggcgcgagccgttcacgcctggggacgacctccgcctgatcgccgccgtcccggtcgacgagtacacccccgacggcgcgttcgaggccggccgcgaccgcgtgcagtcgcttgcggcagccatccgggacggcgaccccgcggtcggcccgccacccgccgactcccccgcgccgttcgagagcgtcgccggccgcgcggcgttcgagtcgcgggtccgtcgcatccaggacgccatccgggacggcgacaccttccaggcgaacgtcagccaccgcctcgacgccccggcggccgtccacccggtggcggtgttcgaggcgctccgggacaccaaccccgcgccctactcggggatcgtcgagttcccgggcgtcgatctggtgtcggccagcccggagctgctgctcgcgcggcgcggccgcgagctcaccaccgagccgattgcgggcacacgcccccgcggggccacccccgccgaggacgacgccgcccgggcggcgctccgcgccgacgacaaggagcgcgccgagcacgcgatgctggtcgatctggagcgcaacgacctcgggaaggtcagcgagtacggctccgtggcggtccccgactaccggcgcgtggacgcgtacagcgaggtgttgcacctcgtcagcgaagtcacgggccggctccgcgactcgtgttcgctccgtgacgcgatcgccgcggtctttcccggcggaactattaccggcgcgcccaagccccgtacaatggcgctcatcgacaccgtcgaagccacccgccgcggtccctacacgggcagcctcgccgccatcgggttcgacggtgacgccacgctcagcatcaccatccgaacgctcgtcagacgcgccgccacctaccacctgcgcgtcggcgccggcatcgtccacgactccacgcccgcagccgaatacgacgaaaccctcgcgaaagcccgcgcgctcgtcaccgcgctgggggacgccggcggcatcgggcgcgtcgccgacacgacgcccgacaactcgtga

SEQ ID NO: 3312 - protein, 488 aa, Halobacterium sp. NRC-1
MPDSAALATDPAAFRDAAGDATAPTRAVVEARLPVTDPFAAYRRARGDAPSFHYETTGGSDGWGYFGVDPASMLRADGAGALDTVQAAVGARLARVGCDVPHPGGLFGWLSYDIARELEAIPDTTTDARGLPRLQLGVYPTIAAWREPFTPGDDLRLIAAVPVDEYTPDGAFEAGRDRVQSLAAAIRDGDPAVGPPPADSPAPFESVAGRAAFESRVRRIQDAIRDGDTFQANVSHRLDAPAAVHPVAVFEALRDTNPAPYSGIVEFPGVDLVSASPELLLARRGRELTTEPIAGTRPRGATPAEDDAARAALRADDKERAEHAMLVDLERNDLGKVSEYGSVAVPDYRRVDAYSEVLHLVSEVTGRLRDSCSLRDAIAAVFPGGTITGAPKPRTMALIDTVEATRRGPYTGSLAAIGFDGDATLSITIRTLVRRAATYHLRVGAGIVHDSTPAAEYDETLAKARALVTALGDAGGIGRVADTTPDNS

SEQ ID NO: 3313 - DNA, 1584 bp, Halobacterium sp. NRC-1
  CDS (1)..(1584)
atgatcgaaaccgaccgcgagacgttcaccgcactcgccgacgatggccccgcgatcgtgcgcgtcgccgccgacctcgatatcgacgtggcaccgctgacggcgtacgacgcgctcgttgccgacgccgacgaccacgccttcctgcttgagagcgccgaaaagacccccgccagcgaccccgacggggcgtttacccccgacacgaccaccgaagagacccgccacgcccgctactcgttcgtgggctacgaccccgcggccgtcgtcaccgtcgaccccgacgacacgacgatcacgcggctgcgcgacgaccccatcaccgacctgctggacgcccccgaccacgccaccggagatgtgcttgaccgcctccggtcggtgatgcccgcggtcccgcgccgcaacatccccaccgaggaccgccagctgctcgatggcggcctggtcgggttcctcgcctacgacgccgtctacgacctctggctcgacgaggtcggcgtcgagcgtccgccgacgccgctgccggacgcggagttcgccgtgaccacgcgcacgctcgtgttcgaccgcgccaccgactccgtctcgctcgtgtgcacgccggtcgccgacgcggacaccgccacggacgtctacgacgccctcgaagccgaagccaagcgcgtgcaggccgtgcttcgggacgcgaccgcgcccgccaccgccggcatcgaggtgaccaccgagcgcgccggcgaccgcgacgcctacaccgacgccgtcgagaccgccgcgaccgcggtccgggacggcgaagtgtatcaggcggtggtttcacgcacgcgcgagcttgacggtgacatcgacccgcgggcgctctacgacgcgctgcgcgcggtcaacccctcgccgtacatgttcctgctcgcgcacggggaccacacggtcgtgggtgccagcccggagacgctggtcgcggtccacgacgacaccgtcgtcacgaacccgatcgcgggcacctgccagcgcggcgccagcccggtggcggaccgccgcctcgccggggagatgctcgccgacgagaaggaacgcgccgaacacacgatgctcgtggatctcgcgcgcaacgacgtgcgccgcgtgagcgcgcccggcaccgtctcggtgcccgagttcatgcgcgtgctgaagtacagccacgtccagcacatcgaatccacggtcaccgggacgctggccgccgacgccgacgccttcgacgcgacccgcgcggcgttcccggcgggcaccctctcgggcgcgccgaaggtccgcgccatggagcacatcgacgccatcgaagccacaccgcggggcatctacggcggcggcgtggggtatttctcctggaccggtgacgcggagctcgcgatcaccatccgatccgggacgatcacccacaccggcgacgaggacacgctcaccgtccgggccggtgcgggcgtcgtcgccgacagcgacccggacgccgagtacgaggagaccgaggcgaaaatggacggcgtgctcgcggccgtggaccgactccggacgaccgacgacggggaggcggtgcaccgatga

SEQ ID NO: 3314 - protein, 527 aa, Halobacterium sp. NRC-1
MIETDRETFTALADDGPAIVRVAADLDIDVAPLTAYDALVADADDHAFLLESAEKTPASDPDGAFTPDTTTEETRHARYSFVGYDPAAVVTVDPDDTTITRLRDDPITDLLDAPDHATGDVLDRLRSVMPAVPRRNIPTEDRQLLDGGLVGFLAYDAVYDLWLDEVGVERPPTPLPDAEFAVTTRTLVFDRATDSVSLVCTPVADADTATDVYDALEAEAKRVQAVLRDATAPATAGIEVTTERAGDRDAYTDAVETAATAVRDGEVYQAVVSRTRELDGDIDPRALYDALRAVNPSPYMFLLAHGDHTVVGASPETLVAVHDDTVVTNPIAGTCQRGASPVADRRLAGEMLADEKERAEHTMLVDLARNDVRRVSAPGTVSVPEFMRVLKYSHVQHIESTVTGTLAADADAFDATRAAFPAGTLSGAPKVRAMEHIDAIEATPRGIYGGGVGYFSWTGDAELAITIRSGTITHTGDEDTLTVRAGAGVVADSDPDAEYEETEAKMDGVLAAVDRLRTTDDGEAVHR

SEQ ID NO: 3315 - DNA, 1542 bp, Caulobacter crescentus
  CDS (1)..(1542)
atgagtttggagcccgcgttcgacgccttctcggaagcctatgactccgggcggcagcaagtcgtttggacccgcctgatcgacgatctggagacgccggtttcggcctatctgaagatcgcccaggcgcggccctacagcttcctgttcgaaagcgtcgagggcggagcgtggcgcggtcgttattcgatcgtcacgatgaatccggatctcgtctggcgctgtcgcggcgaccaggccgagatcgccgagggcgacgacatcgccgccggccggtttacgccgcagcccggcggcgcgctggacagtctgcgcgatctggtggcgcgctcgcgcatggacctgcccaagggcttaccgccgatggccgccggcgtgttcggcgccttgggctacgacctggtgcgcctggtcgagcgccttccggacgtcaatccggacgccttgaacctgcctgacggcatcatgacccgcccgtcgatcgtggcggtgttcgacgccatcgcgcaggagatcatcctgacgacgaccgtacgcccccaggccggcgtatcggccaaggcggcccacgacgccgcccgcgcgcggatcgaggcggtgatggccgacctgcaccgtccgctcgcccacgacgcgccccgcccgccgcgcgggccgatggacttcaccaccccggtcagccgcgcggactacgcagaggtcgtggccaaggccaaggactacatcgccgccggcgacatcttccaggtggtggccagccaccgcttccgcgcgcccttcgacctcccgccgttcgccctctatcggtcgctgcgccgaaccaatccctcgcccttcctgttcttcctgaacctggacggcttcaatctggtcggctccagccccgagattctggttcgcctgcgcgacggcaagatcaccatccggccgatcgccggcacccgtccgcgcggcgcgacgcccgaggaagacgccgcgctggaagccgagctgctggccgatcccaaggagcgcgccgagcatctgatgctgctggatctgggccgcaatgacgtcggccgcgtggcgatgctgaaccatcacggccgcaacgcaccgccggaacaggcccgcccgaagggcccgaacgtgcgcgtgaccgagagcttcacgatcgagcgctacagccacgtgatgcacatcgtctcgaacgtcgaaggaaccgcgcctgaaggcgttgatcccgtcgacgtcctgatggccgccctgcccgccggcacgctgtcgggcgcgcccaaggttcgcgccatggagatcatcgacgagctcgaggtcgagaagcgcggcattagctatgctggcgcggtcggctatttcggcgccgacggcgcagtcgacacctgcatcgtgctgcggaccgctctggtgaaggacggcatgatgtacgtccaggccggcggcggcatcgtcgccgacagcgatccggacgccgagtacgacgagaccctgcacaagtcccgcgctctgaagcgcgcggccgaagaggcctggcgattcagctga

SEQ ID NO: 3316 - protein, 513 aa, Caulobacter crescentus
MSLEPAFDAFSEAYDSGRQQVVWTRLIDDLETPVSAYLKIAQARPYSFLFESVEGGAWRGRYSIVTMNPDLVWRCRGDQAEIAEGDDIAAGRFTPQPGGALDSLRDLVARSRMDLPKGLPPMAAGVFGALGYDLVRLVERLPDVNPDALNLPDGIMTRPSIVAVFDAIAQEIILTTTVRPQAGVSAKAAHDAARARIEAVMADLHRPLAHDAPRPPRGPMDFTTPVSRADYAEVVAKAKDYIAAGDIFQVVASHRFRAPFDLPPFALYRSLRRTNPSPFLFFLNLDGFNLVGSSPEILVRLRDGKITIRPIAGTRPRGATPEEDAALEAELLADPKERAEHLMLLDLGRNDVGRVAMLNHHGRNAPPEQARPKGPNVRVTESFTIERYSHVMHIVSNVEGTAPEGVDPVDVLMAALPAGTLSGAPKVRAMEIIDELEVEKRGISYAGAVGYFGADGAVDTCIVLRTALVKDGMMYVQAGGGIVADSDPDAEYDETLHKSRALKRAAEEAWRFS

SEQ ID NO: 3317 - DNA, 1557 bp, Haemophilus influenzae
  CDS (1)..(1557)
atgaacattcaaactcaagcctttattgcggtgacagctcaacccattccctattatgctgacaccaccgctatttttaatacactttgtcaatccaattcaaattctcttctactcgactctgccgaaatcggtagtaaaaacagtttacaaagccttatcttagtcaatgctgcggttaaaataacgtgcttaggtcacaacgtcacatttaaagctttaaataataatggaaaacaagttttaaaagaaattcatccaaaattaaccgcacttggaaaagtaagtgcggtcaattttgaagacgaattttctgtacaatttttgccacttgataatcaacttgatgaagatagtaaattacagtctgccactatttttgatgggttgcgtgttatttctagtctttatcaacatagccaaacgcctattttcttaggcggattatttgcttacgatctcgtcgcaaattttattccaatggatggcattacattaaaaaatgatggtatcaactgccctgattacagtttctatcttgccgaacacctcattactatcgaccatcaaaatcaacaagcaacactgaaaagtttctgttttgctcaagaagaacaagttaatattgcgaaaacctccctttccatcgcacaaaaactaaaaaatattgatcacgttctttctattaaagcggcaagtgatgaagttaaaacaaactttgacgatcctgaatttactggtatcgtaaaagccttaaaacaccatattaatattggagatgttttccaaattgtgccttctcgccgtttctcccttgcttgcccgaatacattagccagttacgctcaactcaaacaaaataatccaagcccttatatgttctatatgaacgatgaagactttattttgtttggtgcatcgccagaaagtgcgctgaaatacgcgccagaaaatcgtcagctagaaatttaccctatcgcaggttcacgccctcgtggttttgatgctcacggcaacattgatcctgaattggatgcgcgtttagaactagaacttcgccttgatcataaagaacaagcagaacatttaatgttagttgatttagcgcgtaacgacattgctcgagtttgccaaagtggcacccgtaaagtggcagaattaatgcaagtggatcgctattctcacatcatgcatttagtgtctcgtgtggtgggtaaattacgccctgaattagatgcacttcacgcctatcaagcctgtatgaatatgggcacattaactggtgcgcctaaaattaaagcgatgcagcttatttatcaatttgagcagcaaaaacgccatagttacggtggtgcagtgggttatctcacgtccgatggacattttgatacctgtatcgtgatccgttctgcttttgtacaaaatggaatggcccatgtacaagcaggttgcggcgaagtgttggattctgatccacaaatggaagctgatgaaacacgccacaaagccgcggctgtcttaaaagcaattcgtcaagttaatacacaagcaaaataa

SEQ ID NO: 3318 - protein, 518 aa, Haemophilus influenzae
MNIQTQAFIAVTAQPIPYYADTTAIFNTLCQSNSNSLLLDSAEIGSKNSLQSLILVNAAVKITCLGHNVTFKALNNNGKQVLKEIHPKLTALGKVSAVNFEDEFSVQFLPLDNQLDEDSKLQSATIFDGLRVISSLYQHSQTPIFLGGLFAYDLVANFIPMDGITLKNDGINCPDYSFYLAEHLITIDHQNQQATLKSFCFAQEEQVNIAKTSLSIAQKLKNIDHVLSIKAASDEVKTNFDDPEFTGIVKALKHHINIGDVFQIVPSRRFSLACPNTLASYAQLKQNNPSPYMFYMNDEDFILFGASPESALKYAPENRQLEIYPIAGSRPRGFDAHGNIDPELDARLELELRLDHKEQAEHLMLVDLARNDIARVCQSGTRKVAELMQVDRYSHIMHLVSRVVGKLRPELDALHAYQACMNMGTLTGAPKIKAMQLIYQFEQQKRHSYGGAVGYLTSDGHFDTCIVIRSAFVQNGMAHVQAGCGEVLDSDPQMEADETRHKAAAVLKAIRQVNTQAK

SEQ ID NO: 3319 - DNA, 1395 bp, Methanobacterium thermoautotrophicum
  CDS (1)..(1395)
atgaatgtttttggcattacagaactgaaaaacccggtaaaggaaaagatagaatttaaagaaccctttgaactattcaaaagtatttattctgaatacgactcatcattccttctggagtcaatggaaagcgacacgggtcttgcaagatactcattcatgggattcgagccacagatgataataagggcccgttcaggttttatagaagttgaatacgagggatcaagggaggagtttgatacagaaaacccctttgaattcctgaggcagttcacaagacccgctggaaaatccaggggcttctgtgggggccttgttggctacatatcctatcaggctgcaaggttctttgacagtatcaacctcagccccggaaacttcccggactttgaattcggactcttccttgacggtatcatgttcaaccacctcacaggagaatgcagttacatcagcctcaaggagaacagactcccggaaatatcagaactgctgcgcgaggaaaccccaacagggcaccttaaatacaggagcatggggaccctgttctcaaggaggagataccttggaatggtggaggaggcaagggagaggatagctgagggcgaaatattccaggcagtcctctcaaatgccactgactacaggctccgtggtgacaggcttgccctctacgaagccctcaggagggttaacccctccccctacatgtaccacctgaaacttggcagcagggagataacaggttcaagtcctgaaatgcttgtccgtgtggaggataaacagattgaaaccttcccaatcgcaggaaccaggccaagggggaaaacaccccatgaggatgagagaatagcggcggaactgctgtcagatgagaaggaacttgcagagcacctcatgctcgttgaccttgcaaggaacgacctcgggagaatatctgagtttggcacggtccaggtaccggagtacatgaccataaggaggttctcccatgttcagcacatcctctcccatgtaaccggcagactcaggaagggcatggatgcccttgatgcccttggcgcggtcttcccggcaggtacagtgagcggggcgcccaaaataagggctatggaaataatagagtcacttgagggggtgccgaggaatgcctacgccggtgccctgggctatctctcactgaacggtaacgcagacttcgcaataaccataagatccatggtcgctgagggagcgtatggaagaatacaggcaggggcaggtatagtacatgactccgtacctgagagggaatacgtggagtgccagaacaaggccatggcggtccttaaatcaatggaactggcaggtgatggctttgattctgatgaaccatttatcgccaggaggtaa

SEQ ID NO: 3320 - protein, 464 aa, Methanobacterium thermoautotrophicum
MNVFGITELKNPVKEKIEFKEPFELFKSIYSEYDSSFLLESMESDTGLARYSFMGFEPQMIIRARSGFIEVEYEGSREEFDTENPFEFLRQFTRPAGKSRGFCGGLVGYISYQAARFFDSINLSPGNFPDFEFGLFLDGIMFNHLTGECSYISLKENRLPEISELLREETPTGHLKYRSMGTLFSRRRYLGMVEEARERIAEGEIFQAVLSNATDYRLRGDRLALYEALRRVNPSPYMYHLKLGSREITGSSPEMLVRVEDKQIETFPIAGTRPRGKTPHEDERIAAELLSDEKELAEHLMLVDLARNDLGRISEFGTVQVPEYMTIRRFSHVQHILSHVTGRLRKGMDALDALGAVFPAGTVSGAPKIRAMEIIESLEGVPRNAYAGALGYLSLNGNADFAITIRSMVAEGAYGRIQAGAGIVHDSVPEREYVECQNKAMAVLKSMELAGDGFDSDEPFIARR

SEQ ID NO: 3321 - DNA, 1509 bp, Bacillus halodurans
  CDS (1)..(1509)
atgaacgtaacccctttttcggctgttaaagcagccaaccagcagtttcgcacaattcccgtaatcggtgaatgctttgccgatgctgttaccccgattcatattgtccagcaacttggagacgaagtggcgtttattttagaaagtaaggacgacgaatccccatgggcaagattttcatttattggtctgaacccgtttgtggagttaatagaacaaaatggtgtctatcaatcaatcagccgaagcggctcgattctcgtggagacggaagactttaaatcgtgtctacaacagacgattgacgttttggatgtacagccattggagcgggaactaccgttttacggcggggctgttggctatatggcgtatgatgcgattgaaacaattgagaaaacgttggcaaatgcaagagagagtgaggcgcctctctatcattttcttttttgtgagacgctgattgtctatgatcatacagaaaaaaagctagcggtcatctacttaagtactgaggatggaggatcccttgatacacggtataaatgtgcggtcaataccatcgaaacagtggttgaaacgattcataaacggcgggacggcgatcggctgttacgtcctgcaccggtccaagatgaagtctcgtttcaagaggtatcctctaactatgaaaaagaagtatttctacgcgacgtagaacgaattaaggaatatattcgcgcaggtgatgtttttcaagcggttttatcacagcgctttgaacgtgaactatcggtccgtgcccttgacgtctatcgcgtcctgagaatgattaacccatctccttatttgttttacattaagtttcatgacgtagaggttgtcggcagttctcctgagcggctcgttcaagtccaagatggacatgtggaaatccacccgattgctggaacgagaaaaagaggggcaacacgggaggaggatgaggcattagccaaggaactgctagctgacgaaaaagagcgcgccgagcattatatgcttgttgaccttgcacgtaacgacattggtcggattgcagaatatgggacggtcaagacgccaaccttgctagaaatcggtaaattttcacacgtgatgcacatcatttcaaaggtgacaggagagttgaagcaaacgctccatccgctagatgcgcttcgctatgggtttccagcaggaactgtttctggtgcaccgaaaattcgggcaatggaaattttaaatgaattggagccgacaaagcgagggatttatgcaggagcgatcgcgtacttagggtttgacggaaacatcgattcttgcattgccattcgcacgatgatcgtcaaagacggccgtgcttatatccaagcaggtgctggaattgtcgccgattcagtacccgaaaatgagtacgaagagacgagaaacaaagcaaaggcgttgctaaaggcggtagaaatggctgaagccatgtttgcgaaaaaggaggcgaccccgcgtgtttaa

SEQ ID NO: 3322 - protein, 502 aa, Bacillus halodurans
MNVTPFSAVKAANQQFRTIPVIGECFADAVTPIHIVQQLGDEVAFILESKDDESPWARFSFIGLNPFVELIEQNGVYQSISRSGSILVETEDFKSCLQQTIDVLDVQPLERELPFYGGAVGYMAYDAIETIEKTLANARESEAPLYHFLFCETLIVYDHTEKKLAVIYLSTEDGGSLDTRYKCAVNTIETVVETIHKRRDGDRLLRPAPVQDEVSFQEVSSNYEKEVFLRDVERIKEYIRAGDVFQAVLSQRFERELSVRALDVYRVLRMINPSPYLFYIKFHDVEVVGSSPERLVQVQDGHVEIHPIAGTRKRGATREEDEALAKELLADEKERAEHYMLVDLARNDIGRIAEYGTVKTPTLLEIGKFSHVMHIISKVTGELKQTLHPLDALRYGFPAGTVSGAPKIRAMEILNELEPTKRGIYAGAIAYLGFDGNIDSCIAIRTMIVKDGRAYIQAGAGIVADSVPENEYEETRNKAKALLKAVEMAEAMFAKKEATPRV

SEQ ID NO: 3323 - DNA, 1464 bp, Streptococcus pneumoniae
  CDS (1)..(1464)
atgaggtggcaccgcgaatttcgtcctcacgcaagttattttgcgtggggatttttcatacagtcgctacgaactagaattagaactgaaagggaaattacaatggaacgaatcattcatggagatgtcttatcaccaatcttggcttatatgcgcttaaaggggcaacacaaggttatcttagagagtattccgagagacaaggaaacagctcgtttttctatcctagcctataatcctgtttttgagattaagtttgaaaatggagttctttatcaaaatggtcaagtgattgatcgggatcccttggatttcctttatgaagtgattcataagagtcagcaccattcagagctaccttttggtggtggagccattggttttgtgggttacgatatgatttcgctttatgaagaaattggtcaaatccctgaggatacaattgggacgccagacatgcatttctttgtctatgagagctatatagtctttgaccacaagaaggagaagatacatgtcatagaggatgcattttatagtgagcgcagtcaagaggccttggaaaaatccttgaaccaagtgcttgaggaattacgcattcctgctccaaatgaatttgaagacttggatttatcaccacttgacttcaaaccgcatatcgctccacataagtttgagggaatggtagaaacagctcgtgacttgattcgtaacggagatatgttccaatgtgtactcagccagcgtttctcagcagaagttactggaaatccatttgacttctacagaaatctccgcgtaactaatccttctaattacctttatttctatgattttggggattatcaaatcatcggagctagtccagaaagtttggtttctgtcaaaaatggcatcgtgacaaccaatccgattgcagggacgcgaccaagaggggctacggatgaagaagacaaggccttggcgactgacctcctctctgatgagaaggaaacagcagaacatcgaatgttggtagacttggggcgtaacgatattggccgcatctctgaaacgaccagtgtccaagtcactaagtatatggaagtggagctcttccgctacgtcatgcatttgaccagcgtagtcaaggggcgtttgcttgcagaactcactgccatggatgccttgaaagcaacgcttcctgctggaaccgtttctggagcaccaaagattcgagcgatgagacgtatctatgaactggaaacggaaaaacggggagtatacgctggggcaatcggctacttgtctgcgacgggtgatatggatttggccatcgccatccgaaccatgattctcaaaaatcaaagagcctatgtgcaggctggggcagggattgtctacgactctatcgcccaaaacgaataccaagaaaccattaacaaagcaaaatctatgactagaattggagaactaagaccatga

SEQ ID NO: 3324 - protein, 487 aa, Streptococcus pneumoniae
MRWHREFRPHASYFAWGFFIQSLRTRIRTEREITMERIIHGDVLSPILAYMRLKGQHKVILESIPRDKETARFSILAYNPVFEIKFENGVLYQNGQVIDRDPLDFLYEVIHKSQHHSELPFGGGAIGFVGYDMISLYEEIGQIPEDTIGTPDMHFFVYESYIVFDHKKEKIHVIEDAFYSERSQEALEKSLNQVLEELRIPAPNEFEDLDLSPLDFKPHIAPHKFEGMVETARDLIRNGDMFQCVLSQRFSAEVTGNPFDFYRNLRVTNPSNYLYFYDFGDYQIIGASPESLVSVKNGIVTTNPIAGTRPRGATDEEDKALATDLLSDEKETAEHRMLVDLGRNDIGRISETTSVQVTKYMEVELFRYVMHLTSVVKGRLLAELTAMDALKATLPAGTVSGAPKIRAMRRIYELETEKRGVYAGAIGYLSATGDMDLAIAIRTMILKNQRAYVQAGAGIVYDSIAQNEYQETINKAKSMTRIGELRP

SEQ ID NO: 3325 - DNA, 1479 bp, Pseudomonas aeruginosa
  CDS (1)..(1479)
atgaatcgcgaagaattcctgcggctggccgccgatggctacaaccgcatcccgctgtccttcgagacccttgccgacttcgacacgccgctgtcgatctacctgaagctggccgacgcgccgaactcctacctgctggagtcggtgcagggcggcgagaaatgggggcgctattcgatcatcggcctgccgtgccgcacggtgctgcgggtctacgaccatcaagtgcggatcagcatcgatggcgtggaaaccgagcgcttcgattgcgccgacccgttggctttcgtcgaggagttcaaggcgcgctaccaggtgcccaccgtgcccggcttgccacgtttcgatggcggcctggtcggctacttcggttacgactgcgtgcgctacgtggaaaaacgcctggccacctgtccgaacccggacccgctgggcaacccggatatcctgttgatggtgtccgatgccgtagtggtattcgacaacctggccgggaagatccacgccatcgtcctcgccgatccctccgaggaaaatgcctacgagcgcggccaggcacgtctggaggagctgctggagcgtctacgccagccgatcaccccgcgtcgcggcctcgacctcgaggcggcccagggtcgtgagccggcgtttcgtgccagcttcacccgcgaggactatgaaaacgcggtaggaaggatcaaggactacatcctggccggcgactgcatgcaggtggtgccgtcgcagcgcatgtccatcgaattcaaggcggcgcccatcgacctgtaccgcgcgctgcgctgtttcaatccgacgccctacatgtacttcttcaacttcggcgacttccatgtcgtgggcagctcgccggaggtgctggtacgggtcgaggatggcctggtgacggtgcgcccgatcgccggtacccgtccgcgcgggatcaacgaagaggccgacctggcactggagcaggatctgctgtcggacgccaaggagatcgccgagcacctgatgctgatcgacctggggcgcaacgacgtggggcgggtgtccgatatcggcgcggtgaaggtcaccgaaaaaatggtgatcgaacgttactccaacgtcatgcacatcgtgtccaacgtcaccgggcaattgcgcgaggggctcagcgcgatggacgcgctgcgggcgattctgccggcgggcactctatccggcgcgccgaagatccgcgccatggagatcatcgacgagctggagccggtcaagcgtggagtctacggcggcgcggtcggctacctggcatggaacggcaacatggacaccgccattgccatccgcaccgcggtgatcaagaacggtgaactccacgtgcaggccggcggcggtatcgttgccgactcggtgcccgcgctggagtgggaagaaaccatcaacaagcgccgggcgatgttccgcgccgtggcgctggccgagcagagcgtcgaataa

SEQ ID NO: 3326 - protein, 492 aa, Pseudomonas aeruginosa
MNREEFLRLAADGYNRIPLSFETLADFDTPLSIYLKLADAPNSYLLESVQGGEKWGRYSIIGLPCRTVLRVYDHQVRISIDGVETERFDCADPLAFVEEFKARYQVPTVPGLPRFDGGLVGYFGYDCVRYVEKRLATCPNPDPLGNPDILLMVSDAVVVFDNLAGKIHAIVLADPSEENAYERGQARLEELLERLRQPITPRRGLDLEAAQGREPAFRASFTREDYENAVGRIKDYILAGDCMQVVPSQRMSIEFKAAPIDLYRALRCFNPTPYMYFFNFGDFHVVGSSPEVLVRVEDGLVTVRPIAGTRPRGINEEADLALEQDLLSDAKEIAEHLMLIDLGRNDVGRVSDIGAVKVTEKMVIERYSNVMHIVSNVTGQLREGLSAMDALRAILPAGTLSGAPKIRAMEIIDELEPVKRGVYGGAVGYLAWNGNMDTAIAIRTAVIKNGELHVQAGGGIVADSVPALEWEETINKRRAMFRAVALAEQSVE

SEQ ID NO: 3327 - DNA, 1386 bp, Thermotoga maritima
  CDS (1)..(1386)
atgggtgatagcatgcacgtgctgaagctcgtttcggatctggaaacaccggtttccaccttcatgaaggtttccagaggggaagaattcgctttcctgctcgaaagcgtggagctcggttccgctttcggaaggcattccttcataggtataggtaaaaaagacgtgctcgttttcgaaaagggaatcttgagaacttcgaatcagcagctcgattacacttcctctcctctcaaggcgataaaagattggcttgaggtctatagatacagcgtcaaacacgacgaactcccttcgttcaggggaggagccgttggcttcgtcagttatgactacatttcttacatagagaaagtcaaagtcaaagcctctgtgtttcccacgttttatttcgtggtacccgagcatctcataatattcgatcacctgaagaacaacgtcttcatcatcagcgatagccctgaggaactcacatcgaaggtcttgagtccttttgaggagaaaccagagaagaacgtttttgtgacagaaccggaatcgaacttcgaaagagagcagttctacaaagtggttgaaaaggccaaaaagtacattgtagaaggtgacatattccaggtggttctctcccaggctttcacattcaaaacgacgctggatccgttctacatctacagggcgctcagaatgatcaatccttctccctacatgttttatctgaagttcggagacacggtcgttttgggatcttctcccgaaaccatggcgaaggtggaaggagacaaggccactgtgaagccaattgccggcaccagaccgcggggaagaactgttgaagaagatctgaagctggagagagaacttttgaacgacgaaaaagagatagcagaacacgttatgctcgtggaccttggaagaaacgatcttggaagagtctgtaaagaaggaaccgtgcgagtggagaagaagatggttatcgagaggtactcccacgttatgcacatagtctcgcaggtgagcggtgaactgaaggacgataaagatgctgtggatgtgttcgaagcgactttccctgcggggacagtctctggcgcacccaaagtgagggcaatggagatcatagaagaactcgaacccaccccgcgagggccatacgctggagccgttgggtatttctctttccccgatgataagggaaggatgaacatggattctgctatcaccatcaggtcctttttcttcaaaggtaaacagggatggctccaggcaggagcgggtatcgtttacgattccgttccggagcgcgaatatcaggagactctgaacaaactcagggctttgttcaggagcctggaagttgcgcagaagatccaggggggattgttttga

SEQ ID NO: 3328 - protein, 461 aa, Thermotoga maritima
MGDSMHVLKLVSDLETPVSTFMKVSRGEEFAFLLESVELGSAFGRHSFIGIGKKDVLVFEKGILRTSNQQLDYTSSPLKAIKDWLEVYRYSVKHDELPSFRGGAVGFVSYDYISYIEKVKVKASVFPTFYFVVPEHLIIFDHLKNNVFIISDSPEELTSKVLSPFEEKPEKNVFVTEPESNFEREQFYKVVEKAKKYIVEGDIFQVVLSQAFTFKTTLDPFYIYRALRMINPSPYMFYLKFGDTVVLGSSPETMAKVEGDKATVKPIAGTRPRGRTVEEDLKLERELLNDEKEIAEHVMLVDLGRNDLGRVCKEGTVRVEKKMVIERYSHVMHIVSQVSGELKDDKDAVDVFEATFPAGTVSGAPKVRAMEIIEELEPTPRGPYAGAVGYFSFPDDKGRMNMDSAITIRSFFFKGKQGWLQAGAGIVYDSVPEREYQETLNKLRALFRSLEVAQKIQGGLF

SEQ ID NO: 3329 - DNA, 1482 bp, Pseudomonas putida
  CDS (1)..(1482)
atgaaccgcgaagaattcctgcgcctggccgctgtcggctacaaccgcatccccctggcctgcgaaaccctggccgacttcgacacgccgctgtcgatctacctgaaactggccgaccaacccaactcgtacctgctcgagtcggtgcagggcggcgagaagtggggccgttactcgatgatcggcctgccgtcgcgcaccgtgatgcgcgttcacggctaccacgtcagcatcttgcatgatggcgtcgaggtggaaagccacgatgtcgaagacccgctggcgttcgtcgaaagcttcaaggaccgttacaaggtcgccgacatccccggcctgccgcgcttcaacggcggcctggtcggctacttcggctacgactgcgtgcgttatgtggaaaagcgcctgggcgtcagccccaacccggacccgctgggtgtgccggatattctgctgatggtgtccgatgccgtagtggtgttcgacaacctggcaggcaagatgcacgcgatcgtgctggtcgacccggctgaagagcaagccttcgaacagggccaggcacggctgcaaggcctgctggaaaccctgcgtcagccgatcaccccgcgccgtggcttggacttgagcggcccgcaggccgccgagccggaattccgctccagctacacgcgtgaggactacgagaacgccgtcggccgtatcaaggaatacatcctggccggtgactgcatgcaagtggtgccgtcgcagcgcatgtccatcgacttcaaggcagcgcctatcgacctgtaccgcgcgctgcgctgcttcaacccgacgccctacatgtacttcttcaacttcggtgacttccatgtggttggcagttcgcccgaggtgctggtgcgtgtcgaggacaacctggttaccgtgcgcccgattgccggtacgcgcccgcgtggagcgaccgaagaggccgaccgtgcgttggaagacgacctgctgtcggacgacaaggaaatcgccgagcacctgatgctgatcgacctgggccgtaacgacgtgggccgtgtgtcctcgaccggcagcgtgcggctgaccgagaagatggtgatcgagcgttattccaatgttatgcacattgtctccaacgtcgccggccagctgcgtgaagggctgacggcgatggatgcgctgcgggcgattttgccggctggcaccttgtcgggcgcaccgaagattcgtgcgatggagatcatcgacgaactggagccggtcaagcgtggggtttacggtggtgccgtggggtattttgcctggaatggcaacatggacaccgcgattgccatccgtactgccgtgatcaacgacggcgaactgcatgtgcaggccggtggcggcatcgttgccgactcggtgccggcgctcgagtgggaagaaaccatcaacaagcgccgcgcgatgttccgtgcggtcgccttggctgagcagacttccgccaagtaa

SEQ ID NO: 3330 - protein, 493 aa, Pseudomonas putida
MNREEFLRLAAVGYNRIPLACETLADFDTPLSIYLKLADQPNSYLLESVQGGEKWGRYSMIGLPSRTVMRVHGYHVSILHDGVEVESHDVEDPLAFVESFKDRYKVADIPGLPRFNGGLVGYFGYDCVRYVEKRLGVSPNPDPLGVPDILLMVSDAVVVFDNLAGKMHAIVLVDPAEEQAFEQGQARLQGLLETLRQPITPRRGLDLSGPQAAEPEFRSSYTREDYENAVGRIKEYILAGDCMQVVPSQRMSIDFKAAPIDLYRALRCFNPTPYMYFFNFGDFHVVGSSPEVLVRVEDNLVTVRPIAGTRPRGATEEADRALEDDLLSDDKEIAEHLMLIDLGRNDVGRVSSTGSVRLTEKMVIERYSNVMHIVSNVAGQLREGLTAMDALRAILPAGTLSGAPKIRAMEIIDELEPVKRGVYGGAVGYFAWNGNMDTAIAIRTAVINDGELHVQAGGGIVADSVPALEWEETINKRRAMFRAVALAEQTSAK

SEQ ID NO: 3331 - DNA, 3065 bp, Pseudomonas aeruginosa
  CDS (401)..(1993)
ctgcagcgtctgccgaccctgctgcaactgatcccgggacacggcggcctgctgcgggggcggctggccgcggatggggccgagtcggcctataccgagtgtctgcgcctgtgccgacggttgctctggcgccagtccatgggcgagtccctcgacgaactgagcgaggagctgcaccgcgcctggggagggcagagcgtcgacttcctgcccggcgaactgcacctggggagcatgcgccggatgctggagattctctcccgccaggcgctgcctctggactgaggcggaacatccattgcggcgatcgcgcccgacggctgcggtcgcaattgggggaaatgggggtatcgatgatgaatatgccgttgcgcgctagcgtcgcgcaggccagtcgcccatgggcgcggggaggtggctcgtgagtggggttggctatcgactggaagaaagtctggagtaccgcacgctggtgccggaggcgctgtcgatctggcgcatggctggcgccaaccggatgctgttcgactgcttcgacgtggacagcaaggctgcgcggcgtagcgtggcgatcctttccagctgcctgcgcatcgagtgctgggggcgcgatgtggtgctgcgggcgttgaactccaacggacgcgccttgctggcgccgttgagcgaggcctgtccggcccaggtcacctgcttgcgtgacggcgacaccctgcactggcgcttccccccggaagagccgcatgcggacgagtggcgacgcctgcatggcctgtccagcctggaggcgctgcgccgcgtgctcggaacgctgggcgacgcggaggggcctgcgctgctgggcggcctgttcagtttcgacctggccgagcagttcgaacccttgccggcgccggccgaacctgcgcggcattgcccggactacctgttcctggtgccggagttgctgctggatatcgatcacctggcgcgccggacttcgctgcaagcgttcgtccacgatccggccgggcacgaccggttggccgccagcctgcgccaatgtgccgacgaattccatggcgccgtggaggaggcttccgagtcgccggtggcaggcgtacgggccggcaactaccaggtcgacctggacgatgcgagctttgcccgccaggtagaacgcctgcaggcccacgtgagggccggcgacgtgttccagatcgtaccttcgcgcagcttcagcatgccgtgcgcggacccctggcgggcctatcgccagttgtgcctgcgcaaccccagcccgtaccgcttcttcctcgatgcgggggacttctgcctgttcggcgcttcgccggagtcggcattgaagtacgacgcggagagtcgcgaggtggaactctatcccattgccggcacccgcccgcgcggatgcgatgcccggggcgccatcgatgcggaactggacaatcgcctggaagcggagttgcgcctggatgccaaggagatcgccgagcacatgatgctggtcgacctggcgcgcaacgatctggcgcgcgtctgccgcagcggtacccggcaggtgcgcgacatgctcaaggtcgatcgctacagccacgtgatgcacctggtctcgcgcgtggctggcgaactgcacggcgaactggatgcgctgcatgcctaccgtgcctgcctgaacatgggcaccctggtcggcgcgccgaaggtccgtgccatgcagttgctgcggcagtacgaggatggctatcgcggcagctacggtggtgcgatcggcattctcgacagcgccggcaacctcgataccagcattgtcatccgctccgccgaggtccgcgaaggtatcgcgcgggttcgggcaggcgccggcgtggtgctggattcggatccacggctggaggccgaggaaacccgcaacaaggcgctggcggtgctgaccgccgtggccgctgccgaacgcgaaaggggagagcgcgatgcgcatcacgctgttggataacttcgattccttcacctacaacctggtcgagcagttctgcctgctcggcgcggaggtccgggtgatgcgcaacgatacgccgttgccgacgatccaggcggcattgctggccgacggttgcgaactgctggtgctgtcgccggggcccggtcggccggaagacgccggctgtatgctggaattgctcgcctgggcccgcgggcgcttgccggtgctcggcgtctgcctcggccaccaggcgctggcgctggccgccggtggcgcggtgggcgaggcgaggaagccgctgcatggcaagagcacgtccctgcgtttcgatcagcgtcacccgctgttcgacggcatcgctgacctgcgcgtcgcgcgctaccactcgctggtggtcagtcgcctgccggaaggtttcgactgcctggccgatgccgatggcgagatcatggcgatggccgatccgcgcaatcgacagctgggcttgcaattccatcccgagtcgattctcaccacccacggccagcgtctgctggagaacgctctactctggtgcggcgcgttggcggtcgcggagcgccttcgggcctgagcggcgctgcgcagtttcgaccgaggctcggttgccaggccggcgcatcgtcgaaacgctggcggcccagttcgcgcaggcgctggcgggcgctttcgagaaagcgacggaagctgcgctcggattccagcgcggtgttgtagtagcaatacaccttggtgtcgatgccgcccggttcgtacagttcgctgaggactgccagggtaccgttgcgcaggcgttcctcgacgaaataatgcggcgcgatgccccatccgacgccggcttccaccagacgcagcatgtcgtcgaagttttccacgaagagtaccttgtcgctgaccggccgcagcaggttcgaatgctgcccggagcggctaccgaggctgatctgccggtaattggccaggctcgcgatgctgtgcagggaggcattgcacaacgggtgctgcggatgggcgacgacgaacgccttggtgtagccgagcacgcactggttgaagcgggagatct

SEQ ID NO: 3332 - protein, 530 aa, Pseudomonas aeruginosa
MGAGRWLVSGVGYRLEESLEYRTLVPEALSIWRMAGANRMLFDCFDVDSKAARRSVAILSSCLRIECWGRDVVLRALNSNGRALLAPLSEACPAQVTCLRDGDTLHWRFPPEEPHADEWRRLHGLSSLEALRRVLGTLGDAEGPALLGGLFSFDLAEQFEPLPAPAEPARHCPDYLFLVPELLLDIDHLARRTSLQAFVHDPAGHDRLAASLRQCADEFHGAVEEASESPVAGVRAGNYQVDLDDASFARQVERLQAHVRAGDVFQIVPSRSFSMPCADPWRAYRQLCLRNPSPYRFFLDAGDFCLFGASPESALKYDAESREVELYPIAGTRPRGCDARGAIDAELDNRLEAELRLDAKEIAEHMMLVDLARNDLARVCRSGTRQVRDMLKVDRYSHVMHLVSRVAGELHGELDALHAYRACLNMGTLVGAPKVRAMQLLRQYEDGYRGSYGGAIGILDSAGNLDTSIVIRSAEVREGIARVRAGAGVVLDSDPRLEAEETRNKALAVLTAVAAAERERGERDAHHAVG

SEQ ID NO: 3333 - DNA, 1485 bp, Aquifex aeolicus
  CDS (1)..(1485)
atgaatttaaacctcagccttgaggaagtaagaaaactatcagagaattacaacgttattcccttatatacggaacttctggtggatactgaaactcctctttctattttcctcaagttaaaggaaaaaggacagttcaacatcttactggaaagtgcggagggcggtgagaagtggggaaggtactcctttataatcacgggatcttccttttacctgagaacgagaaaagatatcggagagatttacgaaaggggaaaggtcaatttctttgaaacgaaggatcctctttcaaagattaaggaagttgtaaagaagttcataccttatcatgatgaaagattgcctaggttctggggagggttagttggttactttgcctacgacgtggtgaagttctacgaacctgtggaagacaaaaatcccgatccgattcacacttacgatatatacctcgtgcttacggacgttgtggttatccacgacaaccttacgggaaaaataaaggtcgttgttcccatcttcgcacaaaacggaattgaggaagagtacgaaagggctaaaaacttaataagggataccgtgaaaaaactaaaggaaaggggaactacttttttaaacgttgtagagaaagaaccggatttcaaaaactggcgttctaacttcacaaaagaggaatttgaggatatagtcaaaaaggcaaaggagtacatagcgcagggggatgtgatacaggtagttctttctcaaagattcagaaagaggtttaagggtaatcccgacaacatttacagagttctcaggttcttaaatccttctccctatatgtactacctcgattttgatcagttaaaagtcataggctcttctcccgaaatcctcgtgagactggaagagggaaggattgaaacgagacctatagcggggacgagaaagaggggaagaacggaagaagaagataaaagactggaagaggatctactttcggacgagaaggagagggcggaacacttaatgcttgttgaccttgcgagaaacgacatagggagggttgcaaaaaccggaagtgtgagagttgaaaactttatgcggatagaacgctactcccatgttatgcacatagtgagcgacgttgtgggagagttaagagaaggctacgacgctctagacgtcttgaaggctacctttcctgcgggaactgtttctggagctcccaaggtaagggctatgcagataatagaggaacttgaaaacgaaaggagaggaatatacgcgggcagtgtaggttatatatcctttcaggggaacatggacatggcgatagccataaggactgcagtttacagggacagggatatattcgtccaagctggagcgggaatagtggcggactccgttcctgaaaaggagtgggaagagaccgtaaacaaggcaaaagcgctcatgaaggcaatagaaattgcagaggaaagccaagaagagtaa

SEQ ID NO: 3334 - protein, 494 aa, Aquifex aeolicus
MNLNLSLEEVRKLSENYNVIPLYTELLVDTETPLSIFLKLKEKGQFNILLESAEGGEKWGRYSFIITGSSFYLRTRKDIGEIYERGKVNFFETKDPLSKIKEVVKKFIPYHDERLPRFWGGLVGYFAYDVVKFYEPVEDKNPDPIHTYDIYLVLTDVVVIHDNLTGKIKVVVPIFAQNGIEEEYERAKNLIRDTVKKLKERGTTFLNVVEKEPDFKNWRSNFTKEEFEDIVKKAKEYIAQGDVIQVVLSQRFRKRFKGNPDNIYRVLRFLNPSPYMYYLDFDQLKVIGSSPEILVRLEEGRIETRPIAGTRKRGRTEEEDKRLEEDLLSDEKERAEHLMLVDLARNDIGRVAKTGSVRVENFMRIERYSHVMHIVSDVVGELREGYDALDVLKATFPAGTVSGAPKVRAMQIIEELENERRGIYAGSVGYISFQGNMDMAIAIRTAVYRDRDIFVQAGAGIVADSVPEKEWEETVNKAKALMKAIEIAEESQEE

SEQ ID NO: 3335 - DNA, 1422 bp, Deinococcus radiodurans
  CDS (1)..(1422)
atgtcccagacctctgcccacccgacctgtctcgccgtccatgaactcaatgccgacctcgacacgcccgtcaccgcttacctcaaggccgcacagggagaaacggtgtcgttcttgctcgaaagcgtggaagcgggcgaaaagctggggcgctactcgtttatcggcgtgggcgagcagggcacgtttcgcgcctgcgccggacgggtgcagagcagcgggcaattcggtgacttcgacggcgaggaagccgacccgctcgcccggctctaccgcgtcacgacccgcccgctggacgtgcccgccggattgcctgcgctggtaggcggcgcagtggggtacgcggcctacgacatcatccgcgcctacgaaaagctgcccgacgccaaccccgatgaactgaagctgcccgacgcgctgttcgtggcgccgcgtgggctggtgattttcgaccacctcaagcaccggctggtggtggtggcggctgcggaggagcaggcgcaggccgacgccgaggtggagcgcctgctcacccggctgcgcggcccgctgccggaggtgccggggcaaacgcccaccgccgcgcccgagttccgcagcaacttcacgccggcggagtacatggaggcggtgcgccggggcaaggagtatgtccacgcgggcgacattttccagttcgtgccctcgcagcgtttcagcgccgagctgggcgacctgcaccccttcgcgctctaccgcgccctgcggcgggtgaaccccagcccctacctcggctatctggcgctgggcgaggtgacactggtggcgagcagccccgagagcctgctgcgcagcgacggcgtgagcgtggtcacccgtccgattgccggcacccgcaagcgcggggcgactgaggccgaggacgacgcgctcgccgccgaactgctcgccgacgaaaaggagcgcgccgaacacttaatgctggtggacctcgggcgcaacgacatcggcaaggtgagcgcttacggcaccgtcaaggtcgaaaacgccttttccatcgagcgctacagccacgtcatgcacatcgtctcgggcgtgcgcggcgaactgcgggaggggcagacgccactgcacgcgctcgcctcggtgctaccgatgggcacggtcagcggcgcacccaaaatccgggcgatggaaatcatcgacgaactcgaacccgtgcgccgggggccgtatggcggctgcttcggctacgtcgctttcgatggcagcctcgacatggcgctcaccctgcggacgatggtgattgcgaacggcaaggtccacatccaggccggggcgggtgtggtcgccgacagcgtgcccgagctggaggagcaggaaacgcgcaacaaggcggcggccctgatgcgggcggtggagctggcggcgggggggctgtga

SEQ ID NO: 3336 - protein, 473 aa, Deinococcus radiodurans
MSQTSAHPTCLAVHELNADLDTPVTAYLKAAQGETVSFLLESVEAGEKLGRYSFIGVGEQGTFRACAGRVQSSGQFGDFDGEEADPLARLYRVTTRPLDVPAGLPALVGGAVGYAAYDIIRAYEKLPDANPDELKLPDALFVAPRGLVIFDHLKHRLVVVAAAEEQAQADAEVERLLTRLRGPLPEVPGQTPTAAPEFRSNFTPAEYMEAVRRGKEYVHAGDIFQFVPSQRFSAELGDLHPFALYRALRRVNPSPYLGYLALGEVTLVASSPESLLRSDGVSVVTRPIAGTRKRGATEAEDDALAAELLADEKERAEHLMLVDLGRNDIGKVSAYGTVKVENAFSIERYSHVMHIVSGVRGELREGQTPLHALASVLPMGTVSGAPKIRAMEIIDELEPVRRGPYGGCFGYVAFDGSLDMALTLRTMVIANGKVHIQAGAGVVADSVPELEEQETRNKAAALMRAVELAAGGL

SEQ ID NO: 3337 - DNA, 1917 bp, Deinococcus radiodurans
  CDS (1)..(1917)
atgctctcccccgccgacgccctcctccgcctccgcgccgctggcctgcccggcatcgccctgctcgaatcgctggggccggtgctgccctacgcccgtttcaccttcctgagcgccgcgccgacctgcgtgcagcacaccctccccgaacttcctgcccccgacgccttttttcccgcctggctcggcggcctgaagtatgaggcggcccgcgagttcggtctggcggcgcacccggcgagcggcccggcgcagtggtggggtttttacccgtccgggctggtgtgggaccgggaggccggcaccctgagcgtcgtgggcgagccgcatctggactgggcggcgctgctggcgagcgaccccgcgcccctgccgagcttgacggtgggcgacttcggcgcggacgacgtggactatccggcgggcgtacgggccgtgcaggagctgattcgggcgggcgaggtgtatcaggtcaacctgtcgcgcggcgtgtcggccccggcgcagggcgacccgctggcggcgtacctgcggctgcgcgaggtgaatccgagtccgttcatggcctttctggacatgggcaacgaagtcgtcgtgtcgtgcagccccgagcggctggtggactgggccgtgtcggaaggcggcggcatcagcgcccgcccgattgccggcacgcggcggcgcggcgacacgccggaggaagacgccgccttcgaagccgagctgcgcgccagccccaaagaagtggccgagcacaccatgctggtggacctcgtgcgccacgacctgggcgcggtagcagcccccggcacagtgagcgtgcccgacctgatgctggtggagcgctacagccacgtcatgcacctcgtttcggaggtcacggccaccgcccgcgcgggcctgacgctgccagacctgctcgccgccactttccccggcggcacgattaccggcgcccccaaagcccgcgtgatggacgcgattgccgcgctggaaccggggccgcgcggctggtacaccggcggcgcagggctggtgagcgggcgacgggtggacgtaaatattctgattcggacggcggaatttgtgctggatacggcggcaggttcgccagcaacgcctccccgctggaccgtcaccgtccgtgcgggcggcggcaccgtcatcgacgccgacccggcccgcgaggcccgcgaaacggtccacaaggcgcaggccctcctcagcgtgctggcgggggtgcccggcagaccggcgcaggcggggcagcccccggtgccgggtcggccttggacgccaccacccgtgcccaagcaggcacagacgccgctgcgggtgctggtgctcgacaaccgcgactcgtttacctggaacctcgcccacgacttgctcgcgctgggggcgatggtggatgtgcggagccaggacgaggacgcagaaacgctgctggcgagccgccccgacgccgtgctcgtcggtcccggccccggcactccgcagacgagcggctgcacactcgccttgacccggcggtgcctggagcgcggcgtgccgctgctgggcgtgtgcctggggcatcaagcgctgggggaagtgctgggtggccgcgttgaacgcgccgagccggtgcatgggcggcccgagcgcgtgcagcacggcggcgcggggctgtttgccgggattgaaaacggcgcggccttcgggcgctaccactcgctcgtcgtgcgcgggctacccgacgaactggtgacggcccgcagtgaagggggcgagattatggcgctggcggtgcctggaaaacccgcctggggcgtgcagtttcatcccgaaagcgtgctgagcccggcgggacgggtgctgctcggcaactggctgcgggctgttgctgggtccgctgcgctgaggggtgaggggtga

SEQ ID NO: 3338 - protein, 638 aa, Deinococcus radiodurans
MLSPADALLRLRAAGLPGIALLESLGPVLPYARFTFLSAAPTCVQHTLPELPAPDAFFPAWLGGLKYEAAREFGLAAHPASGPAQWWGFYPSGLVWDREAGTLSVVGEPHLDWAALLASDPAPLPSLTVGDFGADDVDYPAGVRAVQELIRAGEVYQVNLSRGVSAPAQGDPLAAYLRLREVNPSPFMAFLDMGNEVVVSCSPERLVDWAVSEGGGISARPIAGTRRRGDTPEEDAAFEAELRASPKEVAEHTMLVDLVRHDLGAVAAPGTVSVPDLMLVERYSHVMHLVSEVTATARAGLTLPDLLAATFPGGTITGAPKARVMDAIAALEPGPRGWYTGGAGLVSGRRVDVNILIRTAEFVLDTAAGSPATPPRWTVTVRAGGGTVIDADPAREARETVHKAQALLSVLAGVPGRPAQAGQPPVPGRPWTPPPVPKQAQTPLRVLVLDNRDSFTWNLAHDLLALGAMVDVRSQDEDAETLLASRPDAVLVGPGPGTPQTSGCTLALTRRCLERGVPLLGVCLGHQALGEVLGGRVERAEPVHGRPERVQHGGAGLFAGIENGAAFGRYHSLVVRGLPDELVTARSEGGEIMALAVPGKPAWGVQFHPESVLSPAGRVLLGNWLRAVAGSAALRGEG

SEQ ID NO: 3339 - DNA, 1551 bp, Mycobacterium tuberculosis
  CDS (1)..(1551)
atgcacgccgacctcgcagccaccacctcgcgtgaggatttccgcctcctggcggccgagcaccgggtggttccggtgactcgcaaggtcttggccgacagcgagacgccgctgtcggcctaccgcaagctcgccgccaatcgcccgggtacgttcctgctggagtcggccgagaacggccggtcgtggtcgcgatggtcgtttatcggtgcgggggcgccaacggcgttgaccgtgcgtgaggggcaagcggtatggctgggtgccgtgcccaaggacgctcccactggcggagacccgctgcgggcgctgcaggtgaccttggagctgctggctacggcggatcgtcagtccgagccgggtcttccgccgctgtcgggtggcatggtcggtttcttcgcctatgacatggtgcgacggctggaacgattgccggaacgggccgtcgatgacctctgcctgccggacatgctgctgttgctggccaccgatgtggcggcggtcgatcaccacgagggcaccatcacgttgatcgccaacgccgtgaactggaacggcaccgacgagcgggtcgactgggcctacgacgacgcggtcgctcggctggacgtgatgaccgcagcgctcggccaaccactaccgtcaaccgtggccaccttcagccgacccgagccgcgccaccgtgcgcaacgcaccgtcgaagaatatggtgcgatcgtcgaatacttggtggatcagattgcagccggtgaagcgttccaggtggtgccctcgcagcgcttcgagatggacaccgatgtcgatcccatcgacgtgtaccgaattctgcgggtaaccaacccaagtccctacatgtatctactgcaggtgccgaatagtgatggtgcagtggacttttcgattgttggatccagtccggaggcgctggtaacggtccacgaaggctgggcgacgacgcatccgatcgccggaacccggtggcgcggaaggacagacgacgaggacgtgcttctggaaaaagagctgctggcggacgacaaagaacgtgccgagcatctgatgctggtcgacctcggccgaaacgacctgggtcgggtctgcacgccgggcactgttcgggtcgaggattacagccacatcgagcggtacagccacgtgatgcacctggtgtccacggtgaccgggaagctcggcgaagggcgcaccgcgctggacgcggtgaccgcctgctttccggccggcacgctgtcgggcgcgccgaaggtgcgggcgatggagctgatcgaagaggtggagaagacacgccgcggcctttacggcggtgtcgtcggttaccttgacttcgccggcaacgctgacttcgccatcgccatccgcaccgcgctgatgcgtaacggcacggcttatgtccaggcaggcggtggtgtggtggccgactccaacggatcctacgaatacaacgaggcgaggaacaaggctcgggctgtgctcaacgcgatcgctgccgccgagacgctggccgctccgggcgcgaaccgcagtggctgctaa

SEQ ID NO: 3340 - protein, 516 aa, Mycobacterium tuberculosis
MHADLAATTSREDFRLLAAEHRVVPVTRKVLADSETPLSAYRKLAANRPGTFLLESAENGRSWSRWSFIGAGAPTALTVREGQAVWLGAVPKDAPTGGDPLRALQVTLELLATADRQSEPGLPPLSGGMVGFFAYDMVRRLERLPERAVDDLCLPDMLLLLATDVAAVDHHEGTITLIANAVNWNGTDERVDWAYDDAVARLDVMTAALGQPLPSTVATFSRPEPRHRAQRTVEEYGAIVEYLVDQIAAGEAFQVVPSQRFEMDTDVDPIDVYRILRVTNPSPYMYLLQVPNSDGAVDFSIVGSSPEALVTVHEGWATTHPIAGTRWRGRTDDEDVLLEKELLADDKERAEHLMLVDLGRNDLGRVCTPGTVRVEDYSHIERYSHVMHLVSTVTGKLGEGRTALDAVTACFPAGTLSGAPKVRAMELIEEVEKTRRGLYGGVVGYLDFAGNADFAIAIRTALMRNGTAYVQAGGGVVADSNGSYEYNEARNKARAVLNAIAAAETLAAPGANRSGC

SEQ ID NO: 3341 - DNA, 1503 bp, Helicobacter pylori
  CDS (1)..(1503)
atgattagcctgatagaaaaagccccttatattccttaccccctagctctttatgaaaagttagagcaacggcacaccttgctttttgaaagcgctgagattgagagcaaagcgcacaccaaatcccttttaatggctaaggcttgtttgaagctagtttgcaaccacaatatcgtaaccatcactagcctaacgcctaatggcggggcgtttttacaaacattgagcgcgtttttcaaaacgcctatacaagacaatgccctaaccttaacctacaccaaagataaaaaaatccaagatgagtttttaaaactctttgagcctagcccttttgacgctttaagggggctttttaaaagcgttaaaacaagacccaaacacccctttacgctctttagcgcgggcgttttttcttttgaaatgctcaatttttttgaagatttgccccacttaaaagcaaacgacaacaccgcaaatgactttattttttatgtcgcgcaaaatttgatcatcatagatcataaagaaaaaagcgctgaaatcttgggggcatgttttgatgaacgctttaaaacagagatagctaaagaattacaggatttaaaagaattggttaaaaacattaaaagcgattttatccctaaaaaagctaagcaaagcatagaagttagcgttagttgtgatgatagcgagtttgaaaaaaaggtgttattcttacaagaagaaatcaaaaagggcgaaatctttcaagcggtgttgtcgcgcagtttttatatggagtgcttggagggtttgagcgcgtattatcacttaaaactctctaaccctagcccctatatgttctatatcaaagacagcgattttatcctttttggggcaagccctgagagcgctttaaaatacaacgccctaacgaatacggctgaaatttatcccattgctggcactcgtttaaggggtaaggacaagcaagggaatattgattacgatttagatagtaaaatggaatttgatttgcaacacgactataaagaaagggctgaacacatcatgttagtggatttagccagaaacgacatggccagggtttcaaaaaaacgctattgcgacaagcttttaaaagtggataagtattccaatgtcatgcatttagtctcaagggttgtgggggaattgaaaaaagggtgcgatagtttgcatgcttacaggagttttatgaacgccggcacgctcagcggagcgcctaaaatctccgcgatcaaattgatttaccaattagaaaaccaaaggagaggttcttatggggggagcgtggggtatttaaacagcgagggctctatggattcttgcatcactatccgttcatgttttgtcaaaaacaatagagcagtgatccaagcaggagccggtattgtgttagacagcgtgccacaaaatgaagcgaatgaaacaagagccaaagtgcaagcccttattgatgcgatcaggaaaaccatctcatga

SEQ ID NO: 3342 - protein, 500 aa, Helicobacter pylori
MISLIEKAPYIPYPLALYEKLEQRHTLLFESAEIESKAHTKSLLMAKACLKLVCNHNIVTITSLTPNGGAFLQTLSAFFKTPIQDNALTLTYTKDKKIQDEFLKLFEPSPFDALRGLFKSVKTRPKHPFTLFSAGVFSFEMLNFFEDLPHLKANDNTANDFIFYVAQNLIIIDHKEKSAEILGACFDERFKTEIAKELQDLKELVKNIKSDFIPKKAKQSIEVSVSCDDSEFEKKVLFLQEEIKKGEIFQAVLSRSFYMECLEGLSAYYHLKLSNPSPYMFYIKDSDFILFGASPESALKYNALTNTAEIYPIAGTRLRGKDKQGNIDYDLDSKMEFDLQHDYKERAEHIMLVDLARNDMARVSKKRYCDKLLKVDKYSNVMHLVSRVVGELKKGCDSLHAYRSFMNAGTLSGAPKISAIKLIYQLENQRRGSYGGSVGYLNSEGSMDSCITIRSCFVKNNRAVIQAGAGIVLDSVPQNEANETRAKVQALIDAIRKTIS

SEQ ID NO: 3343 - DNA, 1476 bp, Neisseria meningitidis
  CDS (1)..(1476)
atgatcagcaaacaagaataccaagcccaagccgcccaaggctacaaccgcatcccgctcgtgcaagaactccttgccgatttggatacgccgctttccctctatctcaaactcgccaaccgcccctatacctacctgctcgaatccgttgtcggtggcgaacgtttcggccgctattcttttatcggcctgccttgcagccactatctcaaagccagcggcaaacacgtcgatgtttatcaaaacggcgaaattgtcgagcaacacgacggcaaccccctgccctttatcgaagccttccacaaccgcttcaaaacacccgaaatcccaagcctgccgcgctttaccggcggactggtcggctacttcggttacgaaaccatctacaattttgaacacttcgcccaccgcctgaaaaacaccaccaaagccgacccgctcggcacgcccgacatcttgctgatgctgtcgcaagaattggcggtgatcgacaatttgagcggcaaaatccatctcgtcgtttacgccgatccgtcgcagcccgacggctacgaacgcgcccgcgaacgcctcgaagacatccgcacccagttgcgccaaagctgcgccatcccgctctcgctcggcagcaaacacaccgaagccgtcagcgaattcggcgaagagccgttcaaagcctgcgttaacaaaatcaaagactacatcttcgcaggcgactgcatgcaggttgtccccagccagcgcatgagcatggaattcaccgacagcccgctcgccctctaccgcgccctgcgtacgctcaacccttcgccttatctcttttactacgatttcggcgatttccacatcgtcggctcctcgcccgaaatcctcgtccgccgcgaacgcgacgatgtcatcgtccgccccatcgccggcacgcgcctgcgcggcaaaacccccgccgaagaccttgccaacgaacaagatttgttaagcgatgccaaagaaatcgccgaacacgtcatgttgattgacttaggacgcaacgacgtcggccgcatcagtaaaaccggcgaagtcaaagttaccgacaaaatggtgattgaaaaatactcccatgtaatgcacatcgtttccaacgtcgaaggccgtctgaaagacggcatgaccaacatggacatcctcgccgctaccttccctgccggcacactctccggcgcacccaaagtccgcgccatggaaatcatcgaagaagtcgaaccgagcaaacgcggcatctacggcggtgccgtcggcgtatggggtttcaacaacgacatggatttggcaatcgccatccgcaccgccgtagtaaaaaacaacacgctatacgtccaaagcggcgcgggcgtggttgccgactccgatccggcctccgaatggcaggaaacacaaaacaaagcccgagccgttatacgcgccgcgcagatggtgcaggaagggttggataaatga

SEQ ID NO: 3344 - protein, 491 aa, Neisseria meningitidis
MISKQEYQAQAAQGYNRIPLVQELLADLDTPLSLYLKLANRPYTYLLESVVGGERFGRYSFIGLPCSHYLKASGKHVDVYQNGEIVEQHDGNPLPFIEAFHNRFKTPEIPSLPRFTGGLVGYFGYETIYNFEHFAHRLKNTTKADPLGTPDILLMLSQELAVIDNLSGKIHLVVYADPSQPDGYERARERLEDIRTQLRQSCAIPLSLGSKHTEAVSEFGEEPFKACVNKIKDYIFAGDCMQVVPSQRMSMEFTDSPLALYRALRTLNPSPYLFYYDFGDFHIVGSSPEILVRRERDDVIVRPIAGTRLRGKTPAEDLANEQDLLSDAKEIAEHVMLIDLGRNDVGRISKTGEVKVTDKMVIEKYSHVMHIVSNVEGRLKDGMTNMDILAATFPAGTLSGAPKVRAMEIIEEVEPSKRGIYGGAVGVWGFNNDMDLAIAIRTAVVKNNTLYVQSGAGVVADSDPASEWQETQNKARAVIRAAQMVQEGLDK

SEQ ID NO: 3345 - DNA, 1575 bp, Caulobacter crescentus
  CDS (1)..(1575)
atggttacaaggtcggccataggccctccaacaatccagccgtctttcgtcattgccctgtccggagggagcgtacccactcaccctcccaccgcttcgcggtgggcccctccctctctccgtgagagaggggttccgtgtggcgtcccctcagggtcgggaaccgtaagcgctcgccacccacccccaaaccgcccgaggggcctcgcactggtctccgtccgtcgagcccgctatcaccacgccatgcggcatgtcgctctcctcaccgccccgtggcgcgagccggtctgggcgttggcgcccttccgggacgagccttacgcctgcgcgctggtcaccggcggggcggggcggtggtcgtatctgttgcgcgcgcccgacgcgacgatgagcctgtcggacaaggacccagccgatcccttcgcggccctcgccgcgctggtcggcccgcgcctgcccagccatcccgaaggcccgccgttccagggcggggtggtgggcctgggcgcctatgagctgggcgaccgggtcgaggacctggggctttcgcgcaccgactggccggacctgacctgcgcccgctaccccgccctgctggccttcgaccatcacgcgcgtcaggtgatcgcggtggggcgcggcgaggctgaggccgaggcgaacgcgcgcgccgccgacgccctggcctggctggaggtcgccgcgcctgagcgcgccgaacccgccggcccgctctgcgccgatctcgtcgccagcgaccccgccacctatgaaaccgccgtggcgcaggtggtcgcgcggatcgtcgggggcgagatcttccaggccaatatcgcccgcgcctggacggggcggctggcggcgggcgttgacccgttcgacctgttcgtgcgcctgcgcgcgcagagccccgcgccgttctcggcctattggcgcctgcccggccgggcgctggtctccaactcgcccgagcggttcctgaagctggatgcggcgggggcgatccagacccagccgatcaagggcacccgcccccggggccgcgatcctgtcgaggaccgcgccctggccgccgagctgctggccagcgacaaggaccgggccgagaacctgatgatcgtggatctgatgcgcaatgacctggcgcgggtgtcgccggccggcagcgtccgcgcgccggaactgttcaaggtcgagagcttcgccaacgtccatcacctggtctcgaccgtcaccgcgcgtctggcgccgggacgcggcgtcgccgacctgctgcgggccagcttcccgccgggctcgatcaccggcgcgccgaaggtccaggccatgaaggtgatcgccgagcttgagccgccgcgcgggccctattgcggcagcctgttctgggccggggtcgacggagcgttcgactccagcgtcctgatccgcaccgtcggccttgtgcaggacggcgcgggctggcgactggaggcccgggcgggggcggggatcgtcgccgacagcgatccgcgcggcgagcgcctggagaccgaggccaagatcgcggccctgaagacggcgctgacccaatga

SEQ ID NO: 3346 - protein, 524 aa, Caulobacter crescentus
MVTRSAIGPPTIQPSFVIALSGGSVPTHPPTASRWAPPSLRERGVPCGVPSGSGTVSARHPPPNRPRGLALVSVRRARYHHAMRHVALLTAPWREPVWALAPFRDEPYACALVTGGAGRWSYLLRAPDATMSLSDKDPADPFAALAALVGPRLPSHPEGPPFQGGVVGLGAYELGDRVEDLGLSRTDWPDLTCARYPALLAFDHHARQVIAVGRGEAEAEANARAADALAWLEVAAPERAEPAGPLCADLVASDPATYETAVAQVVARIVGGEIFQANIARAWTGRLAAGVDPFDLFVRLRAQSPAPFSAYWRLPGRALVSNSPERFLKLDAAGAIQTQPIKGTRPRGRDPVEDRALAAELLASDKDRAENLMIVDLMRNDLARVSPAGSVRAPELFKVESFANVHHLVSTVTARLAPGRGVADLLRASFPPGSITGAPKVQAMKVIAELEPPRGPYCGSLFWAGVDGAFDSSVLIRTVGLVQDGAGWRLEARAGAGIVADSDPRGERLETEAKIAALKTALTQ

SEQ ID NO: 3347 - DNA, 1251 bp, Campylobacter jejuni
  CDS (1)..(1251)
atgtttgttaaaaatgtaaatttttattacagacaaatccttgaaaaatttgaaaattcttattttgcagaggatttgactaaggtaattatagggattgattgtgattatttagatgctaatgaattatcctttagcgagtttaaggcaaaatattatgaagctttaagcaagaataaaatttgcgactttgctggattttttggagtttttagtgcaaattttgtatctttgtttgaaaaaattccactttcttctaagaaaaattatgattttcctttatttttatttgccaatgctaaggcttatttgatttatgagaaaaatagcaagatgttttttaaatttggtgcttcaaaatattttgaatatttaaaagatgatattgaaccaatgaaaaagaaacaaaaaaatgattttgaaattttaaattctttagaagatgaaaaaaatgattttttaaaaatgtgcgaaaaagccaaagaatatcttttaagtggagatatttttcaagtggtcttaagtaagcaactttgtatcaaacatcaagtaaatgcttttgattattatgagagtttaagtgctttaaatccaagcgcttatatgttttattttccaagtaaatatggtgttgttttgggttcttctccagagtttttattgaaaattaaaaaaagagagatttatttagcccctattgctggaactagaaatttggaaaataactgtgatcttttagctttagaaaaagatcttttaagcgatgaaaaagaacttagtgaacataagatgcttgtagatttagcaagaaatgatgcttctaaatttggcactcaaacaagagtggaaaatcttttttctattattaaaaataaatttgtaatgcacatagtgagtgaagtgtatgccaatatgaaagaagatgcgagtatttttgatgtgattgaagcagtttttccagcgggaactttaagcggagctcctaaaataagagctttagagatcactagcgagcttgaagattgcgatcgtggaatttatggtggtgcggtaggatttttaaattttaacgaagacataactttagcgattttaatccgttgcgctttttttactcaagataaggcttatttggcaagtggggcgggtattgttttgcaaagtgagagtcaaaaagaatatgcagaaatttgtgctaaacgcaaggcgcttttggtagcttttgaaaatttaaaaaaggaaaatcaatga

SEQ ID NO: 3348 - protein, 416 aa, Campylobacter jejuni
MFVKNVNFYYRQILEKFENSYFAEDLTKVIIGIDCDYLDANELSFSEFKAKYYEALSKNKICDFAGFFGVFSANFVSLFEKIPLSSKKNYDFPLFLFANAKAYLIYEKNSKMFFKFGASKYFEYLKDDIEPMKKKQKNDFEILNSLEDEKNDFLKMCEKAKEYLLSGDIFQVVLSKQLCIKHQVNAFDYYESLSALNPSAYMFYFPSKYGVVLGSSPEFLLKIKKREIYLAPIAGTRNLENNCDLLALEKDLLSDEKELSEHKMLVDLARNDASKFGTQTRVENLFSIIKNKFVMHIVSEVYANMKEDASIFDVIEAVFPAGTLSGAPKIRALEITSELEDCDRGIYGGAVGFLNFNEDITLAILIRCAFFTQDKAYLASGAGIVLQSESQKEYAEICAKRKALLVAFENLKKENQ

SEQ ID NO: 3349 - DNA, 1266 bp, Sulfolobus solfataricus
  CDS (1)..(1266)
atggaagttcatccaataagtgaatttgcctcaccattcgaagtatttaagtgtatagagagagactttaaagtagctggattactagagagcataggtggccctcaatataaggcgagatatagtgtgatagcttggtcaactaatgggtatctgaaaattcatgacgaccctgtaaatattcttaatggttatttgaaagatttgaaattagcagatataccggggttattcaaaggaggtatgataggatacataagttacgatgcagtaagattttgggagaaaataagagacttaaagccagcagctgaagattggccttatgcggaattctttactccagataacatcataatctatgatcataatgagggcaaagtatacgttaatgctgatttaagctctgtagggggatgtggtgatataggggagtttaaagtaagcttttacgatgagtctcttaataagaacagttatgagaggattgtttccgaatcattagagtatataagatctggttacatatttcaagttgtattgtctagattttacagatatatatttagtggagatccattaagaatatattataatctaaggagaataaatccatccccttacatgttttatctcaaatttgatgaaaaatacttaataggatctagtccggaattactgttcagagttcaagataatatagttgaaacctatcccatagctggcactagacctaggggcgctgatcaagaggaagatcttaaattggaattggaattaatgaactcagaaaaggataaagctgagcacttaatgctggttgatttggctagaaatgatctaggtaaagtatgcgttccagggactgtaaaagtaccagaattaatgtatgtcgagaagtatagccatgtccaacacatagtatcaaaagtgattgggaccttaaagaagaagtataacgcgttaaacgttttatcggctacattcccagcaggtacagtaagcggagcacctaaaccaatggcaatgaatataattgaaacgttagaggagtataaaaggggtccttatgcaggtgctgtaggttttatctcagctgatggtaacgcagagttcgcaatagcgataagaactgcatttctaaacaaagagttattacgaatacatgccggtgctggtatagtatatgactctaatccagaatctgaatatttcgaaactgaacataaactaaaagcactaaaaacagcaataggggtgaggtaa

SEQ ID NO: 3350 - protein, 421 aa, Sulfolobus solfataricus
MEVHPISEFASPFEVFKCIERDFKVAGLLESIGGPQYKARYSVIAWSTNGYLKIHDDPVNILNGYLKDLKLADIPGLFKGGMIGYISYDAVRFWEKIRDLKPAAEDWPYAEFFTPDNIIIYDHNEGKVYVNADLSSVGGCGDIGEFKVSFYDESLNKNSYERIVSESLEYIRSGYIFQVVLSRFYRYIFSGDPLRIYYNLRRINPSPYMFYLKFDEKYLIGSSPELLFRVQDNIVETYPIAGTRPRGADQEEDLKLELELMNSEKDKAEHLMLVDLARNDLGKVCVPGTVKVPELMYVEKYSHVQHIVSKVIGTLKKKYNALNVLSATFPAGTVSGAPKPMAMNIIETLEEYKRGPYAGAVGFISADGNAEFAIAIRTAFLNKELLRIHAGAGIVYDSNPESEYFETEHKLKALKTAIGVR

SEQ ID NO: 3351 - DNA, 1548 bp, Buchnera aphidicola
  CDS (1)..(1548)
atgtcaaaaaatccatatgaaattgaaataattcaaaaaacagctccttatcatcccgatcctactatgatatttaatcatctttgcgcatcccgaccaggaacattgttactagaaacagctgaggtaaacaaaaaaagagatctagaaagcataatgattattgatagtgcaatgcgtatttcttcagaggacaattcagttaaattaacacccttatctataaatgggacagacattttatcaactttaaaaaaaacgatacctaaaaaaatagaaatatacgaaaaaaataacagtacaatccttgtttttccgaaaattaaaaaaaatattgacgaagataaaaaacttttttccctgtcagtttttgatgcttttagattgatgattagaatatttgaaaatcgagaaaaaaaatcaaaagcgatgttttttggtggattattttcttatgatttaatttcagtttttgaatcattacctaagttaaagggcaatcaaaaatgttcaaatttttgtttttacttagcagaaacattactggttttagatcaccaaaaaaaaacgtgtttaattcaaaatagtttattcagtaaaaatttgaaagaaagaaaaagaattaaaaaaagatcagtagaaatagagagaaaactcaatgaaaagttaaagttaataccaaaaacaaaaattaaagatatcaatttaacttcgaatatgaataattttgaatatggtactataataaaaaaattacaaaaattaattcaaaaaggtgaaatttttcaagttgtaccatcccgaaaattctatctaccatgtccgaacccgttatctgcttatcaaaaactaaaaaaaagcaatccgagcccctatatgttttttatgcaagatcaagattttacattatttggagcatcgccagaaagttcattaaaatacgatgaaaaaacaagaaaaattgaactttatcccattgcaggaaccagacctagggggaaaactgaagacggcaatttagatttagatttagacagcagaatagaacttgagatgagaactaaccataaagaattagcagaacatttaatgcttgttgatctagcacgcaatgatcttgcgcgtatctgcaaaccgggttcgagatatgtttcagatttagtaagggtagatagatattctcacgtaatgcaccttgtatcaagggtgataggtgaacttagagagggattagatgcattgcatgcatacgcttcgtgcatgaacatggggacgttaacaggtgcacccaaggtacgagcaatgcaattgattgctgaacatgagggtgaaaaaagagggagttatggtggcgctataggctattttaccgatttaggtaatttggatacctgtatcacaatacgttcagcgtatgtggaaaaacaagttgccacaattcaagcaggtgctggtattgtttacaattcgataccagaaaatgaagtaaatgaaagtttaaataaagcccaagcagtaattaacgctattaaaaacgcacattattaa

SEQ ID NO: 3352 - protein, 515 aa, Buchnera aphidicola
MSKNPYEIEIIQKTAPYHPDPTMIFNHLCASRPGTLLLETAEVNKKRDLESIMIIDSAMRISSEDNSVKLTPLSINGTDILSTLKKTIPKKIEIYEKNNSTILVFPKIKKNIDEDKKLFSLSVFDAFRLMIRIFENREKKSKAMFFGGLFSYDLISVFESLPKLKGNQKCSNFCFYLAETLLVLDHQKKTCLIQNSLFSKNLKERKRIKKRSVEIERKLNEKLKLIPKTKIKDINLTSNMNNFEYGTIIKKLQKLIQKGEIFQVVPSRKFYLPCPNPLSAYQKLKKSNPSPYMFFMQDQDFTLFGASPESSLKYDEKTRKIELYPIAGTRPRGKTEDGNLDLDLDSRIELEMRTNHKELAEHLMLVDLARNDLARICKPGSRYVSDLVRVDRYSHVMHLVSRVIGELREGLDALHAYASCMNMGTLTGAPKVRAMQLIAEHEGEKRGSYGGAIGYFTDLGNLDTCITIRSAYVEKQVATIQAGAGIVYNSIPENEVNESLNKAQAVINAIKNAHY

SEQ ID NO: 3353 - DNA, 2172 bp, Streptomyces griseus
  CDS (1)..(2172)
atgcgcacccttctcgtcgacaactacgactcgttcacctacaacctcttccactacctctcccgggccaacggccgggaacccgaggtcatccgcaacgacgacccggcctggcggccgggtctgctcgacgcgttcgacaacgtggtgctctccccggggccgggcaccccgcaccgcccggccgacttcggcctgtgcgcccggatcgccgaggagggccggctgccggtgctcggcgtctgcctgggccaccagggcatggccctcgcccacggcgcccgggtgggccgggcccccgagccccgtcacggccgcacctcggcggtacggcacgacggcaccgggctcttcgaggggctgccgcagccgctggaggtggtgcggtaccactccctcgcggtgacggaactgccgccggagctggaggccaccgcctggtcggaggacggggtcctgatggcgctgcgccaccgcacgctgccgctgtggggagtgcagttccaccccgagtcgatcggcacccaggacggccaccggctgctggccaacttccgcgacctcaccgagcgccacggccgaacgcgccacggcggccgggcgggacacggcacgctcccgccccccgcgcccgcccgggagacgaaggccaccaccggcaccccacggcggctccgggtcatcgcaaagtcgctgcccacgcgctgggacgccgaggtcgccttcgactcgctgttccgcaccggcgaccaccccttctggctcgacagcagccgtcccgggggcgagctgggccagctctccatgatgggcgacgcctcaggtcccctcgcccggaccgccaaggccgacgtgcacgccggaaccgtcacggtgagagccgacggcgccagcagcacggtcgagagcgccttcctgacctggctggagaacgacctggcggggctgcgcaccgaggtgcccgaacttcccttcgcgttcgcgctcggctgggtcggctgcctgggctacgagttgaaggccgagtgcgacggcgacgccgcgcaccgctcgcccgatcccgacgccgtgctggtcttcgccgaccgggccctggtgctggaccaccgcacccgcaccacctacctgctggcgctggtggaggacgacgccgaggccgaggcgcgcgcctggctcgcggcggcctccgccaccctggacgccgtcgccgggcgggagcccgagccgtgccccgaggcgcccgtgtgcacgacgggtccggtggagctgcgccacgaccgggacggctacctgaagctgatcgacgtctgccagcaggagatagccgccggggagacctacgaggtctgcctgaccaacatggccgaggcggacaccgacctcaccccgtgggcggcctaccgcgcgctgcgccgggtgagccccgccccgttcgccgcgttcctggacttcggtcccatggccgtgctcagcagctctccggagcggttcctgcgcatcgaccggcacgggcggatggagtccaagccgatcaagggcacgcggccacgcggcgccaccccgcaggaggacgccgcgctcgtacgtgccctggccacctgcgagaaggaccgcgccgagaacctgatgatcgtcgacctggtccgccacgacctggggcggtgcgccgaggtcggctcggtcgtcgccgacccggtgttccaggtcgagacgtacgcgaccgtgcaccagctggtcagtaccgtcacggcgcggctgcgcgaggacagcagcccggtggcggcggtccgggcggccttccccggcgggtcgatgaccggggcgccgaagatccgcaccatgcagatcatcgaccggctggaaggcgggccgcgcggtgtctactcgggcgccatcggctacttctccctcaccggcgcggtagacctgtccatcgtgatccgcacggtggtgctcagcggcggcaggctgcgctacggcgtcggcggcgccgtcatcgcgctctccgacccggccgacgagttcgaggagacggcggtcaaggccgccccgctgctgcgtctcctcgacaccgccttcccgggccgtgagcgtcccggcaaggacctcgacggtgaacccgacgacggcacggacgcgggtgctccgaaggacctcgtcctgcccgggtga

SEQ ID NO: 3354 - protein, 723 aa, Streptomyces griseus
MRTLLVDNYDSFTYNLFHYLSRANGREPEVIRNDDPAWRPGLLDAFDNVVLSPGPGTPHRPADFGLCARIAEEGRLPVLGVCLGHQGMALAHGARVGRAPEPRHGRTSAVRHDGTGLFEGLPQPLEVVRYHSLAVTELPPELEATAWSEDGVLMALRHRTLPLWGVQFHPESIGTQDGHRLLANFRDLTERHGRTRHGGRAGHGTLPPPAPARETKATTGTPRRLRVIAKSLPTRWDAEVAFDSLFRTGDHPFWLDSSRPGGELGQLSMMGDASGPLARTAKADVHAGTVTVRADGASSTVESAFLTWLENDLAGLRTEVPELPFAFALGWVGCLGYELKAECDGDAAHRSPDPDAVLVFADRALVLDHRTRTTYLLALVEDDAEAEARAWLAAASATLDAVAGREPEPCPEAPVCTTGPVELRHDRDGYLKLIDVCQQEIAAGETYEVCLTNMAEADTDLTPWAAYRALRRVSPAPFAAFLDFGPMAVLSSSPERFLRIDRHGRMESKPIKGTRPRGATPQEDAALVRALATCEKDRAENLMIVDLVRHDLGRCAEVGSVVADPVFQVETYATVHQLVSTVTARLREDSSPVAAVRAAFPGGSMTGAPKIRTMQIIDRLEGGPRGVYSGAIGYFSLTGAVDLSIVIRTVVLSGGRLRYGVGGAVIALSDPADEFEETAVKAAPLLRLLDTAFPGRERPGKDLDGEPDDGTDAGAPKDLVLPG

SEQ ID NO: 3355 - DNA, 2712 bp, Streptomyces lividans
  CDS (119)..(1546)
gagctccgcaatcggtgccttgacccgctaggctccgctactagctccgcgcttgcacttgacggcaatcgtggactgcgtagagtggcatcgtggaccgtggcgagtacgggaggaaatggcgagctgccggatgggcgcgcggtcggcgctggagccgtgccaggtggactgcctagacgaggcggcggacgagcggtgcgctgagacgccgaggtgccacgcagagctgctggagagcgtgacgggcgcgtcgcggatgtcgcggtactcgatcatcgtgctggacccgatcggcacgatccgggcggcagaggcgctgacggcgctggtggacgcggacgacgtgatcttcaaggacgaggacccgctgaagggcatccggtcggtgttcgagctgggcgacctggacccgacgaaccacgaggaaatcgagttccagggcggcgcgctgggccggttcgcgtacgacatcgcgcggcgactggaggcgatccgggacctgggcgaccgggagctggcaggcccggacgcgggcacggcgctgtacgacctgatcctgtacgaccaccaggacgacgtgatctggattctggtacccaacgaggcgggcgagcaggacccaagcgaggacttccgggacctggtgaacgcgtggtcgtacgacgacgagttcgacatcggcgcggagttcggcgcgaactacacggacgatgcgtacgcggacggcgtggaccggctgaaggactacctgggctcgggcgacatgtaccaggtgaacctggcgcagcggcgggtgggcatgatcagcgcggaggactaccagctgtacatccgactgcgggacgcgaacccggcgccgtacatggcgtacctggacatcgacgagggactgctggtggcgagcccggagcggatcatcctggacgaggcgtcggacctggacacgcggccgatcgcgggcacgctgcgaggccggccgcgggcgggcggagacgacgaggacgacggacgggcgatcgacctgctgcgggtggacaaggaccgggcggagcggatcatgatcgtggacctggaccggaacgacatcgcgcgggtgggcgtgggcggaagcgtgaaggtgcgggagatcatgggcctggagcggtacagcggcgtgatgcacctggtgagccaggtgacgggcgacctgcaggaagcgatcgaggcggtggacctgatccgggcgggcttcccgggaggcacgctgacgggcgcgccgaaggtgcggacgatggagatcatagacgagctggagccgcagcggcgagcggcctactgcggcagcatcggctacatcgcgtacaagggcaacatcgacttcaagatcgcgatcccgacgctgtacgcactggcgggccagctgttctgccaggcgggcggaggcgtggtgggagacagtgtgccggacggcgagtaccgggagagcttcgagaagggaaacgcgctgatccggggcctggagatccggcatggcgcggtggtggcgcagtcggaggacaagtgaggtaaatgacgagcgtcctgatgatcgacaactgcgacagctttacgtacaacctggtggaccagttcagcccgcacggcacgatcgtcatcgtgaagcggaaccacccgttctacgacggcgagatcgaagcaatcatggcgctgacgagcatctgcatcacgccgggaccgtgctacccggcagaggcggcactgaactcgtgcagcatcatcggacacctcgcgggccgcatcccgatcctgggcatctgccttggacagcaggcgttgggacaggcgcgcggcggcttggtcatcttcgcgcacggaaagttgtccaacatcgagcacaacggaatcttcgcgccactgttcaacccgccgcgggcgctgccggcgggccgataccactcgctggtcgtcgagccggcgcgcatcgaggtcacgggccagtgcaaccagctggaggtcgtcccgcaggagatcatggcgatccggcaccgggacctgccggtggagggcgtgcagttccacccggagtcgatcctgtcgtcgaacggcgcggcgatcctggcgaacttgatccaccggccgtgccactgaccgtgcaagctgacttagccgtagcctagcgatgccatatggcacggacgtagcagggcatgccaggactgcacctgaacgcgtcgatccatggccagcatcagccgtgcggacgcctgcatcagcggcggatggcggtagcgctcggcacctcgaagcattccgcggttggcacagccaagggcggaatgcttccggtacgcaccgctgcggagctagctcgtagcgctccgaggtcgcctggacgtcgagttgctcaggcggacctgtcgtgccgatgcaggcgtgcggcaccgtgccgtgcgtaccagaccgtgacgggcagcgcagccgatgcacggcgtgcgatgcatgcagcgctgccggtgccatgcggtctgcgatgctgacggcggtggcggtgacggtggcgtcgtggtcggtccgacatgcggtgcagtcgtatgcgtgacgtgcacgtgcaccggtgcggcgacccgtgactgcatgcgtgctacgtgacgggctgtgcgtggacgtcccgtgacgtgacgtggcgagcggtgcgacgcgacccgcgtgcacgaccggcactgcggatcc

SEQ ID NO: 3356 - protein, 475 aa, Streptomyces lividans
MASCRMGARSALEPCQVDCLDEAADERCAETPRCHAELLESVTGASRMSRYSIIVLDPIGTIRAAEALTALVDADDVIFKDEDPLKGIRSVFELGDLDPTNHEEIEFQGGALGRFAYDIARRLEAIRDLGDRELAGPDAGTALYDLILYDHQDDVIWILVPNEAGEQDPSEDFRDLVNAWSYDDEFDIGAEFGANYTDDAYADGVDRLKDYLGSGDMYQVNLAQRRVGMISAEDYQLYIRLRDANPAPYMAYLDIDEGLLVASPERIILDEASDLDTRPIAGTLRGRPRAGGDDEDDGRAIDLLRVDKDRAERIMIVDLDRNDIARVGVGGSVKVREIMGLERYSGVMHLVSQVTGDLQEAIEAVDLIRAGFPGGTLTGAPKVRTMEIIDELEPQRRAAYCGSIGYIAYKGNIDFKIAIPTLYALAGQLFCQAGGGVVGDSVPDGEYRESFEKGNALIRGLEIRHGAVVAQSEDK

SEQ ID NO: 3357 - DNA, 2115 bp, Clostridium thermocellum
  CDS (361)..(1845)
gttcaatgtcaaggattattgcgaaacagctcattaaaaagattattgttacggtgtcagtgaaagctgtatatttggcacaaaacatcatttattatatatcatttgaaaaagtttcaaataaaatttataacatttatgaaatttaacttgcatttttcgtattttccatgctacaataatcttaaagataagaataagttaagaattggatgagatgagtttgagtttgaagagaagagatgagaagagacgagcgtgaataaatgtatttgcgccatatcgccggattcttccatccggcgtttttagtatggtcatctctcatgtcttccttcttagaaataaggaggagtcggaatgttttatccaaccctggacgaagtcaaaataatggcaaaagattataatatcatacctgtcacaatggaagtatatgccgacatggaaacccctataagcctttttaaaaggtttgaggaaagcagttgctgtttccttttggagagcgttgagggcggtgaaaaatgggcccggtactccatcatcggaaaaaatccgtttcttgttgtggaaagctacaaaaacaaaaccattataagggagaggaacggttctcaaagggaagttgaaggaaatcctgttgaaataataaagggcattatggggaagtttaaaggtgccaaccttccgaatcttccgagattcaacgggggagcggtgggatattttgggtatgacctcatacgacactatgaaaatcttcccaatgtccccgaagatgacatgggtcttccggaatgccatttcatgtttaccgacgaagtgctggtgtatgaccatctaaagcagaaaattcatataattgttaatttgcatgtcaacggcaacattgaacgggcctatataagcgcggttgaccggataaaaaccatacacagggagattcttgacaccaggtggaaaaccgctgacaactctgttctaagttacaataaaaagaaaaatgaacttgcggtaaccagcaatatttcaaaagaggatttctgccggaatgtgttgaaggcaaagcagtatataagggacggagacatattccaggtggttttgtcgcaacgcttgtgtgttgagacaaatgaaaatccttttaacatataccgcgccttaagggttataaatccttctccatatatgtattatcttaaatttggcggctacagaataataggttcttcccccgagatgctggtcagggttgaaaatggaattgtggaaacctgtccgattgcaggaacgcgaaagagaggcaggacaaaagaagaggatgaggctttggaaaaagagcttctttccgatgagaaagaaatagccgagcatgtgatgctggtggacctgggcagaaacgatatcggaagagtatcgaaatttggtaccgtagcggtaaagaaccttatgcacattgagagatattcccatgtaatgcatgtggtaacaaacgtacagggagagattcgggaggataagactccttttgacgcccttatgtccattcttcctgccggtaccctttccggagcgccaaaggtcagggctatggagataatagacgagcttgagaccgtaaaaagaggtccctacggcggtgcgatcgggtatcttagctttaacggcaatctcgacagctgcataaccataaggacaattatattaaaggacggaaaggcttatgttcaggccggagcgggcatagtcgcggattcggtcccggaaagggagtatgaagagtgctacaacaaagcaatggcacttcttaaagccatagaagaggcaggtgaaataagatgatagaaaacatattgattattgataattatgattcttttacctacaatttgtaccagtatgtcggggaaatcagtcccaatattgaggtctacagaaatgacaaaataactttggaaaagatagaagaaatgaatcccacgcatataataatttctcccggccccggttttccgaaagatgcaggaatatgcatagaagctataagaaagttcggcaggtatatacccattctgggggtatgccttggacatcaggcaattggagaagctt

SEQ ID NO: 3358 - protein, 494 aa, Clostridium thermocellum
MFYPTLDEVKIMAKDYNIIPVTMEVYADMETPISLFKRFEESSCCFLLESVEGGEKWARYSIIGKNPFLVVESYKNKTIIRERNGSQREVEGNPVEIIKGIMGKFKGANLPNLPRFNGGAVGYFGYDLIRHYENLPNVPEDDMGLPECHFMFTDEVLVYDHLKQKIHIIVNLHVNGNIERAYISAVDRIKTIHREILDTRWKTADNSVLSYNKKKNELAVTSNISKEDFCRNVLKAKQYIRDGDIFQVVLSQRLCVETNENPFNIYRALRVINPSPYMYYLKFGGYRIIGSSPEMLVRVENGIVETCPIAGTRKRGRTKEEDEALEKELLSDEKEIAEHVMLVDLGRNDIGRVSKFGTVAVKNLMHIERYSHVMHVVTNVQGEIREDKTPFDALMSILPAGTLSGAPKVRAMEIIDELETVKRGPYGGAIGYLSFNGNLDSCITIRTIILKDGKAYVQAGAGIVADSVPEREYEECYNKAMALLKAIEEAGEIR

SEQ ID NO: 3359 - DNA, 1548 bp, Bacillus subtilis
  CDS (1)..(1548)
atgaatttccaatcaaacatttccgcatttttagaggacagcttgtcccaccacacgataccgattgtggagaccttcacagtcgatacactgacacccattcaaatgatagagaagcttgacagggagattacgtatcttcttgaaagcaaggacgatacatccacttggtccagatattcgtttatcggcctgaatccatttctcacaattaaagaagagcagggccgtttttcggccgctgatcaggacagcaaatctctttacacaggaaatgaactaaaagaagtgctgaactggatgaataccacatacaaaatcaaaacacctgagcttggcattccttttgtcggcggagctgtcgggtacttaagctatgatatgatcccgctgattgagccttctgttccttcgcataccaaagaaacagacatggaaaagtgtatgctgtttgtttgccggacattaattgcgtatgatcatgaaaccaaaaacgtccactttatccaatatgcaaggctcactggagaggaaacaaaaaacgaaaaaatggatgtattccatcaaaatcatctggagcttcaaaatctcattgaaaaaatgatggaccaaaaaaacataaaagagctgtttctttctgctgattcatacaagacacccagctttgagacagtatcttctaattatgaaaaatcggcttttatggctgatgtagaaaaaatcaaaagctatataaaagcaggcgatatcttccagggtgttttatcacaaaaatttgaggtgccgataaaagcagatgcttttgagttataccgagtgcttaggatcgtcaatccttcgccgtatatgtattatatgaaactgctagacagagaaatagtcggcagctctccggaacggttaatacacgttcaagacgggcacttagaaatccatccgattgccggtacgagaaaacgcggtgcagacaaagctgaagatgagagactgaaggttgagctcatgaaggatgaaaaagaaaaagcggagcattacatgctcgttgatcttgcccgaaacgatatcggcagagtagcagagtatggttctgtttctgtgccggagttcacaaaaattgtttccttttcacatgtcatgcacattatctcggtggttacaggccgattgaaaaaaggggttcatcctgtcgatgcactgatgtctgctttcccggcggggactttaacaggcgcacccaaaatccgtgccatgcagcttttgcaagaactcgagccaacaccgagagagacatacggagggtgtattgcctacattgggtttgacgggaatatcgactcttgtattacgattcgcacgatgagtgtaaagaacggtgttgcatcgatacaggcaggtgctggcattgttgctgattctgttccggaagccgaatacgaagaaagctgtaataaagccggtgcgctgctgaaaacgattcatattgcagaagacatgtttcatagcaaggaggataaagctgatgaacagatttctacaattgtgcgttga

SEQ ID NO: 3360 - protein, 515 aa, Bacillus subtilis
MNFQSNISAFLEDSLSHHTIPIVETFTVDTLTPIQMIEKLDREITYLLESKDDTSTWSRYSFIGLNPFLTIKEEQGRFSAADQDSKSLYTGNELKEVLNWMNTTYKIKTPELGIPFVGGAVGYLSYDMIPLIEPSVPSHTKETDMEKCMLFVCRTLIAYDHETKNVHFIQYARLTGEETKNEKMDVFHQNHLELQNLIEKMMDQKNIKELFLSADSYKTPSFETVSSNYEKSAFMADVEKIKSYIKAGDIFQGVLSQKFEVPIKADAFELYRVLRIVNPSPYMYYMKLLDREIVGSSPERLIHVQDGHLEIHPIAGTRKRGADKAEDERLKVELMKDEKEKAEHYMLVDLARNDIGRVAEYGSVSVPEFTKIVSFSHVMHIISVVTGRLKKGVHPVDALMSAFPAGTLTGAPKIRAMQLLQELEPTPRETYGGCIAYIGFDGNIDSCITIRTMSVKNGVASIQAGAGIVADSVPEAEYEESCNKAGALLKTIHIAEDMFHSKEDKADEQISTIVR

SEQ ID NO: 3361 - DNA, 1524 bp, Saccharomyces cerevisiae
  CDS (1)..(1524)
atgaccgcttccatcaaaattcaaccggatattgactctctaaagcaattacagcagcaaaatgacgatagttccataaatatgtatcccgtgtatgcgtatttgccatcattggatctgactcctcacgtggcatatctaaaattggcacaattgaacaaccctgatagaaaggaatcatttctgttggaaagtgctaagacaaataatgaattagatcgttattcattcataggtatctcgccacgcaagaccatcaaaaccggtcctactgaaggcattgaaacagatcctttggaaattttggaaaaggagatgtctacctttaaagtagccgaaaatgttcctggtttaccgaaattaagtggtggtgctattggttatatttcttatgactgtgttcgttatttcgagccaaaaacaagaaggcctttgaaagatgtcctaagacttccagaggcatatttaatgctttgtgataccattattgcctttgataatgtttttcagagatttcaaatcattcataacattaataccaatgaaacttcgttggaggaaggttaccaagctgcagcacaaataatcactgatatcgtatcaaagctaaccgacgattcctcgccaataccatatccagaacaacctcctattaaattgaatcaaacttttgaatcgaatgtgggcaaggaaggttacgaaaatcacgtctccactttgaagaagcatattaagaaaggtgatattattcaaggtgtgccatcgcaaagagtggcaaggccaacttcgttacatcctttcaatatttacagacatttacgtacagtgaacccatctccttacctgttttatattgattgtttggatttccaaatcattggtgcatctccagaattgttgtgcaaatcggattccaaaaatagagtcattacccatccaattgctggtactgtcaaacgtggggctactactgaagaggatgatgctttagcggaccaattacgtggctcgttaaaagaccgtgcagaacatgttatgctggtagatttagcaagaaacgatattaacagaatttgtgacccattaacaacaagtgtcgataaactgttaactattcaaaaattttctcatgtccaacatctggtttctcaagtcagcggtgttctccgcccagaaaagacaagatttgatgcattcagatcgattttccctgcaggtactgtcagtggtgctccaaaggttagagccatggaattgattgccgaactagaaggagaaaggcgtggggtttatgcaggcgccgtaggtcattggtcatacgacggtaaaacaatggacaattgtatcgctttaaggactatggtctataaagatggcattgcttacttgcaagctggcggtggtattgtttacgattcagatgagtacgatgaatatgtcgaaaccatgaataaaatgatggccaatcacagtactattgtgcaagcagaagaattgtgggccgatatcgtaggatcagcttaa

SEQ ID NO: 3362 - protein, 507 aa, Saccharomyces cerevisiae
MTASIKIQPDIDSLKQLQQQNDDSSINMYPVYAYLPSLDLTPHVAYLKLAQLNNPDRKESFLLESAKTNNELDRYSFIGISPRKTIKTGPTEGIETDPLEILEKEMSTFKVAENVPGLPKLSGGAIGYISYDCVRYFEPKTRRPLKDVLRLPEAYLMLCDTIIAFDNVFQRFQIIHNINTNETSLEEGYQAAAQIITDIVSKLTDDSSPIPYPEQPPIKLNQTFESNVGKEGYENHVSTLKKHIKKGDIIQGVPSQRVARPTSLHPFNIYRHLRTVNPSPYLFYIDCLDFQIIGASPELLCKSDSKNRVITHPIAGTVKRGATTEEDDALADQLRGSLKDRAEHVMLVDLARNDINRICDPLTTSVDKLLTIQKFSHVQHLVSQVSGVLRPEKTRFDAFRSIFPAGTVSGAPKVRAMELIAELEGERRGVYAGAVGHWSYDGKTMDNCIALRTMVYKDGIAYLQAGGGIVYDSDEYDEYVETMNKMMANHSTIVQAEELWADIVGSA

SEQ ID NO: 3363 - DNA, 2340 bp, Thermus aquaticus
  CDS (169)..(1557)
ggatccgggccctggaggggcggcccctttagcccctggacagggcccccgtgtcccgctatcctgaggccatggcccttccctccgccctctggtggcccggctaggccccggggcgggaggcctttccccggggcacaccccggggctttgtttttgggggacggcatggagcggatccgaccttaccgcaaaaccttcctcgcggacctggagaccccggtgaccgcctacctgaagcttgccgagaaggctccggtgagcttccttttggagtcggtggagcgggggcgccaaagccgcttctccatcgtgggggtgggggcgcggcgcaccttccgcctgaaggacggggtcttcacggtgaacggggagcgggtggaaacccgtgatcccttgcgcgccctctacgagagggtctacgcccccttggagcgccaccccgacctcccccccttcttcggcggggtggtgggctacgccgcctacgacctcgtccgctactacgaaaggcttccgagcctcaagcccgacgacctcggcctccccgacctcctcttcgtggagcccgaggtggtggccgtctttgaccacctgaagaacctcctccacctcgtggccccagggagggaccccgaggaggcggaggcccgcctcttttgggcggagaggcggctcaagggccccttgcccggggtgccgggggagagggcgggggggagggcccgcttccaggcggacttttcccgggaggcctacctggaggcggtgaggagggccctggactacatccgggcgggggacatcttccaggtggtcctctccttgaggctctcctcccccctcaccgtccaccccttcgccctctaccgggcgctgaggagcgtgaacccgagcccctacatgggctacctggacctgggggaggtggtcttggtctcggcgagcccggaaagcctcctccgctcggacggccgaagggtggtcacccggcccatcgcgggcacgaggccgagggggaaggacgaggaggaggacaaaaggcttgccgaggagctccttagggacgagaaggaggtcgcggagcacgtgatgcttctggacctctcccgcaacgacatcggccgggtcgccgccttcggcacggtgcgggtcctcgagcccctccacgtggagcactactcccacgtgatgcacctggtctccacggtggagggcatcttggccgaggggaagacccccctggacgccctggccagcgtgctgcccatggggacggtctccggggccccgaagatccgggccatggagatcattgaagaactggagccccaccgccgggggccctacgggggaagcttcggctacctcgcctacgacggggccatggacatggccctcaccctgcgcaccttcgtggtggcgaaggggtggatgcacgtccaggcgggggcggggatcgtggcggactcggtgccggagagggagtacgaggagtgctggaacaaggcgcgggcgctcctcaaggcggtggagatggcggaggcggggctgtgatcccaccccatgccggcaggggcccggtaaggaggcctggtaggcatggctgctaacggagcgaaggggagaaaggttatgagggtcttggtggtggacaactacgacagcttcacctacaacctggtgcagtacctgggggagctcggggcggagcccatcgtgtggcggaacgaccgcttccggctggaggaggtggaggccctggacccggaccggatcctcatcagcccggggccttgcaccccctttgaggcggggctttccgtccccttggtccagcgctacgccccccgctaccccatcctgggggtctgcctcggacaccaggccatcggggcggccttcggggggaaggtggtccccgcccccgtcctcatgcacggcaaggtgagccccatccaccacgacggcaccggggtcttccgggggctagatagccccttccccgccacccgctaccactccctggcggtggtggaggtgccggaggccctcgtggtgaacgcctgggcggaggaggcgggggggcggacggtgatgggcttccgccaccgggactaccccacccacggggtgcagttccacccggaaagctaccttacggaggcgggtaaactcatcctcaagaacttcctggaggacccatggacgcggtgaagaaggccattctgggcgaggttttggaggaagaggaggcctacgaggtcatgcgggccctgatggcgggggaggtctccccggtgcgggcggcggggcttttggtggccttgagcctgaggg

SEQ ID NO: 3364 - protein, 462 aa, Thermus aquaticus
MERIRPYRKTFLADLETPVTAYLKLAEKAPVSFLLESVERGRQSRFSIVGVGARRTFRLKDGVFTVNGERVETRDPLRALYERVYAPLERHPDLPPFFGGVVGYAAYDLVRYYERLPSLKPDDLGLPDLLFVEPEVVAVFDHLKNLLHLVAPGRDPEEAEARLFWAERRLKGPLPGVPGERAGGRARFQADFSREAYLEAVRRALDYIRAGDIFQVVLSLRLSSPLTVHPFALYRALRSVNPSPYMGYLDLGEVVLVSASPESLLRSDGRRVVTRPIAGTRPRGKDEEEDKRLAEELLRDEKEVAEHVMLLDLSRNDIGRVAAFGTVRVLEPLHVEHYSHVMHLVSTVEGILAEGKTPLDALASVLPMGTVSGAPKIRAMEIIEELEPHRRGPYGGSFGYLAYDGAMDMALTLRTFVVAKGWMHVQAGAGIVADSVPEREYEECWNKARALLKAVEMAEAGL

SEQ ID NO: 3365 - DNA, 2558 bp, Bacillus caldotenax
  CDS (312)..(1838)
agatctgccacgtgtatttaaaaggggcggtcgtgctgcgcccggatttgtcgttgacaaaaaaaacagaaatgtaatatagttaaaataacctctttgccccctgagacatcgggggcgttagaagctgagcgagagcagagagcgagcgtagggtagatgagaatgagcgagtttagctgaggtgagcgttttttcattcgccgacatctgcccaaagacggtcgtctttgggcgttttattttccctctcttttttcgcctcataaaccctcattctccgcccgctgatcatgaagggaggagaagtgatgtctgctgatgggctggccgcttttttggcggaagcgaacgaatttcgaaccatcccgattgtgcgcaaatttgtagccgatgtcattgagccgctcggcgtgtttgccaatttgcgcgaggaagccgtgtttttgcttgaaagcaaggatgacgaatcgccgtgggcgcgctattcgttcatcggtgtggcgccgtttttgacgctggagagcgaaaccggcgaaacgttttcggtgaaagacgaaaacgggaacgaacaaatcaccgcaccgacgctgaaagaagcgtttcaatgggtcgagcggacgcttgccgtcaagccgcttgccgagacggtgccgtttacaggcggtgcagttgggtttttaggctacgatttcatttccgccatcgaaaaagtgccgcgccacaaaaaccgcgatgtgcctatgaagacggcctatttcgtgttttgtgaatcgctgtttgcgtttgaccaaaaaaagcgtgagttgctcgtcattcactatattcggttgagcggcaacgaaacggaggaagagaaaatcgaagcgtaccgcgcggccgaacggcgcatggccgatctcgcggcgaaagcggcccgccctcaagccgagcaaccgctcttgccggcggaaagcgaatcggggcggaccgcctcgtttgccaaagcggtgtccaactatgacaaaaaacagtttttgcgcgatgtggaggccgtgaaacggtacatcgcggccggcgatgtgtttcaagcggttctgtcgcagcgcttctgcgtgccggttcaagccggaggctttgccatttatcggctgctccgatacatcaacccgtcgccgtacatgttttatttccagcttgacggtgtggaaattgtcggcagttcgccggaaaaactgattcaagtgcaccgtcggcgcgttgaaatcgatccgattgccggcacacggcggcgcggccgatcgccggaggaagacgagaggctggctgatgagctgtaccacgacccgaaagaacgggctgagcattatatgcttgtcgatttggcgcgcaacgacatcggccgggtcgccaagtacggaacggtcgaggtgccggtgttgcttcagatcggcaagttttcacacgtgatgcacttaatttccaaggtcgtcggtgaactggacgacaacgtccacccgatcgatgcactccttgccgcctttccggctggaacggtgagcggggcgccgaaagtgcgggcgatgcaaattttgcaggaactcgagccgacagcgagggggctgtatgccggagcgattgcctatatcgggtttgatggcaacatcgattcgtgcatcgccatccggacagcggtcgtgaaagacggctatgcctatgtgcaagccggcgccggcattgtcgccgactccgttccggaactggagtggaaagagacgcgcaataaggcgagcgccttgatgaatgcgattgaacaagcggaacgactatttgctaaaggggagagggccgtatgttgaagcagctgctttcgaaatgtgcggaagggaaagcgttgacggaagacgaagcgtatgcggcgatgaatatcatcatgtccggcgaggcgacagacagtcaaatcgcaagtctgttgtccatgctccgcctgcgcggagagacagtcgatgagctcgtcggatttgtgcgggcgatgcgcgaccggatgactgccattgaggctagtgatgatgtcatcgatacgtgcggtacgggcggcgatggggcggcgacattcaacgtttccaccgccgcggcgatcgtcatttcatcgcttggcgtcaaagtcgccaagcacggcaaccgcgctgtttcgtcaaaaagcggcagcgctgatgtgctcgagcggctcggcatcgacattcacacgtcgccgtcggccgccaaacaggcgttggaaacgaaagggctggcgtttttgttcgccccgctctatcacgcggcgatgaaacacgccgccgggccgcggaaggaaatcggtttccgcaccgttttcaacttgatcggcccgctcgccaatccggcgcgctgcaagcggcaagtcgtcggcgtctattcgacctgctacgctgagaaattggcggaggcgatgcgccgcctcggctcggaacatgtgttgtttgtcaccgggcgcgatgggcttgatgaatgcagcatcgctgcagaaacggatgtcgtggagttgaaagacggtgcgatcc

SEQ ID NO: 3366 - protein, 508 aa, Bacillus caldotenax
MSADGLAAFLAEANEFRTIPIVRKFVADVIEPLGVFANLREEAVFLLESKDDESPWARYSFIGVAPFLTLESETGETFSVKDENGNEQITAPTLKEAFQWVERTLAVKPLAETVPFTGGAVGFLGYDFISAIEKVPRHKNRDVPMKTAYFVFCESLFAFDQKKRELLVIHYIRLSGNETEEEKIEAYRAAERRMADLAAKAARPQAEQPLLPAESESGRTASFAKAVSNYDKKQFLRDVEAVKRYIAAGDVFQAVLSQRFCVPVQAGGFAIYRLLRYINPSPYMFYFQLDGVEIVGSSPEKLIQVHRRRVEIDPIAGTRRRGRSPEEDERLADELYHDPKERAEHYMLVDLARNDIGRVAKYGTVEVPVLLQIGKFSHVMHLISKVVGELDDNVHPIDALLAAFPAGTVSGAPKVRAMQILQELEPTARGLYAGAIAYIGFDGNIDSCIAIRTAVVKDGYAYVQAGAGIVADSVPELEWKETRNKASALMNAIEQAERLFAKGERAVC

SEQ ID NO: 3367 - DNA, 2068 bp, Arabidopsis thaliana (mouse-ear cress)
  CDS (29)..(1894)
aagacttaaaatcaacgagctcacggggatgtcggccgtttcaatctccgccgtcaaatctgattttttcaccgtcgaagccatagccgttacacaccatcggacgccgcatccaccacatttcccttcgctccggtttccactatcgctcaagtccccgccggctacttctcttaaccttgtggctggatcaaaactcctccacttctcgcgtcgtcttccttctatcaaatgctcatatactccgtcgttagatttatcggaggaacagttcacaaaatttaaaaaagcatcggaaaagggaaacttagttcctctattccgatgtgtattctcggatcatttgactccgatacttgcttaccgatgtttggtgaaagaagatgatagagatgctcctagcttcttgttcgagtctgtggagcctggttcgcaatcgtccaacatcggtaggtatagtgtagttggagctcagcctacaatagaaatcgttgcaaagggaaatgtagttactgtgatggaccatggagctagtcttaggacagaggaggaagtggatgatccaatgatggttcctcagaaaatcatggaggaatggaatccacaaggcattgatgaattgcctgaagctttctgcggtggttgggttggatacttttcatatgacactgtacgttatgttgagaagaagaagctgcctttttctaatgctccagaggatgataggagtcttcctgatgttaatttgggtctttatgatgatgtgatcgtgtttgatcatgttgagaagaaagcatatgtgatccactgggtgcggatagataaggatcgttctgttgaagaaaatttccgtgaaggaatgaatcggttggaatctctaacctctagaattcaagaccaaaaaccccccaagatgcctactggtttcataaaactacgcactcagctcttcggtccgaaattggagaaatcaactatgacgagtgaggcatacaaggaggcagtggtggaagccaaagaacatatcttggctggggacatctttcagatagttcttagtcagagatttgaaaggcggacatttgcggacccatttgagatatatagagctcttaggattgtaaatccaagtccctacatggcctatttgcaggttagaggatgcatattagttgcatcaagtccagagatattgttacgttcaaaaaataggaaaattaccaatcgcccccttgctggaactgtcagaagagggaagacacccaaagaagatctaatgctggaaaaagagctcttaagcgatgaaaaacaatgcgcagaacatattatgcttgttgatttgggaaggaacgatgttggcaaggtttcaaagcctggttctgtggaggtcaagaagctcaaggatatagaatggttttcacatgtcatgcacattagctccacggtagtaggtgaattgctcgatcatctaacaagctgggacgctcttagagctgtacttcccgttggaaccgtgagcggagccccaaaggtaaaagccatggagctgatagatgaacttgaagtaacaaggcgtggtccttacagtggaggctttggaggcatttcgtttaatggagacatggacattgccttagctctcagaacaatggtcttcccaacaaatacccgttatgacacattgtactcatacaagcatcctcagagacgtagagaatggattgctcatattcaagctggagctgggattgttgcagacagtaaccctgatgatgaacatagagagtgtgagaacaaagcagcggctttagcccgagccatcgatcttgctgagtcctcctttcttgaggcacctgagtttactactatcacacctcacatcaacaatatctgagcataagcattctttatttctttacttttgctttcagcattactcactccacatagctgtttgatttgcgagattggctcttttaagttttagaatttaggacttctgtccgaggtttgaggtctgtcggaccaaaatttggtagcaaatatttacaaataatatcatatgatc

SEQ ID NO: 3368 - protein, 621 aa, Arabidopsis thaliana (mouse-ear cress)
MSAVSISAVKSDFFTVEAIAVTHHRTPHPPHFPSLRFPLSLKSPPATSLNLVAGSKLLHFSRRLPSIKCSYTPSLDLSEEQFTKFKKASEKGNLVPLFRCVFSDHLTPILAYRCLVKEDDRDAPSFLFESVEPGSQSSNIGRYSVVGAQPTIEIVAKGNVVTVMDHGASLRTEEEVDDPMMVPQKIMEEWNPQGIDELPEAFCGGWVGYFSYDTVRYVEKKKLPFSNAPEDDRSLPDVNLGLYDDVIVFDHVEKKAYVIHWVRIDKDRSVEENFREGMNRLESLTSRIQDQKPPKMPTGFIKLRTQLFGPKLEKSTMTSEAYKEAVVEAKEHILAGDIFQIVLSQRFERRTFADPFEIYRALRIVNPSPYMAYLQVRGCILVASSPEILLRSKNRKITNRPLAGTVRRGKTPKEDLMLEKELLSDEKQCAEHIMLVDLGRNDVGKVSKPGSVEVKKLKDIEWFSHVMHISSTVVGELLDHLTSWDALRAVLPVGTVSGAPKVKAMELIDELEVTRRGPYSGGFGGISFNGDMDIALALRTMVFPTNTRYDTLYSYKHPQRRREWIAHIQAGAGIVADSNPDDEHRECENKAAALARAIDLAESSFLEAPEFTTITPHINNI

SEQ ID NO: 3369 - DNA, 1371 bp, Lactococcus lactis subsp. lactis
  CDS (1)..(1371)
atgagaaaaattaaagaaatttcagcagacaccatgaccccgatttcggtttatcttcgcctgaaagggaaaaataaagtgattttagaatccattcccagagaaaatgaccaatcacgtttttcaattattgcgttgaatcctgtgaagcacatcaaatttactgacggaattttaagcgtaaatgacgaaatcattagcgatgaaaatccaatggaatttctggaaaaattagtttgtcagccagaaagtactgacgaaaatttagacttgccttttacaagtggagcgattggatatgctggatttgatacctatggtatttttgaaggcattcaacctgaactgaaagattcgattggaacaccagatatgtattttatgttatacgaatcagctctaatttttgaccacaaacgagaaaaactgatttttattgaagacaatacttacagtcagcgttcagaaaaagagttacaaaacgcgctgtacagaaatattgagtcattatctttactgacagaagcagaaaatgaactgacagaattaagtaaactgaatttcgtcagcaatatgtctcaagaactttttgaagaaaaagttgctaaagcaaaggaacttatcagaaatggtgacatgttccaagttgttttatcacaacgtttaacagccgattttactgacaacccttttaattattacagaaagcttcgggttgaaaatccgtcatcgtatatgtactttatggaattcgataattttcatgtcattggcagctcaccagagcgtttggttgcagttcatggaaatcaagtttcaaccaatccaattgccggaacaaggaaacgcgggcaaactgaatttgaagaccaagctcttattgaggatttagaaagtgatcccaaagaagtcgctgaacacaaaatgcttgttgatttaggacgaaatgatattggtaaaatttccaaatatggttcaatcgaagttcctgttttcatgaaagttgagaaatatcgctacgtcatgcatattacaagtgaagtgaccggcgagcttcgtcctgaatttacagctatggatgccttacgcgccacattgccagcggggacgctatcaggagcaccgaagcatcgagcctaccaaagaatttatgaatttgaaacgcaaaaacgaggaatttatggtggagctatcggttatctaacgaaaaatggaaattgcgattttgcaattgccattcggacaatggtcttgaaagacaagaaagcacatgttcaagcaggagccggaattgtttacgattcagtacccgaacatgaatatcaagaaaccttaaacaaagcccaaggcttattgaaagttggtcaataa

SEQ ID NO: 3370 - protein, 456 aa, Lactococcus lactis subsp. lactis
MRKIKEISADTMTPISVYLRLKGKNKVILESIPRENDQSRFSIIALNPVKHIKFTDGILSVNDEIISDENPMEFLEKLVCQPESTDENLDLPFTSGAIGYAGFDTYGIFEGIQPELKDSIGTPDMYFMLYESALIFDHKREKLIFIEDNTYSQRSEKELQNALYRNIESLSLLTEAENELTELSKLNFVSNMSQELFEEKVAKAKELIRNGDMFQVVLSQRLTADFTDNPFNYYRKLRVENPSSYMYFMEFDNFHVIGSSPERLVAVHGNQVSTNPIAGTRKRGQTEFEDQALIEDLESDPKEVAEHKMLVDLGRNDIGKISKYGSIEVPVFMKVEKYRYVMHITSEVTGELRPEFTAMDALRATLPAGTLSGAPKHRAYQRIYEFETQKRGIYGGAIGYLTKNGNCDFAIAIRTMVLKDKKAHVQAGAGIVYDSVPEHEYQETLNKAQGLLKVGQ

SEQ ID NO: 3371 - DNA, 1527 bp, Synechocystis sp
  CDS (1)..(1527)
atgatttcccctgggttttctcacttcactgaactcgcccaacaaggcaattttattccggtgtatcaggaatgggtggcggatttagaaacgccagtttctgcttggtacaaagtttgctctagccaaccctacaattttctcctggagtcggtggaagggggagagagtattggtcgctatagttttctcggttgcgaccccatgtgggtgctagaagccaggggcgacgaaactacccaagttttacgcaatgggcaaacggaaacctttcggggtaatcccctcgatattttgtcccaatgtttggaatcaatccgtccggtgaatttaccccaactacctccgggcattggtgggctgtttggggtttggggttatgagctgattcgttggatggaacccagggttcctgtgtatgaaccccagccggaagatccacccgatggcatttggatgcaggtggaccatctcctcattttcgaccaggtcaaacgcaaaatttgggcgattgcctttgcggatttgcggggggaaaatgttgatttggaaactgcctatcgcaatgcttgtcaacgggtgacgaaattagtcctgcaattacaattacctctgccgccggaagccaccgccctggaactgctcaccaaaacccaacttgagggtaaggaactgaactacagcagtaatacggagcaagaaaagtttttagaagaagtggcgatcgccaaggattacatcacagcgggggacattttccaggtggtgctttcccaaagactttccactatttaccgggatgatcccttcaagctctaccgttccctcaggctgattaatccttccccctacatggcttattacaactttggccattggcaaattattggctctagcccggaggtgatggtcaaagccgatcgccaactggatggcaaattaatggccacggtacgccccattgctggcaccagacccaggggcaaaacccacccagaggatgaacagttagccgaagaattgctgaacgatcccaaagaaatcgccgaacacgtcatgctggtggatttgggtcgcaatgatttgggacgggtttgcgttcagggctcagtcaaagtgaatgagttgatggtgattgaacgttattcccacgtcatgcacatagtcagtaacgtagtgggagaactggcatcggataaaaccgcctgggatcttttgaaagcttgttttcccgctggcaccgtcagtggtgcaccgaaaattagggccatggaaattattaacgagctggaaccggaacggcgggggccctactccggagtctatggctactatgattttgaaggccagttaaatacggcgatcgccattcggaccatggtggtgcaggaacagccagatggagcccatcgggtgtcggtgcagaccggagctggcattgtggccgattccgatccccaaaaagagtatgaggaaactttaaataaagcgaggggacttttggaagccattcgtgccttgtcctag

SEQ ID NO: 3372 - protein, 508 aa, Synechocystis sp
MISPGFSHFTELAQQGNFIPVYQEWVADLETPVSAWYKVCSSQPYNFLLESVEGGESIGRYSFLGCDPMWVLEARGDETTQVLRNGQTETFRGNPLDILSQCLESIRPVNLPQLPPGIGGLFGVWGYELIRWMEPRVPVYEPQPEDPPDGIWMQVDHLLIFDQVKRKIWAIAFADLRGENVDLETAYRNACQRVTKLVLQLQLPLPPEATALELLTKTQLEGKELNYSSNTEQEKFLEEVAIAKDYITAGDIFQVVLSQRLSTIYRDDPFKLYRSLRLINPSPYMAYYNFGHWQIIGSSPEVMVKADRQLDGKLMATVRPIAGTRPRGKTHPEDEQLAEELLNDPKEIAEHVMLVDLGRNDLGRVCVQGSVKVNELMVIERYSHVMHIVSNVVGELASDKTAWDLLKACFPAGTVSGAPKIRAMEIINELEPERRGPYSGVYGYYDFEGQLNTAIAIRTMVVQEQPDGAHRVSVQTGAGIVADSDPQKEYEETLNKARGLLEAIRALS

SEQ ID NO: 3373 - DNA, 1458 bp, Synechocystis sp
  CDS (1)..(1458)
atggcatcaattgcgcattgttcgggcggattggttggtgctgggaactttgattttattttggggggctcggatcctgtggggaggcatggcctgatggaactccaaccctggcattggtgttgtttgcccctagaaggccgcacgggcagtgaaatttttagtcaattatttggtcatcaaggcatcgccaccctactagaaagtccctatcctgcttcaccggatcatccccatttaggccgttattccctctgtgccggccaaccgagaaagggtaggttatggactcctaagccggaagagatttttagctttttaaaccaactttgcccatgtaatcatgatgtaaatttgacaaaaaatattcctgaacatttacctttccatggcggttggttaggctggttaggttacgacactgcttgggcaattgaaaaattaccttattcaaaagctgatgatttaccttttccggtggcctattggtacgagcctgaaaattttgtaattttagatcatcaagagcaattattatggttagctactaccgaccaggagaaaattaagttttttcaaactcagttagcagataaaatcaactcagtttcatcgcctcaagtgcctcccttaaatttgacctataccactgaccaagatcagtacgaaaccatggtcaatcaagcgaaacaatatattaaagccggagatatttttcaagctaatttaacactacgtttcattgctaaaactgagcaaaagcttaacagttggcaggtctatcaacatctacaaactatcaatccttctcctttcgctagttactggcgatcgccgtggggagatgtggttagttgttctccggaaagattagttaagttagaaggcaatgtggcccaaactagacccattgctggcactagggcaaggggcaaaaatctggcggaggatgaacaattattgcaggagttgctggttaacaccaaagagttggcagaacatatcatgttggtggatttagaacgcaatgacctcggccgggtctgtacctggggaacggtggaagtagatgaattattggcgatcgagcgctatagccatgtgtcccatttagttagtaatgtaaaaggcattttacaaccagataaaaccggagtagatttggtcaaagctttgtttcccggtggcaccattaccggctgtcccaaaatacgttgtttagaaattattgaagaattagaaccagtgcggcggagtttgttttacggttcctgtggctactgggatcaacgggggaacttagatttaaatattctcattcgcaccctgttattcacctctggacaagtgacaggacaagtgggagccggcattgtggcagacagtgatcccgccaaggaatggttagaatcattgcaaaaagccaaagctttattggcggcattggagggactataa

SEQ ID NO: 3374 - protein, 485 aa, Synechocystis sp
MASIAHCSGGLVGAGNFDFILGGSDPVGRHGLMELQPWHWCCLPLEGRTGSEIFSQLFGHQGIATLLESPYPASPDHPHLGRYSLCAGQPRKGRLWTPKPEEIFSFLNQLCPCNHDVNLTKNIPEHLPFHGGWLGWLGYDTAWAIEKLPYSKADDLPFPVAYWYEPENFVILDHQEQLLWLATTDQEKIKFFQTQLADKINSVSSPQVPPLNLTYTTDQDQYETMVNQAKQYIKAGDIFQANLTLRFIAKTEQKLNSWQVYQHLQTINPSPFASYWRSPWGDVVSCSPERLVKLEGNVAQTRPIAGTRARGKNLAEDEQLLQELLVNTKELAEHIMLVDLERNDLGRVCTWGTVEVDELLAIERYSHVSHLVSNVKGILQPDKTGVDLVKALFPGGTITGCPKIRCLEIIEELEPVRRSLFYGSCGYWDQRGNLDLNILIRTLLFTSGQVTGQVGAGIVADSDPAKEWLESLQKAKALLAALEGL

SEQ ID NO: 3375 - DNA, 2144 bp, Nicotiana tabacum (common tobacco)
  CDS (90)..(1940)
gtcaaaaatccccatttcaccgtttcctcgtttctcctcctcactaattttgtctctttctcttggtttgctattgtgctcttgtaggaatgcagtcgttacctatctcataccggttgtttccggccacccaccggaaagttctgccattcgccgtcatttctagccggagctcaacttctgcacttgcgcttcgtgtccgtacactacaatgccgctgccttcactcttcatctctagttatggatgaggacaggttcattgaagcttctaaaagcgggaacttgattccgctgcacaaaaccattttttctgatcatctgactccggtgctggcttaccggtgtttggtgaaagaagacgaccgtgaagctccaagctttctctttgaatccgttgaacctggttttcgaggttctagtgttggtcgctacagcgtggtgggggctcaaccatctatggaaattgtggctaaggaacacaatgtgactatattggaccaccacactggaaaattgacccagaagactgtccaagatcccatgacgattccgaggagtatttctgagggatggaagcccagactcattgatgaacttcctgataccttttgtggtggatgggttggttatttctcatatgacacagttcggtatgtagagaacaggaagttgccattcctaagggctccagaggatgaccggaaccttgcagatattcaattaggactatacgaagatgtcattgtgtttgatcatgttgagaagaaagcacatgtgattcactgggtgcagttggatcagtattcatctcttcctgaggcatatcttgatgggaagaaacgcttggaaatattagtgtctagagtacaaggaattgagtctccaaggttatctcccggttctgtggatttctgtactcatgcttttggaccttcattaaccaagggaaacatgacaagtgaggagtacaagaatgctgtcttacaagcaaaggagcacattgctgcaggagacatatttcaaatcgttttaagtcaacgctttgagagaagaacatttgctgacccatttgaagtgtacagagcattaagaattgtgaatccaagcccatatatgacttacatacaagccagaggctgtattttagttgcatcgagcccagaaattttgacacgtgtgaagaagagaagaattgttaatcgaccactggctgggacaagcagaagagggaagacacctgatgaggatgtgatgttggaaatgcagatgttaaaagatgagaaacaacgcgcagagcacatcatgctggttgatttaggacgaaatgatgtaggaaaggtgtcaaaacctggttctgtgaatgtcgaaaagctcatgagcgttgagcggtattcccatgtgatgcacataagctccacggtctctggagagttgcttgatcatttaacctgttgggatgcactacgtgctgcattgcctgttgggaccgtcagtggagcaccaaaggtaaaggccatggagttgattgatcagctagaagtagctcggagagggccttacagtggtgggtttggaggcatttccttttcaggtgacatggacatcgcactagctctaaggacgatggtattcctcaatggagctcgttatgacacaatgtattcatatacagatgccagcaagcgtcaggaatgggttgctcatctccaatccggggctggaattgtggctgatagtaatcctgatgaggaacagatagaatgcgagaataaagtagccggtctgtgccgagccattgacttggccgagtcagcttttgtaaagggaagacacaaaccgtcagtcaagataaatggttctgtgccaaatctattttcaagggtacaacgtcaaacatctgttatgtcgaaggacagagtacatgagaaaagaaactagcgaatatgaagatgtacataaattctaaagtggttttcttgttcagtttaatcttttactggattgagactgtagttgctgaagatagttgtttagaatgaccttcattttggtgttcctgaaaggacagtgcacatatatagcaaattgatcaaatgtttaatccttgtatgcgggtgagaatcaatgccatcagcaatttgg

SEQ ID NO: 3376 - protein, 616 aa, Nicotiana tabacum (common tobacco)
MQSLPISYRLFPATHRKVLPFAVISSRSSTSALALRVRTLQCRCLHSSSLVMDEDRFIEASKSGNLIPLHKTIFSDHLTPVLAYRCLVKEDDREAPSFLFESVEPGFRGSSVGRYSVVGAQPSMEIVAKEHNVTILDHHTGKLTQKTVQDPMTIPRSISEGWKPRLIDELPDTFCGGWVGYFSYDTVRYVENRKLPFLRAPEDDRNLADIQLGLYEDVIVFDHVEKKAHVIHWVQLDQYSSLPEAYLDGKKRLEILVSRVQGIESPRLSPGSVDFCTHAFGPSLTKGNMTSEEYKNAVLQAKEHIAAGDIFQIVLSQRFERRTFADPFEVYRALRIVNPSPYMTYIQARGCILVASSPEILTRVKKRRIVNRPLAGTSRRGKTPDEDVMLEMQMLKDEKQRAEHIMLVDLGRNDVGKVSKPGSVNVEKLMSVERYSHVMHISSTVSGELLDHLTCWDALRAALPVGTVSGAPKVKAMELIDQLEVARRGPYSGGFGGISFSGDMDIALALRTMVFLNGARYDTMYSYTDASKRQEWVAHLQSGAGIVADSNPDEEQIECENKVAGLCRAIDLAESAFVKGRHKPSVKINGSVPNLFSRVQRQTSVMSKDRVHEKRN

SEQ ID NO: 3377 - DNA, 1509 bp, Streptomyces coelicolor
  CDS (1)..(1509)
atggacgtcacgcatgacatggacctcgacaccttccgcaagctcgccgccgaccgccgggtgatcccggtgagccgcaagctcctcgccgacggcgacaccccggtcgcgctgtaccgcaagctcgccgcctcgcgccccggcaccttcctgctggagtccgcggagaacggacgctcctggtccaggtactccttcgtcggcgtccgcagcgccgccaccctcaccgagaaggacggccaggcgcactggcagggcaccccgcccgtcggcgtccccaccgacggcgacccgctcgccgccctgcgcgccaccgtcgaggccctgcacaccccgcgcgacctcgcccacgacctgggcctgccgcccttcaccggcggcatggtgggctacctcgggtacgacatcgtgcgccgcctggagaaggtcggcccgggggagcgcgacgacctgaagctgcccgagctgaccatgctgctcaccagcgacctcgccgtcatggaccactgggagggctcggtcctgctgatcgccaacgcgatcaaccacaacgacctggagaccggcgtcgacgaggcctacgccgacgcgatcgcccgcctcgacgtcatggaggccgacctcacgcgtgccgtcgcccagcccccggccgcgctgcccccctccgagctgcccgagtacaccgcgctgtggggcggccccgacttccaggacgccgtcgaggacatcaaggagcgcatccgcgcgggcgaggccttccaggtcgtcccctcccagcgcttcgagacgccctgcacggcgagcgccctcgacgtctaccgggtcctgcgggccaccaacccctccccgtacatgtacctgctccgtctcgacggcttcgacgtcgtcggctcgtcccccgaggcgctggtcaaggtcgaggacgggcgcgccatggtgcaccccatcgccggtacccgcccgcgcggcgccaccccgcgggaggaccagtccctcgccgacgaactgctcgccgaccccaaggagcgcgccgagcacctgatgctggtcgacctcggccgcaacgacctcgggcgcgtctgcgagcccgggtccgtcgaggtcgtcgacttcatgtccgtcgagcggtactcgcacgtcatgcacatcgtctcgacggtcaccggccgggtcgccccgggccgcaccgccttcgacgtcctcaccgcctgcttcccggccggcaccctctccggcgcgcccaagccgcgcgccctgcagatcatcgacgaactcgagccctcccggcgcggcctgtacggcggctgcgtcggctacctcgacttcgccggcgactccgacaccgccatcgccatccgcaccgccctgctgcgcgacggcaccgcctacgtccaggcgggcgcgggcgtcgtcgccgactccgacccggtcgccgaggacaccgagtgccgcaacaaggcggcggccgtgctgagggccgtacacacggccaaccggctggcgcaatag

SEQ ID NO: 3378 - protein, 502 aa, Streptomyces coelicolor
MDVTHDMDLDTFRKLAADRRVIPVSRKLLADGDTPVALYRKLAASRPGTFLLESAENGRSWSRYSFVGVRSAATLTEKDGQAHWQGTPPVGVPTDGDPLAALRATVEALHTPRDLAHDLGLPPFTGGMVGYLGYDIVRRLEKVGPGERDDLKLPELTMLLTSDLAVMDHWEGSVLLIANAINHNDLETGVDEAYADAIARLDVMEADLTRAVAQPPAALPPSELPEYTALWGGPDFQDAVEDIKERIRAGEAFQVVPSQRFETPCTASALDVYRVLRATNPSPYMYLLRLDGFDVVGSSPEALVKVEDGRAMVHPIAGTRPRGATPREDQSLADELLADPKERAEHLMLVDLGRNDLGRVCEPGSVEVVDFMSVERYSHVMHIVSTVTGRVAPGRTAFDVLTACFPAGTLSGAPKPRALQIIDELEPSRRGLYGGCVGYLDFAGDSDTAIAIRTALLRDGTAYVQAGAGVVADSDPVAEDTECRNKAAAVLRAVHTANRLAQ

SEQ ID NO: 3379 - DNA, 1470 bp, Schizosaccharomyces pombe
  CDS (1)..(1470)
atgaagatttatcctgacttgaaacaagttcaagagcttgctgaaaagcacaaggctaacaagattcccatttatggagtaatccctgccgatatgctgactccttcagtagcctacttgaagcttaatcaaggaaagaagtattcgtttattttagaaagtgtcactcaaggagagagtgtctcaagatacagttttattggcagcccttatagaatattaatggccaatggaaaaacagatcctttggcacgtttagaacgtgagttgaaagaagttaaaacagcccctgttgagggtctgccatctttcagtggaggtgctgtgggctatgtttcttatgattgcatcaaatattttgaacccactactgaaatgcctttagaagataccttgggtcttccggaggctatgtttttcatgaccgacgatttagtcgctttcgatcatgcttatcagactgtcaagataatttctcatgtttgcattcagcaaggccgacccattgaagaggcttacgaagctgccgttttcaaaatcaatatgcttaaaaagaaacttgaaagtcctgaaattcctttgcctgagcaaaagaaggtccatttaggatacgaagctaagtcaaatgtaggcgaagacgggtataaagcatttgtttccaacctcaaggaacatatctttaatggcgatattttccaagctgtcccaagccaacggattgctaggcgtacagatttacatccttttaatttgtaccgccatttaagaacagttaacccgtccccttatatgttctacatccactgtgatgatttcgacataatcggtgcttcccctgaattactggttaaatcagagcatgggcgtattatcaatcatcccattgccggaactgttccaagaggaaaaactaaagaagaggatgaggcatatgccaaggatttacttgctagtgtcaaggatagagctgaacatgtaatgctggtggacttggcaagaaacgatgtcagtcgtgtctgtgatctcgacacaacaagtgttgacaagttgatgactattgaaaagttttctcatgttcagcatcttgtttctcaagtttctggtgttctgagacctgataaaactcgttttgatgcattccgtagtatatttccggctggaacggtcagtgggtctcccaaagtccgtgcaattcagctcgtttatggattagagaaagaaaagcgtggtatatacgcgggagccgtaggtcgttggggctatgaagatgacaacatggatacttgtatagcaatccgtacaatggtttataaagacggaactgtttatttgcaagccggtggtggtattgtgtttgattcagatgaacaagatgagtacgtggaaactttaaacaaactacgttcaaatgttactgcaattgaggaaaccgaaaaattatacgctgaagaagaaaactcttcagcataa

SEQ ID NO: 3380 - protein, 489 aa, Schizosaccharomyces pombe
MKIYPDLKQVQELAEKHKANKIPIYGVIPADMLTPSVAYLKLNQGKKYSFILESVTQGESVSRYSFIGSPYRILMANGKTDPLARLERELKEVKTAPVEGLPSFSGGAVGYVSYDCIKYFEPTTEMPLEDTLGLPEAMFFMTDDLVAFDHAYQTVKIISHVCIQQGRPIEEAYEAAVFKINMLKKKLESPEIPLPEQKKVHLGYEAKSNVGEDGYKAFVSNLKEHIFNGDIFQAVPSQRIARRTDLHPFNLYRHLRTVNPSPYMFYIHCDDFDIIGASPELLVKSEHGRIINHPIAGTVPRGKTKEEDEAYAKDLLASVKDRAEHVMLVDLARNDVSRVCDLDTTSVDKLMTIEKFSHVQHLVSQVSGVLRPDKTRFDAFRSIFPAGTVSGSPKVRAIQLVYGLEKEKRGIYAGAVGRWGYEDDNMDTCIAIRTMVYKDGTVYLQAGGGIVFDSDEQDEYVETLNKLRSNVTAIEETEKLYAEEENSSA

SEQ ID NO: 3381 - DNA, 1302 bp, Pyrococcus kodakaraensis
  CDS (1)..(1302)
atgcctctcaaaaagctgaagcccgttgaccctttgaagctctacagcgcccttagagactttgggatgccattcatgctccgctctgccgagaaggactccaggaaggccagattcacctacatatcggccgagccggagttcgtcgtggaggtcggcgaggggactgagatcgacggggagcgagtttccgacgagaggaaccccctcagagctcttaaagggctcatgggggagagggtcgagggcaggaggttcatgggtggcttcgttggctacgtctcctacgattcggtacactccatcatcggggggaagatcgaagagccctcggtcttcggctactacccctggaccttcatctacgaccactctaccggcgctctttccttcttttacctcagagaggctcctttcgaccccgaggccttagttgaaagggccaggagggaagagtcacggcttgaagacggcggttcggaggtcatatccaccgacgcgggcatggaagagttcgttgaaatcgtcagggctgggaaggagtacatctactcgggggacgtcttccaggtggttctgtcgcgcgagtacagggttagaacggatctcgatgccctcgaaatctacaagcggctcgtggagctcaacccctccccgtacaccttcatcctggagttcgagaagaccgtcgtaggggcctcacccgaaaccatgggttccgtcgaggggagaaccttcaagataaaccccatagcaggaacagcgccgaggggaaggacgggggaggaagaccgggagctggaaaaggccctactctccgacgagaaagagcgagctgagcacgtcatgctcgttgaccttgctagaaacgacgtcaggagggtttcaaagcccgggagcgttaggctaacccgcttcttcgacgtcctgaagtacagccacgtccagcacatagagagcgaggtggtcggtgaactcgatgaggggaaaaacgcgttcgacgccatggaggcggcttttccggcgggaacactaaccggagccccgaagataagggcgatggagatcatagacgagctggagaggagcaggagaaaggtctacgggggagcagtgggttacttctccctcaccggggacgccgacatggcgatagcgataaggatggccgagatcgagggcaggaaagcgagcgttagggccggggcaggaatagtggcggattcagttccagagaaggagttcttcgagaccgagaacaaaatgagagcagttctgaaggcgctgggggtgagggaatga

SEQ ID NO: 3382 - protein, 433 aa, Pyrococcus kodakaraensis
MPLKKLKPVDPLKLYSALRDFGMPFMLRSAEKDSRKARFTYISAEPEFVVEVGEGTEIDGERVSDERNPLRALKGLMGERVEGRRFMGGFVGYVSYDSVHSIIGGKIEEPSVFGYYPWTFIYDHSTGALSFFYLREAPFDPEALVERARREESRLEDGGSEVISTDAGMEEFVEIVRAGKEYIYSGDVFQVVLSREYRVRTDLDALEIYKRLVELNPSPYTFILEFEKTVVGASPETMGSVEGRTFKINPIAGTAPRGRTGEEDRELEKALLSDEKERAEHVMLVDLARNDVRRVSKPGSVRLTRFFDVLKYSHVQHIESEVVGELDEGKNAFDAMEAAFPAGTLTGAPKIRAMEIIDELERSRRKVYGGAVGYFSLTGDADMAIAIRMAEIEGRKASVRAGAGIVADSVPEKEFFETENKMRAVLKALGVRE

SEQ ID NO: 3383 - DNA, 1590 bp, Mycobacterium leprae
  CDS (1)..(1590)
atgcacgcccacctcgccgccaccacgtcacgtgaggactttcgccagctagctgtcgatcatcgggtggttccagtgacccgcaaagtcttggccgatagcgaaacgccgctatcggcataccggaagctcgccgccaatcgtccgagcaccttcctgctagagtcggccgagaacggcagatcctggtcgcagtggtcgttcattggcgtgggtgccccatcggctttgacaattcgtgacggcgaagcggtgtggctgggcactgtaccgcaggacgcgcccactggcggtgaccccctgcatgtcctgcaggccacgctcgagctacttgccaccgcggcaatgcccgggttgccaccgctatcgagtggtatggtgggcttcttcgcctacgacatggtgcggcgcctggagcgcctgcctgaactggccttaaatgatttgcagttgcccgatatgctgctgctgttggccaccgatgtagcggccgttgaccaccacgagggcacgatcaccctgattgccaacgctgtgaactggaacggtaccgatgagcgggtagatcaggcctacgacgatgcgatcgcgcgcttggacgtaatgaccgcagcactgggccagccgctgccatcgaccattgccacgttcagccggcccgaccctcggcgccgagcgcaatgcaccatcgaggaatacggtgcgatcgtcgaccacctcgtcgaccagatcgcggccggtgaggcctttcaagtggtgccctcgcagcgcttcgaggtggataccgatgtcgatccgatcgatgtctatcgcatgctgcgggtcaccaaccctagcccttacatgtatctgctgcatgtgcctaatagcgatggagcaactggcttttcgatcgttggatccagcccggaggcgttggtgaccgtcaaggacggtcgggtgacgacgcatccgatcgctggaactcgctggcgaggccagaccgaagaagaggatcagctactggaaaaagagttgctcgccgacgagaaggaacgagcagagcacttaatgcttgtcgatctcggtcgcaacgaccttggtcgggtctgtacgccaggcaccgtacgtgtcgaggattacagccacgttgaacgttacagtcacgtaatgcacatggtgtctacggtgaccgggctgctcggtgaaggccgcaccgccctggacgcggtgaccgcctgcttccctgccggcacgctgtcgggtgccccgaaggtgcggtccatggagctaatcgaggaagtggagaagacgcgccgcggcctttatggtggcgtggtcggttacctcgacttcgctggtaacgctgacttcgcgatagcaatccgtacagcgctgatgcgtgacggcatcgcgtatgtccaagccggcggtggggtagtggccgactccaacgggccctacgaatacatcgaggcgagtaacaaggctcgagcggtgttgaacgcgatcgccgccgccgagacgttgacctctttggacttcggtgttgccctcgcccctggccgcgtggcggccaggggcgaggcgggcaatcaagggaggctgtga

SEQ ID NO: 3384 - protein, 529 aa, Mycobacterium leprae
MHAHLAATTSREDFRQLAVDHRVVPVTRKVLADSETPLSAYRKLAANRPSTFLLESAENGRSWSQWSFIGVGAPSALTIRDGEAVWLGTVPQDAPTGGDPLHVLQATLELLATAAMPGLPPLSSGMVGFFAYDMVRRLERLPELALNDLQLPDMLLLLATDVAAVDHHEGTITLIANAVNWNGTDERVDQAYDDAIARLDVMTAALGQPLPSTIATFSRPDPRRRAQCTIEEYGAIVDHLVDQIAAGEAFQVVPSQRFEVDTDVDPIDVYRMLRVTNPSPYMYLLHVPNSDGATGFSIVGSSPEALVTVKDGRVTTHPIAGTRWRGQTEEEDQLLEKELLADEKERAEHLMLVDLGRNDLGRVCTPGTVRVEDYSHVERYSHVMHMVSTVTGLLGEGRTALDAVTACFPAGTLSGAPKVRSMELIEEVEKTRRGLYGGVVGYLDFAGNADFAIAIRTALMRDGIAYVQAGGGVVADSNGPYEYIEASNKARAVLNAIAAAETLTSLDFGVALAPGRVAARGEAGNQGRL

SEQ ID NO: 3385 - DNA, 1512 bp, Rhodobacter sphaeroides
  CDS (1)..(1512)
atgtcgctcgtgacctccttcgaaagcttcgagcgcggctggaaggccgggcagaaccagatcgtctatgcccggctgaccgcggatctcgacacgccggtgtcgctgatgctgaagctcgccgaggcgcgcaccgacacgttcatgctggaatcggtgacgggcggcgagatccgcggccgctattcggtcgtgggcatgaagcccgacctgatctggcagtgccacgggcaggacagccgcatcaaccgcgaggcgcgcttcgaccggcaggccttccagccgctggaaggccacccgctcgagacgctgcgggcgctgatcgccgagagccggatcgagatgccggccgacctgcccccgatcgcggcgggcctcttcggctatctcggctatgacatgatccggctggtcgagcatctgccggggatcaaccccgatccgctcggtctgcccgatgcggtgctgatgcggccctcggtcgtggcggtgctcgacggggtgaagggcgaggtcaccgtggtggcgcccgcatgggtctcgtcgggcctctcggcgcgggccgcctatgcgcaggcggccgagcgggtgatggatgcgctgcgcgatctcgaccgcgcgccgcccgcgcagcgcgacttcggcgaggtggcgcaggtgggcgagatgcgctcgaacttcacccacgagggctacaaggccgcggtcgagaaggccaaggactacatccgcgcgggcgacatcttccaggtggtgccgtcgcaacgctgggcgcaggacttccgtctgccgcccttcgcgctctaccgctccttgcgcaagacgaacccctcgcccttcatgttcttcttcaacttcggcggcttccaggttgtgggggccagccccgagatcctcgtgcggctgcgcgaccgcgaggtgacggtgcgtcccatcgccggcacccgcaagcgcggcgcgacacccgaggaggaccgcgcgctggaggccgaccttctgtccgacaagaaggaactggccgagcatctgatgctgctcgatctcgggcgaaacgacgtgggccgggtggcgaagatcggcaccgtgcgcccgaccgagaagttcatcatcgagcgctattcccacgtcatgcatatcgtctcgaacgtggtgggcgagatcgcggagggcgaggatgcgctctcggcgctgctggcgggcctgccggcgggcaccgtctcgggcgcgcccaaggtgcgggcgatggagatcatcgacgagctcgagccggaaaagcgcggcgtctatggcggcggcgtgggctatttcgcggccaacggcgagatggatttctgcattgcgctgcggaccgcggtcctgaaggacgagacgctctacatccagtcgggcggcggcgtcgtctatgacagcgaccccgaggccgaatatcaggagacggtcaacaaggccagggcgctccgccgggccgccgaggatgcgggcctcttcgcccgccgcgccgggaacggctga

SEQ ID NO: 3386 - protein, 503 aa, Rhodobacter sphaeroides
MSLVTSFESFERGWKAGQNQIVYARLTADLDTPVSLMLKLAEARTDTFMLESVTGGEIRGRYSVVGMKPDLIWQCHGQDSRINREARFDRQAFQPLEGHPLETLRALIAESRIEMPADLPPIAAGLFGYLGYDMIRLVEHLPGINPDPLGLPDAVLMRPSVVAVLDGVKGEVTVVAPAWVSSGLSARAAYAQAAERVMDALRDLDRAPPAQRDFGEVAQVGEMRSNFTHEGYKAAVEKAKDYIRAGDIFQVVPSQRWAQDFRLPPFALYRSLRKTNPSPFMFFFNFGGFQVVGASPEILVRLRDREVTVRPIAGTRKRGATPEEDRALEADLLSDKKELAEHLMLLDLGRNDVGRVAKIGTVRPTEKFIIERYSHVMHIVSNVVGEIAEGEDALSALLAGLPAGTVSGAPKVRAMEIIDELEPEKRGVYGGGVGYFAANGEMDFCIALRTAVLKDETLYIQSGGGVVYDSDPEAEYQETVNKARALRRAAEDAGLFARRAGNG

SEQ ID NO: 3387 - DNA, 1993 bp, Ruta graveolens
  CDS (94)..(1935)
aaaaaatctgtctgtttttcgtgtttggacatttcagcggcactgggtgccatcagttgattcgactcatttgatttattttgtttgttggccatgagtgcagcggcaacgtcgatgcaatcccttaaattctccaaccgtctggtcccacccagtcgccgtctgtctccggttccgaacaatgtcacctgcaataacctccccaagtctgcagctcccgtccggacagtcaaatgctgcgcttcttcctggaacagtaccatcaacggcgcggccgccacgaccaacggtgcgtccgccgccagtaacggcgcatccacgaccaccactacatatgttagtgatgcaaccagatttatcgactcttctaaaagggcaaatctagtgccattataccgttgcatattcgcggatcatctcacgccggtgcttgcctatagatgtttggttcaagaagacgataaagagactccaagttttttattcgaatcagtagagccgggtcggatttctactgttgggaggtatagtgtggttggagctcatcccgtgatggaagttatagctaaagataatatggttacggtgatggatcatgagaaagggagcttagttgaggaggtggtcgatgatcccatggagattcctagaagaatttccgaggattggaagcctcaaataatcgatgatcttcctgaagctttttgcggtggttgggttggtttcttctcatacgatacagttcgatatgtggagaagaaaaagttaccattctcaaaggcacctcaggatgataggaatcttgcagatatgcatctaggtctctataacgatgttattgtgtttgatcatgtggaaaagaaagtatatgttattcattgggtgaggctaaatcaacagtcttctgaagaaaaagcatatgccgagggtctggaacacttggagagactagtatccagagtacaggatgagaacacgccaaggctcgccccaggttccatagacttacacactggtcattttggacctccattaaaaaagtcaaacatgacatgtgaagaatacaaaatggctgtactagcggcaaaagaacatattcaggctggggatatttttcaaatcgtactaagccaacgttttgaacgtcgaacatttgctgatccatttgaagtttatagggcactgagagttgttaatccgagtccctatatgacgtatatgcaggcaagagggtgtgttctggtagcttcaagtccagaaattcttactcgagtaaagaagaataagattgtgaatcgacctttggctggaacagcccgaagagggaggactactgaagaagatgagatgttggaaacacagttgctaaaagacgcaaagcaatgtgctgagcatgttatgctggtcgatttgggacggaatgatgttggcaaggtttcaaaatctggttctgtgaaagtggaaaagctgatgaatgttgaacgatattcacatgttatgcacataagctctacggtcacaggtgagttgcaagataatctcagttgctgggatgccctgcgtgctgcactgcctgtcgggactgttagtggagcaccaaaggtgaaggcaatggagttaatcgatgaattggaggtaaatagacgtggcccctacagtggtgggtttggcggtatctccttcaccggagatatggacattgccctggctctaaggaccattgttttccaaaccggtacacgctatgacacaatgtactcgtacaagaatgctaccaaacgccggcagtgggtggcataccttcaagccggggctggcattgttgctgatagtgatccagacgacgagcatcgtgagtgccagaacaaagccgccggactggcccgtgccatcgacctagctgagtctgcttttgtgaacaaatcaagtagctaaagttttggatttggaagtggagttgagtctcggataggatttagagtaaaaaaagagg

SEQ ID NO: 3388 - protein, 613 aa, Ruta graveolens
MSAAATSMQSLKFSNRLVPPSRRLSPVPNNVTCNNLPKSAAPVRTVKCCASSWNSTINGAAATTNGASAASNGASTTTTTYVSDATRFIDSSKRANLVPLYRCIFADHLTPVLAYRCLVQEDDKETPSFLFESVEPGRISTVGRYSVVGAHPVMEVIAKDNMVTVMDHEKGSLVEEVVDDPMEIPRRISEDWKPQIIDDLPEAFCGGWVGFFSYDTVRYVEKKKLPFSKAPQDDRNLADMHLGLYNDVIVFDHVEKKVYVIHWVRLNQQSSEEKAYAEGLEHLERLVSRVQDENTPRLAPGSIDLHTGHFGPPLKKSNMTCEEYKMAVLAAKEHIQAGDIFQIVLSQRFERRTFADPFEVYRALRVVNPSPYMTYMQARGCVLVASSPEILTRVKKNKIVNRPLAGTARRGRTTEEDEMLETQLLKDAKQCAEHVMLVDLGRNDVGKVSKSGSVKVEKLMNVERYSHVMHISSTVTGELQDNLSCWDALRAALPVGTVSGAPKVKAMELIDELEVNRRGPYSGGFGGISFTGDMDIALALRTIVFQTGTRYDTMYSYKNATKRRQWVAYLQAGAGIVADSDPDDEHRECQNKAAGLARAIDLAESAFVNKSSS

SEQ ID NO: 3389 - DNA, 1983 bp, Corynebacterium glutamicum
  CDS (86)..(1963)
tcgtctaagtttttctttgagttttcatatgtagaaggcatcgtcggcttcggcctggcggtgcttttctcgttgttttgtggttatgtcagaggatgtcatgcgcgttttaattattgataattatgattctttcacgtttaatctcgccacctatgtggaagaggttacgggtcaggcacctgtggtggtgcctaatgatcaagaaatagatgagatgcttttcgacgccgtcatcctctcacctggcccgggccacgccggcgttgcggctgattttggtatctgtgcaggcgtcattgagcgtgcacgcgttccgattttgggtgtgtgtttaggccaccagggcattgcgttggcctatggcggtgatgttgatttggcgcccaggccggtccacggtgaggtttcgcagatcacccatgatggttcaggtttatttgcaggcatccctgaaacgtttgaggcggtgcgttatcactcgatggtggcaacccgcttgccggagtcattgaaagctacagctaccagcgatgatggtttgatcatggcattggcacatgaagtgcttccgcagtggggtgtgcaatttcatccggaatctattggtggacaattcggccatcagatcattaagaacttccttaatttagcgcgcacatatcgctggcaactcacggagaaaactattccgctcagcgttgattcagcagcggtttttgaaacattctttgcccattcctcccatgctttttggctcgatgatgcccaaggaaccagctatcttggtgatgccagcggtcctctcgcacgcacaaaaacccataatgtcggcgagggggatttcttcacctggctaaaggaggatctcgccgccaactcagttgcgcccggtcaaggttttcgtcttggctgggttggttacgttggttatgagcttaaagcggaagctggcgcacgggctgcgcacacttcgagtcttccggatgcgcacctcatttttgccgatcgcgccatcgcagtggaatcggatcaggttcggttgctggcgttgggggagcaggacgagtggtttgaagaaaccatcaagaagctgcataatcttgtcgccccgcggatacctgcgtccggacacctcgctttgcaggttcgagattccaaagatgagtatctcgacaaaattcgcagagcccaggagctgattactcgcggcgaatcgtatgaaatctgcctgaccacaaaacttcagggcaccactgatgtggcccctctggctgcctatctagcactgcgtggggccaatcccaccgcatatggtgcgtatcttcagctgggggatacctctattttgagttcctcgccggagcggttcatcaccattgattcggcagggtatgtggaatcaaagcccattaaaggcaccaggccgcgtgggcgaacagcgcaagaagaccaagaaatcattgctgagctgcgcagtaatcctaaagatcgtgcagaaaacttgatgatcgtggatttggtccgcaacgacttagcccgcggcgctttgcccaccacagttaaaacatccaagcttttcgacgtcgaaacctacgccacagtccaccaacttgtcagcaccgtctctgcagagttggggccacgcagtccgattgagtgcgtgcgcgcagcattccccggtggttcgatgactggtgccccaaagctgcgcaccatggagatcatcgatgagctggaggcagctcctcgcggtatttactcaggtggcttgggatatttttccctcgacggcgcagttgatctctccatggtgatcagaactctcgtcatccagaacaatcacgtggagtacggagtgggcggtgcacttcttgctctgtctgatccggaggctgagtgggaggaaatccgcgttaaatcacggcctctgctgaatttgtttggggttgaattcccatgacgtacctcgtgtgggacggt

SEQ ID NO: 3390 - protein, 625 aa, Corynebacterium glutamicum
MSEDVMRVLIIDNYDSFTFNLATYVEEVTGQAPVVVPNDQEIDEMLFDAVILSPGPGHAGVAADFGICAGVIERARVPILGVCLGHQGIALAYGGDVDLAPRPVHGEVSQITHDGSGLFAGIPETFEAVRYHSMVATRLPESLKATATSDDGLIMALAHEVLPQWGVQFHPESIGGQFGHQIIKNFLNLARTYRWQLTEKTIPLSVDSAAVFETFFAHSSHAFWLDDAQGTSYLGDASGPLARTKTHNVGEGDFFTWLKEDLAANSVAPGQGFRLGWVGYVGYELKAEAGARAAHTSSLPDAHLIFADRAIAVESDQVRLLALGEQDEWFEETIKKLHNLVAPRIPASGHLALQVRDSKDEYLDKIRRAQELITRGESYEICLTTKLQGTTDVAPLAAYLALRGANPTAYGAYLQLGDTSILSSSPERFITIDSAGYVESKPIKGTRPRGRTAQEDQEIIAELRSNPKDRAENLMIVDLVRNDLARGALPTTVKTSKLFDVETYATVHQLVSTVSAELGPRSPIECVRAAFPGGSMTGAPKLRTMEIIDELEAAPRGIYSGGLGYFSLDGAVDLSMVIRTLVIQNNHVEYGVGGALLALSDPEAEWEEIRVKSRPLLNLFGVEFP

SEQ ID NO: 3391 - DNA, 2220 bp, Streptomyces pristinaespiralis
  CDS (61)..(2220)
ggcgtcaagaacctgccgctgaccgtacggcgcggctgacacagacaagggggccacctgatgcgcaccgtgcgaaccctgctgatcgacaactacgactcgttcacctacaacctcttccagatgctggccgaggtgaacggcgccgctccgctcgtcgtccgcaacgacgacacccgcacctggcaggccctggcgccgggcgacttcgacaacgtcgtcgtctcacccggccccggccaccccgccaccgacaccgacctgggcctcagccgccgggtgatcaccgaatgggacctgccgctgctcggggtgtgcctgggccaccaggccctgtgcctgctcgccggcgccgccgtcgtccacgcacccgaaccctttcacggccgcaccagcgacatccgccacgacgggcagggcctgttcgcgaacatcccctccccgctgaccgtggtccgctaccactcgctgaccgtccggcaactgcccgccgacctgcgcgccaccgcccacaccgccgacgggcagctgatggccgtcgcccaccgccacctgccccgcttcggcgtgcagttccaccccgaatcgatcagcagcgaacacggccaccggatgctcgccaacttccgcgacctgtccctgcgcgcggccggccaccgccccccgcacaccgaacgcatacccgcacccgcacccgcccccgcccccgcccccgcaccggcaccgcccgcgtccgcgccggtgggggagtaccggctgcatgtgcgcgaggtcgcctgcgtgcccgacgcggacgccgcgttcaccgccctgttcgccgacgccccggcccggttctggctcgacagcagccgcgtcgagccgggcctcgcccgcttcaccttcctcggcgcccccgccggcccgctcggcgaacagatcacctacgacgtcgccgaccgggccgtgcgcgtcaaggacggttcaggcggcgagacccgccggcccggcaccctcttcgaccacctggaacacgaactggccgcccgcgccctgcccgccaccggcctgcccttcgagttcaacctcggctacgtcggctacctcggctacgagaccaaggccgacagcggcggcgaggacgcccaccgcggcgaactgcccgacggcgccttcatgttcgccgaccggatgctcgccctcgaccacgaacaggggcgggcctggctcctggcactgagcagcacccgacggcccgccaccgcacccgccgccgaacgctggctcaccgacgccgcccggaccctcgccaccaccgccccccgcccgcccttcaccctgctgcccgacgaccaactgcccgccctggacgtccactaccgccacagcctgccccgctaccgggaactggtcgaggaatgccgccgcctgatcaccgacggcgagacctacgaggtgtgcctgacgaacatgctccgggtgcccggccggatcgacccgctcaccgcctaccgcgccctgcgcaccgtcagccccgccccctacgccgcctacctgcagttccccggggccaccgtgctcagctcctcacccgaacggttcctgcgcatcggcgcggacggttgggcggagtccaaacccatcaagggcacccgcccccgcggcgccggccccgcccaggacgccgccgtcaaggcctccctcgccgcggccgagaaggaccgcagcgagaacctgatgatcgtcgacctggtccgcaacgacctcggccaggtctgcgacatcggctccgtccacgtaccgggcctgttcgaggtggagacctacgccaccgtccaccagctcgtcagcacggtccgcggccgcctggcggccgacgtctcccgcccccgcgcggtacgggccgccttccccggcgggtcgatgaccggcgcgcccaaggtccgcaccatgcagttcatcgaccggctcgagaagggcccgcgcggcgtgtactcgggcgcgctgggctacttcgccctcagcggcgcggccgacctcagcatcgtcatccgcaccatcgtcgccaccgaggaggccgccaccatcggcgtgggcggcgccgtcgtcgccctgtccgaccccgacgacgaggtccgcgaaatgctcctcaaggcgcagaccaccctcgccgccctgcgccaggcacacgcgggcgccaccgcctcggaccgtgaactcctggccggcagcctgcggtga

SEQ ID NO: 3392 - protein, 719 aa, Streptomyces pristinaespiralis
MRTVRTLLIDNYDSFTYNLFQMLAEVNGAAPLVVRNDDTRTWQALAPGDFDNVVVSPGPGHPATDTDLGLSRRVITEWDLPLLGVCLGHQALCLLAGAAVVHAPEPFHGRTSDIRHDGQGLFANIPSPLTVVRYHSLTVRQLPADLRATAHTADGQLMAVAHRHLPRFGVQFHPESISSEHGHRMLANFRDLSLRAAGHRPPHTERIPAPAPAPAPAPAPAPPASAPVGEYRLHVREVACVPDADAAFTALFADAPARFWLDSSRVEPGLARFTFLGAPAGPLGEQITYDVADRAVRVKDGSGGETRRPGTLFDHLEHELAARALPATGLPFEFNLGYVGYLGYETKADSGGEDAHRGELPDGAFMFADRMLALDHEQGRAWLLALSSTRRPATAPAAERWLTDAARTLATTAPRPPFTLLPDDQLPALDVHYRHSLPRYRELVEECRRLITDGETYEVCLTNMLRVPGRIDPLTAYRALRTVSPAPYAAYLQFPGATVLSSSPERFLRIGADGWAESKPIKGTRPRGAGPAQDAAVKASLAAAEKDRSENLMIVDLVRNDLGQVCDIGSVHVPGLFEVETYATVHQLVSTVRGRLAADVSRPRAVRAAFPGGSMTGAPKVRTMQFIDRLEKGPRGVYSGALGYFALSGAADLSIVIRTIVATEEAATIGVGGAVVALSDPDDEVREMLLKAQTTLAALRQAHAGATASDRELLAGSLR

SEQ ID NO: 3393 - DNA, 2051 bp, Ruta graveolens
  CDS (43)..(1869)
ggcacactcaagtgccgtctcttctttattcagggaaccaaaatgattactctcaacgtggaaaccccacccctcacccgctctcagcttccgtcaactttccgtgtctcctccgccgcctccgttaactttaacgacagggttgctacctcgagatggcgccccaactccctctccctcaccacctccagctatcgtctccgcactcttaaatgcgccgcctccgcctccacctccgcctccacctccgcctcgccctctccctctccctcattggtcgaccagtcagcaaattttcacgaagcttcgaagaaggggaatttaattcctctataccggtgcatattctcggaccacttgactccagttcttgcgtacaggtgtttggttaaggaagatgatagagatgctccaagctttctgtttgagtcagttgagcctggttcacaagcttccagtattggaaggtatagtgttgttggagctcagccagccatagaaattgtggcaaaggagaacatggttacaattttggaccatgagggtgggcagagaacagagcaatttgtggaggatccaatggatgttcctaggagaatcatggagggatggaaaccccaacttattgatgaacttccagaagcattttgtggtggatgggttggttacttctcatatgacactgtccgctatgttgagaaaaaaaagctgcccttcttttctgccccaactgatgatagaaaccttcctgatgttcatctcggcctctatgacgatgtgatcgtgtttgatcacgtggagaagaaagcatttgttattcattgggtgcgattagatcaatattcttctgtggcggaggcatacaatgacggaatgaaccggttggaaaacctagtatctagagtgcatgatatagttccaccaaagctccgttcaggatcaataaagttacacactcgtcattttggtcctaaactggagaggtcaagcatgacaagtgaagcatacaaggaggcagtactggaggccaaggagcatatccttgctggtgacatattccagatcgtactaagtcagcgttttgaaaggcgaacgttcgcagacccatttgaaatctatagatcactgaggattgttaatccaagcccatatatgacttatttacaagctagaggatgtatattggttgcttctagtccagaaattcttacacgcgtgaagaagagaaagattactaatcgaccccttgctggcactattagaagagggaagacacgtaaggaagatttggtgtttgaaaaggagcttttgaatgatgagaagcaatgtgcggagcacattatgcttgttgacttggggaggaatgatgttggaaaggtctcagaacctggctctgtgaaggttgaaaagctcatgaatattgaacattattctcatgttatgcacattagctcaacagttactggagagttgcttgatcatttaactagctgggatgctttacgtgcagcactacctgttgggaccgtcagcggagcacccaaggtgaaagccatggagataattgataagctggaagtcacaaggcgtggcccatatggtggtggatttggaggcatttcatttactggtgatctggacattgcccttgctctcagaactatggtattccaaactgctacacgctatgacactatgtactcgtacaaagatgtggacaagagacgggaatggatcgctcatctccaagctggggctggaatcgtggccgacagtgatcctgctgatgagcagagagagtgtgagaacaaagctgcagctcttgctcgtgccattgatcttgcagaatcctcgttcattgagaaatgattaatagttttgccatatggagtgtctcggtcttcttgacattgcttcccttggtcacaagtgctagatttcttgccacgtggagaagaaacaaagcaccaatgtgatgataacttttcttggtgagtgtcaaccgtgactgaaatgttaaagaatgaaacagtttcttttcccgtttttgc

SEQ ID NO: 3394 - protein, 608 aa, Ruta graveolens
MITLNVETPPLTRSQLPSTFRVSSAASVNFNDRVATSRWRPNSLSLTTSSYRLRTLKCAASASTSASTSASPSPSPSLVDQSANFHEASKKGNLIPLYRCIFSDHLTPVLAYRCLVKEDDRDAPSFLFESVEPGSQASSIGRYSVVGAQPAIEIVAKENMVTILDHEGGQRTEQFVEDPMDVPRRIMEGWKPQLIDELPEAFCGGWVGYFSYDTVRYVEKKKLPFFSAPTDDRNLPDVHLGLYDDVIVFDHVEKKAFVIHWVRLDQYSSVAEAYNDGMNRLENLVSRVHDIVPPKLRSGSIKLHTRHFGPKLERSSMTSEAYKEAVLEAKEHILAGDIFQIVLSQRFERRTFADPFEIYRSLRIVNPSPYMTYLQARGCILVASSPEILTRVKKRKITNRPLAGTIRRGKTRKEDLVFEKELLNDEKQCAEHIMLVDLGRNDVGKVSEPGSVKVEKLMNIEHYSHVMHISSTVTGELLDHLTSWDALRAALPVGTVSGAPKVKAMEIIDKLEVTRRGPYGGGFGGISFTGDLDIALALRTMVFQTATRYDTMYSYKDVDKRREWIAHLQAGAGIVADSDPADEQRECENKAAALARAIDLAESSFIEK

SEQ ID NO: 3395 - DNA, 2660 bp, Streptomyces venezuelae
  CDS (651)..(2660)
ggatccgccgaggtcgtcgccctgcccttcctcggcgaacacggcgacctgcgcatccgcagcaagaccggatggctgatccgcttcggggagcgctccgtgctgttcgccgccgactccaccaacatctccccgacgatgtacaccaaggtggccgaggtgatcggccccgtcgacaccgtcttcatcggcatggagagcatcggcgcggcggccagctggatctacggtccgctctacggcgagccgctcgaccgcaggaccgaccagagccgacggctcaacggctccaacttcccccaggcgagggagatcgtcgacgccctggagcccgacgaggtctatgtgtacgcgatgggcctcgaaccctggatgggcgtcgtgatggccgtcgactacgacgagagccaccccgccatcgtcgacagcgacctcctcgtccggcacgtccaggacaagggcgggaccgccgaacggctgcacctccggcggacgctgcgcctctgagcgacgcgacgcccgcggccggggcgcggcgatccgccgcccccggcccccggcccctccggcacggcccctccggcccgtccccgtggcccgccgccgcccccgcgccctccggcgagcccttcgagacaaggtgccccatcatgcgcacgcttctgatcgacaactacgactcgttcacccagaacctgttccagtacatcggcgaggccaccgggcagccccccgtcgtgcccaacgacgccgactggtcgcggctgcccctcgaggacttcgacgcgatcgtcgtgtccccgggccccggcagccccgaccgggaacgggacttcgggatcagccgccgggcgatcaccgacagcggcctgcccgtcctcggcgtctgcctcggccaccagggcatcgcccagctctcggcggaacccatgcacggccgggtctccgaggtgcggcacaccggcgaggacgtcttccggggcctcccctcgccgttcaccgccgtgcgctaccactccctggccgccaccgacctccccgacgagctcgaacccctcgcctggagcgacgacggcgtcgtcatgggcctgcggcaccgcgagaagccgctgatgggcgtccagttcccaccggagtccatcggcagcgacttcggccgggagatcatggccaacttccgcgacctcgccctcgcccaccaccgggcacgtcgcgacgcggccgactggggctacgaactccacgtgcgccgcgtcgacgtgctgccggacgccgaagaggtacgccgcgctgcctgcccggccgagggcgccacgttctggctggacagcagctccgtcctcgaaggcgcctcgccgttctccttcctcggcgacgaccgcggcccgctcgccgagtacctcacctaccgcgtcgccgacggcgtcgtctccgtccgcggctccgacggcaccacgacccgggacgcggcgaccctcttcagctacctggaggagcagctcgaaccgccggcgggtcccgtcgcccccgacctgcccttcgagttcaacctcggctacgtcggctacctcggctacgagctgaaggcggagaccaccggcgaccccgcagtaccggccccgcaccccgacgccgcgttcctcttcgccgaccgcgccatcgccctcgaccaccaggaaggctgctgctacctgctggccctcgaccgccggggccacgacgacggcgcccgcgcctggctgcgggagacggccgagaccctcaccggcctggccgtccgcgtccggccgaggccgacccccgccatggtcttcggggtccccgaggcggcggccggcttcggccccctggctcgcgcacgccacgacaaggacgcctcggcgctccgcaacggcgagtcgtacgagatctgcctgaccaacatggtcaccgcgccgaccgaggcgacggccctgccgctctactccgcgctgcgccgcatcagccccgtcccgtctggcgccctgctcgagttccccgagctgtcggtgctcagcgcctcgcccgagcggttcctcacgatcggcgccgacggcggcgtcgagtccaagcccatcaaggggacccgcccccggggcgcaccggcggaggaggacgagcggctccgcgccgacctggccggccgggagaaggaccgggccgagaacctgatgatcgtcgacctggtccgcaacgacctcaacagcgtctgcgcgatcggctccgtccacgtgccccggctcttcgaggtgggagacctcgcgcccgtgcaccagctggtgtcgaccatccggggacggctgcggcccggcaccagcaccgccgcctgcgtacgcgccgccttccccggcggctccatgaccggcgcgcccaagaagcgacccatggagatcatcgaccgcctggaggaaggcccccggggcgtcttacccggggcgctcggatggttcgccctcagcggcgccgccgacctcagcatcgtcatccgcaccatcgtgctggccgacggccgggccgagttcggcgtcggcggggcgatcgtgtccctctccgaccaggaggaggagttcaggcagaccgtggtcaaggcccgcgccatggtcaccgccctcgacggcagcgcagtggcgggcgcccgatga

SEQ ID NO: 3396 - protein, 669 aa, Streptomyces venezuelae
MRTLLIDNYDSFTQNLFQYIGEATGQPPVVPNDADWSRLPLEDFDAIVVSPGPGSPDRERDFGISRRAITDSGLPVLGVCLGHQGIAQLSAEPMHGRVSEVRHTGEDVFRGLPSPFTAVRYHSLAATDLPDELEPLAWSDDGVVMGLRHREKPLMGVQFPPESIGSDFGREIMANFRDLALAHHRARRDAADWGYELHVRRVDVLPDAEEVRRAACPAEGATFWLDSSSVLEGASPFSFLGDDRGPLAEYLTYRVADGVVSVRGSDGTTTRDAATLFSYLEEQLEPPAGPVAPDLPFEFNLGYVGYLGYELKAETTGDPAVPAPHPDAAFLFADRAIALDHQEGCCYLLALDRRGHDDGARAWLRETAETLTGLAVRVRPRPTPAMVFGVPEAAAGFGPLARARHDKDASALRNGESYEICLTNMVTAPTEATALPLYSALRRISPVPSGALLEFPELSVLSASPERFLTIGADGGVESKPIKGTRPRGAPAEEDERLRADLAGREKDRAENLMIVDLVRNDLNSVCAIGSVHVPRLFEVGDLAPVHQLVSTIRGRLRPGTSTAACVRAAFPGGSMTGAPKKRPMEIIDRLEEGPRGVLPGALGWFALSGAADLSIVIRTIVLADGRAEFGVGGAIVSLSDQEEEFRQTVVKARAMVTALDGSAVAGAR

SEQ ID NO: 3397 - DNA, 1518 bp, Symbiobacterium thermophilum
  CDS (1)..(1518)
atgtaccaccccagcctggggacctacctgagcctggccagggagtacgacctggtccccgtccaccgggaggtcctggcggacctggagacgccgatctcggtcttcatgaagctctgcctcgacgagccgtgcgccttcctgttcgaatccgtggaaggcggggagaaggtggcccgctactccttcctcggctgccggccgctcctcaccctggcccacaaggcgggcgtgagccggctgctccggggcgaggaggccgcggagtaccgcacggtgggcatggtgaccgagggcgaacggggcgagcggatggagggcgacccgctgggccacctgcggcaggtgctgcgccgctatgccgtgtatcagcccccggggctgccccggttcgcgggcgggctggtgggctacgtggcctacgacgccgtccgggcgtacgagcgcctgccgccggggccgccggacgagctgaatctgcccgattcgctgttcatggcgccggagctggtggtggtgttcgaccacctgaagcacaagctgctgctcgtcgccaacaccatgccgggcggcgagcccgacgtggcctaccgccgggcgcaggccctcctggaccgggcggtcgagcggctgcggggtccggtgcccctgccgccgggactcccgtggacccggtcccgccccctggaggtgcgggcctgccagacgccggaggacttcacggcggcggtcgagcgggccaaggcctacatccgggcgggcgacgctttccaggtggtgctctcgcagcggtgggagacccgggtgcgcagccggccgctggacatctaccgggcgctgcgcatgctcaacccgagcccctacatgttctacctgagcttcggcgacctgaaggtgatcggcgcctcgccggagctgctggtgcgggtggaggacggcgtggccaccacccggccgctggcggggacccggccccggggcgccaccgaggaggaggaccggcggctggaggcggagctgctcgccgacgaaaaggagcgggccgagcacgtgatgctggtcgacctgggccgcaacgacctgggccgggtctgtaactacgggacggtgcacgtgcaccagctcatgcacgtggagcggtactcccacgtgatgcacatcgtcagcgacatccggggcgaggtggccgaggagaaggacgcctgcgacgtgctggccgcctgtttcccggccgggaccctcaccggggcgccgaaggtgcgggcgatggagatcatcgacgagctggaaccggtgcgcaggggcatctacggtggggccgtgggctacttctcctggagcggcgccatggacacctgcatcgccatccggaccctgatcatgaagggcgaccgggtcttcatccaggccggggccggcatcgtggccgactcggacgcggaagcggagctgaacgagtcccggaacaaggcccgggcgctgatccgggccctggagctggcggaggaggggctgtga

SEQ ID NO: 3398 - protein, 505 aa, Symbiobacterium thermophilum
MYHPSLGTYLSLAREYDLVPVHREVLADLETPISVFMKLCLDEPCAFLFESVEGGEKVARYSFLGCRPLLTLAHKAGVSRLLRGEEAAEYRTVGMVTEGERGERMEGDPLGHLRQVLRRYAVYQPPGLPRFAGGLVGYVAYDAVRAYERLPPGPPDELNLPDSLFMAPELVVVFDHLKHKLLLVANTMPGGEPDVAYRRAQALLDRAVERLRGPVPLPPGLPWTRSRPLEVRACQTPEDFTAAVERAKAYIRAGDAFQVVLSQRWETRVRSRPLDIYRALRMLNPSPYMFYLSFGDLKVIGASPELLVRVEDGVATTRPLAGTRPRGATEEEDRRLEAELLADEKERAEHVMLVDLGRNDLGRVCNYGTVHVHQLMHVERYSHVMHIVSDIRGEVAEEKDACDVLAACFPAGTLTGAPKVRAMEIIDELEPVRRGIYGGAVGYFSWSGAMDTCIAIRTLIMKGDRVFIQAGAGIVADSDAEAELNESRNKARALIRALELAEEGL

SEQ ID NO: 3399 - DNA, 1476 bp, Symbiobacterium thermophilum
  CDS (1)..(1476)
atggcgacggctgagtccgtccgccgcctgccccttccgccctgggagcccgcggacctggccgcggccctgggctccgggccggtggcgctgctggacggcatcacctgggaaggccgcagggtggccctggtggcctgggccccggaggcccgcgcccgcacggtggcggaggcggctgcggcggcggacaggacccccctgccgccgcaggccccgccgctgctggctgcggcggtgggccggctggactgggacggaaccggtcgcttctgggtaccgggctcggccgcgctgttcgaccgggaggcgggcgagctctgggtgcgggggcgcctgcccgccgtccccggccgcggctgcccgccggtgcgaagcggcgcctgcgcaggtgagggcggcgctgacgcaagcgagagcagtaccaacgcaggcgagagcggcggcaccgcgggtaagagcggcggcaacacgggcgagaacggcgccaacgtgcgcaagagcggcgccgacgcaaggaagagtggcgccgacgaaggcgaggtcggtcttgccgccggccagggcggctccggaagacccggcgagcgggcatcggcacatgcgcccccgcaccgggccgtgccgctgtggccgtacccggcgtacgcggccgcggtgcgggaggcgctgacggccatggccgaaggccggctgaccaaggtgatcctctcggtgcccttcgccgccccctgccccctgccccccgcggccatctaccgcccgctgactgccggcagcccgcccgggctggggttcctcctacgggtcggcgcgggtggcgagaccctggtgggcatctcccccgagccgctggtctttctggaagccggccgcgcccacatgcacctgctggccggcacccggcccgccgagcgcgcgtcggaactcgccgccagcccgaaggaccgggaggagcatgcggtggccgtggaacaggcccgccgggacctggaggcggtctgcctaccggggagcgtcgcggtggaagccttcatggagctggagcgccacccgggcctggtccacctggcgtcacggctgtcggggacgctccggcccgacctgggccccggcgatctggtcgccgcctgcttcccggccggcacggtgggcgggattccccgggaggcggcccgggcgctgatcgatcggttggaacctgtgccgcggggctggtacgccggcgccgtgggcgcggtactgcccggcggcggactgcagctctggctcaccatccgctcgctggccctgcgggacggcaccgtcctggtccgggccggcgccggtctggtgccgggcagcgaccccgcggccgaatggcgggagtgcatggccaaggcggaacgggccctggccgcggccggcgccgcgctgcccccggcggaggagctgatgcggggcgaggacgccgtccgaggaggtgacccaacgtga

SEQ ID NO: 3400 - protein, 491 aa, Symbiobacterium thermophilum
MATAESVRRLPLPPWEPADLAAALGSGPVALLDGITWEGRRVALVAWAPEARARTVAEAAAAADRTPLPPQAPPLLAAAVGRLDWDGTGRFWVPGSAALFDREAGELWVRGRLPAVPGRGCPPVRSGACAGEGGADASESSTNAGESGGTAGKSGGNTGENGANVRKSGADARKSGADEGEVGLAAGQGGSGRPGERASAHAPPHRAVPLWPYPAYAAAVREALTAMAEGRLTKVILSVPFAAPCPLPPAAIYRPLTAGSPPGLGFLLRVGAGGETLVGISPEPLVFLEAGRAHMHLLAGTRPAERASELAASPKDREEHAVAVEQARRDLEAVCLPGSVAVEAFMELERHPGLVHLASRLSGTLRPDLGPGDLVAACFPAGTVGGIPREAARALIDRLEPVPRGWYAGAVGAVLPGGGLQLWLTIRSLALRDGTVLVRAGAGLVPGSDPAAEWRECMAKAERALAAAGAALPPAEELMRGEDAVRGGDPT

SEQ ID NO: 3401 - DNA, 2088 bp, Propionibacterium acnes
  CDS (1)..(2088)
atgatcctgctggttgacaaccacgattccttcaccttcaacctggcacacctattggccgaagtcagcgggatcgagccagtggtggtccgccccgaggaggtcgagcgtgcagggatcctccgccgattggctgatggcgaattcgaccacgtggttatcggtccaggacctggctccccgcacaacgacaaggacttcaagaccgccggacaggtgatcgatgcctccaacaagctccccctgctcggggtgtgcctgggccaccaaggcctcgggttacgtcacggtgcccagttgcagaccattcggccccatcacggcatcgtcagccgaattcatcactccaggcgtggaatcttcgccggattaccgcaagatttcgaggcaactcggtatcactcactgtgcttgaccacgttgggtgaccagatcgtcgaacatgctcgcgccgaggatggcgccatcatggcgttcgaggttgccgaccggccacactggggcgtgcaattccacccagagtcagtcatgacgcaggtcggatgtcagttaatgacgaacttcctggcgatcggcagccagccacgacacagcgaggtacgcgacaaacgcgaaccgcgcaacatccagtcacgaaagtgtgcccggactacggcacggtggacaatccaccaccaaacggtggacatcgacctcgacgaagaagccaccttcagccgcctcgctggcgacggtgacgccttctggttggactcggccaccacgcgtggcgacaccggccgttggagtgtcatgggcacggcgtcgggggcggcatccgaactggtcagttacgacgtcatcacaaacacgttgacggtcaacgggcgaacccagtctggtgatgtgctggacttcttggaacgccgtcttgcagatggagtatcacggagggacccggaactagatgacatcccattcacaggtggctatgtcggtttcctgggctatgagtgcaaggcgctgaccttgggcccgaatgcgcactgcagcgaactgcccgatgccatgtggatgcgtccggccagctggattgcgtacgaccactaccggcatcacgctcacctcctagccttggacgaccgtgacacgcccggctgcaatgaggccgctgatctattggacgcactggctgcgacgctggtgaagcgaccaggtagcagcgaagagcccgcaccgctaaccgtgcctgtggaagggtcgtggcggctcagccgagggggctaccaggaccgtgttgccgcaatccagcaggcgctaacgcgcggtgactcgtacgaggcctgtctgaccgacacgtggacctcccggtgcgacgtggacggctggcggttgtaccgcgcactgcggcgtcgaaacccagccccctatggggcgtatcttcggtttaccgacccgcgtgtggaggtgtgctcttcatccccggaacggttcctgcgagtacgcgacggcatcgctgaatccaagccgatcaaggggacaatggctcgctgtgatgatccggtggaggatgcccggggaattgtcgatttacaacatgacgcgaaaaaccgcgccgagaatctcatgatcgctgatctggtgcgcaacgacctgtcgcgcgtgtgccaaccaggcacggtggaggtaccacgtctgatggcgatcgagtcatatgcgacggtgcaccagatggtgaccacggtgcgcggacgattgcgtgaggacgtcggattggtcgacgtactgcgagcgaccttccctggtggatcgatgaccggggcaccgaaggaacggtccgtagaaatcctggacggtctggaggtcggcgcccggggaatctactcgggaatcctgggatatctcggcttcgatcgcaccgccgacctcagcatcgtgatacggacggtgatccgaacggggtcgcaggtaacggtcggtgccggcggcgcaatcgtcgcagcttcccagcctgacgaggagtggcgcgagaagaacctcaaagcggcggcaccgttggctgcgctgacgctgtcagccgggccaggaattcccgtcactcccccatag

SEQ ID NO: 3402 - protein, 695 aa, Propionibacterium acnes
MILLVDNHDSFTFNLAHLLAEVSGIEPVVVRPEEVERAGILRRLADGEFDHVVIGPGPGSPHNDKDFKTAGQVIDASNKLPLLGVCLGHQGLGLRHGAQLQTIRPHHGIVSRIHHSRRGIFAGLPQDFEATRYHSLCLTTLGDQIVEHARAEDGAIMAFEVADRPHWGVQFHPESVMTQVGCQLMTNFLAIGSQPRHSEVRDKREPRNIQSRKCARTTARWTIHHQTVDIDLDEEATFSRLAGDGDAFWLDSATTRGDTGRWSVMGTASGAASELVSYDVITNTLTVNGRTQSGDVLDFLERRLADGVSRRDPELDDIPFTGGYVGFLGYECKALTLGPNAHCSELPDAMWMRPASWIAYDHYRHHAHLLALDDRDTPGCNEAADLLDALAATLVKRPGSSEEPAPLTVPVEGSWRLSRGGYQDRVAAIQQALTRGDSYEACLTDTWTSRCDVDGWRLYRALRRRNPAPYGAYLRFTDPRVEVCSSSPERFLRVRDGIAESKPIKGTMARCDDPVEDARGIVDLQHDAKNRAENLMIADLVRNDLSRVCQPGTVEVPRLMAIESYATVHQMVTTVRGRLREDVGLVDVLRATFPGGSMTGAPKERSVEILDGLEVGARGIYSGILGYLGFDRTADLSIVIRTVIRTGSQVTVGAGGAIVAASQPDEEWREKNLKAAAPLAALTLSAGPGIPVTPP

SEQ ID NO: 3403 - DNA, 1458 bp, Leifsonia xyli
  CDS (1)..(1458)
atgctcctcccaccccgtgtgcaccacctcaacgcccccgtcgacccagccgacgccttcgcagcgctttaccccgcaggcgatgccgtctggctcgattcgggcccggacgccgcagcgggcatgagcgtcatcggcaccgggacgcgcgtcgcgacggcgtccgtggcggacgggacggtgaccgtcgacggggagacccgcaccggcagcatcgtcgaggtgctgcgggcgaccggtcgcgcggacaccgcaggctacccgctcggctggatcggctggctcggctatgaggcgggcgcggcggatctcgggcttccgcacgcgccgggcgagggacaggacgcggcgttcgtctgggcggaccggctgatcgtgttcgatcacgacaccgggcgggtgacgctcgtggacgctcgcgacggcggggcggaccctgagccagcaggcggcgaatcatcggcgggaggagcgtcggactccgcaccggcctcctccgctcctccctggctccgcgcgaccgccgccgccctcaccgctccggccgccgccggctcggccgcgcggcacctcgcggcccacccgctgcccggcccgcgcgcccaagccggctggcggtatggaccggcggcctaccgcgccctcctcgacgcctgtcagtccgccatccacgccggggatgcctaccagctctgcctgacgaacaccgcaaccgcccagacgtccgccgacccgcttgccgtccacctgcggctgcgccgggaaagccccgcaccccacgcaggtttcctccgtattggcggcgaaaccctcgtcagctcgtcgcccgagcagtttctccgggtcgagcccgatggacgggtgcgaaccaagccgatcaagggcacccggccgcgcggaacgacgcccgccgaggaccgccgcctgcgagccgagctcgaagccagcgagaaggagcgtgccgagaatgtcatgatcgtggatctcatgcggaacgatctcgctcgggtgtgcgagaccggttcggtggaggtgcggcaccttctcgccgtcgagtcgtacgcccaggtccaccagctcgtcagcacggtcgagggacgcctccgcgacggccagggcgtgctggacgctctggccgcctgtttccccgccggctcgatgaccggtgcgccgaaactgagcgccatgcgcatcctgaaccgtctcgagcagggtccgcgcggtgtctacgcggggtgtttcggcgccctcgcggccgacggttcggccgacctcgcgatggtgatccgcagtgtccagttccgcggctccgtcgccaccatcggctccggtggcgggatcaccgcgctttcggtgcccgacgaagagctcgcggaggtcggcgtgaaggcggcggcgctcttgcgtgcggctggcctggacggcgccgggaacggacaggacctgccgaacgtttag

SEQ ID NO: 3404 - protein, 485 aa, Leifsonia xyli
MLLPPRVHHLNAPVDPADAFAALYPAGDAVWLDSGPDAAAGMSVIGTGTRVATASVADGTVTVDGETRTGSIVEVLRATGRADTAGYPLGWIGWLGYEAGAADLGLPHAPGEGQDAAFVWADRLIVFDHDTGRVTLVDARDGGADPEPAGGESSAGGASDSAPASSAPPWLRATAAALTAPAAAGSAARHLAAHPLPGPRAQAGWRYGPAAYRALLDACQSAIHAGDAYQLCLTNTATAQTSADPLAVHLRLRRESPAPHAGFLRIGGETLVSSSPEQFLRVEPDGRVRTKPIKGTRPRGTTPAEDRRLRAELEASEKERAENVMIVDLMRNDLARVCETGSVEVRHLLAVESYAQVHQLVSTVEGRLRDGQGVLDALAACFPAGSMTGAPKLSAMRILNRLEQGPRGVYAGCFGALAADGSADLAMVIRSVQFRGSVATIGSGGGITALSVPDEELAEVGVKAAALLRAAGLDGAGNGQDLPNV
